United States Patent 11,981,905 (POLYNUCLEOTIDE SEQUENCES AND PROTEINS ENCODED THEREBY USEFUL FOR MODIFYING PLANT CHARACTERISTICS) - sequence listing, part 3

SEQ ID NO: 5009 - DNA, 1926 bp, Panicum virgatum
  misc_feature: Ceres CLONE 1813891
  misc_feature: Encodes the peptide sequence at SEQ ID NO. 5010
gtgttgtgctcccgcgagcttcctcgtgccacgggagggccgctgctgccgttccgtccaccggtggattatccgacagaacaactatcttggagatctaagcctaaagatttgaagtctggaagtttctgttgaagagtacatagaaatatttcctgatttttttgaggaagactacagagcttctaaatgtgaaacttgcctctttttattggttactcctggatggtgttgaacttggcttctcacgttacttgaagctcaaggtcatactagcatgagcacttcaaggatggaacaagcaacaggtgtaagtggccctgaacacataattgatattccgagggacactggttcttccgcttcggtttctcgcggtgtcgatagagagaaccatgaagaactgaattctgcagacaggccttcaactagagctctagtacctgccttgcaggcaccatcagcaataggtgctgtacctagtacaggacagacttcaggcacaaggagaagtgataactatgttcgccggcacagaagccctttgaattctggactgtggatttcaattgaagttattgtcaacgtgagccagattgtagctgccatagttgttctctgcctgtcaagaaaggagcatccacaagctccattacttgagtgggtcataggttatacagttggttgttttgcaacgttaccccatctctattggcgttatatacatcgtaatattgtaaatggtgagcatgagccagcacacgctccacaaggatcctctcataacaactcaactgaagccactcatgcagcaagtgcatcagagcgtcgtaggaatgctgcacgaaatgcggtgctcgctaatcccaggattaatgcactgtttgaccacttcaagatggccctggattgtttctttgctgtatggtttgttgttggaaatgtgtggatattcggtggacgttcttctgctgctgatgctccaaacttgtacaggttatgtattgtgttcctcacttttagttgcattgggtatgccatgccgttcatcctctgcgcgatgatatgctgctgccttccctgcattatatctgttatgggttttagagaagatacaaacaacacaaggggggctacttcggaatctattaatgctttgcctacatataaattcaaaaccaagaaacgccgccatggttcaggaagtgaaactgaaggccaagaaggtggggtagtggctgcggggactgagaaggagcgatcactttctgctgaagatgctgtttgttgcatctgtcttgccaagtatgcacacaatgatgagcttcgtgaactcccatgctcgcattgtttccacaaggattgtgttgataaatggctcaagataaatgcactttgccctttgtgcaaatctgagatagcgagctcatccagcacttctgatacacgtcaatcggaccagaatgctattccggtgcaggagattgaaatgcattaggttggtctgctctccctccttattacacaagaataccgctgtttggggttccctggcttgatgtataaagctggagattgatgtatggattgtagtgactcctagggttcgttttatcattgttatcttggagatgttacagctcttctcgctgtcacccaacaatgccaagccaatactacccaggtttccatcagcgtggattgtgccttgtgttctgttttggatgacactggatggctatttcgtagcccaaaagaggcgggccaggtccaggtacatagatgatccgttaacagcgtgatcctagtcaactttgcagtattttcattctgtgaaactgaagtttacgatattcagttgatgactataaaaatctggtaaacatgttccacttgttatctccgtaaaaaaaaaaaaaaaaaaaa

SEQ ID NO: 5010 - protein, 406 aa, Panicum virgatum
  misc_feature: Ceres CLONE 1813891
  misc_feature (1)..(41): Pfam Name: zf-C3HC4 Pfam Description: Zinc finger, C3HC4 type (RING finger)
  misc_feature: The sequence is a functional homolog of  SEQ ID NO 178 in the  10/666,642 US patent application
  misc_feature: The sequence is a functional homolog of  SEQ ID NO 404 in the  10/666,642 US patent application
  misc_feature: Useful for making plants with modulated growth and phenotype characteristics
MSTSRMEQATGVSGPEHIIDIPRDTGSSASVSRGVDRENHEELNSADRPSTRALVPALQAPSAIGAVPSTGQTSGTRRSDNYVRRHRSPLNSGLWISIEVIVNVSQIVAAIVVLCLSRKEHPQAPLLEWVIGYTVGCFATLPHLYWRYIHRNIVNGEHEPAHAPQGSSHNNSTEATHAASASERRRNAARNAVLANPRINALFDHFKMALDCFFAVWFVVGNVWIFGGRSSAADAPNLYRLCIVFLTFSCIGYAMPFILCAMICCCLPCIISVMGFREDTNNTRGATSESINALPTYKFKTKKRRHGSGSETEGQEGGVVAAGTEKERSLSAEDAVCCICLAKYAHNDELRELPCSHCFHKDCVDKWLKINALCPLCKSEIASSSSTSDTRQSDQNAIPVQEIEMH

SEQ ID NO: 5011 - DNA, 2225 bp, Panicum virgatum
  misc_feature: Ceres CLONE 1813917
  misc_feature: Encodes the peptide sequence at SEQ ID NO. 5012
actagctacttaccatctctatatatctacaaatctaacagcaacatatatacatatatagcatatggacacatacatgtagctcaaggactgcagataagccgtatttgcggcagcaagcgaattaaagcagcagctagcacagttcggtcgcatctgtcgtcggctagcgagaggatcggagaagccccggccgcgtcgtcgtcgtcgatcgctcgctcggccatgacgacgtacagggtgtgctgcttcctgcggcggttcggggcggcgtccaacgagccgtcggaggctatcagggacgtgttccaggcgtacgccgacggcggcggcgtggtcggggaggaggcagtgcggaggctcctgcgggaggtgcagggggagaccgacgccggcgccgaggcggcggccaaggaggtgatggcgttcgcggcggagcagacgctgctcaagaagggcggcctcaccgccgagggcttccaccgatggctctgcagcgacgccaacgccgctctcgacccgcgccgtggggtgtaccaggacatgggttggccgctgtcgcactacttcatctacacgggccacaactcgtacctgacggggaaccagctgagcagcggctgcagcgagaggcccatcgttaaggccctcctcgacggcgtcagggtcatcgagctcgacctctggcccaactccaccaaggacgaggtcgaggtccttcacggcaggacatggacgtcgcccgtggagctgaacaagtgcctggacgccatcaaggagcacgccttcgtggcctccccctaccccgtcatcctcaccctcgaagatcacctcaccccggacctccaagccaaagtggccaagatgctgaaacagaccttcggggacatgctgtacatctcggaatccgagagcatggcggagttcccttccccggacgacctcaagggcaaggtcatcatctccacgaagccgcccaaggagtacctgcagaccaagagcggcaaggaggaggcggaggacagggccgaggaggagggcgtctggggggaggagatctccgacggcaaggccaccgcccggcagatgtcggagcagggcagtggcaagtacggcgcggaggaggccgaggaggagccgctggacggcgaggccgagaagaaggcgcggcagcagggggccgacagcgagtacaatcgcctcatcgccatccagctcacccggaggaagcacgacatggaccaggacctcaaggtcgacccggacaaggtcacgcggctcagcctgggggagaaggcgtacgagaaggccatcgtctcccacggggctcacatcatcaggtttacgcagagaaacctgctgcggattttcccgcggtcaacgcgcatcatgtcgtcgaactacaatccgttgatggggtggaggtacggggttcagatggttgcagccaacatgcagggacacgggaggaagctgtggctgacccaagggatgttccgagccaacggcggctgcggctacgtgaagaagcctgacatcctgatgaacagcgaccctgacaagcttttcgatcctaaagccgatctgccggtgaagacgagactgagggtgacggtgtacatgggggacggctggcggttcgatttccgcaagacgcatttcgacaagtgctcgccgccagacttctacgcaagggtgggggtcgccggcgtggcggcggacacgcggatggagcagacgcgggtgatgatggacagctggatcccggcgtgggaccgcgagttcgagttcccgctggcggtgccggagcgggcgctgctgcgggtggaggtgcacgagtccgacaaccaccagaaggacgacttcggcggccagacctgcctgccggtgtgggagctccgaccggggatccgcgccgtccggctctgcgaccacaagggccagccgctgcgatccgtcaagctgctcatgcgcttcgagttcttcccctcctcctcctcctccaactccaagtagaacctcactgtcgtgatgacgacgcgctggattttcggaggattctttgtttggtgtttattctctgtcgcttgtgcatggaagtagcgcgacactgctgcgtgtgataccggactgcgattgtgattgtgattatcattggtggtgataatcaacttaataaaaaacaagagaggcttttgttcgtttaaaaaaaaaaaaaaaaaaaa

SEQ ID NO: 5012 - protein, 596 aa, Panicum virgatum
  misc_feature: Ceres CLONE 1813917
  misc_feature (1)..(145): Pfam Name: PI-PLC-X Pfam Description: Phosphatidylinositol-specific phospholipase C, X domain
MTTYRVCCFLRRFGAASNEPSEAIRDVFQAYADGGGVVGEEAVRRLLREVQGETDAGAEAAAKEVMAFAAEQTLLKKGGLTAEGFHRWLCSDANAALDPRRGVYQDMGWPLSHYFIYTGHNSYLTGNQLSSGCSERPIVKALLDGVRVIELDLWPNSTKDEVEVLHGRTWTSPVELNKCLDAIKEHAFVASPYPVILTLEDHLTPDLQAKVAKMLKQTFGDMLYISESESMAEFPSPDDLKGKVIISTKPPKEYLQTKSGKEEAEDRAEEEGVWGEEISDGKATARQMSEQGSGKYGAEEAEEEPLDGEAEKKARQQGADSEYNRLIAIQLTRRKHDMDQDLKVDPDKVTRLSLGEKAYEKAIVSHGAHIIRFTQRNLLRIFPRSTRIMSSNYNPLMGWRYGVQMVAANMQGHGRKLWLTQGMFRANGGCGYVKKPDILMNSDPDKLFDPKADLPVKTRLRVTVYMGDGWRFDFRKTHFDKCSPPDFYARVGVAGVAADTRMEQTRVMMDSWIPAWDREFEFPLAVPERALLRVEVHESDNHQKDDFGGQTCLPVWELRPGIRAVRLCDHKGQPLRSVKLLMRFEFFPSSSSSNSK

SEQ ID NO: 5013 - DNA, 1941 bp, Panicum virgatum
  misc_feature: Ceres CLONE 1813965
  misc_feature: Encodes the peptide sequence at SEQ ID NO. 5014
atttttttcccatccattcgttctctatccctcctcacgagctggcccttccactccctatccaaggctctctcactccacgagctctcttcccagctgctccttgtgccgttctccctctccacgagctctctcttccttgctgctccctcttctcggcgagctttttgtcccctgctcttctcctccctcgatgtggcgcaagttcttctccattcatggaatggagccgggacggcctggaggcggcgcgtgccacgagcgcggccttgcgcgcgtcatcacaggagtggggacgtcacgcgcagcggagcagggcccgtgcccgtcgtcagcatggtgcatggggcggggtggcgcgccggaagacggtgtgcatcgcgcggtgcggctgctagaggaaacaaacatacgtgaagctcacggctgcggcgggaatttggacttggacaaatctatttgtcgcgcgcgttagtaggatgcaagccatcgcataagacgaggcgctcaagccgaatcttagcttgcccgcggcccataaagatgtaagttgactccaccgttttctgtactcgcacacaacccccccatggctcaggcacgcgtgcgcctccctcccgccggcccaacgccggccaccgccttcttctcgggctccaatcccagacccgaccacctgccgttctcctcgaagcgcgcccccgcctccctctgcgccgccgccgccgccgccaatgcgccgccggcccccatcgtcgtcgtcggctccgccaacgccgacatctacgtcgaggtcgaccgcctcccgctcgccggcgagaccgtggcggctcgcgcagggcgcagcctcgcgggcgggaagggcgccaaccaggcggcctgcggcgggcggctcgcgctgggccccacctacctggtggcgcgcgtgggggacgacgccaacgggcggcttctcgagggcgcactggccgacgccggcggcgtccgcaccgaccgcgtcgcgcgcgcgcccgacgcgccctcggggcacgccgtcgtcatgctcatgcccgacggacagaactccatcatcatcgtcggcggagccaacatgcagggctgggccgctgggatcagcgcggaggacctggaattgatccaaaaggcaggggtactgctgctgcagagggagatacccgattgggtcaacacgcaggctgcccaggctgcaaaaagtgcaggcgtgcctgttatcatggacgctggtggaatggatgctcctgtacctcgagatctactcagtctagtggatatttttagtccaaatgaaacagagctagcacggttgactgggatgcctactgagacatttgagcagatcagccaggctgcaggagaatgccataaaatgggtgtgaaagaagtactagttaagcttggatcgcagggatctgctttgtttgttgagggagagaagccaatcagacagccgattattcctgccacagaagttattgataccacgggggctggtgacactttcacctcagcttttgctgtagccctggttgagggaaagcctaagaaggagtgcatgagatttgctgctgctgctgcctcattgtgtgttcgagtgaagggtgctatacccagcatgcccgacagagaatcagtgatgaagcttctgggatctgtgcaagtcgagtagctgcagaatgcatcgatcgttcaaagtcgacctcatccatcgggaataatgtgagcaccttcacgctccttgacaactcattctctggtgtgtgcatttggagtcttgtagtgtgatggtagcatagaaaaacaagagaaaacagtaccgccccctagtcccccagaaatagaaacgctggttgataagctttagtttttgtcaggtttattataggctttcctgtttcgagccaaaaaaaaaaaaaaaaaaaa

SEQ ID NO: 5014 - protein, 365 aa, Panicum virgatum
  misc_feature: Ceres CLONE 1813965
  misc_feature (3)..(301): Pfam Name: PfkB Pfam Description: pfkB family carbohydrate kinase
MAQARVRLPPAGPTPATAFFSGSNPRPDHLPFSSKRAPASLCAAAAAANAPPAPIVVVGSANADIYVEVDRLPLAGETVAARAGRSLAGGKGANQAACGGRLALGPTYLVARVGDDANGRLLEGALADAGGVRTDRVARAPDAPSGHAVVMLMPDGQNSIIIVGGANMQGWAAGISAEDLELIQKAGVLLLQREIPDWVNTQAAQAAKSAGVPVIMDAGGMDAPVPRDLLSLVDIFSPNETELARLTGMPTETFEQISQAAGECHKMGVKEVLVKLGSQGSALFVEGEKPIRQPIIPATEVIDTTGAGDTFTSAFAVALVEGKPKKECMRFAAAAASLCVRVKGAIPSMPDRESVMKLLGSVQVE

SEQ ID NO: 5015 - DNA, 1471 bp, Panicum virgatum
  misc_feature: Ceres CLONE 1813969
  misc_feature: Encodes the peptide sequence at SEQ ID NO. 5016
aagtgggaagacgaggccgcaaggcaggcagacagaccacgccgcacgccctgcttgagccgcggcgcgctccggcatttctcctcttcctcccgccgctccgcccgcctctgccgccgccgacccacccgcctcctgcctctcgtctcgcggactccgcggctggtgctgcctccacacgtcttccgcgcgggggctgctgccgcgaccatggccaccggcgccgtcacgccgccgccgccgccggcggcggccggcgcgcggcgcggcgtccgtgcccgggggatcctccaccggcgcctcgccgcctcgtctatgaaagatgaatctgtgatttccacaaatggcggaaatgaggaaatggtcactgatagcctcaatgttgccagaggattgtctcacccgggtctttcatcaagtttatccaataaggcatctgtggtcccaacccctttgcttcctaacgaaccatctgacctccggttcaatcgccttcgaccctcaattgatgaaagcaaatacaaaagactatttgactgctatgttgctcgtgaggctgtaattgatgaggaatactggattgctgcatggttgagagcagaagatcactttgaaggtcagtcaggaaaccgctatgttgaaagctttaaaagaaagtttgcatctcaggaatttcatgcattaaagaagcgatgcagcaaacagcatggagaaaagtatatatgttttgtcgcggtaaagaatgatgacctcaggcgaactgtcctgaatagcgttgttggtaccttagatgtatgtgtaaggcatcctctacatggggagaaatttcctgaggagcctggaaggtcgtctcttcattgtagaatctatcagccggatcagccaaaatttgggtatttaactaatgtatgtgttgctaaatatgcaaggcgtcaagggattgccagtaacatgttgttattggccatagatgctgcaagaatctatggtgctgaaaatatttacattcatgtgcataaagataacttaccagcgtggaggctctataatcagataggattcaagatggttgaccaggatggtgcccgtcattcatcagatctgtgcttactcaccttcggttcgtagggctagctgactaggataggagaagggacatgcttccttgttccatctccctgtgcagagaaatgccaccagtcctcagcgatttggaaaagcaagagggtgtgtgccaaggaatacctttacaatcttgtacatgatgaaagttgttttcataagtttgtgagttctgaggtcgtcactatcccggtgacagttctgatgccccggaatgttgtggtatctgaatgcttcaaagcttctgtcattgtatagtttgtgaatcctacaaatgtttgttggttgttcccgccattctgcaatgaattcatactcttgagcatcttaaaaaaaaaaaaaaaaaaaa

SEQ ID NO: 5016 - protein, 305 aa, Panicum virgatum
  misc_feature: Ceres CLONE 1813969
  misc_feature (1)..(102): Pfam Name: Acetyltransf_1 Pfam Description: Acetyltransferase (GNAT) family
MATGAVTPPPPPAAAGARRGVRARGILHRRLAASSMKDESVISTNGGNEEMVTDSLNVARGLSHPGLSSSLSNKASVVPTPLLPNEPSDLRFNRLRPSIDESKYKRLFDCYVAREAVIDEEYWIAAWLRAEDHFEGQSGNRYVESFKRKFASQEFHALKKRCSKQHGEKYICFVAVKNDDLRRTVLNSVVGTLDVCVRHPLHGEKFPEEPGRSSLHCRIYQPDQPKFGYLTNVCVAKYARRQGIASNMLLLAIDAARIYGAENIYIHVHKDNLPAWRLYNQIGFKMVDQDGARHSSDLCLLTFGS

SEQ ID NO: 5017 - DNA, 1604 bp, Panicum virgatum
  misc_feature: Ceres CLONE 1814021
  misc_feature: Encodes the peptide sequence at SEQ ID NO. 5018
aagtccgctccctcgcagagtcgcagtgcacgcacacggcagcaggacagccgaggagagagcagagcgagtgaggggggccggagcaaggaccatggcggcgtccaacggcggaggcgatgcccccgggcggttcgacgtgatcgtggtgggcgcgggcatcatgggcagctgcgcggcgtacgcggcgtcctcccgcggcgcgcgcgcgctgctcctggagcggttcgacctgctccaccaccggggctcctcgcacggcgagtcccgcaccatccgcgccacctacccgcaggcgcactacccgcccatggtgcgcctgtcgcggcgcctctgggaggaggcccaggccgacgccgggtaccgcgtgctcacgcccacgccgcacctcgacctgggcccgcgggacgaccccgagctccgcgccgccatcaggaacggcggcgccgccgtggtcgccggcggctcttcctggccgtgggcgggcgtgttcagggtgccggacgggtgggcggcggcgagcagcgagctcggcggggtgatgaaggcgaccaaggcggtggccatgttccaggcgctcgccgtcaagaagggcgccgtcgtgagggaccggatggaggtggtcgacgtcgccaagcgaggagaaggatcaatcttggtcaggacagcgagcggcgaggaattccatggcgccaagtgcattgtaacggtcggcgcctggacaagcaagctggtcaagtcggtcgtcggcatggacctgccggtgcagccggtgcacacgctcatctgctactggaaggtgaagcccggccacgagagcgagctcaccgcggaggccggcttcccgacgttcgccagctacggcgatccctacatctacagcacgccgtcgatggagttccccggcctcatcaagatcgccaagcacggcggcccgccgtgcgacccggacagcagggactggtccacgggcgccgccgacctggcggagcccgtagcccggtggatcgacgccgtcatgccgggccacgtcgacaccgccggcgggccggtcatccggcagtcgtgcatgtactctatgacgcccgacgaggactacgtgattgacttcctgggcggggagtttgggaaggacgtcgtcgtcggcgcggggttctccggccacgggttcaagatggggccggcagttgggaggatcctggccgagatggccatggacggggagtcgagttcggcggtggaggccggcgtggatctcaaacccctcaggatcgacaggttcgtgggcaatccaagggaaacctcagtagtcctggagatcagggccaatgatgaacaccttcgatctacttgattgagatcatatattcaaccattcgtgatcaaatcaaagtgtgcgcatgtcaattgctttgtttgcttggaataatctgttgaaaattgcattgtgaaactttccttcgttctgttggagtgtcaggactcaggaaactgaagtgcatctcctttgtacctgtaccaaaattaaaagctaccagctcaactgcattcagttgcagatgaacgtttcagtattaactggtctgttgactctgttgagaact

SEQ ID NO: 5018 - protein, 419 aa, Panicum virgatum
  misc_feature: Ceres CLONE 1814021
  misc_feature (1)..(362): Pfam Name: DAO Pfam Description: FAD dependent oxidoreductase
MAASNGGGDAPGRFDVIVVGAGIMGSCAAYAASSRGARALLLERFDLLHHRGSSHGESRTIRATYPQAHYPPMVRLSRRLWEEAQADAGYRVLTPTPHLDLGPRDDPELRAAIRNGGAAVVAGGSSWPWAGVFRVPDGWAAASSELGGVMKATKAVAMFQALAVKKGAVVRDRMEVVDVAKRGEGSILVRTASGEEFHGAKCIVTVGAWTSKLVKSVVGMDLPVQPVHTLICYWKVKPGHESELTAEAGFPTFASYGDPYIYSTPSMEFPGLIKIAKHGGPPCDPDSRDWSTGAADLAEPVARWIDAVMPGHVDTAGGPVIRQSCMYSMTPDEDYVIDFLGGEFGKDVVVGAGFSGHGFKMGPAVGRILAEMAMDGESSSAVEAGVDLKPLRIDRFVGNPRETSVVLEIRANDEHLRST

SEQ ID NO: 5019 - DNA, 1561 bp, Panicum virgatum
  misc_feature: Ceres CLONE 1814026
  misc_feature: Encodes the peptide sequence at SEQ ID NO. 5020
aagtccacggacaccgccgatccccacttattaagcttcctgtctcggcggccgcctcctctcttctcctcatcgggtctccccagctcccactccaccaggccccgccactgattcagagtccgccattgatggactacgagcgcatccacgagccgctctcccgtcagtccggtggattctctccagctaagctacgagcaatgcttcgcgggctagagaaacaccagcgcagcggtgatgacacatcaccggaggccaacgactccggcgagctcgacgaccgaaggagcttggagtgctccacctccatatcgagccacagtggtcacagatcaagacaccgagctccagacgacgatagcttcgactccgagagcagctcatcgggaccgccgacggtgaagaggtccgcggcggtggctgcgttactgccgccgttctcccggccaactccttcgaagtgggacgacgccgagaagtggatttccagcccgacgtcaaaccatacaggccgcgcgggacctgccactgggactgtgccaaagaagtcatcattggcatttcctgaacatggaggccgcccaccagctgttgctaaggtggtcgcggatgtgcccattagcactggacccttggttaagaattcagatggtctaactcagtctgatttatttaaacctgcacaaagttctccaatagttgatgaaccagaggctgcaattaggtcagtctcgatgagggacataggaacagaaatgactccaattgcgagccaggagccttctcggactgggacgcctatcattgcatctagtccaacatcctctcggacaccaactccgcaacgtactactgaattcagtttaagtaatattgattctaacaagaaggagatgtctgaggaggagctacaaataaatacgagacaggaaattatggatcttggccaaaggttaggcaagactactatagccgcatgggcaagtaaggaagagaaagctgctgcacatctcacaagtagtacaacccataaggttgtcaatatcgacatggaggctcgagctacggattggcaggaggcagagaaggcaaagtatcttgcaaggtttcacagggaggaagcaaagatccaagcttgggaaaatcaccagaaagcgaaaatcgaagctgaaatgaagaggatagaggccaagatagaacgaaaacgggcgcgcgagcaggacaggctggccaacaagctggcagcagtaagccaccgagcagaggcgaagagggaggccgcggaggtgaggaggagccaagaggcggcgcggacagaagagatggcagctgagatccgagagacagggcacgcgccttcgtcgttctcctgctggtgctggtgcctctgaacgactcctcaggcgcctatagcaggatccgccgtcatgtgtggtggtgggtgaggtggaaaatttgttgccgcacgacccttgtaaattgtaatgcgatgccatgggctcatctttgtcacaaggaatgccaagtgtttgtcgtccaaaaaaaaaaaaaaaaaaaa

SEQ ID NO: 5020 - protein, 420 aa, Panicum virgatum
  misc_feature: Ceres CLONE 1814026
  misc_feature: The sequence is a functional homolog of  SEQ ID NO 1040 in the  10/666,642 US patent application
  misc_feature: The sequence is a functional homolog of  SEQ ID NO 1041 in the  10/666,642 US patent application
  misc_feature: The sequence is a functional homolog of  SEQ ID NO 264 in the  10/666,642 US patent application
  misc_feature: Useful for making plants with modulated growth and phenotype characteristics
MDYERIHEPLSRQSGGFSPAKLRAMLRGLEKHQRSGDDTSPEANDSGELDDRRSLECSTSISSHSGHRSRHRAPDDDSFDSESSSSGPPTVKRSAAVAALLPPFSRPTPSKWDDAEKWISSPTSNHTGRAGPATGTVPKKSSLAFPEHGGRPPAVAKVVADVPISTGPLVKNSDGLTQSDLFKPAQSSPIVDEPEAAIRSVSMRDIGTEMTPIASQEPSRTGTPIIASSPTSSRTPTPQRTTEFSLSNIDSNKKEMSEEELQINTRQEIMDLGQRLGKTTIAAWASKEEKAAAHLTSSTTHKVVNIDMEARATDWQEAEKAKYLARFHREEAKIQAWENHQKAKIEAEMKRIEAKIERKRAREQDRLANKLAAVSHRAEAKREAAEVRRSQEAARTEEMAAEIRETGHAPSSFSCWCWCL

SEQ ID NO: 5021 - DNA, 1530 bp, Panicum virgatum
  misc_feature: Ceres CLONE 1814046
  misc_feature: Encodes the peptide sequence at SEQ ID NO. 5022
tgttgtttactcgatctgctcgtttgaggctgcatcgatctgtggatttgagcttaattaactgcggcagccatatactatctcgacgatttctagtcgcggggttctcgctcagaaatcggtgaacgggtgggtggtgccgcagcggagaggagggagggggatggcgcagccgccgcgtgtgtgcgtgaccggtggcggcgggttcatcgcctcctggctcgtcaagctgctgctctcccgcggctacgccgtccacgccaccctccgtgacccaggcaacccaaagaacgcccatttgaaggagctggacaatgccccagagaacctgcttctgttcaaggccgatgtgctagactacgacacgctaacacctgctgttgaaggatgtgagggggtcttccatcttgccactccggtgcctgaagataagattgttgatcctgagtcacaactcgatactgctgtgaaaggtaccttaaatatactaaaggtctgctcagctgcaaaggttcagaaacttgttgtgatgtcctccaatgctgctgtggattttaacccgaattggcctcaagatataatcaaagatgagagttgctggtccgacaaagagttctgcaaggaaaatggggactggtattctgttgctaagattatgggtgaacaggcagccttggaatatgcagataaaaatggactgaatgttgttacactttgcccacctttggtttttggcccactgttgcagcctacggtgaatactagcagcaaatttctcatctacgttataaaaggaggccctgatgtgatgaacaacaaactgtggcacatagtagacgtccgtgatgtggctgatgctttgcttctgctgtacgagaaggaagagtcatccgggagatacatctgctcgccgcatcacattcgcacgagggatttggtggccttgttgaagaagatgcacccagagtacaactacgtagacaacatcctcgatgtcgatcagaaagcgtcgttgacatgccagaagctgatggacctgggctgggaacccaggacgacgctggaggagacgctctcggactgcgtcgagtgctacgaaaaggcaggcgcgctccaggatgtacccgggcgtcctcgccgtctcccccatctcttccgtctggctggtgaccaatgaatcaactgtcgtgtcgtggcagtgccctgtttggttctctagcgctagcgctacttgctctacaaaaggaattttgtatgtacgaagtactaaacgaatttatttgcaaatttttttcacagatgggtgcaactttacgcgacgaatctaatgagtctaattaattcatgattggatacagtaatactacagtaaccattctctaatcgtgcggtcgaagaactcattagattcgtctcgcaaagtagcgcagatgttgtggagttggttttgtaaactacatttattttatacctgtaattaatggtcaaagttggctatagttttttttttgaaaaaaaaaaaaaaaaaaa

SEQ ID NO: 5022 - protein, 337 aa, Panicum virgatum
  misc_feature: Ceres CLONE 1814046
  misc_feature (1)..(244): Pfam Name: Epimerase Pfam Description: NAD dependent epimerase/dehydratase family
MAQPPRVCVTGGGGFIASWLVKLLLSRGYAVHATLRDPGNPKNAHLKELDNAPENLLLFKADVLDYDTLTPAVEGCEGVFHLATPVPEDKIVDPESQLDTAVKGTLNILKVCSAAKVQKLVVMSSNAAVDFNPNWPQDIIKDESCWSDKEFCKENGDWYSVAKIMGEQAALEYADKNGLNVVTLCPPLVFGPLLQPTVNTSSKFLIYVIKGGPDVMNNKLWHIVDVRDVADALLLLYEKEESSGRYICSPHHIRTRDLVALLKKMHPEYNYVDNILDVDQKASLTCQKLMDLGWEPRTTLEETLSDCVECYEKAGALQDVPGRPRRLPHLFRLAGDQ

SEQ ID NO: 5023 - DNA, 1963 bp, Panicum virgatum
  misc_feature: Ceres CLONE 1814060
  misc_feature: Encodes the peptide sequence at SEQ ID NO. 5024
gacggtcagcggctgcaaccaccacgcctccccaatggaggctggggaaatcggcggcgccctcctcttcctcctcgccgtcgcgggggccgtcgcggccgccgtctccgtcggcgcggtcgacttcagccgcccgctcgccgcgggcgcgccgctcgggttccagcaggccgtgtcctggctcatcggcgtcctcgacggcacgtcctccgcggcggcggacgtgtactgggcgtgggtggctgtgcgggccggggtgatcgcgccagtgctgcaggtggcggtgtgggcgtgcatggtgatgtccgtgatgctggtggtggaggccgtgtacaacagcgtggtcagcctcggcgtcaaggccatcgggtggcggcccgagtggaggttcaagtgggagcccctcgacggcgccgacgaggagaaggggagagcccactaccccttggtcctggtccagatacccatgtacaatgagctggaggtatacaagctgtcaatagcggccgcatgtgagctgcagtggccgaaggacaggataatagtccaagtgctggacgattccaccgatccgttcatcaagaatttggtggagcttgaatgcgagaactgggcaaacaaaggtgtcaacattaagtatgccacaagaactagccgcaaggggttcaaagctggagctctgaagaaaggaatggaatgtgattacgcaaggcaaagtgattacatagccatatttgatgctgatttccaacctgaaccagactttctgctccgaactgtcccattccttgtgcacaatccggaagttgcccttgttcaagctcggtggtccttcgtgaatgacaccacaagcctgttgacaagggtacagaagatgtttttcgattaccacttcaaagttgaacaagaagcaggatcagctacattctccttcttcagtttcaatggaactgctggagtgtggcgtacagtagccataaaagaggcaggaggttggaaggaccgcactacaattgaggacatggacttggcagttcgagcaaccctaaagggctggaaatttgtttatgttggggatgtcagagtcaagagtgaactgccatccacttacaaggcctactgtcggcagcaattccggtggtccagtggtggcgcacacttattccgtaagatggcaaaggatgttttggtagccaaggatgtatcactcctcaagaagtcctatatgctctatagcttcttcttggtgcggagagttatagcgccaaccgctgcctgtattctctacaatatcatactccccgtatcggtcacaatcccggagttgtatttaccagtctggggtgtcgcctatattcccacggtgcttaccatagtaacagccattagacatccaaaaaatcttcacataatgccattttggattttgtttgagagtgtgatgacagtacgtcgcatgagagctgcactgacagggctgttggaattagaaggtttcaaccagtgggatgtgaccaagaaggtggggaatgatcttgaggacagtgaagttcctttgcttcagaaaacccggaaaaggttaagggacagagttaatttccccgagattggattttcggtgttcatcttcctatgtgcatcatacaaccttgcgttccatgggacaacaagctactacatatacctatatctccagggattagcatttttattgctaaggctcaatttcactggaacttgttcctgctgccaatgacaaatgacaatggcaaaattgtatgaatcacagctttatagtcattttctgggtatgagtccatcaggttacaattcaaatggtttagatcgtagatgcatagaaaggtgttgttattccatgtggtcacgatggtttgaccggtgctgtttttccccatctaaactaatgcagaatggcttaatccaaaaaaaaaaaaaaaaaaaa

SEQ ID NO: 5024 - protein, 573 aa, Panicum virgatum
  misc_feature: Ceres CLONE 1814060
  misc_feature: Great-hit functional homolog of the protein sequence encoded by LOCUS At5g03760
  misc_feature (1)..(179): Pfam Name: Glycos_transf_2 Pfam Description: Glycosyl transferase family 2
  misc_feature: Useful for making plants with altered cell wall content and/or composition
MEAGEIGGALLFLLAVAGAVAAAVSVGAVDFSRPLAAGAPLGFQQAVSWLIGVLDGTSSAAADVYWAWVAVRAGVIAPVLQVAVWACMVMSVMLVVEAVYNSVVSLGVKAIGWRPEWRFKWEPLDGADEEKGRAHYPLVLVQIPMYNELEVYKLSIAAACELQWPKDRIIVQVLDDSTDPFIKNLVELECENWANKGVNIKYATRTSRKGFKAGALKKGMECDYARQSDYIAIFDADFQPEPDFLLRTVPFLVHNPEVALVQARWSFVNDTTSLLTRVQKMFFDYHFKVEQEAGSATFSFFSFNGTAGVWRTVAIKEAGGWKDRTTIEDMDLAVRATLKGWKFVYVGDVRVKSELPSTYKAYCRQQFRWSSGGAHLFRKMAKDVLVAKDVSLLKKSYMLYSFFLVRRVIAPTAACILYNIILPVSVTIPELYLPVWGVAYIPTVLTIVTAIRHPKNLHIMPFWILFESVMTVRRMRAALTGLLELEGFNQWDVTKKVGNDLEDSEVPLLQKTRKRLRDRVNFPEIGFSVFIFLCASYNLAFHGTTSYYIYLYLQGLAFLLLRLNFTGTCSCCQ

SEQ ID NO: 5025 - DNA, 2140 bp, Panicum virgatum
  misc_feature: Ceres CLONE 1814063
  misc_feature: Encodes the peptide sequence at SEQ ID NO. 5026
gaaaaggcgtgccttcctctgaaagctcagcactccagccatgggttcaggtctcttcaagccttgtgttcatccggacctccgtgatgttttctctaagatgtctttcggtgacaagattggctttctattcattcatgcatttgacaagagaaacctatggcataagatgcctattccgatcggtttactctacctgaacactcgccggaccctacttgaaaaatacaaccttctaccagttgggagttctcatggtgccctgtttgaccccaaggagttcttgtaccgcactggagatggcaagtacaacgacccccataatgctgaggctggtagccaaaacaccttttttgggagaaacatgaagccagttgatcaaaaggatgagttgatgagcccagatccatttgttgttgtgacaaagctgttatctaggagagaatacaaggacacagggaaacaattcaatatactagcagctgcatggatacagttcatggttcatgactggatagatcatatggaggataccaaacagattgaaatcaccgctccaaaagaagtggccaatgagtgcccactcaaatcgttcaagttctacgccacaaaagaactgcctacgaattctgatggaataaagactggttactacaatgtccgcacagcttggtgggatgggagtgcagtatatggtgataatgagaaaaaggcaaaaaagatcaggacttatgttgatggaaaactagtgatcggagatgacggtcttcttttgcatgatgagaatggtgttccattatccggcaatgttcgcaacaattgggttgggatttcgatcttacaatctctttttgttaaggaacacaatgcagtttgtgatgcaataaaggaagaacatcccaacctatcagatgaagaattatatcgatatgccagattggtcacttctgctgtcattgcaaaggttcacactattgattggaccgtcgagcttctcaagactaaaaccatgagagctgcaatgcgcgcaaattggtatggattattgggtaagaagataaaagatacatttggtcacataggaggaccggcattaggtgggcttgtgggattgaagaagccgaacaaccatggcgtaccttattctttgactgaagagtttaccagtgtttacagaatgcactccctcttaccaagcactctcaagctcagggatccgaatgggcaacctgatgcaaataattccccaccatacctggaagacatcgatattggagaattggttggtctcaagggggaagaacagctatcaaaaatagggtttgaaaaacaaacattatcaatgggatatcaagcttgtggtgcacttgaactatggaactacccaagtttcttccgggacctcataccacaaaatttggatggtaccagtcgatctgacagaatcgaccttgctgccctagaagtataccgagacagggagagaagtgtaccgaggtacaatgagtttaggaggagactatttctgattccaataaaaagctgggaggatctgacaagtgacaaggatgcaattgaagccataagagcaatatatggagatgatgtagagaaattggaccttcttgttggtcttatggcagagaaaaaaatcaagggatttgccataagcgaaacagcattcaacattttcattataatggcatcaaggaggctcgaatcagatcgattttttacaagcgatttcaatgagaaaacatacaccaggaaggggatgcaatgggtcaaaacaactgaaggcctacgagatgtgatcaaccggcactaccctggaatcactgccaagtggatgaagtcctctagtgctttctctgtgtgggatgcagactactagtgcaaaaataaaaggcccctgccatatttactgcatgcaatttttcaagttctatgaagtattatttgtttacagaattgtggtgtgtaatatatgtaataggattcattacatggcacaagttgtatgcttatttgtttacaatttattgtacattattatttattcactgtaattaaatatatctgggaaaataatcaggaggagaccatataacatcttccttaaaaaaaaaaaaaaaaaaaa

SEQ ID NO: 5026 - protein, 617 aa, Panicum virgatum
  misc_feature: Ceres CLONE 1814063
  misc_feature (1)..(533): Pfam Name: An_peroxidase Pfam Description: Animal haem peroxidase
MGSGLFKPCVHPDLRDVFSKMSFGDKIGFLFIHAFDKRNLWHKMPIPIGLLYLNTRRTLLEKYNLLPVGSSHGALFDPKEFLYRTGDGKYNDPHNAEAGSQNTFFGRNMKPVDQKDELMSPDPFVVVTKLLSRREYKDTGKQFNILAAAWIQFMVHDWIDHMEDTKQIEITAPKEVANECPLKSFKFYATKELPTNSDGIKTGYYNVRTAWWDGSAVYGDNEKKAKKIRTYVDGKLVIGDDGLLLHDENGVPLSGNVRNNWVGISILQSLFVKEHNAVCDAIKEEHPNLSDEELYRYARLVTSAVIAKVHTIDWTVELLKTKTMRAAMRANWYGLLGKKIKDTFGHIGGPALGGLVGLKKPNNHGVPYSLTEEFTSVYRMHSLLPSTLKLRDPNGQPDANNSPPYLEDIDIGELVGLKGEEQLSKIGFEKQTLSMGYQACGALELWNYPSFFRDLIPQNLDGTSRSDRIDLAALEVYRDRERSVPRYNEFRRRLFLIPIKSWEDLTSDKDAIEAIRAIYGDDVEKLDLLVGLMAEKKIKGFAISETAFNIFIIMASRRLESDRFFTSDFNEKTYTRKGMQWVKTTEGLRDVINRHYPGITAKWMKSSSAFSVWDADY

SEQ ID NO: 5027 - DNA, 1671 bp, Panicum virgatum
  misc_feature: Ceres CLONE 1814076
  misc_feature: Encodes the peptide sequence at SEQ ID NO. 5028
acggactcgtctcttccttcccagctctcctataggctcctgctcaaaaaaaaaaagctctcctataggctcctcgcgcggtcgcgccgaacacgcctccttcagatccaggcatccttcagccgccgccgcggagccgcctccgcctcccccttccctcgccggcgtcctcgcccgcccccaccgggccgacgcgcggtagagatcgtccgcgcttggattgacttctcagttcttcctctgctgcaagcccccgttatcagccatgtttggacgcatgccaaggaagagcagcaacaacaccaagtattatgaggttcttggtgtgtctaagactgcaagccaggatgagctgaagaaagcatacaggaaagctgccataaaaaaccatcctgacaagggtggtgaccctgagaagtttaaggaattgtctcaagcatatgaagttcttagcgacccggaaaagagggagatctatgaccagtatggagaagatgcacttaaagagggaatgggaggaggcagcagcagtgatttccatagcccgttcgacttatttgagcaactttttccgggttctggcacctttgggggaggtggctcaagagtacgcagacaaaagcgtggtgatgatgtggtgcatactatgaaggtttctttagaagatctgtataatgggacaaccaaaaagctatctttgtcacggagtgttttgtgctcaaagtgcaaggggaaaggatccaagagtggggcatcaggaacttgccatggttgtcgtggtgttggaatgaggacaatcacaagacagataggccttggcatgatccaacagatgaacactgtttgccctgcatgcaaaggaacaggtgagatcataagtgagaaggataaatgctcaagctgtaaaggaagcaaggtagtcgaggagaagaaggtcttggaggttcatgtggagaaaggaatgcagcatgaccagaagattgtattccagggtcaagctgacgaagctcctgacacggtgacaggagacattgtttttgtgttgaaacttaaagaccacccaaagtttaagaggaagtatgatgacttatatgttgagcacacaatctcccttactgaggctctgtgtggcttccagtttgttctgactcatcttgatggtcggcagcttctgataaaatctaatcctggagaggttataaagcctggtcaacacaaggccataaatgatgagggtatgccccagcaaggtcgccctttcatgaagggccgtctttttgttgaattcaacgtcgagtttcccgagtccggtgccctctcccctgcccaatgccgatcacttgagaagatccttccaccaaagccagggagccagctgtcggacacggagctggatcagtgcgaggagaccaccctgcatgatgtcaacattgaagaggagatgaggcgcaggcagcatcagaagcggcaggaagcgtacgatgaagacgaggaagaatctggaccgagggtgcagtgcgcccagcagtgatctccggttcattggaatctccaaaagttccccgtcagatttattggcatcgattcttttttcggcaaagatttagccagtttgaacttgaagcgtgtaggtatagcaagtagatcccggaaaaaaaaaaaaaaaaaaaa

SEQ ID NO: 5028 - protein, 421 aa, Panicum virgatum
  misc_feature: Ceres CLONE 1814076
  misc_feature (1)..(127): Pfam Name: DnaJ_C Pfam Description: DnaJ C terminal region
  misc_feature (1)..(59): Pfam Name: DnaJ Pfam Description: DnaJ domain
  misc_feature (1)..(87): Pfam Name: DnaJ_CXXCXGXG Pfam Description: DnaJ central domain (4 repeats)
MFGRMPRKSSNNTKYYEVLGVSKTASQDELKKAYRKAAIKNHPDKGGDPEKFKELSQAYEVLSDPEKREIYDQYGEDALKEGMGGGSSSDFHSPFDLFEQLFPGSGTFGGGGSRVRRQKRGDDVVHTMKVSLEDLYNGTTKKLSLSRSVLCSKCKGKGSKSGASGTCHGCRGVGMRTITRQIGLGMIQQMNTVCPACKGTGEIISEKDKCSSCKGSKVVEEKKVLEVHVEKGMQHDQKIVFQGQADEAPDTVTGDIVFVLKLKDHPKFKRKYDDLYVEHTISLTEALCGFQFVLTHLDGRQLLIKSNPGEVIKPGQHKAINDEGMPQQGRPFMKGRLFVEFNVEFPESGALSPAQCRSLEKILPPKPGSQLSDTELDQCEETTLHDVNIEEEMRRRQHQKRQEAYDEDEEESGPRVQCAQQ

SEQ ID NO: 5029 - DNA, 1616 bp, Panicum virgatum
  misc_feature: Ceres CLONE 1814188
  misc_feature: Encodes the peptide sequence at SEQ ID NO. 5030
aaccccacctctctctctctctctctctctctctctctcctcgctttctctctcctcctcactctctctcctccgccacgcgccgccgccgtcgccgagcaggaagggggggccgcgggaagatgatgatgacgcgggccccgatggggccgatggagggcgcggcggtggacgaggtggtgcggcggctcgtggagggcggccgcggcgggcgccaggtgcagctgtcggaggcggagattcggcagctctgcgtcgagggcaagcgggtgctcctctcccagcccaacctgctccgaatccacgcccccgtcaagatctgcggtgatattcatggccagtttgtggaccttctgagactgtttgatttgggtggttatcctccaacttcaacttatgtattcctaggagattatgtcgatagaggcaaacagagcttggaaactatatgcttgctgctggcatacaaaatcaggtacccggaaaagattttcctgttgagagggaaccatgaagatgcgaaaatcaacagagtatatggtttctacgatgagtgcaagaggaggttcaatgtccggctgtggaagatattctcggattgcttcaactgcctgcctattgcagcagtcattgatgacaagatactgtgcatgcatggtggtctctcacctgaattgactagtttggaccagataaaggatatcgagaggccagctgagattcctgattatggtctcctctgtgatttgctttggtctgatcctagcccagatggagaaggatggggggagagtgacagaggtgtttcatgtacgtttggtgcagataagcttgtagagtttttagagaagaatgatctcgatcttatttgccgagctcatcaggtggttgaagatggctatgagttcttcgcacaacggcgattagtgacaatcttctctgctccgaattattgtggagaattcgataatgtgggtgctctattgagcatagatgagagcctaatgtgttcatttcagatcctgaagccaactgatacgggtccaccacatgctagaaaacaaattcccaataagccagccagaggttgaagcattttatcagcagtactttcggtcccatcatcttcagtcagctcaaagggggtggatctattgtttggatagttggatccaccagggcatggcattatacatccatcagccaatccccttgaaccatcctttatctgtgtcttgagtggcagcttggctgtaaagggtattatgtacagcattaggttggattcatcaccatatgttcttgttcttgtcctgccagcacagaacctcattggcagcatgacatccagtagatgttggtagtctttatttttttttagctatgtcatgcttttttttttgcaccctttgtgacttgatgtatggtaatattatctttacaatatgtagttgttggaggaaaaagtctgaacaattgttatttccatctaggcatctgcagaatcattctttgtacctttcgttccattgcggacccggaagctggaaatgccatttccatgtcatgcaagggaaagattgtggttagttggttaaaaaaaaaaaaaaaaaaaa

SEQ ID NO: 5030 - protein, 322 aa, Panicum virgatum
  misc_feature: Ceres CLONE 1814188
  misc_feature (1)..(196): Pfam Name: Metallophos Pfam Description: Calcineurin-like phosphoesterase
  misc_feature (11)..(321): SWISSPROT Homolog: EC 3.1.3.16 Serine/threonine-protein phosphatase PP1
  misc_feature (2)..(314): SWISSPROT Homolog: EC 3.1.3.16 Serine/threonine-protein phosphatase PP1 isozyme 8
MMMTRAPMGPMEGAAVDEVVRRLVEGGRGGRQVQLSEAEIRQLCVEGKRVLLSQPNLLRIHAPVKICGDIHGQFVDLLRLFDLGGYPPTSTYVFLGDYVDRGKQSLETICLLLAYKIRYPEKIFLLRGNHEDAKINRVYGFYDECKRRFNVRLWKIFSDCFNCLPIAAVIDDKILCMHGGLSPELTSLDQIKDIERPAEIPDYGLLCDLLWSDPSPDGEGWGESDRGVSCTFGADKLVEFLEKNDLDLICRAHQVVEDGYEFFAQRRLVTIFSAPNYCGEFDNVGALLSIDESLMCSFQILKPTDTGPPHARKQIPNKPARG

SEQ ID NO: 5031 - DNA, 2088 bp, Panicum virgatum
  misc_feature: Ceres CLONE 1814200
  misc_feature: Encodes the peptide sequence at SEQ ID NO. 5032
gtcacgcctgccactctcaccgcacagtgatcccaccaccgtagcacaaacatgccgcctcggcccaagagcgcagccgtagccaagctccccgtccccgccaccttcctctccctcgcccttctcctcctgccgctcggcttcctcgccacccacaggacattttccggtggcgtcgccgtgtccacgtccgctgcacctgcagaggaacgtcaccgtgaagaacgggtgctgcttgcgggcggcggcaatgccgacgcggacgccgccgcggcggagcacgcggccgccgtggaccggcactgcggctgcacgctgcaccgcgacgtgtgcgcgtcgacgctcgccaccatcccgaacctcgcccagaagccgctgcgggacgtgatctcccacgtggtggcgcgcgcggcggcggcggtgcgcgcgtcctcgtccaactgctcgtcctacctccgccggccccagcgcctgcgcgtgcgcgaccgcctggcgctgtccgactgcctggagctgttcgggcgcacgctggggctgctgggcacggcggcggacgagctgtcggcggggaaccgcacggcggaggagtccatcgcgggcgtccagaccgtgctctcggccgcgctgacgaaccagtacacctgcctggacgggttcgcgggcccgtcggcgtcgggggacgggcgcgtccggccatacatccagggccgcatctaccacgtggcccacctggtgtccaactccctggccatggtgcgccgcctcccgcagcaccgccggcgagggcgcgaggcgctggaggggtacgggcgggtgcggcgcgggttcccgtcgtgggtgtcggagggggacaggaggcggctgcagcagcagcaggcggtggcggacctggtggtggccaaggacgggagcggcaacttcacgacggtgggggaggcggtggcggcggcgcccaacaacagcgaggcgcggttcgtgatctacatcaaggcgggcgggtacttcgagaacgtggaggtcgggccggagaagacgaacctgatgttcgtcggcgacggcatgtggaagacggtgatcaaggccagccgcagcgtcgtcgacaactccaccacattccgctccgccaccctagcggttgtcggcacggggttcctggcgcgcgacctgacggtggagaacgcggcggggccgaagaagcaccaggccgtggcgctgcgcgtcaacgccgacctcgccgccttctaccgctgcagcttcgtggggtaccaggacacgctctacgcccactccctccgccagttctaccgcgactgcgacgtctacggtaccgtcgacttcgtcttcggcgacgccgccgtcgtgctccagggctgcaacctctacgcgcgtcgcccggaccccggccagaagaacgccgtcaccgcgcagggccgcgaggaccccaaccagaacacgggcatcgtcgtgcagggcggcaaggtcgccgccgccgccgacctcatccccgtcctcgccaacttctcctcctacctcggccgcccgtggaagctctactcgcggacggtgttcgcgcagaccaagatggagagcctcatccacccgagggggtggctcgagtggaacggcagcttcgcgctcgacacgctctactatgccgagtacatgaaccgcgggcccggcgccaacacgtcggcgagggtggcctggcccggctaccacgtgctcaccaacgccaccgacgccgccaacttcaccgtgctcaacttcattcagggcgacctctggctcaacgccacctccttcccctacacactgggcttcagctagctagctatttgcagcttatgggaatttttaacccatttttcttattctctctctctttttttggaagaataaattaatagtggtggctgggctaagctcgggttccgtagttcctagtactaatcctgaaagctggacctctgctactacggagtgtagcacatgtgttcccatatgattcttggttaaagtctgaacgaaaaagccgaaggctaatcatggaaggagatgacctcgatctcaaaaaaaaaaaaaaaaaaa

SEQ ID NO: 5032 - protein, 591 aa, Panicum virgatum
  misc_feature: Ceres CLONE 1814200
  misc_feature: Great-hit functional homolog of the protein sequence encoded by LOCUS At4g02320
  misc_feature (1)..(160): Pfam Name: PMEI Pfam Description: Plant invertase/pectin methylesterase inhibitor
  misc_feature (1)..(298): Pfam Name: Pectinesterase Pfam Description: Pectinesterase
  misc_feature: Useful for making plants with altered cell wall content and/or composition
MPPRPKSAAVAKLPVPATFLSLALLLLPLGFLATHRTFSGGVAVSTSAAPAEERHREERVLLAGGGNADADAAAAEHAAAVDRHCGCTLHRDVCASTLATIPNLAQKPLRDVISHVVARAAAAVRASSSNCSSYLRRPQRLRVRDRLALSDCLELFGRTLGLLGTAADELSAGNRTAEESIAGVQTVLSAALTNQYTCLDGFAGPSASGDGRVRPYIQGRIYHVAHLVSNSLAMVRRLPQHRRRGREALEGYGRVRRGFPSWVSEGDRRRLQQQQAVADLVVAKDGSGNFTTVGEAVAAAPNNSEARFVIYIKAGGYFENVEVGPEKTNLMFVGDGMWKTVIKASRSVVDNSTTFRSATLAVVGTGFLARDLTVENAAGPKKHQAVALRVNADLAAFYRCSFVGYQDTLYAHSLRQFYRDCDVYGTVDFVFGDAAVVLQGCNLYARRPDPGQKNAVTAQGREDPNQNTGIVVQGGKVAAAADLIPVLANFSSYLGRPWKLYSRTVFAQTKMESLIHPRGWLEWNGSFALDTLYYAEYMNRGPGANTSARVAWPGYHVLTNATDAANFTVLNFIQGDLWLNATSFPYTLGFS

SEQ ID NO: 5033 - DNA, 1832 bp, Panicum virgatum
  misc_feature: Ceres CLONE 1814269
  misc_feature: Encodes the peptide sequence at SEQ ID NO. 5034
ttcggcagatccccgacgagaaggatactgatgtcgttgaccaaagacgcttcctcagctctatgttacaagtatgaagctattgtcgacgaggattcatatgggccggtaacttgttcgacatcccgggcaagtaaaggaatagatccaattttgtcgccgaagacgcttcgagctttcagagaagaagggtgctgccaagcaatcatccatggcttccaacgatgagcaacagccactacatgttctcttattcccgtttgtcgcgccgggccacctcattccggtcgctgacatggccgccctcttcgcctctcacggcgtcaagtgcaccatcctcaccacccccgcgaacgccgatgtcatccgctcagctgtcgacggagccaacaacgccgtctgcagcaccggcgccccggagatcgacatctccaccgtccccttccccgacgtcggactggcgccgggcgtcgagagcgtcgtcggaatttcctctgaggccgataggtccaggttgctggaagcggtccggctgctccgcgagccgttcgaccgcttcctggccgaccaccgccccgacgccgtcgtggctgatagcttctacccgtggaccacggacaccgctgccgagcatggcgtcccacggctatgtttccttgggaccagcatgtttgcccgggcctgcaacgcctccttgctgtgcagcaacacgttggagttggaggggcttcctccagacgaccccgatgccatcgtgtccctgccgggtctgccgcaccgcgtcacgctgaggaggggccaggtgatggacccgaggaagaacgagctggagtggaactacgggaagctcgtgaacgccgcggaccagaggagctacggcgaggtcttcaacagcttcgccgagctggagccgggctatgccgagcactaccgcacggcgctcggccgccgcgtgtggctcgtgggtccggtcgggcacgccagcgatgtcttggcggcgaggggcggcgccggcgagctctcgctcgaggcggaaaggtgcctgcggtggctcgaccagaagccggatggctcagttgtgttcatctcgttcggtacgctgactcgtttcacggcggtggagcagcgggaggtggcccgcggcctacagctatccggaaggaatttcgtctgggtcatgagtgaatcagaggccgaaccatcacagtggatgcccgaaggctttgcagaactcattgatccgagagagcacggcatcattttctggggttgggctccacagaggctcatcctcggccactccgcagtcggtgggttcgtgactcactgtgggtggaactcggtgctagaggccgtgagcgctggcgtgccgctggtgacgtggcctcggcacggtgaccagttctacaatgaaaagctcatcttggaggtgctcaagattggggtcagtgtcggttccaggttctccgcgacaaaggtggaggttcgtagtgaggtcatcaatggtgagaagatcgcagaaggcattgatagagtgatgggtgatgacgaagaagcagaagcggtaaggaagaaggctgtagatcttcgtggaaaagccaggagcgccatagagaagggaggctcttcgtacgacgatcttgatcagctgattactgagttgatggctcgccggaactctgtaagtgtttgaggacttctatggaaatcagttggctcgttgagttgaacggatgggaggttttaaccaattgtatggtgcttcatgttcttatgactctgtcccttattatatgagttattcgttattcgaaaaaaaaaaaaaaaaaaaa

SEQ ID NO: 5034 - protein, 493 aa, Panicum virgatum
  misc_feature: Ceres CLONE 1814269
  misc_feature (2)..(133): Pfam Name: UDPGT Pfam Description: UDP-glucoronosyl and UDP-glucosyl transferase
MASNDEQQPLHVLLFPFVAPGHLIPVADMAALFASHGVKCTILTTPANADVIRSAVDGANNAVCSTGAPEIDISTVPFPDVGLAPGVESVVGISSEADRSRLLEAVRLLREPFDRFLADHRPDAVVADSFYPWTTDTAAEHGVPRLCFLGTSMFARACNASLLCSNTLELEGLPPDDPDAIVSLPGLPHRVTLRRGQVMDPRKNELEWNYGKLVNAADQRSYGEVFNSFAELEPGYAEHYRTALGRRVWLVGPVGHASDVLAARGGAGELSLEAERCLRWLDQKPDGSVVFISFGTLTRFTAVEQREVARGLQLSGRNFVWVMSESEAEPSQWMPEGFAELIDPREHGIIFWGWAPQRLILGHSAVGGFVTHCGWNSVLEAVSAGVPLVTWPRHGDQFYNEKLILEVLKIGVSVGSRFSATKVEVRSEVINGEKIAEGIDRVMGDDEEAEAVRKKAVDLRGKARSAIEKGGSSYDDLDQLITELMARRNSVSV

SEQ ID NO: 5035 - DNA, 1908 bp, Panicum virgatum
  misc_feature: Ceres CLONE 1814297
  misc_feature: Encodes the peptide sequence at SEQ ID NO. 5036
atctcggccttgtccaccaccggaggtccggagcggagccggagggaatggcggccactcttctcccgaccttatcgccggccgtttcccgcgccgccgccgctttcctccttctccgacgaggcccagcgaagtccctcccctccaccctccgccacttcgtcgcctccgtctcgtcctcctctccagcaaccccatcccctgccatccgtcccccctccaccgtggcgtcatcctccaccgtcgctcgcgccacccatgcccgccgcgacctcctcatgctcggcatagagacaagctgcgacgacactgcggccgctgtggttaggggcgacggggagatccttagccaagtggtatcttccgaagcagatttgcttgcgaggtatgggggtgttgctccgaagatggccgaggaagctcatgctcttgtgattgaccaggttgttcagaaggcacttgatgatgcaaaattgtcaggaagcgatctttctgctgtcgctgttaccgttggaccaggacttagtctatgccttagagttggtgtccacaaagcgagacaagtggcaaaatcatttggcttgcctattgttggagttcatcatatggaagcacatgcattagtttccaggctagtgaacaaggaccttgatttcccatttttggctcttctaatttcaggaggacacaatcttcttgttcttgctcatagccttgggcaatatgttcaactggggactactatagatgatgcgattggtgaggcatatgacaaaacagcaagatggttgggccttgatatgcgaaaaggtggtggtcctgctcttgaagagcttgctctagatggtgatcctgacgctgttaagttcagagttccaatgcaacaacataaagattgcaatttttcttatgctggtctgaagactcaagtccgattggcaattgaatctaagaatttaagcacagatgatattcccatttcatctgcatcagaggaagacagacaatcaagggcaaacattgctgcctcttttcagcgagttgctgtgttacatttggaagaaagatgccaacgagcagttgaatgggcattgaagattgaaccttccatcaaatactttgttgtttcagggggcgtcgcatcaaacaagtatgttagaactcgcctgaatcaagttgctgagaataacagactacaacttgtatctcctcctccaagcctttgtactgacaatggcgtcatgattgcttggactgggattgagcacttcattgcgggaagatttgaggacccacctgctgctgatgagcctgatgatacgcagtatgagctgcggccaagatggccgcttggtgaggaatattccgaaggaagaagtgttgcacgatcattgaagaccgctcgtgttcatccatcactaacgtcaatgatacagggctctcttcaaaagtagttcatttggaaccaattgttggtctcagctgcttgtacagtaagcgtttcttgtttggagaagaaaacaaaggtgctgtagttcgtcaaactgaagtgaagctatcgtcaaactggagttaatcagttgcaggttgtcgaagaatcctgctggtgctggccaagtgacacgtggcttgatttagtgtagtgtgtgtgtactgataggatgagtaacatggcttcaattgtttagttttttgcgtaaaagtggaataggatggtatgcttttggataaggtgcaacaggcaaataaaggagctgagtaggagccgtatattagttcggcattagattgtacacaatgtcctggaaagtctgcaatacaacctcgactggaaccacaatttacagtacaatcattaagcggtcgcgcgcgcgctcagtgtttcttgaaaaaaaaaaaaaaaaaaaa

SEQ ID NO: 5036 - protein, 468 aa, Panicum virgatum
  misc_feature: Ceres CLONE 1814297
  misc_feature (1)..(305): Pfam Name: Peptidase_M22 Pfam Description: Glycoprotease family
MAATLLPTLSPAVSRAAAAFLLLRRGPAKSLPSTLRHFVASVSSSSPATPSPAIRPPSTVASSSTVARATHARRDLLMLGIETSCDDTAAAVVRGDGEILSQVVSSEADLLARYGGVAPKMAEEAHALVIDQVVQKALDDAKLSGSDLSAVAVTVGPGLSLCLRVGVHKARQVAKSFGLPIVGVHHMEAHALVSRLVNKDLDFPFLALLISGGHNLLVLAHSLGQYVQLGTTIDDAIGEAYDKTARWLGLDMRKGGGPALEELALDGDPDAVKFRVPMQQHKDCNFSYAGLKTQVRLAIESKNLSTDDIPISSASEEDRQSRANIAASFQRVAVLHLEERCQRAVEWALKIEPSIKYFVVSGGVASNKYVRTRLNQVAENNRLQLVSPPPSLCTDNGVMIAWTGIEHFIAGRFEDPPAADEPDDTQYELRPRWPLGEEYSEGRSVARSLKTARVHPSLTSMIQGSLQK

SEQ ID NO: 5037 - DNA, 1345 bp, Panicum virgatum
  misc_feature: Ceres CLONE 1814324
  misc_feature: Encodes the peptide sequence at SEQ ID NO. 5038
acctaattccgagacggtgcagggtcctcccctcgaacagcaggtccacccaaccaccgctgcctgctgcattcagcccagatctcgcccccgccgcgcgatggccgccttccccgtcgcgcctccgccggccgcggcggacgacgagatcgtctacgagtccatgccctgcatccgcatctacaagaaccgcgtggagcgctacttcggctccgagttcgtcgccgcctccaccgacgccgccaccggcgtcgcgtccggggacgtggtcatctcccccaacgtctccgcgcgcctctacctcccgcgcctcggcgacggggccgccaagctccccgtcctcgtctactaccacggcggcggcttctgcctcggctccgccttcaaccccaccttccacgcctacttcaacagcttcgcggcgctcgccagcgtcctcgtcgtctccgtcgagtaccgcctcgcccccgagcaccccgtccccgccgcctacgccgactcctgggaggccctcgcctgggtcgtctcccacctcgccggcggcggcggggacccgtgggtcgcgggccacgccgacttcggccgcctctacctcggcggtgagagcgcgggctccaacatcgcgcaccacatggcaatgcgcgtcgccgcggaggggctgccccacggcgcccagatccggggcctcgtcatgatccacccctacttcctgggcaccgacaaggtgccctccgacgacctcgaccccgtggcgcgcgagagcctgggctccctgtggcgcgtcatgtgcccggccaccaccggcgaggacgacccgctcatcaaccccttcgtcgacggcgcgccgccgctggcgtccctggcttgcggccgcgtgctcgtgtgcgtcggcgagggcgacgtgctccgcgaccgcggccgcgcctactacgaccggctcagggccagcggctggcaaggcgaggcggcgatctggcaggcgcccaacaagggccacacgttccacctcctggagccgagctgcgccgaggccgtcgcgcaggacaaggtcatcagcgacttcctcaacagctgactcgcctcatcgtctcaccgccggcggtggcgtatacgcggcaatcggattgaataataactgcagcttcatcgccgatgaatgctgctgggctacactacttattgctagtctatttcagattcagaaattgtgtctctgttctttcaagggggatcgccattgttggtgttgtattgctttggaaattagggggacggtgatacagtcatagtgtcatacagatgaattatacttgttggacgcacagaaaaaaaaaaaaaaaaaaaa

SEQ ID NO: 5038 - protein, 324 aa, Panicum virgatum
  misc_feature: Ceres CLONE 1814324
  misc_feature (1)..(223): Pfam Name: Abhydrolase_3 Pfam Description: alpha/beta hydrolase fold
MAAFPVAPPPAAADDEIVYESMPCIRIYKNRVERYFGSEFVAASTDAATGVASGDVVISPNVSARLYLPRLGDGAAKLPVLVYYHGGGFCLGSAFNPTFHAYFNSFAALASVLVVSVEYRLAPEHPVPAAYADSWEALAWVVSHLAGGGGDPWVAGHADFGRLYLGGESAGSNIAHHMAMRVAAEGLPHGAQIRGLVMIHPYFLGTDKVPSDDLDPVARESLGSLWRVMCPATTGEDDPLINPFVDGAPPLASLACGRVLVCVGEGDVLRDRGRAYYDRLRASGWQGEAAIWQAPNKGHTFHLLEPSCAEAVAQDKVISDFLNS

SEQ ID NO: 5039 - DNA, 1713 bp, Panicum virgatum
  misc_feature: Ceres CLONE 1814357
  misc_feature: Encodes the peptide sequence at SEQ ID NO. 5040
agagagcgcgtggcgtggcacgtatggggcaagaggcagccgtcgtggcagcgaacggcgccggcgccggcagcagcaagccgcacgccgtggtggtggcgtacccgctgcaggggcacgtcatcccggcggggcacctggcgctgcgcctcgccgagcgcggcttcgccgtcaccttcgtcaacaccgagtccgtgcaccaccggacggcgcgcgcgctgggcggcggcgccggcgacatcttcgcgggcgtgcgcgcgcgcggcgaggggctggacctgcggtacgagctggtgagcgacggcttcccgctggggttcgaccggtccctgaaccacgaccagttcatggagggcctcctgcacgtgctcccggcgcacgtcgaggagctcctccgccgcgtcgtcaaagacccggccaccacctgcctcgtcgtcgacaccttcttcgtctggccggccacgctggcccggaagctgggggtcccctacgtgtccttctggacggagcccgcgctcatcttcaacctctactaccacatggacctgctcgccgagcacggccacttcaaatgcaaagagcctcgcaaggacacgatcacgtacatccccggcgtggcgtcgatcgagccgggcgagctcatgtcgtacctgcaggagacggacaccacctccgtggtgcaccgcatcatcttcaaggcgttcgacgaggcccggcgcgccgactacgtgctgtgcaacaccgtggaggagctggagccgtcgaccatcgccgcgctgcgcgccgccggcaagcccttctaccccgtgggccccatcttcccggcggggttcgcgcgcagcgccgtggccacgtccatgtgggccgagtccgactgctcccgctggctggccgcgcagccgccggggtccgtgctctacgtctccttcggcagctacgcgcacgtgacgcgccgggatctgcacgagatcgcggccggggtgctcgccagcggcgcgcggttcctgtgggtgctgcgcccggacgcggtgagctccgacgacccggacccgctccccgaggggttcgcggcggcggcggcggcggggcgcgggctggtggtgccctggtgctgccaggtggaggtgctctcgcacgccgccgtgggcgcgttcctcacgcactgcggctggaactccgtcctggagagcgtgtgggcgggcgtgccgatgctgtgcttcccgctgctcacggaccagatcaccaaccgccgcctcgtcgcgcgggagtggcgcgccggcgtctccatcggggaccgcggcgcggtggccgccgacgaggtgagggcgcggatccagggggtgatgggcggggaggagggcgagaagctcagggagcaggtgcggaagctcagggccacgctccaggccgccgtggcacccggcggctcgtcgcggagcaacttcgacgagttcgtcgacgtgctgaagcgccgctgcggggggcactaaggatcagagctacccggtcgaggaagcagcctagccgcgccaagtctatctggaacacgtgggcatgtactatcatgtgtagctgttgtatcctccagtgtaccgtcgaacataaactggctcgatcgaagcgttgtgagtacggtcggccattgttgtgcaggttcgatgtcaatatatacgtatgccaataacctttggtcaaaaaaaaaaaaaaaaaaaa

SEQ ID NO: 5040 - protein, 488 aa, Panicum virgatum
  misc_feature: Ceres CLONE 1814357
  misc_feature (2)..(129): Pfam Name: UDPGT Pfam Description: UDP-glucoronosyl and UDP-glucosyl transferase
MGQEAAVVAANGAGAGSSKPHAVVVAYPLQGHVIPAGHLALRLAERGFAVTFVNTESVHHRTARALGGGAGDIFAGVRARGEGLDLRYELVSDGFPLGFDRSLNHDQFMEGLLHVLPAHVEELLRRVVKDPATTCLVVDTFFVWPATLARKLGVPYVSFWTEPALIFNLYYHMDLLAEHGHFKCKEPRKDTITYIPGVASIEPGELMSYLQETDTTSVVHRIIFKAFDEARRADYVLCNTVEELEPSTIAALRAAGKPFYPVGPIFPAGFARSAVATSMWAESDCSRWLAAQPPGSVLYVSFGSYAHVTRRDLHEIAAGVLASGARFLWVLRPDAVSSDDPDPLPEGFAAAAAAGRGLVVPWCCQVEVLSHAAVGAFLTHCGWNSVLESVWAGVPMLCFPLLTDQITNRRLVAREWRAGVSIGDRGAVAADEVRARIQGVMGGEEGEKLREQVRKLRATLQAAVAPGGSSRSNFDEFVDVLKRRCGGH

SEQ ID NO: 5041 - DNA, 1601 bp, Panicum virgatum
  misc_feature: Ceres CLONE 1814374
  misc_feature: Encodes the peptide sequence at SEQ ID NO. 5042
agcctagcattgccatcacgctcagataaccaaccaaccatggtcaacttctccgatcaccgcatccacatcctcgtcctgccgtacccgtcccagggccacatcaacccgctcttccagttcgccaatctcctcgccggccacggcggcgtccggtgcacccttgcgctgacccgcttcgtcgccacctcggcgagcaggccggccaccggctccgtccacgtcgccgtcatctccgacggctgcgacgacgtgggccccgacggcgtcggagggcaccggggcccctacttcgaccggctaaacgccgccgggcccgagtccgtggaccggctcctccgggcggaggcggagctggggcggccggtgcacgtcgtggtgtacgacgcgttcctcccgtgggcgcagggcgtcacgaggcgccgcggcgcggcttgcgccgcgttcctcacgcaggcgtgcgccgtcgacgtgctgtacacgcacctgcgcgccggcaggatcccggcgccgccggtgcgggaggaggagttgccgccggagctgcccgggctgccgtcccgactcgagctgaccgacctgccgacgttcatggtcgacaagaaccgtcccccgggtctcctggagttgctgatgaaccagttcctggggctgcacaccgtggaccaggttcttgtcaattcgttctacgacttggagccacaggaagcggattacgtggcgtctacgtggggtgccaagacggttggcccaaccatgccatccgtgtaccttgacaaccgccttccaaacgatgcatcctgtggcatccatctccacaccccaaagacgtcacaaagcaaggcgtggctggacgcccacccctcgctctccgtcgtgtacgtctccttcggcagcatagcctccctgagctccaaacagatggccgaaatagccgaaggcctccgcaacagtggcaagcccttcctgtgggtcgttcgggccaaggagacttggaagctacccgcaaccttcgccgacgaggtaaaagataggggtctcatcgttccatggtgctcgcagctggaggttctagcgcacccgtccatcgggtgcttcgtgacgcactgcgggtggaactcgacattggaggcgatcagcgctggtgtgcccatggtggcgatcccgcactggtcagaccagccgacgaacgccaagtatgtccaggatgtttggcgtgtcggcgtacgggtgcgtccagattcccaaggggtgatgaggagggaggaggtcgagatgtgtgttcggcaggtgatggaaggagagatgcgcaaggagttcaaaaagagggctttggagtggagcaacaaggccaagaaggccatgggtaaaggtggcagctcagacatcaacatctcagatttcctctccaagtttgggcaccacaaataatcagctctgataatgcggcgtttcatatcatcatatgtatgtttccttcaaaatgggtgtgacttgtaacaaccttgagtgataagaaaatgcatttagtttgcatgctgtaaagtgattctatatcataatcttaaaaaatatgcttctaaaaaaaaaaaaaaaaaaaa

SEQ ID NO: 5042 - protein, 463 aa, Panicum virgatum
  misc_feature: Ceres CLONE 1814374
  misc_feature (5)..(166): Pfam Name: UDPGT Pfam Description: UDP-glucoronosyl and UDP-glucosyl transferase
MVNFSDHRIHILVLPYPSQGHINPLFQFANLLAGHGGVRCTLALTRFVATSASRPATGSVHVAVISDGCDDVGPDGVGGHRGPYFDRLNAAGPESVDRLLRAEAELGRPVHVVVYDAFLPWAQGVTRRRGAACAAFLTQACAVDVLYTHLRAGRIPAPPVREEELPPELPGLPSRLELTDLPTFMVDKNRPPGLLELLMNQFLGLHTVDQVLVNSFYDLEPQEADYVASTWGAKTVGPTMPSVYLDNRLPNDASCGIHLHTPKTSQSKAWLDAHPSLSVVYVSFGSIASLSSKQMAEIAEGLRNSGKPFLWVVRAKETWKLPATFADEVKDRGLIVPWCSQLEVLAHPSIGCFVTHCGWNSTLEAISAGVPMVAIPHWSDQPTNAKYVQDVWRVGVRVRPDSQGVMRREEVEMCVRQVMEGEMRKEFKKRALEWSNKAKKAMGKGGSSDINISDFLSKFGHHK

SEQ ID NO: 5043 - DNA, 2362 bp, Panicum virgatum
  misc_feature: Ceres CLONE 1814413
  misc_feature: Encodes the peptide sequence at SEQ ID NO. 5044
aaaaaatctttcccgccatttcgtcccgccatttcccaccgccccgcctcgctcgggccccagattcctcgccttcctccctccccccaaccccacgccgccgggccaccacccccacctcgactgcgcaagcgagtgaacagcggcagggcgatggaggcagagatccgcgccgagttcgagagcagcggcttctccatcgggggcgccggccccgaggacgccgccgagatcctctccacgctgctgacctactgcatcaactacaagatgagccccgcggacctcgtctccaactgggaggtctactacctcaacaggcaattggatggcttaaagctcgaaaggtcatatcttgatggttttctttcacaccttcaaaatgaagttaaagagaggctaatagaagaagaggccaaccttcacgtttactccagtaacgatgttgacatgctccttaacaattcacatgcagatgaagcggcatttcttgacacaccaggctctaaacaggagaagccgcctggagaatcatctaacactgagttgactcctctgacaaacgacagaccatcatccagcagaatggccaaaacaaatggtgaccggatcaccccttttgccacacgagtaaataaatttactcaacagtatgttcttaattctggtaatgcggctagcatgccaaggaatcatgaggctgaaaccacagaagatgaactaattagaagaattcagccaagtcaaagatgttccttacaagttcagcgctcgcagcctgaaccaggttgcaggttcatgtatgacagaatggaagacagatttaactacttggaggatcggatacgaaaatcggcaaccttgttttctgcatctgggttatgtggagaacctgcagatgctacccttgcttcagaggacaaaatgttcgcagtcggcatggtaacctgtgatggggaaggtcgtctgaatgaaaaatctatcttgctacagggcagtgttgagcactcaaggggagagcgtgtgcgccttgacttgaaggatctcgatcacttctctttgtttcctgggcaggtggtgggtattgaaggccgcaatcccagtggacactgtttcgttgcatcaaaattgattgattcgataccagtctctgtggatgctcaacttcctagtgctaagaaacaagctgttgataatggaagccaccaccaaaattctgacgttggcactctgtcaagagaattgtcatcggtcatcgcggcaggtccctacacaacaaccgataatctgttgtttgagccattgcaagaacttctttcatatgcttgtcgtaagcagcctcaactgctcatattgatgggaccctttgttgactctgatcatcctgacataaaaaagggaactgttgaccagtcctttcatgatattttctattctgaggttctgagaaagattcaagactttacccaatatttggggaacactgttcgtgtaattctcattccatctgtgcgtgatgctcaccatgactttgttttccctcagcctgcatttgacttgaatttaccagaagatatcacacatcagatttcttctctggcaaatccaagtttattcagttctaaccagatacatttcggctgttgtacagtggacatcctgaaacagatcagtggtgaggaaatttctcgcaagccacccggtggaaagcctggcgacaggattgggcgactagcaacgcacatattaaagcaacagagctactatcctctatatcctcctgctggtggtgtgccattggacttctcacttgctaaggaagccctggagatctcatcgactccagatgttctcctgcttccttccgatcttgctccatttgtgaaggtgctctcccttggggaaggcagcgatgatcaaaaacagtttatttgcttgaaccctgggaggttggcaaagggtattggtgggggtacattcgtggagctttactacaatgaggacaccagcaggacaaatgcctccatcatccgtatatagttttaccggcaccgcatatcacctgacatgaaaagaggctgatccttctgctgtggaaaatgtaccaaaggtttgtggtcttatttgccaccagtgccagtaaggattgtagtgctcagatttatttttgtggcaagcattgttggtgacatgtaaattttgcacggaaagccatctcatgcctgtcatcatttagcgcatggcggcatttctgttgtaaccaagtactgactagaagattgacattattgtcaactaaagaactgatttgatcatttcccagttttttcgtcctattgtataaaaaaaaaaaaaaaaaaaa

SEQ ID NO: 5044 - protein, 628 aa, Panicum virgatum
  misc_feature: Ceres CLONE 1814413
  misc_feature (1)..(177): Pfam Name: DNA_pol_E_B Pfam Description: DNA polymerase alpha/epsilon subunit B
MEAEIRAEFESSGFSIGGAGPEDAAEILSTLLTYCINYKMSPADLVSNWEVYYLNRQLDGLKLERSYLDGFLSHLQNEVKERLIEEEANLHVYSSNDVDMLLNNSHADEAAFLDTPGSKQEKPPGESSNTELTPLTNDRPSSSRMAKTNGDRITPFATRVNKFTQQYVLNSGNAASMPRNHEAETTEDELIRRIQPSQRCSLQVQRSQPEPGCRFMYDRMEDRFNYLEDRIRKSATLFSASGLCGEPADATLASEDKMFAVGMVTCDGEGRLNEKSILLQGSVEHSRGERVRLDLKDLDHFSLFPGQVVGIEGRNPSGHCFVASKLIDSIPVSVDAQLPSAKKQAVDNGSHHQNSDVGTLSRELSSVIAAGPYTTTDNLLFEPLQELLSYACRKQPQLLILMGPFVDSDHPDIKKGTVDQSFHDIFYSEVLRKIQDFTQYLGNTVRVILIPSVRDAHHDFVFPQPAFDLNLPEDITHQISSLANPSLFSSNQIHFGCCTVDILKQISGEEISRKPPGGKPGDRIGRLATHILKQQSYYPLYPPAGGVPLDFSLAKEALEISSTPDVLLLPSDLAPFVKVLSLGEGSDDQKQFICLNPGRLAKGIGGGTFVELYYNEDTSRTNASIIRI

SEQ ID NO: 5045 - DNA, 1429 bp, Panicum virgatum
  misc_feature: Ceres CLONE 1814472
  misc_feature: Encodes the peptide sequence at SEQ ID NO. 5046
acgcactccagatccgcccaccaccgccaccgccgtccaccacgccctgccccaaatccgccgcgagagcgagaggaccggccccccgcgcgagagcgatggcgacgctccagcaccagccgaagccggcggcggcgccgtcgacgaccacgggcggagagctgcgcgccatggacctgtacgagaagctggagaaggtgggcgagggcacgtacgggaaggtgtacaaggcgcgggagaaggcgacgggccggatcgtggcgctgaagaagacgcggctccccgaggacgacgagggcgtgccccccaccgcgctgcgggaggtctcgctgctgcggatgctgtcgcaggacccgcacgtggtgcgcctgctcgacctcaagcagggcgccaacaaggagggccagaccatcctcttcctcgtcttcgagtacatggacaccgacctcaagaagttcatccgggggcaccgcgccaaccacgagaagatccctgcgctcaccgtcaaggtcctgatgtaccagctgtgcaagggtgtggccttcgtccacggccgcggggtgctgcaccgcgacctcaagccgcacaacctgctcatggaccgcaagaccatggcgctcaagatcgctgacctcggcctcagccgcgccatcaccgtccctttgaagaagtacacccacgagatcctgaccctgtggtacagggcacccgaggttctgcttggcgccactcactacgccacgccggttgacatctggtccgtgggctgcatatttgctgagttggtcactaacaacccactattccccggggactcagagttgcagcagctcctgcacatcttcaagctgcttggcaccccgaatgagcaggtgtggccaggcgtcggcaagctccccaactggcacgagtgcccgcagtggaagcccacgaagctgtccactcttgtccccggtctcgacgaagacggctacgacttgcttgggaaaatgctcgagtacgcgccggcgaggcggatctctgcgaagatggccctgaagcacccgtacttcaatgatgtgaacaaggagcagtactgaagcgatgcgagaagcaggaatcaggaatccgctgcgagccttcatgagttggcatgaaggtgaagctgcttcttgtataagctaattcttggccttgttggtgtgcaacttgattgccctgaagcagtgcttttgcttccaggacagcagtagtaatagtagtagtagaagaagagtatgtctgttttctagtacctgctttcttcctgtgctgtggcattcactttggttgtgatggataaactagaaagaagttcaacataaagtgaactagtattgacgagttttttttttcgcgaacgtgactgagtacttattttgttaagagcgaaaaaaaaaaaaaaaaaaaa

SEQ ID NO: 5046 - protein, 326 aa, Panicum virgatum
  misc_feature: Ceres CLONE 1814472
  misc_feature: Great-hit functional homolog of the protein sequence given in SEQ ID NO 9249
  misc_feature (24)..(323): SWISSPROT Homolog: EC 2.7.11.22 Cell division control protein 2 homolog D
  misc_feature (25)..(326): SWISSPROT Homolog: EC 2.7.11.22 Cell division control protein 2 homolog B
  misc_feature: Useful for making plants with modulated nitrogen use efficiency
MATLQHQPKPAAAPSTTTGGELRAMDLYEKLEKVGEGTYGKVYKAREKATGRIVALKKTRLPEDDEGVPPTALREVSLLRMLSQDPHVVRLLDLKQGANKEGQTILFLVFEYMDTDLKKFIRGHRANHEKIPALTVKVLMYQLCKGVAFVHGRGVLHRDLKPHNLLMDRKTMALKIADLGLSRAITVPLKKYTHEILTLWYRAPEVLLGATHYATPVDIWSVGCIFAELVTNNPLFPGDSELQQLLHIFKLLGTPNEQVWPGVGKLPNWHECPQWKPTKLSTLVPGLDEDGYDLLGKMLEYAPARRISAKMALKHPYFNDVNKEQY

SEQ ID NO: 5047 - DNA, 2075 bp, Panicum virgatum
  misc_feature: Ceres CLONE 1814569
  misc_feature: Encodes the peptide sequence at SEQ ID NO. 5048
cacttattccccccgcaccccggcgtcactcccccttccccctctctcgcggagccgccgcaaccagcgcaagtctaaccctagatccggaccgctctccggcgatctccggtcatggcgtcccgccgggtcgtctcctccctcctccgctccgcctcccgcatcagggcggcctcacccgccgtgccgcgcccgcgcgcgccgccgcaccgcccgtccccggcagggtacctcttcaaccgcgccgccgcctacgcctcgtccgccgcggcccaggagaagcccgccgccccgccgccggccaccgggaagaccgggggcggcaagatcaccgacgagttcaccggcgccggcgccatcgggcaggtgtgccaggtcatcggcgccgtcgtcgacgtgcgcttcgatgagggcctcccgcccatcctcaccgcgctcgaggttcttgacaacaacatccgcctcgtgctagaggtggcgcagcaccttggcgagaaaatggtgcgcaccatcgctatggacgggactgaggggctcgtccgcggccagcgcgtcctcaacaccggctcccccatcaccgtgcctgttggcagggctacacttggacgcattatgaatgttattggtgagccaattgatgagaagggtgacataacgacaaaccacttcctcccgatccatcgtgaagcccctgcatttgttgagcaagccactgagcagcaaattcttgttacaggaattaaggttgtggatcttcttgcaccctaccaaaggggaggaaagattggtctttttggtggtgcaggagtgggtaaaactgtacttattatggagttgatcaacaatgtcgctaaggcccatggtggtttctctgtgtttgctggtgttggagagcgtacccgtgaaggtaatgacctgtacagggaaatgattaaaagtggtgtcattaagctaggtgacaagcagagcgaaagcaagtgtgctcttgtctacgggcaaatgaatgagcccccaggtgctcgtgctcgtgttgggctgactggtttaactgtggctgaacatttccgtgatgctgaaggacaagacgtgcttctgtttattgacaacattttccgcttcactcaggcaaactctgaggtgtctgctcttcttggacgtattccctctgctgtggggtaccagccaacccttgcaactgatcttggaggactgcaagagcgaattacgacaacaaagaagggttctattacttctgtccaagctatctatgtgcctgctgatgatttgacagatcctgctcctgctactacctttgcccatcttgatgccacaactgtgttgtcacgacagatatctgagcttggtatctatcctgctgttgacccactggattccacatccagaatgctttctcctcatgtgctgggtgaggatcactacaacactgctcgtggtgttcagaaggttcttcagaactacaaaaatcttcaggatattattgccattttgggtatggatgagctaagtgaagatgacaagctgacggtcgcacgtgcgaggaagattcaacgtttcctgagccagcctttccatgttgctgaagttttcacgggtgctcctgggaagtatgtggagctcaaggagagtgttaagagtttccagggtgttttggatggtaagtacgatgaccttcctgagcagtcattctacatggtgggaggcattgaggaagtcattgctaaggctgagaaaatcgcaaaggagtctgcttcataaggaggcttcttgattgttgaacctcttgtacaagttccatttttggatttttaagcaaatgttcttcgcagttaggcaggacgagctggagagccatctcctgctgagggatgcatgttttgttttttgttcctccactttacaaccaaataagcaacagcagtgacattgattttggctgcactgaaattacatgactccagaaacttgtgcccgttgtaatgcagatccatcagaccatgaagttatggcgtctggttggtaaattatgtcatctccaaaaaaaaaaaaaaaaaaaa

SEQ ID NO: 5048 - protein, 553 aa, Panicum virgatum
  misc_feature: Ceres CLONE 1814569
  misc_feature (1)..(223): Pfam Name: ATP-synt_ab Pfam Description: ATP synthase alpha/beta family, nucleotide-binding domain
  misc_feature (1)..(553): SWISSPROT Homolog: EC 3.6.3.14 ATP synthase subunit beta, mitochondrial precursor
MASRRVVSSLLRSASRIRAASPAVPRPRAPPHRPSPAGYLFNRAAAYASSAAAQEKPAAPPPATGKTGGGKITDEFTGAGAIGQVCQVIGAVVDVRFDEGLPPILTALEVLDNNIRLVLEVAQHLGEKMVRTIAMDGTEGLVRGQRVLNTGSPITVPVGRATLGRIMNVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIKSGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 5049 - DNA, 996 bp, Panicum virgatum
  misc_feature: Ceres CLONE 1814614
  misc_feature: Encodes the peptide sequence at SEQ ID NO. 5050
ggagcagcgagcgaggcctcggccgaaatatcttctccaccccgaagaaaaaagaaagcctcggtggtcgcggctgccgccggcgagagtcacgagcacgggacgatggcttgctgccgggccctcgcgctccacctcctccccgcgtccgctccctccctccgcgctccccgcgcccggattggcgcccaccggccccgcccttctctcgtccggtgctacgccgccgcgggcgaccaggcggagccgccgcaggacaccgttctcaaggccatctctcagatagcaagctctacaggaagggttgcacaaacaacaaatgttgtcatgggtggtactgtaacagatgacgcaacagatgaatggcttgttcttgataaaaaggtaaatacatatcctacagttagagggtttacagcaattggtacaggaggtgatgatttcgtccagtcaatggttgttgctgttgaatcagttattgaagaaagtattcctaagggtcaaatatcccaaaaagtgtctgcaaaggggaaatatgtgtctgtcaaaattggacctatccgtgtggtttccagcgagcaggtccaagcggtgtacaatgccatgaagaaagatgtgcgcatgaaattctttttgtgaatgacaaataggttggagtgttgtacatcgaatggctgaatcgtgaagatatcctggctctgcatgagtaaatgcttgcaagcagagttgcttgcatttcacgcggcatcatcctcttgttggcgaggtaatttgtgaaggactaatatgacatcattgacatgccagccagggaggggattagtggtccgatccatcatctactggagttagttccgttccgtcagatgtagctcgagattagatttggagacgtttcaatgttcaaagcatcacaattgtgttgtaattaacggtggacatagaaacaagtatagaatggaatgggcaatgcatcaaaaaaaaaaaaaaaaaaaa

SEQ ID NO: 5050 - protein, 177 aa, Panicum virgatum
  misc_feature: Ceres CLONE 1814614
  misc_feature: Great-hit functional homolog of the protein sequence given in SEQ ID NO 9554
  misc_feature: Useful for biocontainment applications
  misc_feature: The plant produces a reduced number of seeds.
MACCRALALHLLPASAPSLRAPRARIGAHRPRPSLVRCYAAAGDQAEPPQDTVLKAISQIASSTGRVAQTTNVVMGGTVTDDATDEWLVLDKKVNTYPTVRGFTAIGTGGDDFVQSMVVAVESVIEESIPKGQISQKVSAKGKYVSVKIGPIRVVSSEQVQAVYNAMKKDVRMKFFL

SEQ ID NO: 5051 - DNA, 1648 bp, Panicum virgatum
  misc_feature: Ceres CLONE 1814647
  misc_feature: Encodes the peptide sequence at SEQ ID NO. 5052
accaagcaccggcgtagtaagctctacctgataattaatttagtttttggccaccgcgccggggccatggaaagaacaatattgataatgaaggccgccgccgccgccgtcgcggtgctcctcgccgtcgcggtgctcctcgccgtcgcggtgctcgccgccgaggcggcggcgccgcaccaccagtacccgcgcggggtgacgagcacgtaccgtcggaagctggaggcctccgaggacatgccactggacgcggacgtgttcgccgtgccgccgggccgcaacgcgccgcagcaggtgcacatcacgctgggagaccaggccggcacggccatgaccgtgtcctgggtcaccatggaggccgagggcaacagcaccgtcctctacggccgcgccgtgggccgcctcgacctcgccgccgagggcaccaccacgcgctacaccttctacaactacacctccggcttcatccaccactgcacgctcaccggcctggaccacgccacccggtactactacgccgtggggcacggcgacacggtgcgcaccttctggttcaccacgccgccccgcccgggtcccgacgcgccgctccgcctggggctcatcggcgacctgggccagacggccgactccaacgccacgctggcgcactacgagcagcaccccggcgccgccgtgctcttcgtcggcgacctctcctacgccgacaagcacccgctccacgacagcaggcgctgggacacctggggccgcttctccgagcgcagcgtcgcgtaccagccctggatctggacggccggcaaccacgaggtggagtacgcgccggagctgggggagacgacggcgttcaagcccttcgcccaccgctacccgacgccgtaccgcgcgagcgggtcgtcggagccgtactggtactcggtgaagctggggccggcgcacatcatcgttctctcctcctactcggccttcggcaagtacacgccgcagttcaagtggctggaggcggagctcgcccgcgtcgaccgcgagctcacgccgtggctcttcatcagcacgcacgtgccctggtacaacagcaacaacttccacttcatggagggcgagccgatgcgcgtgcagttcgagaagatggccgtcgacgcccgcgttgacgccgtcttcgccggccacgtccacgcctacgagcgcagccaccgcttctccaacatccagtacaacatcaccgacggcaggtgcacgcccgtcgccgaccgccgcgcgcccgtctacgtcgtcatcggcgacggcggcaacatcgaggggctcgccgacgagctcacgtggccgcagccggcctactcggcgttccgggagtacagcttcaggcacgccgtgctggacatcaagaaccgcacgcacgcctactacgcctggtaccgcaaccacgacggcaacaaggtcacggcggacgccacctggttcaccaatcgctaccacatgcccaaccacgacgacgcctccgtctcaaaaaccccctactacgcgtaatacaattatatatatataaatttcccgagctgcaggaaaattaattaattaattaattgtgctgcatatatatttatctagtacccaataataaccatggacatgagatgtgcacttg

SEQ ID NO: 5052 - protein, 487 aa, Panicum virgatum
  misc_feature: Ceres CLONE 1814647
  misc_feature (2)..(198): Pfam Name: Metallophos Pfam Description: Calcineurin-like phosphoesterase
  misc_feature (44)..(470): SWISSPROT Homolog: EC 3.1.3.2 Iron(III)-zinc(II) purple acid phosphatase precursor
  misc_feature (44)..(481): SWISSPROT Homolog: EC 3.1.3.2 Purple acid phosphatase precursor
MERTILIMKAAAAAVAVLLAVAVLLAVAVLAAEAAAPHHQYPRGVTSTYRRKLEASEDMPLDADVFAVPPGRNAPQQVHITLGDQAGTAMTVSWVTMEAEGNSTVLYGRAVGRLDLAAEGTTTRYTFYNYTSGFIHHCTLTGLDHATRYYYAVGHGDTVRTFWFTTPPRPGPDAPLRLGLIGDLGQTADSNATLAHYEQHPGAAVLFVGDLSYADKHPLHDSRRWDTWGRFSERSVAYQPWIWTAGNHEVEYAPELGETTAFKPFAHRYPTPYRASGSSEPYWYSVKLGPAHIIVLSSYSAFGKYTPQFKWLEAELARVDRELTPWLFISTHVPWYNSNNFHFMEGEPMRVQFEKMAVDARVDAVFAGHVHAYERSHRFSNIQYNITDGRCTPVADRRAPVYVVIGDGGNIEGLADELTWPQPAYSAFREYSFRHAVLDIKNRTHAYYAWYRNHDGNKVTADATWFTNRYHMPNHDDASVSKTPYYA

SEQ ID NO: 5053 - DNA, 1588 bp, Panicum virgatum
  misc_feature: Ceres CLONE 1814656
  misc_feature: Encodes the peptide sequence at SEQ ID NO. 5054
aagcaaacgaacaaacaaacaaaaacagagcgagaggagagatttcatagcgcttcctagttgcgtgttctagtgtgctacgcatgctgctaaagatttcaagaaagtccctacaatcatgagcggatttggttagagcgggcaaagacaagagaaatgatgtgttgaggcagctaacttccaagcatcggtcacactcaccatttccatctttcctcttcttcgccggcgccagcccccgcatcgccgaacctcccgcacgccggccggagaattcatccagacgtggcattgagcgaatccttttcctgctctgtcagctaattgcgggttcttctcctgcggtcttgcggaaggcatggcggggttcggatggagagtcggttccaaggtgcagagatggggtcggagcttcttccggggcttctcttctgcttcgattccgtctcagctggagaatgtaggattcattggactcgggaatatgggatcccatatggcaaggaacctgattacggctggatataaagtgactgttcatgatataaatgaaaattcgatgaagaaattctcagatgatggaatccccacaaagcagtctccacttgaagtttcagagtcgagtgatgtcgtgattaccatgcttccttcctcttcccatgttttagaggtatacaatggaactaatggcttgcttggtggtggtagccaccttggaccttggttatacatagactcatctacagttgatccgcaaacatcaagaaagatatcgacggccatatcaagatgccatttaaaggaaaataaaggctacgttgaaaacccattgattctggatgctccggtttctggaggtgttcctgctgcagaagctgcgaagctaactttcatggtaggaggtctagaggaagcatatttagcagccaagcccctacttctctcaatggggaaaagggcaatctactgcggtggggctggaaatggctcggctgcaaagatctgtaacaacatggcaatggcgatcagcatgcttggggtctcagaagcctttgctcttggtcagaatcttgggatcaaagcaagcactcttacagacattttcaattgctcgagtgctcgctgctggagtagcgacacatataacccagttcccggagttatggagggcgtgccatcatcgaggaactatgacggtggtttcacctccaaactaatggctaaagatttggatttggccatggcctctgcatctggagtcggcttcaaatgtcccatgggctctgaggcacttgaaatttaccgaaagctctgcggggattgctgcgaactcaaggacttctcatgtgtattccaccattactatgctggcaaggatgaagagtgacctgctagttactctagcaaacttgccgcttgttcaaatgaataaaacaaaaataaagtttctggaatggttccattgtaaatctgtagagttgtactgagatggtggctttgtaaactgtttgttggtttgcttctcggcaatggcaatagactgttcgagacatctttaactatgatccaagaactgccagttttcagc

SEQ ID NO: 5054 - protein, 342 aa, Panicum virgatum
  misc_feature: Ceres CLONE 1814656
  misc_feature (1)..(176): Pfam Name: NAD_binding_2 Pfam Description: NAD binding domain of 6- phosphogluconate dehydrogenase
MAGFGWRVGSKVQRWGRSFFRGFSSASIPSQLENVGFIGLGNMGSHMARNLITAGYKVTVHDINENSMKKFSDDGIPTKQSPLEVSESSDVVITMLPSSSHVLEVYNGTNGLLGGGSHLGPWLYIDSSTVDPQTSRKISTAISRCHLKENKGYVENPLILDAPVSGGVPAAEAAKLTFMVGGLEEAYLAAKPLLLSMGKRAIYCGGAGNGSAAKICNNMAMAISMLGVSEAFALGQNLGIKASTLTDIFNCSSARCWSSDTYNPVPGVMEGVPSSRNYDGGFTSKLMAKDLDLAMASASGVGFKCPMGSEALEIYRKLCGDCCELKDFSCVFHHYYAGKDEE

SEQ ID NO: 5055 - DNA, 1934 bp, Panicum virgatum
  misc_feature: Ceres CLONE 1814690
  misc_feature: Encodes the peptide sequence at SEQ ID NO. 5056
atccgtgatcattcacctgtccctgtcccctctctcccttttctccctgcgaccaatccgcgcgcagcgtgctcgttcctcctcctcctcgagccgcggcaggcatggagggcgacggcaaggaggccgcgggcaagggcctcgactgggccgccatgaacctcgagggcggcggcggcggcgccgagaagggcgacggcaatgcgacccggaggccggggatgggcatcgtccggctcttcctcgcctgcatggtctccggcggcatccagtacggctgggcgctccagctctccctcctctcgccatactctcagactcttgggatctcgcacagctacgtctccctgacatggatctgcggccctatcgccggatttgtggtgcaacccatcgtcggctactacagcgaccggtgcacggcgaagctcggccgccggcggcccttcatcctcgccggatgcgtcatcatctgcctctctgtgctgatgatcggcttctcggcggacatcggccgccacctcggcgacaccaaggagaactgcagcacgttcaccggcgcccggtggtccgccgccgccgtctacatcgtgggcttctggttcctcgacttcgccaacaacaccgtccagggacctgctcgcgcgatgatggctgacctttccgccggacagcacggccccaacgttgggcaggcgatcttctccctgtggatggctctcggcagcgtcctcggctacctgtccggcgccaacgcgaaatggcacgagtggctcccatggctcaagaccgccgcgtgctgcgacgcctgcgcaaatctcaagggcgccttcttgaccgctgtgatcctcatcattatcagcatgtcggtcaccttggccctcgccggcgaggagcagctcggcaaggacaacgtcgacgcctcctccggcggcgcgtgctccgcgttcgtcgacctcttcaagagcctcaggaacctcccccctgccatgttcaaggtgctcgccgtcacggccgtcacctggctctcgtggttccccttcttccagtacaacacggactggatgggccgggagatctaccacagcgagccgcagggcctgggcggcaaggcggacgccttcaacgccggcgtccgcgagggcgccgtcgggctcctcttctgctccatcgcgctgggcgtcacctcgttcctcatccccaagctgtgccggaagctcacgtcccgggtcgtctggtccatcagcaacctcatggtgttcgtcatcatgaccgtcatggtcgtcctcggcatcatctccatgaagggctacaagccctccctcaccgccggcctcctcggccccgactcgaccttcaggggcatcgcgctcgccctcttcgccctcatcggcatcccgcaggccgtgctgttcagtgtcccatgggccgtggcgtctgaggtcgccaccgaggaaggaggaggccaaggcctcaccattggcgtcctcaacatcgccatcgtccttccacagctggtgatcgcgctcaccgccggccccatcgacggcgtcttcaacaagggcaacaccccggccttcggcatcggcgccgccttcgccctgatctgcgcggtcctgtcgatgatcctgctccccaagacgagaggggtgtccaacgccaccgtcatggcgggcgggcactgacctccgccacacagcggcagggaccgagagtgggtcggaaatccggcatctgcatctcggttttctgcggcacctgatccaacatattatgcaaggaaaaaaaaaggaagtaaacaagcaggaaggcagggttagttggtgtgatgataatcccgggagtgttgtcaatgtcaaggactcgagtctgctcgtacatcagcctctgttgggcctcatgtttatccgcgttaaaaaaaaaaaaaaaaaaaa

SEQ ID NO: 5056 - protein, 526 aa, Panicum virgatum
  misc_feature: Ceres CLONE 1814690
  misc_feature: Great-hit functional homolog of the protein sequence given in SEQ ID NO 9391
  misc_feature: Useful for making plants with modulated heat sensitivity
MEGDGKEAAGKGLDWAAMNLEGGGGGAEKGDGNATRRPGMGIVRLFLACMVSGGIQYGWALQLSLLSPYSQTLGISHSYVSLTWICGPIAGFVVQPIVGYYSDRCTAKLGRRRPFILAGCVIICLSVLMIGFSADIGRHLGDTKENCSTFTGARWSAAAVYIVGFWFLDFANNTVQGPARAMMADLSAGQHGPNVGQAIFSLWMALGSVLGYLSGANAKWHEWLPWLKTAACCDACANLKGAFLTAVILIIISMSVTLALAGEEQLGKDNVDASSGGACSAFVDLFKSLRNLPPAMFKVLAVTAVTWLSWFPFFQYNTDWMGREIYHSEPQGLGGKADAFNAGVREGAVGLLFCSIALGVTSFLIPKLCRKLTSRVVWSISNLMVFVIMTVMVVLGIISMKGYKPSLTAGLLGPDSTFRGIALALFALIGIPQAVLFSVPWAVASEVATEEGGGQGLTIGVLNIAIVLPQLVIALTAGPIDGVFNKGNTPAFGIGAAFALICAVLSMILLPKTRGVSNATVMAGGH

SEQ ID NO: 5057 - DNA, 1692 bp, Panicum virgatum
  misc_feature: Ceres CLONE 1814716
  misc_feature: Encodes the peptide sequence at SEQ ID NO. 5058
tttttctctttgttctcttcccgggcgctttcttctctccctccctcgccccgcccactctctctctattcttttgcgcccgcggcctgtcattcccccggggatcagccttagcgttgcctcatatgggggcgagctgagagtaaagcgagggccggcaccggacaaggagagcctttcgatcccctctctctctctcactctacttctctcgtcacgcactcccttcgcctctggggatagaggagggaggtggtgagagagagaggcaggggccggccgggggagaggagagggcgagatcgatcatatcgtcgtcgtcgatcggcggcgaccatgacatggtgcaacagcttcaacgacgtgcgcgccgtggagaacaacctggccaccgccgcggccgtcgccgccgccaagaagcagcagcaggcatcgtcgcacgtcaacctcatcaggacctgcccctcctgcggccaccgcgcgcagtatgaacagttgcaggcggcggcgacgatccaggacctgccggggctgccggccggcgtgaagttcgacccgacggaccaggagatgctggagcacctggaggggaaggcgaggccggacgcccgcaagctccacccgctcatcgacgagttcatccccaccatcgagggcgagaacggcatctgctacacccacccggagaggcttccgggtgtcggcaaggacgggctcatccgacacttcttccaccgcccgtcaaaagcatacacgaccggcactcggaagcggcggaaggtgcacaccgacgagcagggcggcgagacgcggtggcacaagacgggcaagacccggccggtgttcaccaacggcatgctcaagggctacaagaagatcctggtcctctacaccaactacgggaagcagcgcaagccggagaagaccaactgggtgatgcaccagtaccacctgggctccgacgaggaggagaaggacggcgagctcgtcgtgtccaaggtgttctaccagacgcagccgaggcagtgcggcagcgggtcggcgacgacggccaaggacgtcgtccccctcgcggctagcgcggccaccccgacggaccaccaccaccaccatgacggaggcagtggcggtagcaacagcatgctgaaggaggcagcaggcattgtagatttctacagcccggtggcgctaatcggctacaaccaggcggctcctaacaacagggcggctgcctctgctcacctgatgcctaactttgaggtgcacacggcaggggcggctggctttggtccctgaccaagatgtgcaagtgtgcaaccgttcgactgatcatataggttagaggggagagaaaggcaggaagataaggcaccctcaagaatgcagtaacttacaagaagggatcgaagacttaactgaaccgtaacgctggacaataagaggggtgttgagtgagtggctggacgtacagatgctgaaaggagtagggatcgatactatacattgttcattaattgttacaagtatacgtaacttgacgttatcaattttttgtttaatgatatgttgtttcataataagaacgctggagtgagttcaatattgtatattagttcttaactaaaagacttgtacattgtatacaaatcggtgtacatctttcttttggcagaaaaaaaaaaaaaaaaaaaa

SEQ ID NO: 5058 - protein, 319 aa, Panicum virgatum
  misc_feature: Ceres CLONE 1814716
  misc_feature: The sequence is a functional homolog of  SEQ ID NO 210 in the  10/666,642 US patent application
  misc_feature: The sequence is a functional homolog of  SEQ ID NO 562 in the  11/435,388 US patent application
  misc_feature: Useful for making plants with modulated growth and phenotype characteristics
MTWCNSFNDVRAVENNLATAAAVAAAKKQQQASSHVNLIRTCPSCGHRAQYEQLQAAATIQDLPGLPAGVKFDPTDQEMLEHLEGKARPDARKLHPLIDEFIPTIEGENGICYTHPERLPGVGKDGLIRHFFHRPSKAYTTGTRKRRKVHTDEQGGETRWHKTGKTRPVFTNGMLKGYKKILVLYTNYGKQRKPEKTNWVMHQYHLGSDEEEKDGELVVSKVFYQTQPRQCGSGSATTAKDVVPLAASAATPTDHHHHHDGGSGGSNSMLKEAAGIVDFYSPVALIGYNQAAPNNRAAASAHLMPNFEVHTAGAAGFGP

SEQ ID NO: 5059 - DNA, 1916 bp, Panicum virgatum
  misc_feature: Ceres CLONE 1814729
  misc_feature: Encodes the peptide sequence at SEQ ID NO. 5060
gcgaaaggccgcctcccattccaccccctcacatctcggctcctcacatctcatccctccccccgtctcgctctcgctctctgcgttggaggccaggccaaggcaagggattcggttcgcgagctcctcctcctcgtcgtcgtcctcggcccgcccgccgatctcgccagagccgccgcgggagatgcaataatcctaggcgaggagcatattcaggagtcaagacagaaagggcattatacgctggaggaacattgtgttggtggtagctgaggtttctgcacattcattgatggagagattaagcaccaacaagctctacagttctggagttcctgtaactgtgccaacatctctgccttctataccggcctctctggaagagagcttcccaaggcttccggatgggcagaatgttttgatagagagagaaatgaggaacacagcaactcatcaaaccactgttgctcctatccgcagccagtttcactcaagtactggatctgtcgggcctttgtgttcgcccccggctgtaaggttctcgtcggtttcaaaccctgagcaatactccaatcccgctccttacaattcccaggcaccaactactgcaagttcttcaacgttgaattatggatcacagtatggaggctttggaccatccttaactgattttcctagtgatgtcgaaccagcctggtgctctgatccagttgagagcattcttggatactctggtgatgtccctgctggaaataatttgactgggagcacttccattggagctccagatgatcttactaagcaaactgaatggtggactgaacttatgaatgatgattggaaggagattgttgataacccagcttctgcagaaactcaacaggttggaccacctgcacaatcatccatctcagttcaccaatcagctacccaacaaacagtttcatctcaatctggagaacctttggcagttgtggcaccctcacccagtgctggctccaatactgccaaggcacgcatgagatggactcctgaacttcatgagcgctttgtagatgctgtcaatcaacttggtggcagtgaaaaagcaactcctaagggtgtgctcaagctgatgaaggcagacaatttgaccatttatcatgtaaaaagtcatcttcagaagtacagaacagctcgatacagaccagaattatctgaaggctcttcagaaaagaaggtagcatcaaaagaagatataccatctattgatttgaaagggagttttgatctcactgaagcacttcgtctccagttagaacttcaaaagcgacttcatgaacagcttgagattcaaagaagtttgcagctaagaattgaggaacaggggaaatgccttcaaatgatgcttgagcagcagtgtataccggggacagaaaaggcaacagatgcttcaacctcagcagaaggatcgaagttatcttcggagactccagaaccttctgctgtgaaggaagttccagaaaccagtaaaaatggaccaaccaagcaaacagaatcaggtgatacccaatgaagttgcaagcaggttctccccaacctggccatgaaatgggtgtggttgttttcaagcttaagtcgtttttgtcctttcgagggaacagatataaacaactttgcgaagcctggccaagtgcgtgtaactaggcgttagttgtacagtacccacatcacggttccgatgaatcccgtgctatgtggatgatgtagggttcagaagacagcgcaagcacaattgtcaggaatttgacattcttgcctttttctcctttgttagggatcaagtagcatctgctaggcatttgattatgggctaatccaagtattcacaataatattcagcacctctctttgtttaaaaaaaaaaaaaaaaaaaa

SEQ ID NO: 5060 - protein, 420 aa, Panicum virgatum
  misc_feature: Ceres CLONE 1814729
  misc_feature (1)..(52): Pfam Name: Myb_DNA-binding Pfam Description: Myb-like DNA-binding domain
  misc_feature: The sequence is a functional homolog of  SEQ ID NO 1857 in the  10/374,780 US patent application
  misc_feature: The sequence is a functional homolog of  SEQ ID NO 384 in the  10/374,780 US patent application
  misc_feature: The sequence is a functional homolog of  SEQ ID NO 426 in the  10/225,066 US patent application
  misc_feature: Useful for making plants with modulated growth and phenotype characteristics
MERLSTNKLYSSGVPVTVPTSLPSIPASLEESFPRLPDGQNVLIEREMRNTATHQTTVAPIRSQFHSSTGSVGPLCSPPAVRFSSVSNPEQYSNPAPYNSQAPTTASSSTLNYGSQYGGFGPSLTDFPSDVEPAWCSDPVESILGYSGDVPAGNNLTGSTSIGAPDDLTKQTEWWTELMNDDWKEIVDNPASAETQQVGPPAQSSISVHQSATQQTVSSQSGEPLAVVAPSPSAGSNTAKARMRWTPELHERFVDAVNQLGGSEKATPKGVLKLMKADNLTIYHVKSHLQKYRTARYRPELSEGSSEKKVASKEDIPSIDLKGSFDLTEALRLQLELQKRLHEQLEIQRSLQLRIEEQGKCLQMMLEQQCIPGTEKATDASTSAEGSKLSSETPEPSAVKEVPETSKNGPTKQTESGDTQ

SEQ ID NO: 5061 - DNA, 1708 bp, Panicum virgatum
  misc_feature: Ceres CLONE 1814757
  misc_feature: Encodes the peptide sequence at SEQ ID NO. 5062
atctctctccaatctctccaatcgcgcgagctcgcacgcaagcccggacccctcacccccacgccaaaccctaaccctaacccgaaccgatccagggtcgcgggccgcggctgcgggagggcatggccgacacggcgcgcgacggcggggacgccttcgcggacgaggcggagcccacggtcaccatcggcgagtacatcgagggcatcgaggccgaggagctggaggcggatttggtgctgggcggcgacgacggcaaggagtgcacctacgccggcaggtacctcaagcgccaggccgtgttctcctgcctcacctgcgtgccggatggagtcgccggggtgtgcaccgcctgcagcctcgcctgccacgacggacatgagattgttgaactttggacaaagagaaggtttcgttgtgactgtggcaactcaaagtttggtggccacctctgcaagctctgccctgagaaagattctgagaatttagaaaattgttataaccataactttaaaggttcctattgcacatgtggaaggccttatccagatccagaagctaaggagcaagttgaaatgatacaatgctgtatttgtgaggactggtttcatgaggatcatattggtcttaactctattgaagagataccgcgagatgaagaaggggaaccactctatgaagatttcatatgccataaatgctcaccagtttgttatttcttgaagttgtatcctgaaacaatttgggcttctggtaagcaggatttggcatcacaaactgacagaaatgattcaactgtgatggaaggaggaccttcggatcatgctaacattgagaaacatgaaaatggtgctcttgttgatcatatgggtggtgagaagacctccatggaaaatggttctataaaagatattgctgttcctgagaaggccaatttggggaacagttctggaaacaactgcaagctaggaacagatgtaaatgcaatgccagctgacacagacaaaaatatgccctttttcatgtctaaaggctggaggaacacactatgtaggtgcgaaacatgcactaacttctatactcaacgaggtattgcatatcttgttgacaaggaggactctattgaggagtatgagaagattgccaagcagaagagggagaagaagttggaacagcaggaaggagctgagacaaactttctaaattcgcttaaccatgttcagaagatagagatcttgagtggcattaatgacatgaagaatgagtttcagtcctttctggaatcttttgactcctcaaaaccagtcacatcagaagatattcgctccgttttcgagaatctggctaagaagaagaaacagaggttatcttagagagtttgtgtagcttcaggtcccgccgagtcaagggctctgctgctgggtagtgtactgcaacttgggtacctttagacattcagagtaatgtcatcctaggtgctactgaacttaccagtaatgtggaattcctgcagtaatgtaccaaagtgggtcgctagatttggatggcccagctggcgaacctgtttgctccttaatctggacacttttagatggtaagttacattgtgttaccagtcccctgcagatgcaatttgcactagggactagttctgctgagtatgatgcttgtcctgtagcattgcaacaaaaaaaaaaaaaaaaaaaaa

SEQ ID NO: 5062 - protein, 416 aa, Panicum virgatum
  misc_feature: Ceres CLONE 1814757
  misc_feature: Great-hit functional homolog of the protein sequence given in SEQ ID NO 9613
  misc_feature: Useful for making plants with altered alkaloid content
MADTARDGGDAFADEAEPTVTIGEYIEGIEAEELEADLVLGGDDGKECTYAGRYLKRQAVFSCLTCVPDGVAGVCTACSLACHDGHEIVELWTKRRFRCDCGNSKFGGHLCKLCPEKDSENLENCYNHNFKGSYCTCGRPYPDPEAKEQVEMIQCCICEDWFHEDHIGLNSIEEIPRDEEGEPLYEDFICHKCSPVCYFLKLYPETIWASGKQDLASQTDRNDSTVMEGGPSDHANIEKHENGALVDHMGGEKTSMENGSIKDIAVPEKANLGNSSGNNCKLGTDVNAMPADTDKNMPFFMSKGWRNTLCRCETCTNFYTQRGIAYLVDKEDSIEEYEKIAKQKREKKLEQQEGAETNFLNSLNHVQKIEILSGINDMKNEFQSFLESFDSSKPVTSEDIRSVFENLAKKKKQRLS

SEQ ID NO: 5063 - DNA, 2281 bp, Panicum virgatum
  misc_feature: Ceres CLONE 1814790
  misc_feature: Encodes the peptide sequence at SEQ ID NO. 5064
actcgcctaccccacctctagcctcgagctcccgattcccacaatcccccatctcagccggcaaccctaggcggcggcggccggcggctggtggagctggacggtaactgggcgagggcggcgtgcagagtgctagcttgcaccgggcgcaccgcgcggccgggcacggacgacgctgcggaggcaagacgcgccgcgtggtcgggcacggatggcaggggctcggtgatgggcagtgccgcggtggcatcggctccagctgcgccttcttggattctcccggtcactcattctcctttctccagcacaccggcaccgcaaggcgacattctgatctgtgaaccgtaggcctgcagtaactcagtaagctagcaactaagggttcggaggccttcaggggattcgggcccgggagcaccgcgatgagcatcgtgccgaaggagacaatcgaggtcatcgcccagagcgtcggtatccctagccttggcgccgatgtcgccgccgccctctcccccgacgtcgagtaccgcctccgcgagatcatgcaggagtccattaaatgtatgcggcatgcaaaacggacagttctgactgcagatgatgttgacagtgctctcagcctaaggaatgttgagcctgtatatggattcgcttctggtgatccattgcggtttaagagagctgttggacataaggatctcttctatcttgatgaccgggaggtagacttcaaagagattattgaagctcctctgccaaaggcccctcttgacacagcagttgtagcccattggctagcgattgagggtgtgcagcctgcaattccggagaatcctcctattgatgcaattataccaccagctgaaaataaaaggtcggaacatgggaaggatgatgggcttgccgttgatgttaagcttcctgttaggcatgtattatctagagaactacagatgtactttgataaaatagctgaacttactatgagtagatctgatacgcctctttttaaagaagctttagtgagcttggcaaaagattcaggccttcatccattggttccttacttttcctacttcatcgcagatgaggttaccaggagtttgggggatctccctgttttatttgctctcatgcgagtagtccgaagtcttctccataatccacacattcatattgaaccttatttgcaccagttgatgccatcaatgatcacttgcattgtcgcaaaaaggctagggcataggctctctgataaccactgggaacttagagacttctctgccaatttggttgctttggtatgccagaggtttggtcatgtctatcacaaccttcaaaaccggttaacaaaaacattaatccatgcgtttcttgatcctgcgaaatcattgacccaacattatggtgctgttcaagggatatctgcattggggcccagtgcgattaggctgctgattttgcccaacctcgtgacatatatgcaacttctggagccagaactgcagcttgagaagcagaaaaatgagatgaaaaggaaggaagcctggcgtgtttatggtgccttgctgtgtgctgcaggcaaatgcttgtatgatcggctcaaattatttcctgttttgctttctccatcgacacgtcctcttttgaggagtgataaaagggttttaaccaataacccaaataagcggaaatccagcacagatctctctgcatcccagccacctctgaagaagatggcgccggacacttcagtcaactccatggcaggaaacatgcaaggagctatggatggcttttccactcagttgggtaaccctgggatgatgcaggcttcatcctccagacagatggtggagagcatcccatcagctgcgatccggagagatcagggcagcgatcttgcgcagagagtgtccacggtgctgaggcaagcttggaaggaggatcaggatgccggtcatctcctggggtcactgtatgaggtctttggtgaagccatcttctcctttgtccaaccaccagagatatccttgtttgtgtagaaaaagtggattcataggcttggaggtatttcaatctgtggtgtacatgtagggacaatagggacagttcctgggtggaatgtcttactggattcttggaattgtttcaagaaatatggaagttatgtaacagtagggacagttccttggtgggtgtggtgtaacttgcatcagttgatctagtgagttatagtataattttaaccaaaatttggcaaaaaaaaaaaaaaaaaaaa

SEQ ID NO: 5064 - protein, 540 aa, Panicum virgatum
  misc_feature: Ceres CLONE 1814790
  misc_feature (1)..(67): Pfam Name: TAF Pfam Description: TATA box binding protein associated factor (TAF)
MSIVPKETIEVIAQSVGIPSLGADVAAALSPDVEYRLREIMQESIKCMRHAKRTVLTADDVDSALSLRNVEPVYGFASGDPLRFKRAVGHKDLFYLDDREVDFKEIIEAPLPKAPLDTAVVAHWLAIEGVQPAIPENPPIDAIIPPAENKRSEHGKDDGLAVDVKLPVRHVLSRELQMYFDKIAELTMSRSDTPLFKEALVSLAKDSGLHPLVPYFSYFIADEVTRSLGDLPVLFALMRVVRSLLHNPHIHIEPYLHQLMPSMITCIVAKRLGHRLSDNHWELRDFSANLVALVCQRFGHVYHNLQNRLTKTLIHAFLDPAKSLTQHYGAVQGISALGPSAIRLLILPNLVTYMQLLEPELQLEKQKNEMKRKEAWRVYGALLCAAGKCLYDRLKLFPVLLSPSTRPLLRSDKRVLTNNPNKRKSSTDLSASQPPLKKMAPDTSVNSMAGNMQGAMDGFSTQLGNPGMMQASSSRQMVESIPSAAIRRDQGSDLAQRVSTVLRQAWKEDQDAGHLLGSLYEVFGEAIFSFVQPPEISLFV

SEQ ID NO: 5065 - DNA, 1659 bp, Panicum virgatum
  misc_feature: Ceres CLONE 1814806
  misc_feature: Encodes the peptide sequence at SEQ ID NO. 5066
aagtctctatttcctagtgtcgccgaccccctcctcctctactggcattgtaccgtcgcggaggggagatccgtccaccctcctatacggtcctagatcgatctcaccaattcttggcaactaacccaagcttgctcggaggaatcgctgcagggcccgagaaatgcagagggacagcggcgccggcgacgcgacgccgggcaccccgagcccgacgcacggcggccgcctcaggcaccggaagcgctccagcgaggttatcagcgacgtgaacaagtccaatggcgccaacctgctcttgaacgaccagaacaagtacaagtcgatgctagtccggacctactcctcgctgtggatgatggctgggttcgtgttcttgatatacatggggcatctctacatctgggccatggtggtggtcatacaaatattcatggccaaggagctcttcaacctgcttaggaaggccaacgaggatcggcagctcccgggatttaggatgctgaactggcattttttctttactgcaatgctgtttacatatggccggttccttagccggcagcttgtcaacactgtcacttcagataagttgctgtacaagctggtgagcggggtcatcaagtatcagatgtttatttgctacttcctctacatagcaggttttgtctggtttattgtcacgctaaagaaaaaggcatacaaataccagttcagtcagtatgcatggactcatatgatccttctgatggtatttgcgcagtcatctttcactgtggcaaacatattcgatggaatattctggttcctcctaccagcttcattaattgctatcaatgatgttgctgcatatttctttggattcttctttgggaaaacacccttgattaagctctctccaaagaaaacatgggaaggctttataggtgcatcagtgacaaccatgctttctgcatttgtgcttgctaatttcatgggccatttccagtggttgacatgcccaagaaaggacttgtcaactggatggcttcattgcgacccaggtcccatgtttacaccagaaagttataggttatcaggatggatgccacaatcgtttccctggcgagaagttgcaattatgcctgttcaatggcatggcttagctcttggctggtttgcttcaataatagcaccatttggggggttttttgcaagtggcttcaagagggcattcaaatttaaggattttggggacagcatacctggccatggtggatttacagataggatggattgccaaatggtcatggctgtctttgcatacatctattatcaatcatttgtgatggtacaggacctgtctgttgagaccatcctggagcagatactaaggaatctcaccgttgaggagcaacatgatctatatgaacagctcggcaagttactggcgcgagcaaactgatgctaacatagacgttgtgcacgcaccagatccaaaaggatatgtgcagtgctttttccaggccgtgttttagttaatctgcttgtacagccctaacacccctaagaacagaatggaaaaatgaaaaccacaacacttcacaggagttgcaccgctgtatgatgtttcggagtatacagatcctgcgtccttcggaaaaaaaaaaaaaaaaaaaa

SEQ ID NO: 5066 - protein, 426 aa, Panicum virgatum
  misc_feature: Ceres CLONE 1814806
  misc_feature (1)..(332): Pfam Name: CTP_transf_1 Pfam Description: Cytidylyltransferase family
  misc_feature (1)..(422): SWISSPROT Homolog: EC 2.7.7.41 Phosphatidate cytidylyltransferase
  misc_feature (9)..(422): SWISSPROT Homolog: EC 2.7.7.41 Phosphatidate cytidylyltransferase
MQRDSGAGDATPGTPSPTHGGRLRHRKRSSEVISDVNKSNGANLLLNDQNKYKSMLVRTYSSLWMMAGFVFLIYMGHLYIWAMVVVIQIFMAKELFNLLRKANEDRQLPGFRMLNWHFFFTAMLFTYGRFLSRQLVNTVTSDKLLYKLVSGVIKYQMFICYFLYIAGFVWFIVTLKKKAYKYQFSQYAWTHMILLMVFAQSSFTVANIFDGIFWFLLPASLIAINDVAAYFFGFFFGKTPLIKLSPKKTWEGFIGASVTTMLSAFVLANFMGHFQWLTCPRKDLSTGWLHCDPGPMFTPESYRLSGWMPQSFPWREVAIMPVQWHGLALGWFASIIAPFGGFFASGFKRAFKFKDFGDSIPGHGGFTDRMDCQMVMAVFAYIYYQSFVMVQDLSVETILEQILRNLTVEEQHDLYEQLGKLLARAN

SEQ ID NO: 5067 - DNA, 1845 bp, Panicum virgatum
  misc_feature: Ceres CLONE 1814858
  misc_feature: Encodes the peptide sequence at SEQ ID NO. 5068
ccattatatttctcctcttgcattgcttcttccccttgcccctcgtccttatcgtcaaccaccattgctcctttccttcccccaagcaataagcaaacacagcttcaccagggcccaatccccgccgcgatccccatggatccgtacaagcaccgcccgtccagcgggaacaactccagcttctggaccaccaactccggcgcccccgtctggaacaacaactccgccctcaccgtcggccagcgaggacccatcctccttgaggactaccatctgattgaaaagcttgctcagttcgacagggaacgtatccctgaacgtgtagttcatgcacggggagccagtgccaagggtttctttgaagtaactcacgatgtttctcaccttacatgtgctgattttctccgagctcctggggttcagacccctgttattgttcggttctccacagttgtgcatgagcggggaagccctgagaccttgagggatccacgtggttttgctgtcaagttctacaccagagagggtaactttgaccttgtgggtaacaacatgcctgtctttttcatccgagatgggatgaaattccctgacatggttcatgctttcaagccaaacccaaagaccaatttgcaggagaactggagaatagtagacttcttctcacaccacccagagagcatgcacatgttcaccttcctctttgatgatgttggcatcccactcaactacaggcacatggagggttttggtgtgaacacctacaccttgatcaacagggctggaaaacctcaccttgtcaaattccattggaagcctacttgcggtgtgaaatgcttgttggatgatgaagctgttactgttggaggcacctgccacagccatgcgacaaaggatctatatgattctattgcggctgggaattacccagaatggaagctttacatacaaaccattgatcctgaccatgaggataaatttgattttgacccacttgatgtcaccaagacctggccagaggatatcatcccactgcagcctgttggaaggatggtcctgaacaagaacatcgataacttctttgcggaaaatgaacagattgctttctgcccagctatcattgtccctggaatccactattctgacgataagctacttcagacgagaattttctcctatgctgacacccaaaggcaccgccttggtccaaactatctgatgcttcctgtgaatgcaccaaaatgtgctcaccacaacaaccaccatgatggcttcatgaacttcatgcacagggatgaagaggtgaactacttcccttcgaggtttgatacagtccgtcatgctgagaaggttcctatccctccccgtgttctgacaggctgccgtgagaagtgcattatccataaggagaataacttcaagcaggctggtgagagataccgatccttcgaccctgcaaggcaagaccggttcatccagcgcgtggttgatgctctctcagatcctcgtgttacccatgagcatcgtagcatttggatctcctactggtctcaatgcgatgcatccctcggccagaagctggcatctaggctcaacctgaagccaaacatgtagattgacaaggatgaaatcgtgcacagtcgaggcgcaccggcggtggatacaacatgaaatatgtgatgttgggaatggttgtaacattgaataaagagtaatggacgtgatagtagtacgtatcctgaggtgtgaaccagtggtggttatcctatccttccaggaactttgcccagcttcatctttgcaagaaagacatacagtacaataaagaagaatgtggtggattat

SEQ ID NO: 5068 - protein, 492 aa, Panicum virgatum
  misc_feature: Ceres CLONE 1814858
  misc_feature (1)..(342): Pfam Name: Catalase Pfam Description: Catalase
  misc_feature (1)..(492): SWISSPROT Homolog: EC 1.11.1.6 Catalase isozyme 1
  misc_feature (1)..(492): SWISSPROT Homolog: EC 1.11.1.6 Catalase isozyme B
MDPYKHRPSSGNNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESMHMFTFLFDDVGIPLNYRHMEGFGVNTYTLINRAGKPHLVKFHWKPTCGVKCLLDDEAVTVGGTCHSHATKDLYDSIAAGNYPEWKLYIQTIDPDHEDKFDFDPLDVTKTWPEDIIPLQPVGRMVLNKNIDNFFAENEQIAFCPAIIVPGIHYSDDKLLQTRIFSYADTQRHRLGPNYLMLPVNAPKCAHHNNHHDGFMNFMHRDEEVNYFPSRFDTVRHAEKVPIPPRVLTGCREKCIIHKENNFKQAGERYRSFDPARQDRFIQRVVDALSDPRVTHEHRSIWISYWSQCDASLGQKLASRLNLKPNM

SEQ ID NO: 5069 - DNA, 1470 bp, Panicum virgatum
  misc_feature: Ceres CLONE 1814868
  misc_feature: Encodes the peptide sequence at SEQ ID NO. 5070
tagttgcttgacagctgcagctgagttggtcgactcgaggccatggccatgtccgcttcctcctcctcccgcgccctcctccgccggatcggcggcgcgctcctccgccgctccttctccgcctcggcaccggcggggtccgactccgccgccgccgcggggtaccacgtggcgggcgggcccagctacatgcgcggcgccgtcttctgggagcccggccgcccactcacgctcgaggagtttcagatgccacggcccaaggccggcgagctcctcatcaaaactaaagcttgcggtgtctgccattccgacctccatgtcatgaaaggagaaatccctttctccagcccttgtgtcgtgggccatgagatcactggggaggttgtcgaccacggcacgcacactcctattgaaatcatcaatcggttcccaattggaagccatgttgttggtgcgttcataatgccctgtggcaactgcttttactgtgttaagggccaagaagatctttgtgagtctttctttgcgtataaccgtgctaaaggaactctatatgatggtgaaacacgcctgtttctacgcagcaatgggaaaccagtgtatatgtacagcatgggcgggcttgcagagtactgtgtcgtgccagccaacgctctagcagttctccctcattcgttgccatacacagaatcagcaatcttgggatgtgcagtgtttaccgcatatggtgccctgaggcatgctgctgaaatgtgtgcgggtgattcagtagctgtgattggagttggtggggtcggatcaagctgtttacagatagcaaaagcctttggagcttctgaagtcatcgcagtggatgttcttgatgagaagctccagaatgctagaacacttggagcaacccacactgtaaacacagcaaaagaggatgccgttgaaaggataaaggaaattactgatggaaggggtgtggatgtggctgtagaggcacttggtaaggcattgacatttgcccagtgtacaaagagcgtacgagatggaggcaaagctgttatgattgggcttgctgcaacaaacgtagttggggaggttgatataacccgtcttgttcggcgacaggtgaaaatcattggatcatacggtgcgagggccaggcaagatcttcctcagatcgtgaagctcgcggaaagtggcgccttcaacctccagaacaccatatcgaggaaatgcaagttcgaggaggcaaatggcgcctatgaggatctcaatcaaggcaagatcatcggccgagctgtggttgagatcatggagtgatgactagatgatcttgtggttctaaacccaggtcggacaataagtgtgcttgtacttgggcaatgtcatctggatttaccaaaatttattgatgagaagatgattaaactaaaaagggagatgttcactgtgtgctggcaaaaaaaaaaaaaaaaaaaa

SEQ ID NO: 5070 - protein, 422 aa, Panicum virgatum
  misc_feature: Ceres CLONE 1814868
  misc_feature (1)..(135): Pfam Name: ADH_N Pfam Description: Alcohol dehydrogenase GroES-like domain
MAMSASSSSRALLRRIGGALLRRSFSASAPAGSDSAAAAGYHVAGGPSYMRGAVFWEPGRPLTLEEFQMPRPKAGELLIKTKACGVCHSDLHVMKGEIPFSSPCVVGHEITGEVVDHGTHTPIEIINRFPIGSHVVGAFIMPCGNCFYCVKGQEDLCESFFAYNRAKGTLYDGETRLFLRSNGKPVYMYSMGGLAEYCVVPANALAVLPHSLPYTESAILGCAVFTAYGALRHAAEMCAGDSVAVIGVGGVGSSCLQIAKAFGASEVIAVDVLDEKLQNARTLGATHTVNTAKEDAVERIKEITDGRGVDVAVEALGKALTFAQCTKSVRDGGKAVMIGLAATNVVGEVDITRLVRRQVKIIGSYGARARQDLPQIVKLAESGAFNLQNTISRKCKFEEANGAYEDLNQGKIIGRAVVEIME

SEQ ID NO: 5071 - DNA, 2009 bp, Panicum virgatum
  misc_feature: Ceres CLONE 1814985
  misc_feature: Encodes the peptide sequence at SEQ ID NO. 5072
gaggcagccccctcgaaaccaaatcgaaaccatccgctcctcgaaaaaccggcagcagaggccgagcgccgccgcggacccaatcgcccccaatcccacccagtccccgccccgagccgagatccgggggccagccgcattgccgcggatcgaggggatggcgccgcagctcaccggcgcgcccggctcggcggcggcgggcggcgtcgcggcggccgtcaagccgcagttccaccactaccaccaccaccgcctgcccccgcgccactaccaccccgcgccggcctcgctcctctccaagctcgccttctggtccgtctgctccctctcgctcctcctcgccttcctcctcctctccccctcctccgcgcccgccccgcgcgccgcgcccgagtccccgcgccgctcgctccacgcgtccccctcgtccaccgcctcctggggcggcgccgcctgggagaagaaggtgcgggcgtcagcgcgcgtcaggcgcccccggggccactccgtcctcgtcacgggcgccgcagggttcgtcggctgccacgcggctgccgcgctgcgccgccgcggagacggcgtgctcggcctcgacaacttcaacgactactacgacaccgccctcaagcgcgggcgggccgcgctcctcgcccgctcgggggtctacgtcgtcgacggggacatcgcggactcagagctgctggccaagctgttcgacgtcgtcccgttcacgcacgtcctccaccttgccgcgcaggcgggcgtgcggcacgcgctcgtcgaccccatgtcctacgtgcgcgccaacgtcgctgggcttgtggcgctgctcgaggcggcgcgctcggcgaaccctcagccggcgatcgtctgggcgtcgtcgtcttcagtgtacgggctcaactcccacgtgcctttctccgagcatgacaggacggatcgaccagcctctctctatgcagccaccaaaaaggctggcgaggagattgctcatgtctacaaccacatctatgggctctcactcaccgctctacggttcttcactgtctatgggccttgggggcgtccagacatggcctacttcttcttcacccgggacatccttgctggtcggccgatcacggtgtatgagagtgcaggtggaggctcacaccagactaccatttcccgtgatttcacctacattgatgatattgtgaaggggtgtgtcgcggcattggatactgctggtcggagtacaggcagtggaggcaagaagagaggtccggcgccattcaggacatacaatttggggaacacctctcctgtgcctgttacacagctagtggatttgctggagaagctgctgaaagtgaaggctgtgaggaaggttgtcaagatgccaaggaatggagatgtgccatatacacatgctaacgtaagccttgcacagcgggagcttggctatcggccgtccacagatctccaaacagggctcaagaagtttgtgcggtggtatcttgagtactaccatcctgacttggctgagaagcagaagcagcatgctggtagcaatggcaagggttcacgtggtcggaacggcagcttgagtagtgcaagatgactgtttattcagtgtcttcgtggcctttcctgacggtgtgtatcagaattctacctccattgcttacttcatcagattgggaggttcattttgctcagcatgttctggatgtgaaacagaagttaagaaacactcattaggtagtcataattcaaacacctggtgcttctctttgctaccttttgctgggcatttaattcctagttccagtagttggttcttaggatggcactgtttggaagatgtttcatgggtttggggggaaggcattctgttgcaaagactacaatagattcttttagtgacattttgtaccacgggagagaactaagtatatcatgacttgttcttgttcaatttaattcgtgatgatcgacagttggcctaaaaaaaaaaaaaaaaaaaa

SEQ ID NO: 5072 - protein, 481 aa, Panicum virgatum
  misc_feature: Ceres CLONE 1814985
  misc_feature: Great-hit functional homolog of the protein sequence encoded by LOCUS At1g02000
  misc_feature: Great-hit functional homolog of the protein sequence encoded by LOCUS At4g00110
  misc_feature (1)..(262): Pfam Name: Epimerase Pfam Description: NAD dependent epimerase/dehydratase family
  misc_feature: Useful for making plants with altered cell wall content and/or composition
MAPQLTGAPGSAAAGGVAAAVKPQFHHYHHHRLPPRHYHPAPASLLSKLAFWSVCSLSLLLAFLLLSPSSAPAPRAAPESPRRSLHASPSSTASWGGAAWEKKVRASARVRRPRGHSVLVTGAAGFVGCHAAAALRRRGDGVLGLDNFNDYYDTALKRGRAALLARSGVYVVDGDIADSELLAKLFDVVPFTHVLHLAAQAGVRHALVDPMSYVRANVAGLVALLEAARSANPQPAIVWASSSSVYGLNSHVPFSEHDRTDRPASLYAATKKAGEEIAHVYNHIYGLSLTALRFFTVYGPWGRPDMAYFFFTRDILAGRPITVYESAGGGSHQTTISRDFTYIDDIVKGCVAALDTAGRSTGSGGKKRGPAPFRTYNLGNTSPVPVTQLVDLLEKLLKVKAVRKVVKMPRNGDVPYTHANVSLAQRELGYRPSTDLQTGLKKFVRWYLEYYHPDLAEKQKQHAGSNGKGSRGRNGSLSSAR

SEQ ID NO: 5073 - DNA, 1537 bp, Panicum virgatum
  misc_feature: Ceres CLONE 1815004
  misc_feature: Encodes the peptide sequence at SEQ ID NO. 5074
gcaggggcctggcccccctaatgctcccgtagcaccattatcaaaggtggaattcttcccagcggcagcctgcggcaagactgttggccccccaatgatcaaatcttggctccgcccctgcttgcatctagcctttttgagctattattgtcgttattcacttaattagagttggagggtgacatactgccattaattatattttctgagcgtttaatttcttttttttttaataaaacaagcaagctgatgaggccgggtatgatacatgcatccgcaggctatatatacagcgcgacaagctagctgctagattgggcgggccataggccagccagcagctagctactaggccatcatcgatagatctttgcttgcatcgatcgatcgatccagcgtatagctagagatgtcgacgtcgtcgtcaagggacagcctggtgctagggcgggtgatcggcgacgtggtggaccacttctcgccgacggtagcgctccaggtctcctacaacggccgccgcatcatgaacggcgccgacttccggccgtcggcggtggcggcgaggcctcgcgtcgaggtcgggggcaccgatctcaggcagtgctacacgcttattatggtggatcctgacgcccccaacccaagcaacccgacgatgagggagtatttgcactggctggtgacagatattcctgggacaactgatgctggctatggtcgggaggtggtctgctacgagagccctcggccggcggcggggatccaccgcgtggtgttcgtgctcttccggcagatggcgcgcggctccgtggacgtggcgccgctcctccgccacaacttctgcacccggaacttcgccgtggcccacggcctgggcgcccccgtcgacgccgccttcttcacctgccagcgagagggcggcaccggcggccgtcgcctcgtcatccggccgccgcggacgacgacaccgccggcgccgcgccctagctagctaagcgctcgatccactacatactgctgcagcagaatatatagatggtcgtcacgacagatcaatcctatatatagctgtatacgatcgacctactcagtgaatcagcacgtacgatcatatgtacgtatacacatacggcggcatatatatgtatatgtatgcgggaggcgatcgacaaggaccagtggcggagccaagggggtgctcaagccccctcctaccaccttggcttccatggaagccccccctacaaattttgtggaggaagaagaaggaaggagaaaattttgaggaggaagaagaaggaatgagaggagggaggaggaagaaggaaaggagagccccctagctctggatcctggctccgccgctgacaaggacatgctcgacgactgcacgaattaatgaaactcgtgtactagggtttaactaggctatgtccatatatggtgtgttaatttgtacgtgactgatcatggtgtgtatatatgaccgaattaacatgctgtatttctcatgatggaaaaaaaaaaaaaaaaaaaa

SEQ ID NO: 5074 - protein, 193 aa, Panicum virgatum
  misc_feature: Ceres CLONE 1815004
  misc_feature: Great-hit functional homolog of the protein sequence given in SEQ ID NO 9500
  misc_feature: Useful for making plants with modulated flowering time
MSTSSSRDSLVLGRVIGDVVDHFSPTVALQVSYNGRRIMNGADFRPSAVAARPRVEVGGTDLRQCYTLIMVDPDAPNPSNPTMREYLHWLVTDIPGTTDAGYGREVVCYESPRPAAGIHRVVFVLFRQMARGSVDVAPLLRHNFCTRNFAVAHGLGAPVDAAFFTCQREGGTGGRRLVIRPPRTTTPPAPRPS

SEQ ID NO: 5075 - DNA, 1862 bp, Panicum virgatum
  misc_feature: Ceres CLONE 1815009
  misc_feature: Encodes the peptide sequence at SEQ ID NO. 5076
acgagacgacgacattattatcggcattttcttcgctgatgaattgatagtactccggtccgggacgctcgcaactcgcaagaacaacgtacacgagtgccaaggccaagaaagcatggcaccccctaccgccgccgccgcccattgccaagacctccatggccgcgagctgcctcacgtcgccgtcttcccgctcatggcgaaaggccacaccatcccgctcctggacctcgcctgcctcctccgccgccgggggctcgccgccgtcacgctcctcaccaccccgggcaacgcggcgttcgcccgcgccgcgctgctggccggcggcgtaggcgccggtggtgacgcggccgtcgtcgagctcccgttcccggccggccacgcgcccgcgggcggggagagcgccgagggcgtcgcgtcggcgtcctccttcgccgcgttcgcggaggccacgtcgccgctgcgcccgcggttcgaggacgcgctcgaggccatgcgcccgccggcgggcctcctcgtcgccgacggcttcctgtactgggcgcacgcgtcggccgccgcgctcggcgtcccgagcgtgtcgttcctcggcacgtccgcgttcgcgcacgtcgtcagggatgcgtgcgtgcgagacaagccgggagcctcggcgcagggtcacgacgacgcgtcgaccaccggtggtacgtacacggtgcctgagttccccgacctccggttctcgctcgccgacctcgtcccgccgccgccgccgccgctgatggagctggacgccaagatggcggtggccgtcgctgcgagccacggcgtcatcatgaacaccttccatgacctggagggccgctacatagagcattggaaccggcagattggacccagagcctggcccatcggcccacaactatgcttggcccgtcaatctacctccgacgctcatgccagcaggcccccatggatgctctggttggacgagaaggcagctgctggaaggactgtactgtacatctcgcttgggacactagcagtcatccctgaagtgcagctgaaacaagtggctgacgggctggaacgggctggagtggacttcctatgggctgtgcggcccaacaacgccgacctcggcatggggttcgaggagcgtgtggaagggaggggaaacgtggtgagagaatgggtggaccaacgagacatacttggccactcgtgtgttcgggggtttttaagccactgcgggtggaactcggtgttagaaagtgttgctgcgggtgtccctctagtggcatggccaattgagtttgaacaacctgtgaacgcaaagttcatcgtcgatgagctaggaattggtgttagggtccatagtagtgatcgaacaattcggggtttggtaaagagtaacgagatcacaagggtggtgagagagttgatgttcggggaggatggaatggcgatggcatcaaaggcggcaaagttagcaagacaagctcaattagcggtgtccgaagtcggatcatcgtggaaagcaaagttagcaagacaagctcaattagcggtgtccgaagtcggatcatcgtggaaagcaatcgaggacatgattagagagctctgtgcgacgagcaaagcaaggaaatcagtggatgggtaagttgtgtacgtgatatggtgattagattgcattgtgccattgaaaaccatttagggacaaataaaattctatgtgtggaccttggatgatctttgcattcgtaatttcatatccagaactatgttgtagaagtattagaattgcggtgggtcgattgacacccattatgtttaatggaatttatggtttaaattttcaaaaaaaaaaaaaaaaaaaa

SEQ ID NO: 5076 - protein, 509 aa, Panicum virgatum
  misc_feature: Ceres CLONE 1815009
  misc_feature (2)..(120): Pfam Name: UDPGT Pfam Description: UDP-glucoronosyl and UDP-glucosyl transferase
MAPPTAAAAHCQDLHGRELPHVAVFPLMAKGHTIPLLDLACLLRRRGLAAVTLLTTPGNAAFARAALLAGGVGAGGDAAVVELPFPAGHAPAGGESAEGVASASSFAAFAEATSPLRPRFEDALEAMRPPAGLLVADGFLYWAHASAAALGVPSVSFLGTSAFAHVVRDACVRDKPGASAQGHDDASTTGGTYTVPEFPDLRFSLADLVPPPPPPLMELDAKMAVAVAASHGVIMNTFHDLEGRYIEHWNRQIGPRAWPIGPQLCLARQSTSDAHASRPPWMLWLDEKAAAGRTVLYISLGTLAVIPEVQLKQVADGLERAGVDFLWAVRPNNADLGMGFEERVEGRGNVVREWVDQRDILGHSCVRGFLSHCGWNSVLESVAAGVPLVAWPIEFEQPVNAKFIVDELGIGVRVHSSDRTIRGLVKSNEITRVVRELMFGEDGMAMASKAAKLARQAQLAVSEVGSSWKAKLARQAQLAVSEVGSSWKAIEDMIRELCATSKARKSVDG

SEQ ID NO: 5077 - DNA, 1812 bp, Panicum virgatum
  misc_feature: Ceres CLONE 1815082
  misc_feature: Encodes the peptide sequence at SEQ ID NO. 5078
acaagggtaaacccctcctccccctccccgtcccgctacccgcgcggccgccaccgccaccccgccgcgtcctcgagcgtctcccctccctcccctccctcccctcccctgcaatggcgtcggcgggagggccctccggggtcatagggattagcgtccgtccaaactccagcgcggcctgcctcgttcagaagagtggagtcctgtcgaattccctccctaccggagctgctgttcaggttcgccggcgccgcaacaaggcccgcaatggccaaggtatcaggtgtgcaatggcaactggaaaagagcagggtgcagtcacccctgctagtagtggtgatcaaaacaacagtggattgcgcggcaaattaaataaagttgttttagcatatagcggtggcttggatacatctgttattgttccatggctcagggagaactatggttgtgaagtcgtttgtttcactgctgatgttggccagggtgccattgaattagaaggattggagaaaaaggcaaaagctagtggagcatgccagcttgttgtaaaggacttgagagaagaatttgttagtgaatatatatacccctgcctgcgagctggtgcagtttatgagagaaagtatctgcttggtacttcaatggctaggcctgttattgctaaggcaatggtcgatgttgccaaggaagttggtgcagatgcagttgctcatggatgcactgggaaaggcaatgatcaggttcgctttgagcttacattttatgctttaaatcctgaactcaaagtggtggcaccttggagggagtgggacatcacagggcgtgaagatgcaattgagtatgcaaagaaacataatgtaccagttccagtttcaaagaaatcaatatacagccgagatcgaaacttgtggcaccttagccatgagggtgacatcttggaggacccagcaaatgagccaaaggaagatatgtatatgatgtctgttgctccagagaatgcaccttcggaacccgagtatctggagattggcatcgttgcaggtgttcctgtttccatcaatggacgggagctctcgccagcatccctccttgcagagctcaatgaaattggtgggaagcatgggatcgggcgcattgacatggtagagaaccgccttgtaggcatgaagtctcgtggtgtgtacgaaacccctggtggtaccatcatggcagccgcggtgcgtgagctcgaggccctgactctggacagggaaaccatgcagtggaaggacatggtggccctcaagtatgctgagctggtctatgcaggccgctggtttgaccctctccggcagtcctttgacgccttcatggagaagatcaccgcgacgaccactggttcagtgaccctgaagctatacaaggggtcggtgaatgttgcatcccggaagagcccctacagcctctacagggaggacatctcgtcgtttgagaatggggagatctacaaccaagctgatgcggaggggttcatccggctctatggtctcccgacacgggttcgggcgatgctggagaagggcatctaagttcctctgtttgttttagaaataaaagctatcattcagaaactgtcaaatagtttccagtgattgcagacagatcgtgttgtacccatcgatttaagtttgtcctagtgaactctgaatgcctttgggtgacagaatggacatgaatattattagtaatctgctggctgctgatgtaggacacaagttcagatgtgaaatagaaggtaaagacaaaatttgcgaaaaaaaaaaaaaaaaaaaa

SEQ ID NO: 5078 - protein, 484 aa, Panicum virgatum
  misc_feature: Ceres CLONE 1815082
  misc_feature (1)..(390): Pfam Name: Arginosuc_synth Pfam Description: Arginosuccinate synthase
  misc_feature (25)..(482): SWISSPROT Homolog: EC 6.3.4.5 Argininosuccinate synthase, chloroplast precursor
  misc_feature (88)..(482): SWISSPROT Homolog: EC 6.3.4.5 Argininosuccinate synthase
MASAGGPSGVIGISVRPNSSAACLVQKSGVLSNSLPTGAAVQVRRRRNKARNGQGIRCAMATGKEQGAVTPASSGDQNNSGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIVAGVPVSINGRELSPASLLAELNEIGGKHGIGRIDMVENRLVGMKSRGVYETPGGTIMAAAVRELEALTLDRETMQWKDMVALKYAELVYAGRWFDPLRQSFDAFMEKITATTTGSVTLKLYKGSVNVASRKSPYSLYREDISSFENGEIYNQADAEGFIRLYGLPTRVRAMLEKGI

SEQ ID NO: 5079 - DNA, 2092 bp, Panicum virgatum
  misc_feature: Ceres CLONE 1815103
  misc_feature: Encodes the peptide sequence at SEQ ID NO. 5080
accaaacccaggccgcgaaacaaaccatcgcctccctccctcgcagctgcgtcgccttctcctcttccgcaaacagcttctcgccagccagccagccttctcctccgcctcctctgcagccgcttcgacgacccggccggccggccgcagcggcatggcggcgcgaccggtgcaggaggaggggggcggggatcatcagcagcagcacccgcggcgtcccttcggcgccgtcctgatcacggtcccggacgggaccggctcgccctccttgcctgcttcgtcctccgacggcgtggcggccgcgctcttgggccgcgcgggcgccgccggctcggacgacgacggcgccctcctggaggcggaggacgagtggccgcggccgtggggggagtcgttctcgccgtggcgcgccgcggtggcggtgtttgcgctcgcggcgctcgccgcggcggggtacgtctgcctgtacgcaggcgggggcgccggcgcggcgtggcggctcctggaggcgcgcgaggaggagagcgaggaccgcggcggccgcaggtccttcctgctgccgctgtacccgaagccgcgtcgcggcggcggcgccgcggcggggaatctgacggccgcgacgtccacgtccaccgggctatactacacaactgtgtcttttggcaatcctccaagggattattttcttgatgttgatactggcagcgacataacatgggtccagtgcgacacgccatgcagaagctgcgcaaagggagctcatccttcatataagcctgaacaatccaacatagttcctgccagtgatccactttgtgatcgagttcaacgcaacccaaatgagtgcaactatgatatcaattatgccgacagaagctcctctatgggtgcgtatgtaagggataatatgcaactaatcagtgaagatagtgaaagggaaaatgtagacattgtgtttgggtgtggatatgatcagagaggaattcttctggacactctagaaaatactgacggaatgctaggcctgggcagccgggcaataagccttcctacacagctagccagccgagggattatttccaatgtcttcggtcactgtatgacaacagatcccagtggtggtggttatttgtttcttggtgatgattacattcccagatggggaatgacatgggttcctgtccgaaatggtccagcagataacatacgcagatcgcaactccagcaagtaaaccacgggaatcagcagctcaatgtgcaagggaagttgactcaagtgatctttgacagtgggtctacatatacatatttcccacacgaagcgtatgcaaatctggttgctgcgctgaaggttgcatccccgagatttgtacaagatgactcagataatactctgcctttctgtatgaaagctgatttttcagtgaggtctgtggatgatgtgaaacattttttcaagcccttgactctgcaattcgggaaacgatttttcttctccagaaccttcaacattcgtcctgaagattacttgaccatcagtgataagggcaatgtctgcctgagggtgttcgatggaacagcaatcggttatgattcagtaataataatcggagatgcttttcttcgtggaaaattgattgcttatgacaatgatgagaatcagatcggatggattgattcaggctgctctgacccaagcaaacaaagcagaattccattattcctacgaagagtattgcgcaaccaacttctgtaaacatcacacagataccaccatgagatcgcctgaccacatccattgttacggatctgcaattctgcatccatattctgatataatcgtgtgaaggaatgtaattattagataggaaaaatggttacaagatagggataaggagaaaggagaggtaggtaagcatagttagtaacttagtatactgtgctttgtatttttttttctatctgtatatagtcatcagaaatctgtattctatgttgtagggcatatctcgctcactttctaagactaaaatggcgaagcatatcaatgaataatcaacagcagttgtgacaaaaaaaaaaaaaaaaaaaa

SEQ ID NO: 5080 - protein, 533 aa, Panicum virgatum
  misc_feature: Ceres CLONE 1815103
  misc_feature (2)..(357): Pfam Name: Asp Pfam Description: Eukaryotic aspartyl protease
MAARPVQEEGGGDHQQQHPRRPFGAVLITVPDGTGSPSLPASSSDGVAAALLGRAGAAGSDDDGALLEAEDEWPRPWGESFSPWRAAVAVFALAALAAAGYVCLYAGGGAGAAWRLLEAREEESEDRGGRRSFLLPLYPKPRRGGGAAAGNLTAATSTSTGLYYTTVSFGNPPRDYFLDVDTGSDITWVQCDTPCRSCAKGAHPSYKPEQSNIVPASDPLCDRVQRNPNECNYDINYADRSSSMGAYVRDNMQLISEDSERENVDIVFGCGYDQRGILLDTLENTDGMLGLGSRAISLPTQLASRGIISNVFGHCMTTDPSGGGYLFLGDDYIPRWGMTWVPVRNGPADNIRRSQLQQVNHGNQQLNVQGKLTQVIFDSGSTYTYFPHEAYANLVAALKVASPRFVQDDSDNTLPFCMKADFSVRSVDDVKHFFKPLTLQFGKRFFFSRTFNIRPEDYLTISDKGNVCLRVFDGTAIGYDSVIIIGDAFLRGKLIAYDNDENQIGWIDSGCSDPSKQSRIPLFLRRVLRNQLL

SEQ ID NO: 5081 - DNA, 2429 bp, Panicum virgatum
  misc_feature: Ceres CLONE 1815136
  misc_feature: Encodes the peptide sequence at SEQ ID NO. 5082
gcattgctattcccttcattattttcctctctttcttccctattagtatcacccgtgcgattagcatgtctctgcccaatgccaccgcctcgccgccgccgtcgccggaaccctaggccgccggagtcggagctcccgtcggcgggggaccgggagggggaggatgcagctgcggatctcgccgagcatgcgcagcatcaccatctccagcagcaatggcgtcgtcgactccatgaaggtgcgcgtcgcaccgcagccgcccccaccgccgccgccgccgctcgggcccggccgccgcggcgggggagggggctggggcgccggctggtactggcgggcggtcgcgttcccagccgttgtggcgctcggctgcctcctgcccttcgccttcatcctcgccgccgtccccgcgcttgaggccggcggaagcaagtgctcctccatcgattgcttggggaggcggatagggcctaatttccttggtaggcagggaggcgattctgcaaggctggtgcaagatctgtacagaatttttgatcaagttaacaatgaggagtccccttccaatgaaaagttaccagaatcattcagggattttcttttggagatgaaggataaccattacgatgctaggacatttgctgttaggttgaaagctacgatggaaagcatggataaggaggtaaaagggtcaaggttggcagaacagctgtataaacattatgctgcaactgccattcccaaaggaatccattgcttgtctctgcgccttactgatgaatactcctcaaatgctcatgcacggaagcaattgccaccaccagaactgttacctttgctttctgataattccttccagcattatattctagccagtgataacattcttgctgcttcagttgttgtcagctcaactatacgatcttcctcagtgcctgagaaagtagtctttcatgtcattactgataagaaaacatatcctgggatgcattcatggtttgctcttaattctatatcacccgccatagttgaagtaaaaggtgttcaccagtttgactggttgacaagagaaaatgtcccagtactagaggctatagaaaatcatcgtggagtcagaaatcactatcatggagatcatggtacagtttccagcgcaagtgacaatcctagggtgctcgcttcaaagctgcaggctcgaagccccaaatatatatccctgctgaaccatctccgcatttatttgcctgagctctttccaaacctcaacaaggtggtcttccttgatgatgacattgttgttcagcgtgacttgtctcccctttgggacatcaatcttgaagggaaggtaaatggagctgtggaaacgtgcagaggtgaagacaattgggtgatgtctaagcgtttcaggacatatttcaacttctctcacccagtgatatctcgaagtcttgacccagatgaatgtgcttgggcatatgggatgaatatctttgatctggcagcttggaggaagacaaacatcagggatacatatcatttctggttgaaggagaatctgaaatctggtcttactctctggaaatttggtactttaccacctgggcttatagcattcaggggtcatgtgcatggaatagatccatcttggcacctgcttggcttaggataccaagaaaagacagatattgacagtgtcaggaggtctgcagtgatccattataatggccagtgcaagccatggctagacattgcttttaagaacctacaaccattctgggcaaggcatgtaaattactccaacgactttgttagaaactgccatattttggagccccagtatgacaaggagtgacttagcaaatactggacacagtgagtgattatagttcacgattcatttgatggctggagaggctgattgctgttggatatgaaaatattggttactcaggaaagctatcggcattggatacaactgaccatcccctgcatcgaccggcatgcaaatacatggagttttcatctgtatcataggggaacacattcttttcatctgtatcatatgggtgcatcattcttttccatactgtaactgcacaaaagagctctgggactgggctgatccttcgtcacagaataagggctagaagattgaacgagtgggtgatcacgacgaagaaaggaggcggatattatgagggcagaagtttatatgctttccatccatccatccatccatttaattcttttttacttggatacacttgagtcattgaaattttgttccggtagttttgtgattgctttggtaggttggagatgattgtagtagagatgccgttgtttgtgagtaacctacaggatattgttacaactgttgacatattaaagatgtgcagataattcaaaaaaaaaaaaaaaaaaaaaaa

SEQ ID NO: 5082 - protein, 562 aa, Panicum virgatum
  misc_feature: Ceres CLONE 1815136
  misc_feature: Great-hit functional homolog of the protein sequence encoded by LOCUS At3g01040
  misc_feature: Great-hit functional homolog of the protein sequence encoded by LOCUS At5g15470
  misc_feature (1)..(332): Pfam Name: Glyco_transf_8 Pfam Description: Glycosyl transferase family 8
  misc_feature: Useful for making plants with altered cell wall content and/or composition
MQLRISPSMRSITISSSNGVVDSMKVRVAPQPPPPPPPPLGPGRRGGGGGWGAGWYWRAVAFPAVVALGCLLPFAFILAAVPALEAGGSKCSSIDCLGRRIGPNFLGRQGGDSARLVQDLYRIFDQVNNEESPSNEKLPESFRDFLLEMKDNHYDARTFAVRLKATMESMDKEVKGSRLAEQLYKHYAATAIPKGIHCLSLRLTDEYSSNAHARKQLPPPELLPLLSDNSFQHYILASDNILAASVVVSSTIRSSSVPEKVVFHVITDKKTYPGMHSWFALNSISPAIVEVKGVHQFDWLTRENVPVLEAIENHRGVRNHYHGDHGTVSSASDNPRVLASKLQARSPKYISLLNHLRIYLPELFPNLNKVVFLDDDIVVQRDLSPLWDINLEGKVNGAVETCRGEDNWVMSKRFRTYFNFSHPVISRSLDPDECAWAYGMNIFDLAAWRKTNIRDTYHFWLKENLKSGLTLWKFGTLPPGLIAFRGHVHGIDPSWHLLGLGYQEKTDIDSVRRSAVIHYNGQCKPWLDIAFKNLQPFWARHVNYSNDFVRNCHILEPQYDKE

SEQ ID NO: 5083 - DNA, 2038 bp, Panicum virgatum
  misc_feature: Ceres CLONE 1815140
  misc_feature: Encodes the peptide sequence at SEQ ID NO. 5084
accaaccgcttgctctctccttggattccactccttcggagcttgttgctgcagctgtgagtcccgtgcgcctctccatctccccgcccctccgccgctgccgcctggggcttcccaattccccactgcgccttgcctgccccggatttcactgtccgccgccggccgggcggctttcctctgagcgccggccgcggcggcggccgggcatctggctttgctggggttcttgagctcgtccgcgcaacgccttaactaaccctggctggggtttgggttcttgtcccggagctctcgtttgtttgaattcttgaaggttgagggagtgaaaaagggcccggatttcgaggagttcttggttccgtgtttgtctcggggaaggggaatcttgcgttcgtggaggttttgttttgtttttttgcgagggttcgtagagggtttttatatctatgaggaggggtgattttctttggttgattttttttttattctgcgcggttcttgaggagctcgggcggagttgagaacccggtaaagtttgaatttttgggcggtaaaagctccggggcctgggcggaaatggcttccatggccggggcgccgagggtccggtccctcaacatcgcggcgccggaggtggaggcgaggccggtgctggtgccggggggcaacaaggccaggtcgggcccggcgaacgcccggaaaccgtcgccgaagccgctgcggaaggcggagccggcggcggcggggacgccggagaagccggcggccaccgcggtcaaggaggaggagggcgccaagaggaatgccgtcggtgggggcggagctggcgcgcccaagggtgcgtcccctgtgccttcgccgcggcgcacgccgccggggccgccgccgaggaggaacgacgcgccgccgctgcagccgagcttaccgctcagcgcgccttgctcctcggacgcctccgcggagtcggtccgcgcccgggctttcgctgggaaggtggagaagggccggtcttggacgaaggctgtgcccaagcaagggaaggctgtgggtaaggtggcggagaacaagtcggccgctgtggattttgttgctccggtgacgccagaggctggggaagggaagaggaggtgcgcttgggcgactccaaccaccgatccttgctatgtcacttttcatgatgaggaatggggggttcccgtacacaatgacaggagattgtttgagctacttgtactatcttatgcattggctgagcttacatggcctgaaattctcaagaggagacaactttttagggacattttcatggattttgaccctgctgctgtctctaaaataaatgagaagaagcttgtggcacctggcagtgttgctcattctcttttgtcagaacaaaagctccgagctgtccttgagattgctcgccagataataaagattgctgatgaatttggatcctttgatcaatactgctggggttttctaaaccacaagcctatagtaagcaagtttcgctatcaaaggcaagttcctgtgaagagtcccaaggcggatataatcagcaaagacatgatgcgaaggggattccgtagtgtgggcccaacggtcatatattccttcatgcaggctgcagggctaacaaatgatcacctggtcagttgcttccggtttgaagaatgcaatgccactccaactctttgcacaattggcatcgacagggtaaacatgaaggcagatctgaaaaaagatgagatggcaatgaagattcgttgtgaggagattgccactaatgcagagatgccaaggacgatcgatgcacttatcgtttcatagcacaatgtagaaattggaatagcagcgtggctactgaacttgtgttatctttatgtagacagtgctagttatccctgaattcagtaggaatcaaaatgcttgtgtaaaaatcatttctgttggtaatgctactctattgtacatctaatggttagcaaagcaaggatggtgacctttttattaaaaaaaaaaaaaaaaaaaa

SEQ ID NO: 5084 - protein, 418 aa, Panicum virgatum
  misc_feature: Ceres CLONE 1815140
  misc_feature (1)..(181): Pfam Name: Adenine_glyco Pfam Description: Methyladenine glycosylase
MASMAGAPRVRSLNIAAPEVEARPVLVPGGNKARSGPANARKPSPKPLRKAEPAAAGTPEKPAATAVKEEEGAKRNAVGGGGAGAPKGASPVPSPRRTPPGPPPRRNDAPPLQPSLPLSAPCSSDASAESVRARAFAGKVEKGRSWTKAVPKQGKAVGKVAENKSAAVDFVAPVTPEAGEGKRRCAWATPTTDPCYVTFHDEEWGVPVHNDRRLFELLVLSYALAELTWPEILKRRQLFRDIFMDFDPAAVSKINEKKLVAPGSVAHSLLSEQKLRAVLEIARQIIKIADEFGSFDQYCWGFLNHKPIVSKFRYQRQVPVKSPKADIISKDMMRRGFRSVGPTVIYSFMQAAGLTNDHLVSCFRFEECNATPTLCTIGIDRVNMKADLKKDEMAMKIRCEEIATNAEMPRTIDALIVS

SEQ ID NO: 5085 - DNA, 1678 bp, Panicum virgatum
  misc_feature: Ceres CLONE 1815171
  misc_feature: Encodes the peptide sequence at SEQ ID NO. 5086
agtacctaccaccaaccgaataatggagcactccgactccgactccggcggccgcctcagccagctcaaggccttcgacgataccaaggccggcgtcaagggcctcgtcgacgcgggcatcgccaccgtcccgcctatcttccgccacccgcccgacccccacgccgcctccgcctccgccaccaccacattagatgcagatgcaatcccggtcgtcgacctcggccgccctgaccctgaccagctggtgggcctgctcagggcggccgccgagaccgttggcttcttccaggtcgtcaaccacggcgtgcccgccgagctcctcgccgagacgctggcggcggtgaggagcttcaacgaggagcccgcggaggcgaggaggccctactacaccagggaccccgccaggcgcgtcaggtaccacagcaacttcgacctcttccagtcgccggcggccaactggcgcgacacgctcttcctggagatgcccgcgccgccggaggagatgccgccgccgtgcagggccgtcgtgcccgaatacaccaggcagctgcgggggctgggcgcccgcctgctggagctgctgtcggaggccctgggcctccacgcgggctacctggagcgcgacgccggctgcctcgacggcatggtgctcgcctgccactactacccgccctgcccggagccgcacctcaccatgggcaccaccaggcactcggaccccagcttcctgacggtgctcctgcaggacggcgccggcggcctgcaggtcctccatgccggccgctgggcggatgtgccgccgcggcccggcgcgctggtcgtcaacgtcggcgacctgctgcagctcatctccaacgacaggttcaagagcgtggagcaccgggtggtggccatgagcccggccgccgcgcgggtctcggtggcctgcttcttcaggacgaccggcgccgcggcgtccaccagggcgtacgggcccatcaccgtcgccactgatgagaacgagcctccgctgccgcggtaccggagcgtcacggtggcggagttcctcgcccactacagggacaagggcctcgacggccgatcggcgctaggccgcttcagcctgctgccctcaccatcttcaggcccatcgtctaattgcaagcaaacaaattaaaacaacaaggaattgctagctagctagctcttcccaacaatcaatcgatccagccgcgctcacaaggcacctgatcgaaacctacaattaatcaacaaactacaaatataagcctttttttttaaaaaaaaaagaaccggtaggagagctgcctgttgcgttgtattaaaaaggaagaacaaagttcagattataaaactggaataaacaaaagaaaactttacactttacatagagagcccgcattgagcccgcattcgaactctctagaagaaactcaagctccactcattaggcacgctagatgtttcatcccggccaaaattcaagccacagctctcccttaatcttctctggcaatgcaaagaaggcgcttctcacaaatatatatgttagtgtatattgagcccatgtataggtgcccatctagaggcccatgtatagttactatattgccaacccttctagagtttggaagaatagacacaattattctcccaaaaaaaaaaaaaaaaaaaa

SEQ ID NO: 5086 - protein, 378 aa, Panicum virgatum
  misc_feature: Ceres CLONE 1815171
  misc_feature (1)..(99): Pfam Name: 2OG-FeII_Oxy Pfam Description: 2OG-Fe(II) oxygenase superfamily
MEHSDSDSGGRLSQLKAFDDTKAGVKGLVDAGIATVPPIFRHPPDPHAASASATTTLDADAIPVVDLGRPDPDQLVGLLRAAAETVGFFQVVNHGVPAELLAETLAAVRSFNEEPAEARRPYYTRDPARRVRYHSNFDLFQSPAANWRDTLFLEMPAPPEEMPPPCRAVVPEYTRQLRGLGARLLELLSEALGLHAGYLERDAGCLDGMVLACHYYPPCPEPHLTMGTTRHSDPSFLTVLLQDGAGGLQVLHAGRWADVPPRPGALVVNVGDLLQLISNDRFKSVEHRVVAMSPAAARVSVACFFRTTGAAASTRAYGPITVATDENEPPLPRYRSVTVAEFLAHYRDKGLDGRSALGRFSLLPSPSSGPSSNCKQTN

SEQ ID NO: 5087 - DNA, 1934 bp, Panicum virgatum
  misc_feature: Ceres CLONE 1815191
  misc_feature: Encodes the peptide sequence at SEQ ID NO. 5088
gaactctccaccacgactccgccggattggaccagtagatctcactccgccggcgctttgcttgcgttcaattcctccctccagcggaaccccagtccaacgcgcgaggacgggatcccgccgccgccccgcaccggccatctgccccgccagcggagcggtgagattggggtgggtggggtggagatgcagagcgccacgcggctgacgctgctgctgtgcgcggcgtgggcggccacggtgctctacggcgagatgggcgcctactgggcctcctacctcgcgtgctcgtggccctcgccgtcgccatcatcctcgccgccgaataaccatgtgaagattgctgttgttgctgatccacagcttatggacagcacctcccttggtcttccttcaagctcaattgctctccaagctgctgagttttacacagatttgaacatgagaaggtcctttcagtctgccatactgccatttgatcctgacatggtcttatttcttggtgatcacttcgatggaggcccatacatgtccaatgaagagtggcatgaatcattgtttcgatttaagcatatattcagcatgaatgaacagagaagaaagccgcatatcccaatcttctacctgtccggaaatcatgatattggttattcagcatttttttctgctcatcctgaggtgcttagtcggtatgaaaaaaaatttggatcaagaaactaccaattttctgctggaaaggttgactttgttgtcattgatgctcaaacacttgatggagctaaaaagagcaaagaaaggtcctcctcttgggagttcattaaaactctatccccaggtaacacatcgaacccaaaggttctactaacacatattccactctaccgacctgataacactccttgtggcccacatcgttcttcacctgttataaatcagagggtatcctatgctgccttagaccaaggaatcacctaccagaattatctaactaaagaaacttctgaccttttgctaagcttattgaaaccggtccttgtgctctcaggtcatgaccatgaccaatgcacagtcgtccactccactcctttcgggccagtaacagagcatacgctggggacaataagttggcagcaaggaaatctttatccatcatttatgctgctatctgctgggcccaagctgtcacagaattcaactgatctgaaacatgaagtcatgacaaacctctgttttctgcctaaacaaacccatatctatatctggtatatctgccagtttgcagtgaccttcgttctgctagtcttttggccaaccaatggtctgagctctgttccatacatgaatgcatttgtaagcttcatgaggtcggtaggtgctgaactgttctcaagaaccaaagaaaaagatgatgaggaagatggtgaatatgaaatggtttttgatgcggaagggtccatgcacctcgttaaaaaggctgttgcaaaagtctcaagtgctagctcagactccagaactgtaggacgtggaaatgttgtcgcaagggcgacagcaggaaaacaccaattggagcctgattcatctattcttgtcgagatgggttccgaggtgatatcagaagatggagcgaggttggcgcgccctagcaaatcaaaagtaaggaaggtgctccaacggctgttccgcgtcatccagtcgatagttgtcattgccgctctgaatgtccccctgtacatgatgcttctgttcaaggactggattgaccattgaagtacgtcagagcctagtccttccagaaattcagtacgttgattggtatctatagagtaactgcacatgcgaaaactgatttggttttcgctgaggcgtcaaacaataacatatctatttaatctgggaaatcttgttgtttacttcaaaaaaaaaaaaaaaaaaaa

SEQ ID NO: 5088 - protein, 526 aa, Panicum virgatum
  misc_feature: Ceres CLONE 1815191
  misc_feature (1)..(243): Pfam Name: Metallophos Pfam Description: Calcineurin-like phosphoesterase
MQSATRLTLLLCAAWAATVLYGEMGAYWASYLACSWPSPSPSSSPPNNHVKIAVVADPQLMDSTSLGLPSSSIALQAAEFYTDLNMRRSFQSAILPFDPDMVLFLGDHFDGGPYMSNEEWHESLFRFKHIFSMNEQRRKPHIPIFYLSGNHDIGYSAFFSAHPEVLSRYEKKFGSRNYQFSAGKVDFVVIDAQTLDGAKKSKERSSSWEFIKTLSPGNTSNPKVLLTHIPLYRPDNTPCGPHRSSPVINQRVSYAALDQGITYQNYLTKETSDLLLSLLKPVLVLSGHDHDQCTVVHSTPFGPVTEHTLGTISWQQGNLYPSFMLLSAGPKLSQNSTDLKHEVMTNLCFLPKQTHIYIWYICQFAVTFVLLVFWPTNGLSSVPYMNAFVSFMRSVGAELFSRTKEKDDEEDGEYEMVFDAEGSMHLVKKAVAKVSSASSDSRTVGRGNVVARATAGKHQLEPDSSILVEMGSEVISEDGARLARPSKSKVRKVLQRLFRVIQSIVVIAALNVPLYMMLLFKDWIDH

SEQ ID NO: 5089 - DNA, 1558 bp, Panicum virgatum
  misc_feature: Ceres CLONE 1815227
  misc_feature: Encodes the peptide sequence at SEQ ID NO. 5090
cagatatggccgcgcgccccctgctgagccactcgtcgctgaacagggggggatcgggaagaagaaagcgactcgtcagtcgtcagcgggaaaggcagctccggcgaatccgcatccgcatcatcgcatcgcatgctgtctctgcgtgcgcctgcgcctattctttttcttcttcgccgccgccgcctcctctctatatcagcgccctctccgggcagaatcggcatcggcagcagcaacagcatcagcatcaggttcaggttcagcttcagcttcagcacaggagaggtgaagcgcggccgcatttccagcgcggctgctccggcggacatggcgaccgacaggtgagccgccgggacacctggatctggttttcacccctagcctctcctcgtcgctacctctctcgctgaatcgtgggatgatgaattgctgatggccatctgttttcgccctctgcctcaactctggagcggcagcgccctgaggaagctggcgccgctggaagccatcctgttcgacatcgacggcaccctctgcgactccgaccccatccacttctccgccttccgcgagctcctgcagcagattggtttcaacgacggtgtccccatcaccgaggagttctacagcgccaacatcagcggcgggcacaacgacgacctcgcccggtctctgttcccggacatggatcaccagaaggctatccagttcatggatgacaaggaggcgttcttcagaaagctggcaccaggacagttgaaggccgtggatgggctgcacgacctctgcagacggatcgaaggccgcaacctgaagcgtgcggcggtgacgaacgctccaagggcgaacgccgagctgatgctgtcactgctggggctcacagacttcttcccggtgctcgtcatcggaagcgagtgcgaccgggccaagccgttccctgacccttacctcaaggccctcgagctcatcggcgcatcgcctgaccacaccttcatatttgaagactctgcatcagggatccgagctggtgtggctgcaggcatgcctgtggttggcctgacgactaggaaccctgggaaggctctcagcgatgcaggagcgagcttactgatcaacgattttcaggacccgaagctgctgtccgtgctggaagagctcaaacccgtgacggaaaatgggcaaatctgattggtgaagggtgatcgcaatcataataagaatgtcatgctggaaaaatacattgcactgcagaataactctgaatcctgggctggaacctggaagtgagcatggatctgtgcagaagctggtgcctgctgcagtggctccttgcattcaactagcattgcggcgaagctcctggtcctccatgatatcagcttatgtcgccaaccttttttttttataacgcattgatttaaataaaggttttatgccagtcattgcatttgagggaaacttcatgtgccaacactaacgccctatttaatttggtgcgtgaaatagtttcttcagataagtatcctgattgtgacaaaaaaaaaaaaaaaaaaaa

SEQ ID NO: 5090 - protein, 251 aa, Panicum virgatum
  misc_feature: Ceres CLONE 1815227
  misc_feature (1)..(190): Pfam Name: Hydrolase Pfam Description: haloacid dehalogenase-like hydrolase
MAICFRPLPQLWSGSALRKLAPLEAILFDIDGTLCDSDPIHFSAFRELLQQIGFNDGVPITEEFYSANISGGHNDDLARSLFPDMDHQKAIQFMDDKEAFFRKLAPGQLKAVDGLHDLCRRIEGRNLKRAAVTNAPRANAELMLSLLGLTDFFPVLVIGSECDRAKPFPDPYLKALELIGASPDHTFIFEDSASGIRAGVAAGMPVVGLTTRNPGKALSDAGASLLINDFQDPKLLSVLEELKPVTENGQI

SEQ ID NO: 5091 - DNA, 1561 bp, Panicum virgatum
  misc_feature: Ceres CLONE 1815284
  misc_feature: Encodes the peptide sequence at SEQ ID NO. 5092
acctacgccctactcggcacctggcacttgtcacctgagccatggctgccgcgcttgctggcttgtcgttgtagtggtagctgttctccgatccgccgtcgtccgacgtgtacgtccgatcgacacgtcgcccgttccggggggcgccgcgcggagaaactagcaatggcgagcgcgcggccgccggcgcgcgcggcgcggtgcgcccgctgcggcgcgtccttgtccgtggcccccggggcgcgctccgtgcggtgcgcgctctgccacgccgtcacgcgcgtcgagcgccgcccgcacggcctgcaccacgccgccgtggggttcatcaagggcctcatcaacgccttcgcgtcgccgcaggcgccgccgccctcctccgccgcggcgtcgtttgcccagctgccggcgagctacccgcgcgcccgcggctgcaagaagcgcgcgctcctcgtggggatcagctacgccggcacccggtacgagctcaagggcgccgtcaacgacgcccactgcatgggctacctgctccgcgagcgcttcggcttcccggccgactgcatcctcgtcctcacacaggaggacggggacccgtaccgggtgccgacgagggcgaacctgatgctcgcgctgcggtggctggtggacggcgccgccgcgggggactccctggtgttccacttctccgggcacggcgtgcagaagctcgacaacaacggcgacgaggcggacgggtacgacgaggcgctgtgcccgctggacttcgaggacccccgcggcggcgtcatcctggacgacgagatcaacgccaccatcgtccgcccgctgggcaggggcgtcaagctgcacgccatcgtggacacctgccacagcggcaccatcctcgacctcccctacctctgccgcctctccaggaccgggtactggcaatgggagaaccagcagacccggctctccagcgagcagaaatgcaccagcggcggcctcgcgatctcgatcagcggctgcggcgacagccaaacctcgcaagacaccacggcgttctcgggctccgcctcgacgggcgccatgacgtacagcttcatcaaggcggtggagtcggagccgggcaccacctacggccgcctgctcacggcgatgagggctaccatccgcgacaacggcggcgagttcggcatccccggtcccatcggcaccttcttccgccgggtcatcaccttcagctgcgcgcaggagccccagctgtgcgcttcggaaacgttcgacatctacagaaagcccttcctattgtgattcaagttgaacatgtggccggccgcttgcaacaatttacaaacgagtttatttatgattggcacagtttaatttgtaggtgttttcgtttgtctctcgtttcttgtttctgtgctagctagtgaacagtgatagattttcttgtgtaatcaagtggtttgaaattaagggctatatataaccatgcatgctggaattttgtagaacttgatcaatgcacatacatcttaaacatggcgtatgttgataaaaaaaaaaaaaaaaaaaa

SEQ ID NO: 5092 - protein, 375 aa, Panicum virgatum
  misc_feature: Ceres CLONE 1815284
  misc_feature (1)..(276): Pfam Name: Peptidase_C14 Pfam Description: Caspase domain
MASARPPARAARCARCGASLSVAPGARSVRCALCHAVTRVERRPHGLHHAAVGFIKGLINAFASPQAPPPSSAAASFAQLPASYPRARGCKKRALLVGISYAGTRYELKGAVNDAHCMGYLLRERFGFPADCILVLTQEDGDPYRVPTRANLMLALRWLVDGAAAGDSLVFHFSGHGVQKLDNNGDEADGYDEALCPLDFEDPRGGVILDDEINATIVRPLGRGVKLHAIVDTCHSGTILDLPYLCRLSRTGYWQWENQQTRLSSEQKCTSGGLAISISGCGDSQTSQDTTAFSGSASTGAMTYSFIKAVESEPGTTYGRLLTAMRATIRDNGGEFGIPGPIGTFFRRVITFSCAQEPQLCASETFDIYRKPFLL

SEQ ID NO: 5093 - DNA, 2162 bp, Panicum virgatum
  misc_feature: Ceres CLONE 1815289
  misc_feature: Encodes the peptide sequence at SEQ ID NO. 5094
cttcagagttccccggttcggccccctcctccgcgccgcgaaaccctaacccgcctccatggacgactcttcctccgcctccaacaagcgcaagcgcaggcgcggccgcaagctcaaggcctcaccgtcctcccctgaacggtccgccccttctccggcgcccgcccccgccgcggcgggccgccggggccgcaagccgcgccgccacgaggcccccgccgacgcggacgccgcgcgaccgccgtccccaccccgccgcggggagccgaagcccgttgctgacggaggcgatgcggtggccgtggcggtgtcggaggcggcccccgcgagctgggatgaggtggtgcgggtggtgccgtgcatggacgccgtggtcaaggtgttctgcgtgcacaccgagcccaacttctcgctgccgtggcagcggaagcggcagtacagctccagcagcagcgggtttatcatcggcggccgccgtgtcctcaccaatgcccactccgttgagcactatacccaggttaagcttaagaaacgtggctcggacacaaagtaccttgccaccgtcctggccatcggcacggagtgcgacattgcgctcttaactgtcagtgacgatgaattctgggaaggagttacccctctcgagtttggaacattaccagctcttcaggatgcagtaactgttgttggttatccaattggaggagataccatatctgttacaagtggagtggtctcgaggatagaaatactttcatatgttcatggttctacagaacttctaggcttgcagatagatgcagctattaattcaggaaattcaggtggcccagcttttaatgataaaggcaaatgtgtcggtatagcttttcaatctctcaaacatgaagatgcagagaatataggctatgtgatacccaccccagttattactcatttcatccaggactacgagaaatctggagagtacacaggcttccctatacttggaattgaatggcagaaaatggagaatcctgatctccgcaaattgatgggaatgaaaccagatcaaaagggtgttcgtgttaggagggtggagcccactgctcctgaatctggatgcctaaaaccatctgatattattcttagctttgatggtgttgacattgccaatgatggaacagttcctttccggcatggcgagcgcattggctttagttacctggtttctcagaaatataccggagagaaagctcttgttaaagttctgcgtgactcaaaagttcatgaatttaaaataaggctagcaactcacaagcgactaattgctgcacacgtaaagggcaggccaccatcatattacattgttgctggctttgtttttgcagctgtctctgtcccatatcttcgatctgaatatggaaaagattatgaatatgatgcgcctgtcaagctgttggtgaaacatttacatgcaatggcagaatcacctgatgaacagcttgtggtggtatcacaggtgcttgtggcagatatcaatatcggttatgaagaaattgtcaatacccaggttcttgctttcaatggccaacctgtaaaaaatttgaagaacttagtgaccatggtggaaaattgcaaggatgaattcttaaagtttgatttggagtatgaccagattgttgtcctggagacaaaaacggcaaaggctgctacccaggacattctgacgacgcactgtataccttctgcaatgtcggatgacctgaaggcctaaccgagggcatgatgcagcccccttgggacatcaggtggcccaaaagcttgggcctaatttttggttgaattgattagcgtagcatagtgcccagtccgtgacaaaaagaaaccccattctatgaatgcaatgtttttttaggggttcttggtgccaaagaacagactggtgtcttagctgcgccatcattgaaggctcggagggagcgtcatcgccagttaactaagctggagttgttgccagcagagagtcgccatgaaagacgatagtagctagtaagaggtggagtttttttttcttccatgatttgattacaattacatcatattggtaggagaatgagaaaagaaatcacactactctgatgctatagcatttcaattaacaaaaaaaaaaaaaaaaaaaa

SEQ ID NO: 5094 - protein, 565 aa, Panicum virgatum
  misc_feature: Ceres CLONE 1815289
  misc_feature (1)..(188): Pfam Name: Trypsin Pfam Description: Trypsin
MDDSSSASNKRKRRRGRKLKASPSSPERSAPSPAPAPAAAGRRGRKPRRHEAPADADAARPPSPPRRGEPKPVADGGDAVAVAVSEAAPASWDEVVRVVPCMDAVVKVFCVHTEPNFSLPWQRKRQYSSSSSGFIIGGRRVLTNAHSVEHYTQVKLKKRGSDTKYLATVLAIGTECDIALLTVSDDEFWEGVTPLEFGTLPALQDAVTVVGYPIGGDTISVTSGVVSRIEILSYVHGSTELLGLQIDAAINSGNSGGPAFNDKGKCVGIAFQSLKHEDAENIGYVIPTPVITHFIQDYEKSGEYTGFPILGIEWQKMENPDLRKLMGMKPDQKGVRVRRVEPTAPESGCLKPSDIILSFDGVDIANDGTVPFRHGERIGFSYLVSQKYTGEKALVKVLRDSKVHEFKIRLATHKRLIAAHVKGRPPSYYIVAGFVFAAVSVPYLRSEYGKDYEYDAPVKLLVKHLHAMAESPDEQLVVVSQVLVADINIGYEEIVNTQVLAFNGQPVKNLKNLVTMVENCKDEFLKFDLEYDQIVVLETKTAKAATQDILTTHCIPSAMSDDLKA

SEQ ID NO: 5095 - DNA, 1837 bp, Panicum virgatum
  misc_feature: Ceres CLONE 1815309
  misc_feature: Encodes the peptide sequence at SEQ ID NO. 5096
agccctctgcttgcagcagtgtacgtagcactggtaggctagctgcagccactgaccgttgctttcaatgggaacggagccggccgcgcacgtcgtgctgcttgcgagccccggtgcaggccacctcctgcccatggtcgagttcgcgcggcgcgtcgtcgcgcacggcggcggcgacggtgccgagttcacggccacgctcgtcacctacaccaacttctcctcggcaagccaccactactcctcgacgctcacgtcgctcccgccgtccgtctccaccgccgtgctccccgaggtgccgctcgacgacctccccgccgacgcccgcgtcgagacccgcatcttcaccatggtcaagcgcgcgctcccgcacctccgcgacctcctcagctccctgctcgcctcgtcccccgccggcgtcgcggctttcgtcccggacatcttgagcgcgtgggcgctcgatgtctctaccgagctcggcgtcccgggctacgtcttctccccgtcgaacctcacggcgctgcactccctgctctacatgccccagctcgacgagaccaccgcctgcgagttccgggacctgccggagcccatccggctcccgggctgcgtgccgctgcgcggcgccgacctcggcgaccctttccaggaccgcgccaaccccacctacgccttcatggtcgagctggggaggaagcacctcctcgccgacggcttcgtcgtcaacaccttggacgccctggagcacgacaccatagcggcgttccgcacgctgtcccacagcggcgtgtaccctccggcctacgccgccggccccttcgtccgtacgtgctccggcggcgaggcagctgcagcagagcgcagcagccgcctgctgcggtggctggacgagcagccggacaggtcggtcctgtacgtgtgcttgggcagcggcggcacgctgtccacggagcagatggccgagcttgccgcggggctcgaggcgagcaggcagaggttcctgtggatggtgcggttcctccccagcgacaaggacgacgaccgcagcgcaagctacttaggtggcggccacggcgacaacccgctgggctacctgccggaagggttcgtcgagaggaccagagccaccgggctcgccgtgacggagtggaccccgcaggtggaggtcctcaaccaccgggccgtcggcggcttcctgtcgcactgcgggtggaactcgacgctggagaccgtggccgcgggcgtgccgacgctggcgtggcccctctacgccgagcagaggatgaacgcggtgatcctgtccgagcaggtggggctcgcgctgcggctcgggggcagcggtaacaaggggaaggatggggtgctggtgccgcgggaggaggtggcggcggcggtgacggagctgatggtgggggagaagggcgccgcggcacgggcaagggcgcgcgagctccgggacgcggcggcggaggcctgggcgccggacggaccgtcgcgcaaggcgttcgaggccgtcgccggcaagtggaagaaagtgatcaagggatagcttgctaccctaggcttgcgcgcgtgacttgctgattcttccatgcgcgtgacattgttggatcgtcggcccgtgccttcactctccgatgccgcgtctctatgtttgcattatcacgtttgtattgtatatgtgtgtgtcgtatatttcgtgaaattaataagggcatacagccggacatgtcggtcctctagtgcatgcaccttttgttggaatatatataaaagggccggtcccatttatttataagataattaaattgagaaataaaaaaaaaaaaaaaaaaaa

SEQ ID NO: 5096 - protein, 493 aa, Panicum virgatum
  misc_feature: Ceres CLONE 1815309
  misc_feature (1)..(150): Pfam Name: UDPGT Pfam Description: UDP-glucoronosyl and UDP-glucosyl transferase
MGTEPAAHVVLLASPGAGHLLPMVEFARRVVAHGGGDGAEFTATLVTYTNFSSASHHYSSTLTSLPPSVSTAVLPEVPLDDLPADARVETRIFTMVKRALPHLRDLLSSLLASSPAGVAAFVPDILSAWALDVSTELGVPGYVFSPSNLTALHSLLYMPQLDETTACEFRDLPEPIRLPGCVPLRGADLGDPFQDRANPTYAFMVELGRKHLLADGFVVNTLDALEHDTIAAFRTLSHSGVYPPAYAAGPFVRTCSGGEAAAAERSSRLLRWLDEQPDRSVLYVCLGSGGTLSTEQMAELAAGLEASRQRFLWMVRFLPSDKDDDRSASYLGGGHGDNPLGYLPEGFVERTRATGLAVTEWTPQVEVLNHRAVGGFLSHCGWNSTLETVAAGVPTLAWPLYAEQRMNAVILSEQVGLALRLGGSGNKGKDGVLVPREEVAAAVTELMVGEKGAAARARARELRDAAAEAWAPDGPSRKAFEAVAGKWKKVIKG

SEQ ID NO: 5097 - DNA, 2289 bp, Panicum virgatum
  misc_feature: Ceres CLONE 1815315
  misc_feature: Encodes the peptide sequence at SEQ ID NO. 5098
actcgcctccggcactcgttcccgttccctgataggcggaggcggcgtggcctgaagaacaccccagactcgagcaagccaccgccgatccgttgctccgtggccgcgcaggcatgaggctcctcctcgtcgccgccgtcctcctctgggcctccgcggcggtggcgtcgaagccgcccctcgacacccttggcacccccccgcaagatgaggcgtactacaggggcggggtgatcaaatgcagggatggatcgggcaagttctccagggaccagctcaacgacgacttctgtgactgccccgacggcaccgacgagcccgggacatccgcatgccctgaagggaagttctactgcaagaatgcaggccacactccaatcacgatcttctcgtcacgagtgaatgacggcatttgtgattgctgtgatgggagcgacgagtatgatagcaatgtcacctgtaagaacacttgctggaaggctggcaaggtggcaagagataaattgaagaagaaaatcgctacgtacaaaagcggtgtcgttattcggaaacaggaagttgaaagggcaaaagaggcttttgctaaagatgaaacggagttagcaaaattgaagggtgaagagaaattactccaaggacttgtcgataagctcaaagagcaaaagaaattaatagagaaggcagaggaagaagagcgtctaagaaaagagaaggaagaaaagcgaataaaagaagaagctgaaaagaaagccactgttgaaaaggaagcacaggatgcttctcaggaagcagattctaaggaaactgtcccccctgtgcaagaagatgaaagcaaggtcggtgaacaacatgatgggcatgccacggaccatgataatcatgtgccagaaagcaggatatctgttgagcaacatggttctgaaagccaaggtgatagtggaactgtagttgaatcgccaccgaaggagtctacacctactttagagaaggaaactagctctgacaatcctgagggtttatcaagggaggagttaggtcgtatggtggcttctcgctggactggagaaagtgtaaatgaggttagtaaggacgataagaaggggcatgaagatgtgcatgaaataccagaaccagcagaagaagcatctgaagacgaattagaaataccagaacctgctgaagaaagttatggtggttatcattcagaagttgaggacgacaggcataaatatgatgatgaagagtttaatgaatcagaagatgaatatgctgatgagcatgttgaatcttataaatctgatgatgaccagaaaggtggtcaccattcagatttaactgcaacaggacattcctcgtggatggacaaaattcagcagactgtacagaatgttctccaaaaattcaactttttcaaaacccctgtggatttatcagaggcttctcgtgttcgtaaagagtatgatgatgccagctcaaagctttcaaaaatccagtccaagatatccacgctaactgagaagctaaagcacgactttggtaaggacaaggagttctattccttttatgatcagtgctttgagagcaaggagggcaagtatacttataaggtctgtgcatacaagaaagcaacacaagctgaaggacacagttccacaaacctggggtgttgggacaaatttgaagagtcataccgagtaatgcagttttcaaatggggacagatgctggaatggtccagaccgaagcttgaaagttaggcttagatgtgggctgagtaatgagcttaatgatgtcgatgagcctagccgatgcgaatatgtagctgtattgtcaactcctgcactttgcgtcgaggagaagctgaaggagctgcaaaacaaacttgacgctatgtcttcaaaacagcccgggcatgatgagctctaaaccattctggtgtgatccaaggaacaataaagaacatgtcacactgggaagcataactctcacatttacaatcataaccaaagagtggaagtctgtgaggtatatgaagagtgaaggtcaaagctggagaaatggtgatgtagcgttcagatcaccaccgaggcaatgttaggtcgcatagaaccctactttttagctgaattcttaggatgttgcaattttgctgcctcgtcctgacttttgtttggtagaggcgactgcaactgagctttaatttgtgatttgacattgctctatcttagggaaagatgctggacccgtgttgtgcctccagcttcattgccaaaaaaaaaaaaaaaaaaaa

SEQ ID NO: 5098 - protein, 603 aa, Panicum virgatum
  misc_feature: Ceres CLONE 1815315
  misc_feature (1)..(50): Pfam Name: PRKCSH Pfam Description: Glucosidase II beta subunit-like protein
MRLLLVAAVLLWASAAVASKPPLDTLGTPPQDEAYYRGGVIKCRDGSGKFSRDQLNDDFCDCPDGTDEPGTSACPEGKFYCKNAGHTPITIFSSRVNDGICDCCDGSDEYDSNVTCKNTCWKAGKVARDKLKKKIATYKSGVVIRKQEVERAKEAFAKDETELAKLKGEEKLLQGLVDKLKEQKKLIEKAEEEERLRKEKEEKRIKEEAEKKATVEKEAQDASQEADSKETVPPVQEDESKVGEQHDGHATDHDNHVPESRISVEQHGSESQGDSGTVVESPPKESTPTLEKETSSDNPEGLSREELGRMVASRWTGESVNEVSKDDKKGHEDVHEIPEPAEEASEDELEIPEPAEESYGGYHSEVEDDRHKYDDEEFNESEDEYADEHVESYKSDDDQKGGHHSDLTATGHSSWMDKIQQTVQNVLQKFNFFKTPVDLSEASRVRKEYDDASSKLSKIQSKISTLTEKLKHDFGKDKEFYSFYDQCFESKEGKYTYKVCAYKKATQAEGHSSTNLGCWDKFEESYRVMQFSNGDRCWNGPDRSLKVRLRCGLSNELNDVDEPSRCEYVAVLSTPALCVEEKLKELQNKLDAMSSKQPGHDEL

SEQ ID NO: 5099 - DNA, 1564 bp, Panicum virgatum
  misc_feature: Ceres CLONE 1815349
  misc_feature: Encodes the peptide sequence at SEQ ID NO. 5100
atccagttctttgcttggccccctccagccctttcccctagcgctgccgtagagggaagaagaaataattcggcgcggcaaatctccgcgcaccacaattctcgtgctcgattcgccgcgatgatgatcccgtggggtggggtcgggtgctgcctcagcgccgcggcgctgtatctgctcgggaggagcagcgggagggatgcggaggtgctgcgctcggtggcaagggctggcagcatgaaggatttagctgctatcttggacactgcaagtaaagtcctaccacttgtagttgccgtttctggaagagttggttcagacacgccacttatatgccaacaaagtggcatgagaggtgtaatcgttgaggaaacggcagagcaacacttcctgaagcacaacgatgctggatcctggattcaagattctgcagtgatgctttctgttagcaaagaggttccatggtatctggatgatggaactggacgtgtctatgtggttggtgctcgtgctgcagctggtttaattttaactgttgccagtgaggtttttgaggaatcagggcggacacttgtacgtggaactctagattatttacaaggattgaagatgctcggagtaaagcgtactgaaagagttcttccaactggaacctctttgacggttgttggtgaggccattaaagatgatgttggaactattcgaattcagcgaccacacaaaggaccattttatgtatcaccaaaaagcattgatcaacttatcttgaatcttggaaaatggaccaagttataccggcttgcttccatgggctttgcaacatttggtgtcttccttcttgcaaagcgtgcaatacagcattttctagaaagaaagcgccggcatgaactgcagaaaagggtttttaatgcagcagcacaaaggcaagctagagaatctgaagggggcaatggtacatcggacacagaacctaacagtaaaaaagatcagttagtgctggatatatgtgttatatgccttgagcaagagtacaatgctgtttttgtgccgtgtggccatatgtgttgctgtatggcgtgctcttcacatttaacaaattgcccactttgccggagaagaatagaccaagctgtcagaactttccgccattgacggcaatgtatgatgctaaaactggcatgggaccaccacgttgaactgcttcttttgaaaccagttggtcaaccaaggacatgaactgcaatactgggttgaagtttcttcaaggagtttgctaacagaacagtgttgcaagctcatagctaatgggtgctgttgcctgtaatactacattgtgtacagaatgttcttgtgtaaatgcacctaggctagcagcgagtttattgataatgtggatgcttgtaacatttatcgctgcccaatgggcatttgtgcagaggaataacaaagttgtttgcgttgttaacattaaatcaatttttctggtgaatcgagtggaaaaccagccatgattcttttgtgcctggtttgcttggcagggtcataaaaaaaaaaaaaaaaaaaa

SEQ ID NO: 5100 - protein, 343 aa, Panicum virgatum
  misc_feature: Ceres CLONE 1815349
  misc_feature (1)..(35): Pfam Name: zf-C3HC4 Pfam Description: Zinc finger, C3HC4 type (RING finger)
MMIPWGGVGCCLSAAALYLLGRSSGRDAEVLRSVARAGSMKDLAAILDTASKVLPLVVAVSGRVGSDTPLICQQSGMRGVIVEETAEQHFLKHNDAGSWIQDSAVMLSVSKEVPWYLDDGTGRVYVVGARAAAGLILTVASEVFEESGRTLVRGTLDYLQGLKMLGVKRTERVLPTGTSLTVVGEAIKDDVGTIRIQRPHKGPFYVSPKSIDQLILNLGKWTKLYRLASMGFATFGVFLLAKRAIQHFLERKRRHELQKRVFNAAAQRQARESEGGNGTSDTEPNSKKDQLVLDICVICLEQEYNAVFVPCGHMCCCMACSSHLTNCPLCRRRIDQAVRTFRH

SEQ ID NO: 5101 - DNA, 2197 bp, Panicum virgatum
  misc_feature: Ceres CLONE 1815370
  misc_feature: Encodes the peptide sequence at SEQ ID NO. 5102
gcgcagcgctgatctcactactcattacaatggccttccttgaagcatagattatatccgagcaggtgctgcggccaacccttaaatcatcggcaaggagtacttgctgttggcatccctgtgcgccgcgccgcgcacacatgtcgaggcccagcggcgccgcgccggccgtgtcagcagctcagcagccgccgtggtgaatcggtgacgatcccttgaagcaagcggcggccaccctccccgcctgcggcctgcctatatatccgcggccaccgctcgcccttcctcttccacaccaccatagcagtcgccgtcgccatgaggttgtcgccgccgtcaccgcccgcggcgtcggcgtggctggtgcccgtcgtcctcgccgtgctggcggcgtgccaccaggctgcggcgccgacgctgtcgacggcgtcgcggtgggtggtggacgcgagcgggagccgggtgaagctggcgtgcgtgaactggccgtcgcacctggagccgatgctggcggagggcctgggccagcggcccgtgggcgccatcgcggcggacgtggccgccatggggttcaactgcgtccggctcacgtggcccacgttcttggtcaccaacgcctcctacggcaacctcaccgtcgcgcagtccttccagcggctcaacctcaccgagtcgctcgccggcgtcagggccaacaaccccggcgtcgccgacctcaagctcatcgacgcgctcaaggccgtggtgagcagcctgggcgagcacggcgtgatggtgatcctggacaaccacctgagcaagccggggtggtgctgcagcaacaccgacggcaacggcttcttcggcgacgccttcttcgacccggacgtctgggtcgacggcctcaccaggatggccgccacgttcgccgccgcgcccaacgtcgtcggcatgagcctccggaacgagctcaggggacccaggcagaacgccaacgactggtacaagtacatgcagcgcggcgcggaggcggtgcacgcggcgaacccgcgcgtgctggtcatcctctcgggcctcagcttcgacaacgacctggccttcctcagctcgcggccggtgaacctgagcttcgccggcaaggcggcgttcgaggtgcactggtacagcttctccaacagccaggagtggagctccgggaacgccaaccaggcttgcgcgcgcgtgtcggccggcgtcacccgccgcgcgctctacctgctcgaccggggctggcccgtcatcctcagcgagttcggcgtcgacaaccgcggcgccaacgccaacgacaaccgctactacggctgcgccgccgccgtcgccgccgacctcgacctggactgggcgctctgggcgctgcaggggagctactacctccgggagggcgtccggggccacgacgaggcctacggcgtgctcgacgggtcccggagcaagccccgcaacgccaccgcgctgcgccgggtccaggccctgcagcgcccgctcaggggccccggcctcgccgaggcgccgccgtacacggcgctcttccacccggtgaccgggatgtgcgcggtggtgcgccgccggtcgccggcggcgcagaagctggagctgggcccctgcgacgagacggaggcgtgggagtacagcgcccaggaccagagcctggcgctgcgggacagctcccagctgtgcctccgcgccgagggcgccggcaggcccgcgagcctcggcgcgagctgcggcgacgccatggcgcggtggcgcctcgtgtcagactccaagctgcacgtcgccgtcaacgcgacggcggcggcgtcgtcctcggcctctgctgcgggcggcggcgcgctctgcctggacgtgggcgccgacggccggagcgtggtcaccaacccgtgccggtgcctgagcgccgacaacagctgcgacccggagagccagtggttcaagctggtgaacagcacgaggagcgtggccgccaagcccaacttgctcgcgcagctgccgctcaagctcaagaactggaagatcaggtcgttttgatcttcgatcgatcgatcgttggcttccatcatcctaccgagagaaatgtagcgcgtacgtgctaggacgacgagaacagagaaacgctgccctttgaaccatagagcggtgttccatcatcctactgaggcaaaaaaaaaaaaaaaaaaaa

SEQ ID NO: 5102 - protein, 575 aa, Panicum virgatum
  misc_feature: Ceres CLONE 1815370
  misc_feature (1)..(303): Pfam Name: Cellulase Pfam Description: Cellulase (glycosyl hydrolase family 5)
MRLSPPSPPAASAWLVPVVLAVLAACHQAAAPTLSTASRWVVDASGSRVKLACVNWPSHLEPMLAEGLGQRPVGAIAADVAAMGFNCVRLTWPTFLVTNASYGNLTVAQSFQRLNLTESLAGVRANNPGVADLKLIDALKAVVSSLGEHGVMVILDNHLSKPGWCCSNTDGNGFFGDAFFDPDVWVDGLTRMAATFAAAPNVVGMSLRNELRGPRQNANDWYKYMQRGAEAVHAANPRVLVILSGLSFDNDLAFLSSRPVNLSFAGKAAFEVHWYSFSNSQEWSSGNANQACARVSAGVTRRALYLLDRGWPVILSEFGVDNRGANANDNRYYGCAAAVAADLDLDWALWALQGSYYLREGVRGHDEAYGVLDGSRSKPRNATALRRVQALQRPLRGPGLAEAPPYTALFHPVTGMCAVVRRRSPAAQKLELGPCDETEAWEYSAQDQSLALRDSSQLCLRAEGAGRPASLGASCGDAMARWRLVSDSKLHVAVNATAAASSSASAAGGGALCLDVGADGRSVVTNPCRCLSADNSCDPESQWFKLVNSTRSVAAKPNLLAQLPLKLKNWKIRSF

SEQ ID NO: 5103 - DNA, 2167 bp, Panicum virgatum
  misc_feature: Ceres CLONE 1815372
  misc_feature: Encodes the peptide sequence at SEQ ID NO. 5104
cgcgggggtggaagcggaagcgggttaatccagcaccggaatgacgtgatccccccgttcctttccatcccatcccgtaccctctcatcactgcaggctgctgctgcagcagacggccttgaaaaatcccaccaccttccttgctccctgcatcacccactcctcgcgccacccaccgggagcgtacggcgccacaatgcggccgcctaccctcctcccgctcgccgccgccgccgccctcctcgtcctcctcctcctcgccgccgcgccaacgcccgcagcctcccgccgccaccaccccgcggcggcggcggcggacacggagacgctcgacgtcgccgcttccctctcccgcgcccgcgccgcgctctccaccgacgccgccgccgccgcttcgctgcaccagtccgccgcggcggccgggaagccgaagcgccgctccccgcggaagggcgcctcccccctcacgctgcagctccacgcgcgggacttcctcccgggcgagcagggccggcacgagagctaccggtccctggtgctgtcccgcctccgccgcgacgcgtcccgcgccgcggcggtgtcggcgcgcgcggcgctggcggcggacggggtgacgcgcctcgacctcgtccccgccaacgcgtcggcggtgttcgcggcctccgcggcggcgatccagggccccgtggtgtccggcgtggggcagggcagcggcgagtacttctcccgcgtcgggatcggcagccccgcgcggcagctgtacatggtgctcgacaccggcagcgacgtgacctgggtgcagtgccagccctgcgccgactgctaccagcagtcggaccccgtcttcgacccctccctctccgcctcctacgccgccgtcccctgcgactccccgcgctgccgggacctcgacaccgccgcctgccgcaacgccacgggcgcctgcctctacgaggtggcctacggcgacggctcctacaccgtcggcgacttcgccaccgagacgctcacgctgggggactcgccgcccgtcggcaacgtcgccatcgggtgcggccacgacaacgagggcctcttcgtcggcgccgcggggctgctcgcgctcggcgggggcccgctctccttcccgtcccagatctccgccgccaccttctcctactacctcgtggaccgcgactcccccgccgcgtccacgctccagttcggggacggcgccgccgaggccggcaccgtgacggcgccgctcctccgcagccctcgcacgagcaccttctactacgtcgccatgaccggcatctccgtgggcgggcagccgctgtccatcccgccctccgccttcgccatggacgccgcctcggggtcgggcggcgtcatcgtggactcgggcaccgccgtcacgcggctccaggccgcggcctacgcggcgctccgcgacgccttcgtccggggcacgccgtcgctgccccggacctccggggtgtcgctgttcgacacgtgctacgacctgtcgggccggacgagcgtggaggtgcccgccgtggcgctgcggttcgagggcggcggcgcgctgcggctgccggcgaagaactacctgatccccgttgacggcgccgggacctactgcctggcgttcgcgcccacgaacgccgccgtgtccatcatcgggaacgtgcagcagcagggcacccgcgtcagcttcgacaccgccaagggcgccgtcggcttcacgcccaacaagtgctagcctggcggcagcggtagtagtagtggggcgattagtggaggaggtaattaatgtaatgttatttagtggggccgggaggggacggggaggacccaccggggtctatgcgctgccgctgccggtctggggaggcgcgaaaggccaaggcgaggacaggtgattccatgccatgccagcctgtgcggtgggggtcccgtgttcttctcggtctttgagtatggatggggtgcgtgcttgcgtgtcgtcgggcttcttcctttggggttgggtgtgggtgtgggtttgcgtggtggatttgcgtgcgtggaggtggagccgtggcatgaccaactacctcttgccatggggtgctccggtttatttaaaatttcatctcatgtccagaaaatggaagtttccatccaaaaaaaaaaaaaaaaaaaa

SEQ ID NO: 5104 - protein, 515 aa, Panicum virgatum
  misc_feature: Ceres CLONE 1815372
  misc_feature (1)..(337): Pfam Name: Asp Pfam Description: Eukaryotic aspartyl protease
MRPPTLLPLAAAAALLVLLLLAAAPTPAASRRHHPAAAAADTETLDVAASLSRARAALSTDAAAAASLHQSAAAAGKPKRRSPRKGASPLTLQLHARDFLPGEQGRHESYRSLVLSRLRRDASRAAAVSARAALAADGVTRLDLVPANASAVFAASAAAIQGPVVSGVGQGSGEYFSRVGIGSPARQLYMVLDTGSDVTWVQCQPCADCYQQSDPVFDPSLSASYAAVPCDSPRCRDLDTAACRNATGACLYEVAYGDGSYTVGDFATETLTLGDSPPVGNVAIGCGHDNEGLFVGAAGLLALGGGPLSFPSQISAATFSYYLVDRDSPAASTLQFGDGAAEAGTVTAPLLRSPRTSTFYYVAMTGISVGGQPLSIPPSAFAMDAASGSGGVIVDSGTAVTRLQAAAYAALRDAFVRGTPSLPRTSGVSLFDTCYDLSGRTSVEVPAVALRFEGGGALRLPAKNYLIPVDGAGTYCLAFAPTNAAVSIIGNVQQQGTRVSFDTAKGAVGFTPNKC

SEQ ID NO: 5105 - DNA, 1696 bp, Panicum virgatum
  misc_feature: Ceres CLONE 1815403
  misc_feature: Encodes the peptide sequence at SEQ ID NO. 5106
gttggggggagcttaaaattagaaggccagcgcaataattgagcaggcgggcacggcaggagccccctcctaatcgctgccctgaacatgtgttccccttctccccggcgtattatatgaggaggaggagctcgaggtggtgatcgatgcgtggaggaggaggatgctgccgctgataatataaagcagaggcaggagaggccgaccctctggccttgctgctcttcccccacctccgtcccccacatgccctgacccccgccgcccggccctgccctgctgcccccaagctgaatcttgccccgaacaactagcggtagctgcattggcggggaaagcgcgaggagctcagcagcaatggcggagccggagggcgccgggaggtactggtgccacatgtgcgccgtggcggtgaggcccgcggagggcgagccggagatgaagtgcccgcactgccacagcggcttcctcgaggagatggagacggcccacagcgcggccgcggccgacggcggcgaaggcggcggcgcgttgaccgaggtggaccccggcgctgaccgcccgagctccatctgggcgcacgccatcctcagcacggtggacagctccgtccgccgccgccgcagccggcgccagcaggagcccggtggcttcctccacgactgggacgagcacgacttcacgcggcgccggcgccgcgtcaccgcgttcctgcgcctcctgcacgagctccgggagcgccagctgcagcgcctggaggcggccgccgacgtcgccatcgagggcgaccagctgacccctttcggccggagcctcttcatcggcgccgctggcggcggcggcgagcatggcgtggcgctgggcgactacttcctcggcaccggcctcgacgccctggtgcagcagctgaccgagggtgaccccggccgccagggcacgccgccggccaagaaggaggccgtcgaggcgatgcccaccgtggagatcgcggggggcaacggcgacgacgcggccagctgtccggtctgcctggaggactacgcgcctggcgagcgcgcccgggagatgccctgcaggcacaggttccacgccaactgcatcgtgccatggctcgagatgcacagctcctgtcccgtctgccggttccagctgccggccgacgacgacaacaagagctcatgcggtagtggccccgacggcggtggctatgtcaacgtcgatgctgatcatgaaggcaacgacaatggcggcggcggggatggcagggcaggctctgctggcaatgccgagccagagcgcatcggcgttgccgttgtggacgccgaagagagcaacaggcggctgccggcgaccatacagtggctcaacagcatgttctcgccgtccggcggcagcagcagcagcagctctcagcattgggaggattgagcaatgacgatgatggctgctggtgctggtcaagcccatcggtgccagtgtacatagggaggaagcatgccgggttggtgccatggaaatttggagccccttttcagtgtgttagttttgctcatgtaatattcactgtgatacagtcctcatggtcgaccaaagaacagatatgggcaagtgtatgaacttgccttctgcgtgaatctggtgctagcagcgtcttacaagtcaagtatggtttctgcaaaaaaaaaaaaaaaaaaaa

SEQ ID NO: 5106 - protein, 356 aa, Panicum virgatum
  misc_feature: Ceres CLONE 1815403
  misc_feature (1)..(41): Pfam Name: zf-C3HC4 Pfam Description: Zinc finger, C3HC4 type (RING finger)
MAEPEGAGRYWCHMCAVAVRPAEGEPEMKCPHCHSGFLEEMETAHSAAAADGGEGGGALTEVDPGADRPSSIWAHAILSTVDSSVRRRRSRRQQEPGGFLHDWDEHDFTRRRRRVTAFLRLLHELRERQLQRLEAAADVAIEGDQLTPFGRSLFIGAAGGGGEHGVALGDYFLGTGLDALVQQLTEGDPGRQGTPPAKKEAVEAMPTVEIAGGNGDDAASCPVCLEDYAPGERAREMPCRHRFHANCIVPWLEMHSSCPVCRFQLPADDDNKSSCGSGPDGGGYVNVDADHEGNDNGGGGDGRAGSAGNAEPERIGVAVVDAEESNRRLPATIQWLNSMFSPSGGSSSSSSQHWED

SEQ ID NO: 5107 - DNA, 1480 bp, Panicum virgatum
  misc_feature: Ceres CLONE 1815446
  misc_feature: Encodes the peptide sequence at SEQ ID NO. 5108
aatctgctccacgcctatcactgttcactgctcggtatcgtctgcaactgcaacgccgggagcttgagcttgagagagagagaagctagcatgacgaagacgcaaggaaccggagccgcggcgccgcgcgcgccggcgctgccgtggacggtgcggttccgcatcttcgccctcgtcaccgccaccgacatcgcgcagcggcccgacggcacggtcaaccgcttcatggtctcgctcgccgaccgccaggcccgcgccagcgcgcggccggacgggctcggcgtcgtgtccgccgacgtcgacgtcgacgcgtcgcgcggcctgtgggcgcgcgtgttctcgccgtcgtcgtccgtcgtcgaccccgcggcgcccgcgctccccgtggtggtctacttccacggcggcggcttcacgctgctctccgcggcgtcggccctctacgacggcatgtgccgccagttctgcagcgagctcggtgccgtcgtggtgtccgtgaactaccgcctcgcgcccgagcaccggttccccgccgcctacgacgacggcgtggacgtgctccggtacctcgggagcgccggcctccccgacctcggcgtcccggtcaacctctcccgctgcttcctcgccggggacagcgccggcggcaacctcacccaccacgtcgcgcagcgctggacggacaccgcctccgcccccatccgcatcgccggtatcatcctgctgcagccgtacttcggcggcgaggagcgcacgccggccgagctgagactggagggcgtggcgccagtggtgaacatgcggcgctcggactggtcgtggcgggcgttcctgccggagggggccaaccggaaccaccctgctgcgcacgtcaccggcgaggccgccccggagcccgagctggcggaggcgttcccgccggcgatggtggtgatcggcgggatggacccgctgcaggactggcagcggcggtacgccgccatgctggagcggaaagggaaggccgtgcaggtcctggagttcccggaggccatccacgcgttctacgtgttccccgagctcgccgactccggcaaggtcgtgaaggcgatcaaggcgttcatggatgagccgagggcagcacatcccagccagctcctcagctgctgatccatcgtcgtcgtgcctacaacttgtcgaccggtggtggaggtccgtcgcatagccctcctgcgacgaacacatcatcggaaaacaccagcggtggacagagcagctccaggcccccaacgacgtcaaaaagcagtagaagagagcgtcttttggtgcacatggatcttgtttatctatcatgcactactgtaatttgaattattcttgtagtagacttgtaatgtgtactttgtggtcatgtattagtactactattattagacgtgtaatggaccacactttgtgcaatcgagtatattgtaatgtccaaaaaaaaaaaaaaaaaaaa

SEQ ID NO: 5108 - protein, 352 aa, Panicum virgatum
  misc_feature: Ceres CLONE 1815446
  misc_feature (1)..(229): Pfam Name: Abhydrolase_3 Pfam Description: alpha/beta hydrolase fold
MTKTQGTGAAAPRAPALPWTVRFRIFALVTATDIAQRPDGTVNRFMVSLADRQARASARPDGLGVVSADVDVDASRGLWARVFSPSSSVVDPAAPALPVVVYFHGGGFTLLSAASALYDGMCRQFCSELGAVVVSVNYRLAPEHRFPAAYDDGVDVLRYLGSAGLPDLGVPVNLSRCFLAGDSAGGNLTHHVAQRWTDTASAPIRIAGIILLQPYFGGEERTPAELRLEGVAPVVNMRRSDWSWRAFLPEGANRNHPAAHVTGEAAPEPELAEAFPPAMVVIGGMDPLQDWQRRYAAMLERKGKAVQVLEFPEAIHAFYVFPELADSGKVVKAIKAFMDEPRAAHPSQLLSC

SEQ ID NO: 5109 - DNA, 1886 bp, Panicum virgatum
  misc_feature: Ceres CLONE 1815458
  misc_feature: Encodes the peptide sequence at SEQ ID NO. 5110
actagagcagcaagagcagccatcgagcccccaggcgaggaggctacgcctacgctacgcagagccacacaccgcgacgccagccacgaagcggatggccgccgccgccgccgccgccgcgggggacgagccgcgcgtccgcagctgccatattgtggcggtgcccttcccgggccgcggccacgtcaacgccatgatgaacctcagccgcctcctcgccgcgcgcggcgccgcggtcaccttcgtcgtcaccgaggagtggctcggcctcatccgctccttctcctcctcctccccggccgacggcgtccgcctgcgcgccatccccaacgtcatcccctccgagcacggccgcgccgccgaccactcgggcttcctcgacgccgtcgccaccgagatggaggcgcccttcgagcgcctgctcgacgggctcgagggcgcgccgcccgccgcgctcgtggcggacgcctacgtctcctgggtcgtcggcgtcggcaaccggaggcgcgtccccgtctggctgctcttccccatggccgccaacttcttctccgcctactaccacttcgaccgcctcccggcctggcttaccggcgacggcgagcacgcgccggactctggtgatactgtagataaatctgatcagagacttgggcaccatatctccagtcaggcttcaagttcgataaggttgtctgatcttgagcccttaattcgcaacaagagaaaagtaaagcatatcctatcagcaatctcaagcgttagaaatgctcagtgcctccttttcaccaccatgtatgagcttgaggccagtgtcatcgactcaatacagtcagtactctcttgcccagtgtacccaatcggtccttgtgttccctacatgacacttgaagaccaccggaccatgagcaatggggataccagccaagtagactacttcacatggttggattctcaacctgtaaactcagtattatatgtgtcccttggcagctttgtctcagtgtcagctgctcagcttgacgagattgcgttggggctagcagcaagtgaggtcaggttcttgtggattcttcgcgaacaatcccctggggtgcgcgaagtcattggtgatactgataaggggatgatactgccgtggtgtgagcagctgaaggttttgtgccattcctctgttgggggcttcttatcccattgcgggttgaactcgacacttgaagccatctttgctggtgtacctatacttgccttaccactattctttgatcaaccgcttgatggccgattaattgtggaagaatggaagattggcctgaacttgagggattgtgctagcaaggatggtctgattgggagagaggatattgcacgggctgcaaagaggctgatgtcctctgatgaacctgagacaaaggcagtgaggagacgtgctcttgagtggaaagaagcttctcgcagagcagttgacaatgggggatcttcataccgtaatctgagtgcattgatggagatggcatgttcttcagcataattggaatcagtacggtatgtgctgaaactgatcttgtcatacacttgtaatcatcagtgtttcatatacggatgctacaatcatccctctttaaaagtcatgcgatttctgaaaggtgacgctcataatcacctttacttatgatgtgttcgacatataaaccagttcttttctcagagtttcatttggattgtactactactatgactctctgtcatcttttaaagaaacagcagtatttacttttagatgttatattttgccaaatgctagtgtatacagtgttttcttctcattattgaaactagcatagtgcccgtgcgttgctacggccaaaaaaaaaagaaaaaaaaaa

SEQ ID NO: 5110 - protein, 478 aa, Panicum virgatum
  misc_feature: Ceres CLONE 1815458
  misc_feature (2)..(121): Pfam Name: UDPGT Pfam Description: UDP-glucoronosyl and UDP-glucosyl transferase
MAAAAAAAAGDEPRVRSCHIVAVPFPGRGHVNAMMNLSRLLAARGAAVTFVVTEEWLGLIRSFSSSSPADGVRLRAIPNVIPSEHGRAADHSGFLDAVATEMEAPFERLLDGLEGAPPAALVADAYVSWVVGVGNRRRVPVWLLFPMAANFFSAYYHFDRLPAWLTGDGEHAPDSGDTVDKSDQRLGHHISSQASSSIRLSDLEPLIRNKRKVKHILSAISSVRNAQCLLFTTMYELEASVIDSIQSVLSCPVYPIGPCVPYMTLEDHRTMSNGDTSQVDYFTWLDSQPVNSVLYVSLGSFVSVSAAQLDEIALGLAASEVRFLWILREQSPGVREVIGDTDKGMILPWCEQLKVLCHSSVGGFLSHCGLNSTLEAIFAGVPILALPLFFDQPLDGRLIVEEWKIGLNLRDCASKDGLIGREDIARAAKRLMSSDEPETKAVRRRALEWKEASRRAVDNGGSSYRNLSALMEMACSSA

SEQ ID NO: 5111 - DNA, 3306 bp, Panicum virgatum
  misc_feature: Ceres CLONE 1815459
  misc_feature: Encodes the peptide sequence at SEQ ID NO. 5112
atttttcttccgcttaaaccctaaccaaaacccctcccctcccctgctcctccccgctcgccgcccgccaccatgtcgatggcggcggccgcctccctccgctccctggcgcgccgccggccccgcctccgcttgcccgtggcgccccttgtggtccctggtgcccgcgcggcattcctctccggcgcggccgaggaggcggccgcggatgcggcggcggcgccgcctgccccgggccggaaggtgctggagagcttccgcgaggagtttgagatcgggggccgctccgttgcattcgagacgggaaagatggcgcgcttcgcgaacggctccgtggtgatctccatggaagacaccaacgtcctcgcaaccgtcgccgctgccaagtcctccgagcccgtccgggactttctcccgctaactgttgactatcaagaaaaacaatatgctcaaggtgttattccgacaacatatatgcgcagggaaggtgtccctaaggaaagggaacttctgtgtgggcgtataattgatcgaccaataaggccattgtttcctcctggcttttaccatgaagttcagatcatggtaaatgttctttcattggatggaaagcaagatccagatttgatggctgcaaatgcctcttcagctgcactgatgctatccgatataccttggaatgggccgattggagtaatacgtgttgggagaattgatgggaattttgtcctaaatcctacagtcgatgagctaggtttgagtgatctcaatcttatttatgcatgttcacgggataaaactctaatgatagatgtgcaagctcgtgaaataaccgaaagggatcttcaggcaggaatgaagcttgcacactctgaggcaattaaatgtattgacccccaaataagattggctaagcgagctggcaaagtgaagaaagagtacaagatatctctgatttcagatacatcctacgagaaaattagaacattatcagaagcaccaattgaagaagtcttcactgattcatcatatggcaagtttgagcggggagaagctttagagaaaattacacaatctgtgaaagcaaagcttgaagaagaaaatgatgaggacagcttgaagtttctgtccaaggcagttgatacagtgagaaaacaggttattcgtaaaagaataattgaggagggacttagagtagatggtagacaacttgatgaggtcagaccagtgtattgtgaatccaatacatacccggtattacatggctctgccctgttttcacgtggagatactcaggttctatgtacagttacccttggtgtccctggtgatgctcagcgactggattcaattgttggtcctccaacgaagcgtttcatgcttcactatagctttccaccattttcaataaatgaagttgccaaacgtgggggcctgaatcgacgggaagttggacatggcactcttgcagagaaagcattgctcgctgtgcttcctccagaaagtgattttccatatactgttcgggtaaattcagaagtcatggcctctgatggttcaacatcaatggcatcagtatgtggaggaagtatagccttgatggatgctgggatacctgtaagagaacatgtagctggtgtttcagttggtcttgtaagtcaagtggatccaactactggagatatttctaattatcgtatcttaacagatattttgggtcttgaagatcatttgggtgacatggacttcaaaattgcaggaacaagaaagggcattactgctattcaactggatataaaacctgctggaataccattggacataatttgtgaaagtttagagcctgcacggaaggctcgaaatcaaattcttgaccacatggaccaggaaataagtaccgcacgtgctatgaatgatggaactgcccctcgattagctacactgagcttcagcagtgattctcttaggaaactgcttttccacaggaaaacaattgagcgagaaacaggtgcacgggtatcagtcagcgacggtacagtcactattgttgctaaaacccaaccaattatggataaagctattgagaaggttgagtttctcgtgggccgtgaaattgaagttggccgaacatacaaaggaattgtttcctcaattaaggagtatggcgcttttgtggagttcaatggtggacagcaaggccttcttcacgtttcagagttgtcacatgaaccggtatcaaaagtctccgatattgtaactgttggccaagtgctatctttgatgtgtattggacaggatgtgaggggtaacattaaactttcacttaaggcaaccttaccccaaccacgtaagaagaaggatttggaaagtcaagatcctttgccaagtcaagaagtaggctgggctgctgtagagaacatgcccagcttgggtgctgatgctgagccatccagtagtaaacaggaagaggcacctgcattttcgactccttcagttataattcgaagtgaggctgactgtgatgctcaagatgctgtaaatggtcctaagaagaggccaaaggttgcaaagtcatctcctagaccatataaagcaccaagcgcatgtcaggaggttaggacagctactgctaagaaagctccaggtgctaccaagaaaactaagaaagtaaagattaaggaatctggaagtgatggcctggaatccagtgggtcagaggttccagaacagactgctagcaacactcttgacctgaagcagagtcctgtgaacttccaatctggatctatgaagttgggtgatgtagttacatcaaaggtctaccagattcgagcttttggactagtacttgagctgagcgatggagcacgtggaatgcataaatttgaggagaatggtcaaaaggaatttgaagttggacaggaactacttgtgaaatgtcgaagtttcaacgccaagggaattccagtcttctcattgctggactagtgcacaagggccgtcagctgcaaatgtgtagcaggctagcagctaatctgccaacgtgaggaacacgttgctagcaaaattttgttctttagcggcggttatgagcaattttctcgagtttttgcacccccatgaaacatgcaaccattaatagaacggaggtaacattaggtccagagattcacatggagtgtagagcgtacgaaccacttttccggttgtcccgaatcctgctgcagaaaatgtatattattagggtataaggttgctaatccatcagttgattaaaatagtagacaatggatgccaattcttcgc

SEQ ID NO: 5112 - protein, 971 aa, Panicum virgatum
  misc_feature: Ceres CLONE 1815459
  misc_feature (1)..(134): Pfam Name: RNase_PH Pfam Description: 3' exoribonuclease family, domain 1
MSMAAAASLRSLARRRPRLRLPVAPLVVPGARAAFLSGAAEEAAADAAAAPPAPGRKVLESFREEFEIGGRSVAFETGKMARFANGSVVISMEDTNVLATVAAAKSSEPVRDFLPLTVDYQEKQYAQGVIPTTYMRREGVPKERELLCGRIIDRPIRPLFPPGFYHEVQIMVNVLSLDGKQDPDLMAANASSAALMLSDIPWNGPIGVIRVGRIDGNFVLNPTVDELGLSDLNLIYACSRDKTLMIDVQAREITERDLQAGMKLAHSEAIKCIDPQIRLAKRAGKVKKEYKISLISDTSYEKIRTLSEAPIEEVFTDSSYGKFERGEALEKITQSVKAKLEEENDEDSLKFLSKAVDTVRKQVIRKRIIEEGLRVDGRQLDEVRPVYCESNTYPVLHGSALFSRGDTQVLCTVTLGVPGDAQRLDSIVGPPTKRFMLHYSFPPFSINEVAKRGGLNRREVGHGTLAEKALLAVLPPESDFPYTVRVNSEVMASDGSTSMASVCGGSIALMDAGIPVREHVAGVSVGLVSQVDPTTGDISNYRILTDILGLEDHLGDMDFKIAGTRKGITAIQLDIKPAGIPLDIICESLEPARKARNQILDHMDQEISTARAMNDGTAPRLATLSFSSDSLRKLLFHRKTIERETGARVSVSDGTVTIVAKTQPIMDKAIEKVEFLVGREIEVGRTYKGIVSSIKEYGAFVEFNGGQQGLLHVSELSHEPVSKVSDIVTVGQVLSLMCIGQDVRGNIKLSLKATLPQPRKKKDLESQDPLPSQEVGWAAVENMPSLGADAEPSSSKQEEAPAFSTPSVIIRSEADCDAQDAVNGPKKRPKVAKSSPRPYKAPSACQEVRTATAKKAPGATKKTKKVKIKESGSDGLESSGSEVPEQTASNTLDLKQSPVNFQSGSMKLGDVVTSKVYQIRAFGLVLELSDGARGMHKFEENGQKEFEVGQELLVKCRSFNAKGIPVFSLLD

SEQ ID NO: 5113 - DNA, 1590 bp, Panicum virgatum
  misc_feature: Ceres CLONE 1815558
  misc_feature: Encodes the peptide sequence at SEQ ID NO. 5114
acgattgtcattttccttcagtgaacgccggggcgccacggcaaacacccccgccggttgcgccacgtgacgtgagcagcctcgcctcgcctggctcgatagctcagcgctgctctgctcctgaatcatctccggccctctccgcactccacagcaatggcggaaactcctctgcatcactccaccgatccgttcacagacggcgagcacaatgagcacgaccctgccgtgcccgcgtcggacgccgcaacatgcggcgcggacggcggcggcatccccgtcgtcgatttcgacgtcctcgtcaacggcaccgccgatcgacgggcgcgggccatccgggacctcggccgcgcgtgcgaggactggggcttcttcatggtggtcaaccatggggtgcccgaggagctcaaggaggcaacaatggagacgtgcagggagctgttcagcttatcggaggaggagaaggtggagtacttggaggccgggccgatggatcctgtccgaatcgggacgggcttcttctccgtcgtcgacggcatcaggtactggagggactacctgaagatgttcgcgcaccctgagctccactgccctgcaaatccaccaaaattaagggacgttgctgccgagtactcggccaagaagagagccctgatgctggtgctcgccagggcgatctccgagagcttgggcctcgacggcggtcgaattccggaggccatgggcctcgagtcgtgcttccagatcctcgtcgccaaccactacccgccgtgctccggtccgggcggcgcgggcatggggctgcccgcgcactcggaccacggcttcctcaccctgctcttccagaacggcgtcgacgggctccaggtcgagcgcggcgggcggtggcgcctcgctaagcccctccccggcgcgttcttcgtcatcgccggcgaccagctggagatcgtgagcaacgggagatacaagagcgcgctccaccgcgcggtggtcggcggcgagcgcgcgaggatgtccgtggtgagcatgatctcgccgtgcctggacgccgtggtcgcaccggtcctggagctggtacccgacggccggggcctcgagttccggggcgtcaggtaccgggactacatggagcatcagcagagcaacaagctctacgggaaggcagcgctggacatcgcccaggtgaagcgtgacatcgcagcctgagaaaatgaaatcaaacgaactgctctgctaaggccctgtttgtttccgtggccaccagtcgcgcgatacccaaactcgcgatcgagaaaagcccagattccctcgcttcctgcataagcggcgtttcagttaaaaaatgaactgaccctcgcgaccgtgatggagataagcgcgtctgtcgcgaggcgttcggcgggattcttcgctttccttcgccgccgccgcagaaatcacggttccaaatagggcctaaacaaaatactaagggactgtttgttttttaagaatttttaaaatctctgtcatattaaaagaaatcttactatttaggagtatcaaataaaatatatttataaatttttttaaaaaaaaaaaaaaaaaaaa

SEQ ID NO: 5114 - protein, 349 aa, Panicum virgatum
  misc_feature: Ceres CLONE 1815558
  misc_feature (1)..(101): Pfam Name: 2OG-FeII_Oxy Pfam Description: 2OG-Fe(II) oxygenase superfamily
MAETPLHHSTDPFTDGEHNEHDPAVPASDAATCGADGGGIPVVDFDVLVNGTADRRARAIRDLGRACEDWGFFMVVNHGVPEELKEATMETCRELFSLSEEEKVEYLEAGPMDPVRIGTGFFSVVDGIRYWRDYLKMFAHPELHCPANPPKLRDVAAEYSAKKRALMLVLARAISESLGLDGGRIPEAMGLESCFQILVANHYPPCSGPGGAGMGLPAHSDHGFLTLLFQNGVDGLQVERGGRWRLAKPLPGAFFVIAGDQLEIVSNGRYKSALHRAVVGGERARMSVVSMISPCLDAVVAPVLELVPDGRGLEFRGVRYRDYMEHQQSNKLYGKAALDIAQVKRDIAA

SEQ ID NO: 5115 - DNA, 1547 bp, Panicum virgatum
  misc_feature: Ceres CLONE 1815609
  misc_feature: Encodes the peptide sequence at SEQ ID NO. 5116
aaccaaacgccgcgccgccacctccccccggcctgcccgaagcgaccagacctccccccgcctgcctgacccgcgcgccgctcctcctctctgctgctgcagcgcacctcggccgcgggccgcctagccttcgtgctggtcctctcctgagtcctgactcctgctgcgtgtactcgtcgtgcccgccgccgcctctgctcacctcgcaacctgcctgtccagtgtccacccacggacaagtcaggacgcggcgcgcgcggcgcgtggccggccatggcgtcatccgcctccacgacgtcgggcgacgacgagcgcccgagcgcaccgccccgcgacccgcccgccggggcggcgccgccgcaggcgcacgcggagtgggccgcatcgatgcaggcctactacgctgccggcgggcagccttacgcatggcacgccgcgcagcagcacatgttggcggcggcggcggcgggcgcgccgtacgggacgcccatgccgttccacgtgtcgttccaccccgcatactacgcgcacgcggccatggccacgagtgttccctacacagctggcgaggcccttgcggtggcggaagggaagagcaagaggaagagctctggtgctccctctgtcggtagtgcttctggaagcagtaacggcggcagcgaggaggcatcagagaaaagagatgctagtgccgggcacaagctattaccttctgcaaagaggagaaagtccaccggtgcaaatgggcaaggagagccatctcaggctgcaataatgcaagatgttgcagctgaagcccgaagtgcagcaaagaggcctgcagggaagctctcagtttcgacaactgaaatggcagcaatttccaatgcaaaaccgaacttgaacattggaatagatctttggagtaattctccggttaaagcagagacctctggaccggttcagataaatgcagcagcaccttcccatgatgtccctttgtcacatatgctggatgaacgagaactgaagagggagagaagaaagcaatctaacagagagtcagcaaggagatcaagactacgcaagcagcaagaatgtgaggagctagcccagaaggtaactgaccttactgccattaatggcgcactaagatcagaactcgaccagcttaagaaggcctgtgaagacatggaagcagagaattcacaactaatgggtgaaatggaacaggccgaggcgcctagtgttgtaacaactttgagcgtgcatatagacacagcaaaggtgcatcatgggaagagtgatcaacatcgtgataaaaacaacaatgatagcaagggatagttttgagtagcaaccatgtaggtgttctctagataaggctaaaagatgagatgaggtgcttaatattaactgcagcattatcatcagttttttcttccgttattacagctacagccatatttacccctttccagagctactggcaagcgttctgatacggacagggtctatggcttgtatatagctgtcatgtatcaggtcaaaaaaaaaaaaaaaaaaaa

SEQ ID NO: 5116 - protein, 350 aa, Panicum virgatum
  misc_feature: Ceres CLONE 1815609
  misc_feature (1)..(65): Pfam Name: bZIP_1 Pfam Description: bZIP transcription factor
MASSASTTSGDDERPSAPPRDPPAGAAPPQAHAEWAASMQAYYAAGGQPYAWHAAQQHMLAAAAAGAPYGTPMPFHVSFHPAYYAHAAMATSVPYTAGEALAVAEGKSKRKSSGAPSVGSASGSSNGGSEEASEKRDASAGHKLLPSAKRRKSTGANGQGEPSQAAIMQDVAAEARSAAKRPAGKLSVSTTEMAAISNAKPNLNIGIDLWSNSPVKAETSGPVQINAAAPSHDVPLSHMLDERELKRERRKQSNRESARRSRLRKQQECEELAQKVTDLTAINGALRSELDQLKKACEDMEAENSQLMGEMEQAEAPSVVTTLSVHIDTAKVHHGKSDQHRDKNNNDSKG

SEQ ID NO: 5117 - DNA, 1918 bp, Panicum virgatum
  misc_feature: Ceres CLONE 1815616
  misc_feature: Encodes the peptide sequence at SEQ ID NO. 5118
gcagcaccgagccatgagccatccgtccccggcaggctagcggctcagacaagaggcctgccagccagtgccagccgcgagccaatgggttgccgcgggggcgctaggctgcggccgctcgtgaggcgcctctgcttcgtcgtcgtgctcctgtgcgccccgtgcctctgctccgtctccgctgccaagaggacgccgcgtcccgcggtgaagccaccgccgtcgccgtcgccgtcgccgtcgcaggtcccgtcgccggcgccggcgtacccggctctccccgtccgagcggtgtgcctgggcgggtggctcgtcaccgagggatggatcctgccgcccctcttcgacggcatccccaacaaggacctcctggacgggacgcaggtgcagttcaagtcggcgctgcggaagacgtacatcaccgccgaccagggcggcggcggcgccgtgctggccaaccggacgctggcctccgactgggagacgttcaagctgtggcggatcaacgagacgaccttcaacttccgggcgcccggcggccagttcgtcggcattggcgccagcgacggcatcatcgtcgccaccgccaccgcgccggcgctgccggagacgttccagatcgtgcgctgcccgttcgacaaggacagggtccggatcaaggcggcaaacggatacttcgtccaggcgatcgctaccggcgaggtgatagcggactacggcgagcccacgcggtggtcggactgggacgcgtcggtcttcctcatgaccaaggtcggccagcagctgcagggggagtaccagctctgcaatggctacggcaccgacaaggccgcacccgtgctcagggaccactggaacacctacatagttgaggacgatttcaagttcatcgcgtcgagcgggctgacagcagtgaggattccagtaggctggtggatcgctagtgaccccaaccctccggctccgtatgttggaggctccctgcaggccctggacaacgccttcaaatgggcagagaagtacaagctgggcgtcatcatcgacctgcacgcagctcccgggtcacagaacccctgggagcacagctcctccagggacggcacgcaggagtggggaacaaccgacgccaacatcgcacagaccgtgcaagtgatcgaattcctcgcgtccaggtacgcgacgagccccagcctgttcgcggtggagctgatgaacgagccgctggcgccccgggcgacgctggacagcctgaccaggtactaccgcgacagctacgacgccgtgaggaggcactcgccggcggcgtacgtggtgatgtcgaaccggctgtcggggaacaagacggagctcctcccgttcgccgccgggctccagggggcggtcatcgacgtgcactactacaccgtgttcaacagcatgttcagcaacttcaccgtgcagcagaacatcgacttcgtcaggaccaacttctccggcgagctcgccgccgtcaccacccagaacgggccgctcaccttcgtaggagaatgggttgcagagtggaaggtgccgaacgcgaccaaggaagagtaccagaagtacgcggcggcgcagatgagtgtgtacggccaggccacgtttggatggtcctactggactgtcaagaacgccaacaaccactgggatctggagtggatgatcaaaaatggatacatctcgttgaaaggctagctagggctgaaatcaatactagtgtgcttctaggctacgagatgatcgatcttgatctacaagtgtgtgtcaaggcgaattagttcgtgttacattggagggcaaaagttcagtgcacatggctttgtaaaattgatcctatgatacgattgtgtatctaaggctctaaaccctcgcggcgctatttaactacccaatagaaaccttc

SEQ ID NO: 5118 - protein, 541 aa, Panicum virgatum
  misc_feature: Ceres CLONE 1815616
  misc_feature (1)..(289): Pfam Name: Cellulase Pfam Description: Cellulase (glycosyl hydrolase family 5)
MGCRGGARLRPLVRRLCFVVVLLCAPCLCSVSAAKRTPRPAVKPPPSPSPSPSQVPSPAPAYPALPVRAVCLGGWLVTEGWILPPLFDGIPNKDLLDGTQVQFKSALRKTYITADQGGGGAVLANRTLASDWETFKLWRINETTFNFRAPGGQFVGIGASDGIIVATATAPALPETFQIVRCPFDKDRVRIKAANGYFVQAIATGEVIADYGEPTRWSDWDASVFLMTKVGQQLQGEYQLCNGYGTDKAAPVLRDHWNTYIVEDDFKFIASSGLTAVRIPVGWWIASDPNPPAPYVGGSLQALDNAFKWAEKYKLGVIIDLHAAPGSQNPWEHSSSRDGTQEWGTTDANIAQTVQVIEFLASRYATSPSLFAVELMNEPLAPRATLDSLTRYYRDSYDAVRRHSPAAYVVMSNRLSGNKTELLPFAAGLQGAVIDVHYYTVFNSMFSNFTVQQNIDFVRTNFSGELAAVTTQNGPLTFVGEWVAEWKVPNATKEEYQKYAAAQMSVYGQATFGWSYWTVKNANNHWDLEWMIKNGYISLKG

SEQ ID NO: 5119 - DNA, 2072 bp, Panicum virgatum
  misc_feature: Ceres CLONE 1815655
  misc_feature: Encodes the peptide sequence at SEQ ID NO. 5120
aacgaaccgagccgctcccctccccgttctcctctctccgctgaccgccgccgaaacgccaccacccgcctccccctcccgccgccgccgccgcctcgcctccccgcaattggccgtcctgctccccgccctgccgctactgggctggcgtcgcggcggtggcgcggagtggagtggagatccacccgcgctcggggctgggcgccttcgccaggcgatggacagtaggcggtataaggtgtcatgattcctggtgggtgatcaggacctgtagtcagatgacgagttatcatctcaggatcactgctgagtacagtttcaggaaggattttgtaaatgccactttttggagttactggccttttggtttagccctcaagactctagctagcaattatctaaagaaacaaatgaaatgttaatcgccaccaagttggcaaagttgtcagaaaacagcaactgagggagaaacttcactgtaatgctaacaatagcagtgccctgcccagatcatgacaatcagagcccgtagcaactgaaccttaagtatccaccaagtttggcaaaactgctggaactcaataattgggggagaaaacattgatgcaacttgttgatgcccaagatttctgcagttgctgcttgatttattttcttggtaggcaggacttaattttgtagatgtatgctttgtcaatgtagaaagcataccctgtggcctgtagtcctcttgttatctgtaagatgtgtggtctatgtgagttgtaatatcgagtcgataagatcgagctcggggaggttggggcgcaaaaaaaaaaaatcatctccaatctccaaccaaactaaccctagcagcagccggcggttagggtttcgagcgagatggcggcggcggcgaggcagcgcgggacggtcaagtggttcaacgacaccaagggcttcggcttcatctcccccgaggacggcagcgaggacctcttcgtccaccagtcgtccatcaagtcggagggcttccgctccctcgtcgagggcgaggaggtcgagttctccgtctcggagggcgacgacggccgcaccaaggccgtcgacgtcaccggccccgacggatccttcgtcaagggcggctccggcggcggcgggggcggcttcggatctcgcggcggggccggatctggcggcggcggccgcagctacggcggcggctggggcggcgggaggagatccggccccggcggcggtggcggcggcggcggcggcggcgcgtgctacaagtgtggggagcccggccacatggctagggactgccccaccgccgacggaggcggcggttacggcgggggaggctacggtggcggcggcggcggcggcggctgctttaagtgcggggagcctggccacatggccagggactgctccagcggcggcggcggctacggaggtggcggctacggaggtggcggcggcggtgcctgctacaactgcggccagaccggccacatggcgagggactgcggctccggcggcggcggcggcggcggccgcttcggaggtggcggcggcggcgaccgctcctgctacaactgcggccagagcggccacatggcgagggactgcaccgcgtgagatcgggtcggatcacaccacgccactacccggtggtgtagcctccctatagatctcgcctaagcctcttactgtgtctcgttcgtcggagcatcgctttagttttgccgatctgggcccgagcgcccgcctccttgctatagaggagctcagccgccttttttttttctctttcgtttcgcttttcatcttggattcggttcgtaggggaactgccgctcaggttatcatcgtgtgcttggtgcttttgctgtgagtctggtcgttggtcgttggtcgtcgtcgttgtcgtcgttaaggttaaggacatcaagaagtgagatgggttggttttgtgttgcttgaggagatgacaagatctgcctctttttttgtggtttgctgctcctgatggaaaagattattattattactattaaaaaaaaaaataaaaaaaaaaaaaaaaaaaa

SEQ ID NO: 5120 - protein, 246 aa, Panicum virgatum
  misc_feature: Ceres CLONE 1815655
  misc_feature (1)..(68): Pfam Name: CSD Pfam Description: 'Cold-shock' DNA-binding domain
  misc_feature: The sequence is a functional homolog of  SEQ ID NO 1086 in the  10/225,066 US patent application
  misc_feature: The sequence is a functional homolog of  SEQ ID NO 110 in the  10/225,066 US patent application
  misc_feature: The sequence is a functional homolog of  SEQ ID NO 128 in the  10/666,642 US patent application
  misc_feature: The sequence is a functional homolog of  SEQ ID NO 136 in the  10/374,780 US patent application
  misc_feature: The sequence is a functional homolog of  SEQ ID NO 1436 in the  10/666,642 US patent application
  misc_feature: The sequence is a functional homolog of  SEQ ID NO 1700 in the  11/479,226 US patent application
  misc_feature: The sequence is a functional homolog of  SEQ ID NO 2096 in the  10/374,780 US patent application
  misc_feature: The sequence is a functional homolog of  SEQ ID NO 44 in the  11/375,241 US patent application
  misc_feature: The sequence is a functional homolog of  SEQ ID NO 850 in the  11/435,388 US patent application
  misc_feature: The sequence is a functional homolog of  SEQ ID NO 860 in the  10/412,699 US patent application
  misc_feature: The sequence is a functional homolog of  SEQ ID NO 952 in the  11/435,388 US patent application
  misc_feature: Useful for making plants with modulated growth and phenotype characteristics
MAAAARQRGTVKWFNDTKGFGFISPEDGSEDLFVHQSSIKSEGFRSLVEGEEVEFSVSEGDDGRTKAVDVTGPDGSFVKGGSGGGGGGFGSRGGAGSGGGGRSYGGGWGGGRRSGPGGGGGGGGGGACYKCGEPGHMARDCPTADGGGGYGGGGYGGGGGGGGCFKCGEPGHMARDCSSGGGGYGGGGYGGGGGGACYNCGQTGHMARDCGSGGGGGGGRFGGGGGGDRSCYNCGQSGHMARDCTA

SEQ ID NO: 5121 - DNA, 1738 bp, Panicum virgatum
  misc_feature: Ceres CLONE 1815667
  misc_feature: Encodes the peptide sequence at SEQ ID NO. 5122
aaaacggccacgctaaacccctcccctctccaatctatcccccacgctgcccattcttctccggtttctccccttctcctcaacccagcagcagccagcagcagccgccccgcgacgcggcgccatggccgccgccccccaccaccaccgcggccacttcgtcctcctcgtcctctccctcgccgcggcattcgccgccgccgcggactcctcccacaacatcacggcggtcctcgacggccggtcggagtacacgctgtacaacagctacctctccgagaccaaggtctgcgacgagatcaacagcgagcacacggtcaccgtcctcgtcctcaccaacggcgccatgtcctcgctcgtcgccaacctctccctcgccgacatcaagaacgcgctccgcatgctcaccctcctcgactacttcgacgagaagaagctgcactccctcgactccggctccgagctcaccacctcgctctaccagaagaccggccaggccgccggcaacatgggccacgtcaacatcaccgacctccgcggcggcaaggtcgccttcgcctccgccgcgcccggcgccaagttccagtccacctacaccaagcgcgtcgacacggagccctccaccctctccgtcctcgaggtctccgaccccatcaccttcccgggcctcttcggctccccgtcggcctcctccgtcaacctcactgacatcctcgacaaggccggctgcaagcagttcgcgcgcctcatcgtctcgtccggggtcgtcaagatgtaccaggccgccatggacaaggcgctcacgctgctcgcgcccaacgacgacgccttcaaggccaagggcctgcccgatctgaccaagctatccagcgccgacctcgtcacgctgctgcagtaccacgcgctgccgcagtacgcgcccaaggcgtcgctcaaggtcgccaagggcgacatcccgaccctggcctccaccggcgcgggcaagtacggcctctccgtcgtctccagcggcgacgacgtgtcgctggacaccggtttgggcaagtcccgcgtcgcgtctaccgtgctcgacaacacaccgacggtcatcctcacggtggacaaattgctgctcccgtccgagcttttcggcggcgcgccgtcccccgcgccggcgcccggaccggccgccgacgtgcccgtttcggccccggctcccgaaacatctgcgcccgcaccctcccccaaggccgcgggcaagaagaagaagaaggccaagtccccttcgcactccccgcccgcgcccccgtcggactcgcccgacctggcccccgccgacgcgccggagggtgacgccgcagacaaggcagactcgaagaagaacggcgccgccgcagcggccgtgaacttcgcggccacggtggcctgcatcgccctggccgtcgcggccttcttgtgagcgggcgagcggcaggtgttcgacgccgagcccccgcatagttattctccctctgagcatgcgtgatctgacgcaatgcaatctgttgttgctcgtgagttctcgtgggctccattgataatttgatatgctcatcaggtgtttctccttcttcctggtttgcttgttggtaggtagtggaagtaagaatttgttaggatttggtcctccacttatcaggtggagatgaagagctaggaactgtcatttgaggtttatttgttcttcctattgtcctgtcaaaaaaaaaaaaaaaaaaaa

SEQ ID NO: 5122 - protein, 437 aa, Panicum virgatum
  misc_feature: Ceres CLONE 1815667
  misc_feature: Great-hit functional homolog of the protein sequence encoded by LOCUS At2g45470
  misc_feature: Great-hit functional homolog of the protein sequence encoded by LOCUS At3g60900
  misc_feature: Useful for making plants with altered cell wall content and/or composition
MAAAPHHHRGHFVLLVLSLAAAFAAAADSSHNITAVLDGRSEYTLYNSYLSETKVCDEINSEHTVTVLVLTNGAMSSLVANLSLADIKNALRMLTLLDYFDEKKLHSLDSGSELTTSLYQKTGQAAGNMGHVNITDLRGGKVAFASAAPGAKFQSTYTKRVDTEPSTLSVLEVSDPITFPGLFGSPSASSVNLTDILDKAGCKQFARLIVSSGVVKMYQAAMDKALTLLAPNDDAFKAKGLPDLTKLSSADLVTLLQYHALPQYAPKASLKVAKGDIPTLASTGAGKYGLSVVSSGDDVSLDTGLGKSRVASTVLDNTPTVILTVDKLLLPSELFGGAPSPAPAPGPAADVPVSAPAPETSAPAPSPKAAGKKKKKAKSPSHSPPAPPSDSPDLAPADAPEGDAADKADSKKNGAAAAAVNFAATVACIALAVAAFL

SEQ ID NO: 5123 - DNA, 1454 bp, Panicum virgatum
  misc_feature: Ceres CLONE 1815682
  misc_feature: Encodes the peptide sequence at SEQ ID NO. 5124
tccccccaaattttcttcttcccatctcggctcagatctgaccccgcacccaacccgagggccgaggccaaccccccctcccaaatggcgcactccaacggcgccgccgccggcggcggcggcggcggcggcgaggccgccccggtgccgcggcccctcgcgccagcgcggaaggcagcgctgatcacgggcatcacggggcaggacgggagctacctgacggagctgctcctctccaaggggtacgaggtgcacggcctcatccgccgctcctccaacttcaacacgcagcggctggaccacatctaccacgacccgcacgccgtgccctcggccccgcgcccgccgatgcgcctccactacgccgacctctccgactcctcctcgctccgccgcgcgctcgacgccatcgcccccgacgaggtctacaacctcgccgcgcagtcgcacgtcgccgtctctttcgagatccccgactacaccgccgacgtcaccgccacgggcgcgctgcgcctcctcgaggccgtccgcctcgcgcgcaagcccatgcgctactaccaggccggctcctcggagatgttcggctccacgccgccgccgcagagcgaggacacgccgttccacccgcgctcgccctacgccgccgccaaggtcgccgcgcactggtacaccgtcaactaccgcgaggcctacggtctcttcgcctgcaacggcgtgctcttcaaccacgagtccccgcgccgcggggagaacttcgtcacgcgcaagatcacgcgcgccgtcggccgcatcaaggtcggcctgcagactaaggtcttcctcggaaacctctccgccgccagggactggggattcgccggggactacgtcgaggcaatgtggctcatgctgcagcaggaccagccaggtgactacgtcgtcgccactgaggagtcccacaccgtagaggagttcttgcaggctgccttcgggtatgccgggctcaactggaaggaccatgtggtcattgacaagaagtacttccggccggcggaggtcgacagccttaaaggggactcgaccaaggcgaggagggtgctcaaatggaagcccaaggttgggttccagcagctcgttgagatgatggttgatcatgacattgagctcgctaagaaggagaaggtgctggtggatgctggttaccgtgatcccaagcagcagccttagaaacagcacaaatgccctcttgctctgttggagcttggatttggggattgttgccttgtagctcatacatcgtggatctcaaagtagaggttgactgaggttactattattatttttcttgggtcagaaataaggatgcttgcagtttgatctcacaatatcttcatttgcattttcttctgactatattatgcgcttctgactatgaatgaatgaatgaatccatgcaaaaaaaaaaaaaaaaaaaa

SEQ ID NO: 5124 - protein, 373 aa, Panicum virgatum
  misc_feature: Ceres CLONE 1815682
  misc_feature: Great-hit functional homolog of the protein sequence encoded by LOCUS At3g51160
  misc_feature: Great-hit functional homolog of the protein sequence encoded by LOCUS At5g66280
  misc_feature (1)..(249): Pfam Name: Epimerase Pfam Description: NAD dependent epimerase/dehydratase family
  misc_feature (11)..(373): SWISSPROT Homolog: EC 4.2.1.47 GDP-mannose 4,6 dehydratase 2
  misc_feature (29)..(373): SWISSPROT Homolog: EC 4.2.1.47 GDP-mannose 4,6 dehydratase 1
  misc_feature: Useful for making plants with altered cell wall content and/or composition
MAHSNGAAAGGGGGGGEAAPVPRPLAPARKAALITGITGQDGSYLTELLLSKGYEVHGLIRRSSNFNTQRLDHIYHDPHAVPSAPRPPMRLHYADLSDSSSLRRALDAIAPDEVYNLAAQSHVAVSFEIPDYTADVTATGALRLLEAVRLARKPMRYYQAGSSEMFGSTPPPQSEDTPFHPRSPYAAAKVAAHWYTVNYREAYGLFACNGVLFNHESPRRGENFVTRKITRAVGRIKVGLQTKVFLGNLSAARDWGFAGDYVEAMWLMLQQDQPGDYVVATEESHTVEEFLQAAFGYAGLNWKDHVVIDKKYFRPAEVDSLKGDSTKARRVLKWKPKVGFQQLVEMMVDHDIELAKKEKVLVDAGYRDPKQQP

SEQ ID NO: 5125 - DNA, 1072 bp, Panicum virgatum
  misc_feature: Ceres CLONE 1815696
  misc_feature: Encodes the peptide sequence at SEQ ID NO. 5126
accatcctcttccctttcccccacgccccaaaatccccttctgcgtctcagctcttcgggaaggaacaggaataaccggataaggcccagggcgggcgcgggcgcggctatgatctcctcttcgacttcgccgccgtcgtcctcgtctgccgcggcagcaagccgctccggtggcaataagccgccaccgcagcagcaggccagcaagtggcgcagcggcacgcagcagaagatctacgggcgccgcctgctagacgcgctccgcgccacgggcggcggccagccgcgcgccgtcaaggccgcggccgactcggcgctggcgctcacggcgcgcggccagacgcgctggagtcgcgcaatcctgctggccggcgccgcctgcagccgccgccgcgtgcttgtgaaggcgggcggcaagatccggcggcgccaccgccggccgcagcatgccaagagcaaagctgccgcttttgcaggggcggcggccgattcgaaggagggcggcaaggtgcaggagcggctccgtgtgctgggccgcctcgtcccgggatgccggaagctcccggcgccagagctgctcgaggaggcggtcgactacgtggcggcgctgcagatgcaggtcaacaccatgcgcgcgctcgccgacgcgctggcggccgcgcagctctccgacgcggagaggtgaggaggattgattggcctggcagcctggcaatggccccatgacatgattgattgatcaccagccgacctgcagccagctgatcgggattggggaggagggcgattgcattactctatggtaatcattgcgttccgttgctttgattgggaacgaacgattaaatgatggtgggattgtcatgaactaatgatccatgcatatgctcatggtttgtaaattcctttccttgcttgttgacacttctcttgttactgatgggtggatgatccagctaccggagacttctttgtgcaagtgaatgctgttcatcgtcttgtattgtttccgctctgctcttttttttttgaaaagcatttccgctctgctcaaaaaaaaaaaaaaaaaaaa

SEQ ID NO: 5126 - protein, 191 aa, Panicum virgatum
  misc_feature: Ceres CLONE 1815696
  misc_feature: The sequence is a functional homolog of  SEQ ID NO 368 in the  10/666,642 US patent application
  misc_feature: Useful for making plants with modulated growth and phenotype characteristics
MISSSTSPPSSSSAAAASRSGGNKPPPQQQASKWRSGTQQKIYGRRLLDALRATGGGQPRAVKAAADSALALTARGQTRWSRAILLAGAACSRRRVLVKAGGKIRRRHRRPQHAKSKAAAFAGAAADSKEGGKVQERLRVLGRLVPGCRKLPAPELLEEAVDYVAALQMQVNTMRALADALAAAQLSDAER

SEQ ID NO: 5127 - DNA, 1476 bp, Panicum virgatum
  misc_feature: Ceres CLONE 1815697
  misc_feature: Encodes the peptide sequence at SEQ ID NO. 5128
  misc_feature (1233)..(1233): n is a, c, t, g, unknown, or other
ccccagcaatcgattcgcccaccagcaaccaggacgccctcgattgcttgcttgcttgctttccgtgtagccgaagaatcaatccgtccaccgtctcgtcgcgctcgttggttggttcgttggcctcagcccttcgcgaaatcaatggcgcccctcggagacggagccgattccgcggcgtcgcccaacctggtggtgtcgttcggcgagatgctcatcgacttcgtccccgacgtggcgggcctctcgctcgccgagtcggggggcttcgtcaaggcccccggcggcgcgcccgccaacgtcgcctgcgccatctccaagctcggcggatcctccgccttcctcggcaagttcggcgacgacgagttcgggcacatgctggtgaacatcctgaagcagaacggcgtcaacgcggagggctgcctcttcgaccagcacgcgcgcaccgcgctcgccttcgtcaccctcaagaagaacggcgagcgcgagttcatgttctaccgcaaccccagcgccgacatgctgctcaccgaggccgagctcaacctcgacctcatccgccgcgccaagatcttccactacggctccatctcgctcatctccgagccctgccgcggcgcccacctcgccgccatgcgcgccgccaaggccgccggcatcctctgctcctacgaccccaacgtgcgcctcccgctctggccctcggaggaggccgccaggaccggcatcctcagcatctggaaggaggccgacttcatcaaggtcagcgacgacgaggtcgccttcctcacccagggggacgccaccgacgagaagaacgtgctctcgctctggttcgacagcctcaagctcctcatcgtcaccgacggcgacaagggatgcagatacttcaccaaggacttcaagggcagcgtgcccggctacaaggtgaacaccatcgacaccaccggcgccggtgacgccttcgtcggctccctcctcgtcaatgtcgccaaggacgacaacatcttccacaacgaggagaagctccgcgaggcgctcaagttctccaacgcctgcggcgccatctgcaccacccagaagggcgccatcccggcgctgcccaccgtcgccgccgcgcaggagctcatcgccaagggcaactagacgccgctgctgcggcccaccaccaccaccgcgccgccttggtcgcccctcgacgtcatcctttgaattcatatcattaggagattngtagctgctctttcttawttattagatggctggtgttctcgtgcgggttaatttagttcagtgtggtgtgcggtgtgtgagatgaacatggttttcgcccggggcattaataaaaagttggcatgcgtggtggattttttttacaaattgatctgaaatggtgtcgtgtgattggaaaagccgctgtaattcagctttcgttgatatttagtctaaatttgaaaccaacgtttttcaggtgtg

SEQ ID NO: 5128 - protein, 333 aa, Panicum virgatum
  misc_feature: Ceres CLONE 1815697
  misc_feature (1)..(309): Pfam Name: PfkB Pfam Description: pfkB family carbohydrate kinase
  misc_feature (1)..(331): SWISSPROT Homolog: EC 2.7.1.4 Fructokinase-2
  misc_feature (1)..(333): SWISSPROT Homolog: EC 2.7.1.4 Fructokinase-2
MAPLGDGADSAASPNLVVSFGEMLIDFVPDVAGLSLAESGGFVKAPGGAPANVACAISKLGGSSAFLGKFGDDEFGHMLVNILKQNGVNAEGCLFDQHARTALAFVTLKKNGEREFMFYRNPSADMLLTEAELNLDLIRRAKIFHYGSISLISEPCRGAHLAAMRAAKAAGILCSYDPNVRLPLWPSEEAARTGILSIWKEADFIKVSDDEVAFLTQGDATDEKNVLSLWFDSLKLLIVTDGDKGCRYFTKDFKGSVPGYKVNTIDTTGAGDAFVGSLLVNVAKDDNIFHNEEKLREALKFSNACGAICTTQKGAIPALPTVAAAQELIAKGN

SEQ ID NO: 5129 - DNA, 1460 bp, Panicum virgatum
  misc_feature: Ceres CLONE 1815722
  misc_feature: Encodes the peptide sequence at SEQ ID NO. 5130
aaaaaaacttggccgcgctccctccacacgcgccagcgccaccatcaccacctctcgccggttactactatggaggccgttctacgacatccatcgctctcccgcctcaagccaccgaacccgaaccctcacagggcgccatcgccgtccctcgcttccccttccctccttcgcctccgcgcgcgccggctcaccgccgccgcggtgttccaggaccagaagccgaaggagccagcaagcaagggaagcgatgaggaggaggcgtacggcgaggtggaccgcatcgtctccagccgcgcggtcaagaatccggtgttcgcggaggacggctcggccaccacctccgtcgccacggagtacctcgtggagtggaaggacgggcacgagccgtcctggatccccgcggaggccatagctgcggacgtcgtggcggagtacgagacgccgtggtggacggcggccaagaaggccgacgcggacgcgctggccgcgctgctcgcggacgagacgctgcggcgggacccggacgcggaggacgcgcaggggcgcaccgcgacgcacttcgccgcggggctgggatccgacaagtgcctgcgcgcgctcgccgcggccggggcggacctgagccaccaggagcgcgccggcggcggcctaacgccgctgcacatcgcggtggggtacggccgcgccgtggccgtgcgcacgctgctggagctgggcgccgacccggaggctcccgacgggcaggggcggacgccgctggagctggtccaacaggtgctcgagaagacgcccaagggcaacccggcggcgttccagctctggcaggggctggaggcggcgcagaaggagctggagaaggctgtgtacgagtgggccgaggtggagaaggtgatcgacgggcgcggcgaaggcaagtggcgcgagtacctggtggaatggcgcgacggcggcgagcgggagtgggtgaaggcggcgtgggtggcggaggacctggtgagcgacttcgaggccgggctggagtacgccgtggcggaggccgtggttgacaagaggcaggcggcggcggaggacggggagaaatgggagtatcttgtcaagtgggtggacattgaggaggcgacgtgggagcccgctgagaacgtggacgccgagctcgtgctggagtttgagcagaggcaatcaggatccgctggtggcgatcgcagcggcactgcaccatgatcgtgaaggtggccatggtggaaaattgtatgattcctcccgtcattcttctcctgatgcttggattgagttgagtcctctcctgattcatgtatcaatagcgatttggcttttgtagcaggatgcaattttttgtgagagtcatatttcgactgaaatttgtagttcagcagatttcatccttgcccactccggaaatgattacttttttaattcaaaaaaaaaaaaaaaaaaaa

SEQ ID NO: 5130 - protein, 384 aa, Panicum virgatum
  misc_feature: Ceres CLONE 1815722
  misc_feature: Great-hit functional homolog of the protein sequence given in SEQ ID NO 9532
  misc_feature: The sequence is a functional homolog of  SEQ ID NO 1813 in the  10/374,780 US patent application
  misc_feature: Useful for making plants with altered Lignin content
  misc_feature: Useful for making plants with modulated growth and phenotype characteristics
MEAVLRHPSLSRLKPPNPNPHRAPSPSLASPSLLRLRARRLTAAAVFQDQKPKEPASKGSDEEEAYGEVDRIVSSRAVKNPVFAEDGSATTSVATEYLVEWKDGHEPSWIPAEAIAADVVAEYETPWWTAAKKADADALAALLADETLRRDPDAEDAQGRTATHFAAGLGSDKCLRALAAAGADLSHQERAGGGLTPLHIAVGYGRAVAVRTLLELGADPEAPDGQGRTPLELVQQVLEKTPKGNPAAFQLWQGLEAAQKELEKAVYEWAEVEKVIDGRGEGKWREYLVEWRDGGEREWVKAAWVAEDLVSDFEAGLEYAVAEAVVDKRQAAAEDGEKWEYLVKWVDIEEATWEPAENVDAELVLEFEQRQSGSAGGDRSGTAP

SEQ ID NO: 5131 - DNA, 1657 bp, Panicum virgatum
  misc_feature: Ceres CLONE 1815762
  misc_feature: Encodes the peptide sequence at SEQ ID NO. 5132
gaacgctcgcccctccgggctcccagcctcccaggcgccgccgcccggcgtagctccaggcggccgggtaccgggaccggcagcgatgagccccaaggaggcggcacagcggccgcacgccgtgctcatcccgcagccggcgcagggccacgtcacgccgatgctgcacctcgccaaggcgctgcacgccagggggttccacatcacctacgtcaactccgagtacaaccaccgccgcctgctccggtcccgcggcccggcgtcgctcgccggcgccgccggcttccgcttcgaggccgtgccggacggcctgccgccgtccgacaacgacgacgtcacgcaggacatcgccgcgctctgcctctccaccaccgagcacagcgccgcgccgttcagggacctgctggcgaggctcaacgccacgccggggggcccgcttgtcagctgcgtcgtagccgacggcgtgatgagcttcgcgcagagggtcgccgaggagatggggatcctggccttggtcttctggaccacgagcgcgtgcggcttcatggggtacctccacttcgccgagctcatcaaacgaggctacgtgccactgaaagacgaaagtgacctgacaaatggttacctggacactgtaatcgactggatccccggcatgccgggcatccgtctgaaggacaaccccagcttcatcagaacgacggaccgggacgacgtgatgctcaacttcgacggcggcgaggcgcagaacgcgcgccgggcccgcggggtcatcctcaacacgtacgacgcgctggagcagggcgtggtggacgcgctgcgccgcgagttcccgcgcgtgtacaccgtcggcccgctcgccgcgttcgcgaacgccgcgcggggaggcgagctggacgcgatcggcgggaacctctggaaggaggacacgagctgcctccggtggctcgacacgcagccgtcgggctccgtcgtgtacgtcaacttcggcagcatcacggtgatgtcccccgctcagctctccgagttcgcgtggggcctggcgggctccggcaggccgttcctgtgggtcatcaggccggacctcgtctccggcgagaacgccatgctgccggaggagttcgtcacggacacaaaggaaaggggtgttctggcgagctggtgcccgcaggagctggtcctctcgcacccctccgtagggctgttcctgactcactgcgggtggaactccacgctggagagcatatgcgccggcgtgccgatgctctgctggcccttcttcgccgagcaaccgacgaactgccagtacgtgtgcgccaagtgggagattgggatggagatcgacagcgacgtgaggagggaggaggtggcgcggcttgtgcgcgaggtcatggacggcgaaaccggcaaggcgatgagagtgaaggcgatgctgtggaaggagaaagctcgagaagcggtggaggacggtggatcctcgaggaaaaacatggaacgcctcgtcgaattcttgctcgcagcgaatgaagatgtttcaacctgaattcgctagtacagataaaatgggctgtgatgatcttaatgtgttaggatctggacctttttgatttgaagtgaaagattttatgactcgactcaaaaaaaaaaaaaaaaaaaa

SEQ ID NO: 5132 - protein, 485 aa, Panicum virgatum
  misc_feature: Ceres CLONE 1815762
  misc_feature (1)..(119): Pfam Name: UDPGT Pfam Description: UDP-glucoronosyl and UDP-glucosyl transferase
MSPKEAAQRPHAVLIPQPAQGHVTPMLHLAKALHARGFHITYVNSEYNHRRLLRSRGPASLAGAAGFRFEAVPDGLPPSDNDDVTQDIAALCLSTTEHSAAPFRDLLARLNATPGGPLVSCVVADGVMSFAQRVAEEMGILALVFWTTSACGFMGYLHFAELIKRGYVPLKDESDLTNGYLDTVIDWIPGMPGIRLKDNPSFIRTTDRDDVMLNFDGGEAQNARRARGVILNTYDALEQGVVDALRREFPRVYTVGPLAAFANAARGGELDAIGGNLWKEDTSCLRWLDTQPSGSVVYVNFGSITVMSPAQLSEFAWGLAGSGRPFLWVIRPDLVSGENAMLPEEFVTDTKERGVLASWCPQELVLSHPSVGLFLTHCGWNSTLESICAGVPMLCWPFFAEQPTNCQYVCAKWEIGMEIDSDVRREEVARLVREVMDGETGKAMRVKAMLWKEKAREAVEDGGSSRKNMERLVEFLLAANEDVST

SEQ ID NO: 5133 - DNA, 2060 bp, Panicum virgatum
  misc_feature: Ceres CLONE 1815770
  misc_feature: Encodes the peptide sequence at SEQ ID NO. 5134
ctctccccgctccaccccgcccccgcccggcgcgcctgtccccttggtcgcaaatggttctcgcgcgagtcctcacgctccctctgcccgccccgtcgtccacgcccaaccgccgcttcctcctcccgcctcgggcggcgcgtgtggcactggcacccgttcgggccgacgcctgccgggcggcgagcgcgatggcggctgtgccggctctggaccccgccgcggccgcggccgtgggcgtcggggaggagctgccggaggggtacgatcagatgatgcccaccgtggagccggcgcggcggcgtcgcgcggggttgttgctgcacccgacgtccctccggggcccgcacggcatcggcgacctcggcgacgaggcgctcgccttcctccactggctacgcgacgccggctgcacgctctggcaggttctgccacttgttcctccggggagaacatctggggaggatggatctccttattctggacaggatgccaactgtggtaatacccttttgatatctcttgaagagcttgtaaaagatggtcttttgatggaagatgaacttcctagtcccgtggatgtggagcatgttgaatttgataccgttgcaaatctgaaagaacctcttattgcaaaggcagcagagaggctcttactgggccaaggagacctcagaacgcaatatgactgcttcaagaaaaatccaaatatatcaggttggcttgaagatgcagcactttttgctgctattgacaaaagcattggtgcattctcttggtacgagtggcctgaacctctgaaaaatcgccatcttggagccttggaagatatatatcaaaaacagaaggacttcatagagacatttatggctcagcaattcttatttcaaaggcaatggcagcggattcgtaaatatgcacagaagttgggtatcagcataatgggtgacatgcctatatatgttggctaccatagtgcagatgtatgggcaaacaggaaatcatttttgctggacaagaacggtttccccacttttgttagtggtgttccacctgatgcatttagtgaaactggtcagctatggaacagtccgttgtacgactggaaagctatggaagcagatggcttttcatggtggataaagaggattaaacgagcccttgatttgtatgacgagttccgcattgaccattttcgggggcttgcgggtttttgggcagtcccatctgatgcaaaagtagcactagttggaagctggagggctggaccgaggaatgccttttttgatgcgctcttcaaagctgttggtagcataaatataatagcagaagacctgggggtgattactgaagatgtggttcagctaaggaaatcaattggggcccctgggatggcagttctccagtttgcttttggaggtggttctgataaccctcacttgctgcataaccatgaaatggaccaagttgtgtataccggaacacatgataacgatacagttcttggctggtggcaaaatttacccgaggaagagaagcaaattgtgattaagtatctaccggaagccaagaatactaacatctcatggacaatgattactgctgccctttcttctgttgcaaggacttccatggtaaccatgcaggatattctgggcctcgacagttctggtagaatgaacactccagctacccagaaaggaaactggagatggaggataccaagctctgttggcttcgacagccttagccctgaagcagcaaagctgaaggatttgcttgcgctgtacaatcgtctgtgaaggccgtgacattatgttctacggtcagaagctcctttcataaaatggcagccaaatgtggggctgctaagttctatgcgactaatacctgtccccgaataagcgtttcgtgttctggttggccggaagcttgcgtgcttgtacatgaaggtcttgctttgcaagttaaggcttgatgaatatgaagcactgtatgtgtattcacaatttaattaggcatttctttcttgaggttccaaaaaaaaaaaaaaaaaaaaa

SEQ ID NO: 5134 - protein, 582 aa, Panicum virgatum
  misc_feature: Ceres CLONE 1815770
  misc_feature (1)..(486): Pfam Name: Glyco_hydro_77 Pfam Description: 4-alpha-glucanotransferase
  misc_feature (1)..(482): Pfam Name: Glyco_hydro_77 Pfam Description: 4-alpha-glucanotransferase
  misc_feature (58)..(582): SWISSPROT Homolog: EC 2.4.1.25 4-alpha-glucanotransferase, chloroplast precursor
MVLARVLTLPLPAPSSTPNRRFLLPPRAARVALAPVRADACRAASAMAAVPALDPAAAAAVGVGEELPEGYDQMMPTVEPARRRRAGLLLHPTSLRGPHGIGDLGDEALAFLHWLRDAGCTLWQVLPLVPPGRTSGEDGSPYSGQDANCGNTLLISLEELVKDGLLMEDELPSPVDVEHVEFDTVANLKEPLIAKAAERLLLGQGDLRTQYDCFKKNPNISGWLEDAALFAAIDKSIGAFSWYEWPEPLKNRHLGALEDIYQKQKDFIETFMAQQFLFQRQWQRIRKYAQKLGISIMGDMPIYVGYHSADVWANRKSFLLDKNGFPTFVSGVPPDAFSETGQLWNSPLYDWKAMEADGFSWWIKRIKRALDLYDEFRIDHFRGLAGFWAVPSDAKVALVGSWRAGPRNAFFDALFKAVGSINIIAEDLGVITEDVVQLRKSIGAPGMAVLQFAFGGGSDNPHLLHNHEMDQVVYTGTHDNDTVLGWWQNLPEEEKQIVIKYLPEAKNTNISWTMITAALSSVARTSMVTMQDILGLDSSGRMNTPATQKGNWRWRIPSSVGFDSLSPEAAKLKDLLALYNRL

SEQ ID NO: 5135 - DNA, 1185 bp, Panicum virgatum
  misc_feature: Ceres CLONE 1815845
  misc_feature: Encodes the peptide sequence at SEQ ID NO. 5136
tcgcgacgaaggcggagctgaccagtgaccaccacagcacgccaccgctggccagccgctgctgcgagctgcggttttgctagggttttataccagggatccctgtgtcggcggcggcggacatggagggggaggagattggcctcgtcctcgcccgcgcctcggacctccgcgccaggatgtccgcctgcgccgccgcggcccggcccgaggacgcggacaagcggctgggcgcggcgggggacggtgaggaaggcgaggaggaggacgcggaggagcaggtggtggagagcctcgtcggcatcagcgacgcgctcgagtcgctcgagcggcagctcgccgccctgcaggacctccagcagcagcaaagatatgaacgggaaaccatcttgagccagatcgaccgcagccggagattcctgcttagcaagctcaaagaatacaaggggcaggactgtgaggtaatccatgaggctgctgcttttgctggtgagaaaatagagcatgatgatagcctcatcctgcctccttactcaaaccatgttaccaattccttcgcgctcgatgacctgtaccctctgagctacgtctccaagcccaagcacgtgcataatggattagactgtgacagagtgactcaagacgatacaagaacaaatgggacggagaacagaaacgccggcacaccaaaccgcggtctgctaggagggatcgggtccttcatcggatggatggctaaaacggcagtcatggtggttggcgccgtgtccatcatgaaggctgctggctacgagccggtgatcgggacgaacagcatcaagctggacttcgcggggctgctcagtaaagcagcgacgggcaaagaagagcagggcgctcgccgctgccctccaggtaaagtgatggtgctcgaggacggcagggcccactgcgtcgtgaaggagagggtggagattcccttcggcaccgacctggcgtccccggacgcgagctacggtctgggctgaaacctggtgatgtgaatattaggatgtagctcgcccctgagaggcggtctgtaggagttgtgtatctgtgacttgtttttttgtaaaatgcctttctgggtttggtgctgaacattgtggtcatcaagatgttgaagttatgtaccatgtcatgcccgaaaaaaaaaaaaaaaaaaaa

SEQ ID NO: 5136 - protein, 294 aa, Panicum virgatum
  misc_feature: Ceres CLONE 1815845
  misc_feature: Great-hit functional homolog of the protein sequence given in SEQ ID NO 9705
  misc_feature: Useful for making plants with modulated nitrogen use efficiency
MEGEEIGLVLARASDLRARMSACAAAARPEDADKRLGAAGDGEEGEEEDAEEQVVESLVGISDALESLERQLAALQDLQQQQRYERETILSQIDRSRRFLLSKLKEYKGQDCEVIHEAAAFAGEKIEHDDSLILPPYSNHVTNSFALDDLYPLSYVSKPKHVHNGLDCDRVTQDDTRTNGTENRNAGTPNRGLLGGIGSFIGWMAKTAVMVVGAVSIMKAAGYEPVIGTNSIKLDFAGLLSKAATGKEEQGARRCPPGKVMVLEDGRAHCVVKERVEIPFGTDLASPDASYGLG

SEQ ID NO: 5137 - DNA, 1930 bp, Panicum virgatum
  misc_feature: Ceres CLONE 1815847
  misc_feature: Encodes the peptide sequence at SEQ ID NO. 5138
ggacactaatcttctccctcattctcatcttcgtcgccacttcaacttcaacgctgcgctcgcgatcgcccaaatccttcccacctcctccctgctcactcgccgcaaatccggcggggcccccgcaccgccggcccccgatgcccgccgccgtcgcagcggcggcggccgcagcgtcgggcggcgcgctccttctgtacctgctgctcacctgccgcccgcagccggcgccggaggccgagagggggagagaggaggacgggacgtcgccgctgctgtcggggtccggggcggcgcgggggagggaggcggagagcgaccgcgaggaggagccgtggccgcacagggagcccatgacctgctgcgaggcggccgcggtggccgcgcgcacggcgcggcgcgcgtgggagctcaccgtcgggcgatggggcctgcacggcctcgccttcggcattaagcgccacatgaaacgtcagggtaatttgcagcatgagtacagtggaaatgattgccgtcaacttagaggccatctggcacatgctgaagttacttctctccttgagtacttgaagctttgcatgttcttctcaaagaaatgcttttcagcatttcttaagtttggtgggtacaaacaagaagacattctcattcacaaggctaggtcgaggctcatgcagccttctttcgcactggtgtgtgacaaaaggaccaagtgttttctgctttttattcggggtgctatcagtactaaagagcggctgacggcagcaactgctgctgaagttccttttcaccatataattctaagtgaaggacagatcagcaatgtagttttaggttatgcacactgtgggatgcttgctggagctcgttggattgcaagactagctattccccatcttcataacaaaatacaagaatttcctgggtaccaaataaaggtcattggacattcaatgggagctggcattggagccattctgacatatattctccgtgagcattatgagttctcgtcctgcagttgtctggcatttgctcctcctgcctgtatgacatgggagctggcggagtctggcaaagaattcatcacttctcttgtcaatagaaatgatgtggtaccatcattttcgaaagtttctatggagagcctgcgatctgaggtaatggtatcatcaaagctggatgatgtgcaggaccactttgaccatggtttattttccagtataagtcagcgtgttgccttcttcaggtcccatatgctttccatctctcattcaacagggaagattgcagatcataactctagtatttctgagcctttgctcaaaaattcggcagataggatacaacccccagcaaatggatacagcatcgaccgcagggggcaacaagttgttgcctctgaagaaagggtcacactagtagttaacaatgaagatgttacctctgtgaagtctgctgtttcaggcttcacatcacaagaagattctgatagcaatggagcattggacactcaacaatcatccacgacaacaaatgatggagaagttctgaatcagaatggcacccgaaatgataaacagaaagaaccgatttctgccagcggttcgcgccaattcttacctcctgggaggatcattcacatggttgcacagccccctccggactcaactcctggtgagggcaccagcagcaacgagatcattggaatttacgagacgccgagagatttatatggcaaaataaggcttgcgccaaatatgattaaagagcattacatgcctagttatataagtacaatggaatcgttattggaacagcttcagaaggacgatgtaccgcatcaaacgacctgtgaattataatgtaacaaaactcagttctgattaatcccattctttttcattaaaaaaaaaaaaaaaaaaaa

SEQ ID NO: 5138 - protein, 575 aa, Panicum virgatum
  misc_feature: Ceres CLONE 1815847
  misc_feature (1)..(141): Pfam Name: Lipase_3 Pfam Description: Lipase (class 3)
MPAAVAAAAAAASGGALLLYLLLTCRPQPAPEAERGREEDGTSPLLSGSGAARGREAESDREEEPWPHREPMTCCEAAAVAARTARRAWELTVGRWGLHGLAFGIKRHMKRQGNLQHEYSGNDCRQLRGHLAHAEVTSLLEYLKLCMFFSKKCFSAFLKFGGYKQEDILIHKARSRLMQPSFALVCDKRTKCFLLFIRGAISTKERLTAATAAEVPFHHIILSEGQISNVVLGYAHCGMLAGARWIARLAIPHLHNKIQEFPGYQIKVIGHSMGAGIGAILTYILREHYEFSSCSCLAFAPPACMTWELAESGKEFITSLVNRNDVVPSFSKVSMESLRSEVMVSSKLDDVQDHFDHGLFSSISQRVAFFRSHMLSISHSTGKIADHNSSISEPLLKNSADRIQPPANGYSIDRRGQQVVASEERVTLVVNNEDVTSVKSAVSGFTSQEDSDSNGALDTQQSSTTTNDGEVLNQNGTRNDKQKEPISASGSRQFLPPGRIIHMVAQPPPDSTPGEGTSSNEIIGIYETPRDLYGKIRLAPNMIKEHYMPSYISTMESLLEQLQKDDVPHQTTCEL

SEQ ID NO: 5139 - DNA, 2073 bp, Panicum virgatum
  misc_feature: Ceres CLONE 1815858
  misc_feature: Encodes the peptide sequence at SEQ ID NO. 5140
tttttttcgccctcctcgcgccgccgccgtcgccgccgctagggttttgggctatggacgcgacgcggcagccggaccagcgtcggggagatggcggcggcggagaccgctacggcgtgcttctctactacaagtacgccgaggtgcccgacgccgccgcgctcgccgcgttctacgaggagcgctgccgcggcctcgcgctcgtcggccgcgtccgcgtcggccccgacggcgtcaacgccacgctcggggggcggatgacggcgctagagaagcacatcgcggagatgagctccaacaccttgttcgagggcacggacttcaagctggcttcctgcgaggacccagttgacgagagggtcgccagggagtgcggcttcacctcgctctccgtccgggtcgtcaaggagctggttaccctgtgctcgaatcccacatcggcaccaccggagatttcaagtgcagggagacacttgtcggctgctgagttccattcggtgctccaaaatgttgctgggactagttcggatgaggtggcatcagcggagaagaatgaagtggttgttgttgatgcaaggaatgtgtatgagacgcggatcggcaagttcaatgtaccaaatgtggagactttagacccagaaatcaggcagtacagtgacctgccttcatggatagatgagcatactgagaagctgcgtgggaagtcaatcctcatgtactgcacaggaggtatacgctgtgagatggcatcagcttatattcgctcgaaaggtgaaggatttgagaatgtttttcagctatatggtggcattcagcggtatctggagcagttcccagatggtggctattttgaagaaaagaattttgtatttgaccacagaatctcagtgggaagccttaaagagaacatacttgggatgtgtttgctatgtggttcttcctatgatgactattcatcccggtgtcgttgcagccactgcagaatgttggtcttagtgtgccctacatgtcaggggtctactaaggaatatgtatgcgagttatgtcaaaagaatggaaaagaactctgccaaatatcgaacacgcaagactgcggaatacagatatctgaaccttctggctttgaaaacccatccataagcaatcacaatgtgacctccaaagttccctggagtaatgatagtgagcagctgaaaaagctgaggattctctgcttgcatggtttccgtcagagcgcatccaattttaagggaagaacatcagcacttgccaagaagctgaagcacattgctgagctcgtcttcatagacgctcctcatgaactttcttttgtataccaaccaatccagggctgctgctctgacaaaccctcacctcctgctgcgactccaaaacggaaattcgcatggctcgttgctccaaactccagtttcaacgccgagcaagactggaaggccgcagatgcgccgttcgacccacttcagtaccagcaacaaaccaaaggctttgaggaatcatacacctacctagaaaacgccatctctgagattggaaacttcgacggaatccttggcttctctcagggcgccgccatggccgccttgttttgcaggcagcagcagaagacatgtggttctccgaaattcaggtttgggatgttctgctccgggtatccagcgccagtgggcaattttgatggtgaaccgatcaagcttccctcgctccattgttttggcaacggcgaaggccatgacaggcagatagcgaacagggcgagcgctgaactcgctggtcagtttcagctggattgctgctctgtggttgagcatgatttgggccacataatccccacccggtcgccctacatcgatcgaataaaggatttcctgtccagtttcctatagaaatgttttcaagtgattgtattctgttgtaagttgctggtgtacacaagttgcgttctgaagggcacccgccgtgattagtagtgttttcccattttattatgggaaacgaattgagttccatattgagaggattactggtgcttcgacatcagattgtcttgaaatc

SEQ ID NO: 5140 - protein, 616 aa, Panicum virgatum
  misc_feature: Ceres CLONE 1815858
  misc_feature (1)..(235): Pfam Name: FSH1 Pfam Description: Serine hydrolase (FSH1)
MDATRQPDQRRGDGGGGDRYGVLLYYKYAEVPDAAALAAFYEERCRGLALVGRVRVGPDGVNATLGGRMTALEKHIAEMSSNTLFEGTDFKLASCEDPVDERVARECGFTSLSVRVVKELVTLCSNPTSAPPEISSAGRHLSAAEFHSVLQNVAGTSSDEVASAEKNEVVVVDARNVYETRIGKFNVPNVETLDPEIRQYSDLPSWIDEHTEKLRGKSILMYCTGGIRCEMASAYIRSKGEGFENVFQLYGGIQRYLEQFPDGGYFEEKNFVFDHRISVGSLKENILGMCLLCGSSYDDYSSRCRCSHCRMLVLVCPTCQGSTKEYVCELCQKNGKELCQISNTQDCGIQISEPSGFENPSISNHNVTSKVPWSNDSEQLKKLRILCLHGFRQSASNFKGRTSALAKKLKHIAELVFIDAPHELSFVYQPIQGCCSDKPSPPAATPKRKFAWLVAPNSSFNAEQDWKAADAPFDPLQYQQQTKGFEESYTYLENAISEIGNFDGILGFSQGAAMAALFCRQQQKTCGSPKFRFGMFCSGYPAPVGNFDGEPIKLPSLHCFGNGEGHDRQIANRASAELAGQFQLDCCSVVEHDLGHIIPTRSPYIDRIKDFLSSFL

SEQ ID NO: 5141 - DNA, 1496 bp, Panicum virgatum
  misc_feature: Ceres CLONE 1815989
  misc_feature: Encodes the peptide sequence at SEQ ID NO. 5142
acacacgcaccattcttcagcgaccatcctcctgaagcctctcgagatcctctaccacctatccatcgatggcggctgctacctcctacgcgacccatgccatggcgagcccggcggggcagtgggctatcctcgcgcttctctccctctctgtcagcctcactgctttgcccgcgagcactggtttttcagaaaatccaaaactgatctgctgcaagatctacatttctgaaagccgcgacaagtccgctcttgacgaaattgataaagcagcaaggaaagaccctgaaaatgtcgtggtgctaagcaagttcggagatcatatctacaaccgtgtgcgctatacgcttgtctcatatatttccacgtccgagtggatttattccaatgaaggcgacatatcaaaattaactcttaatgtaagtagcccaatcaagggtgtactgttggaaatggtaaaagctgcaatatcatcaaccttaagcctcgactcgcaccaaggagagcaccctaggattggcatcattgatgacctgtctttccatcccttgggtgatgccaagatggaggatgctgtttacctggctaaggacgtggcctctgacattgcgagttcaaaagtcccagtgttcctgtactacgaagcccatccacagcgaaagactctttctgacgtacggcgtgaccttggctactacaagaagaatggcacggccggccagcggtcaggcgtgatggaacttaatacgacggagggaaatgaacctgatgtagtttttcaaaaaaataaacctgatgtgtgcccagcagtagttgatcagcaaattctacaaaaaaaaggtatcacaacagttggtgccatgcattttgttgagggctataatgtgccggtgcggtccgagaatttcaaaaaagtggaggacattgtgaaaagattaagagaacaattaggtggtcgcggtggtgaagggcccccaaagtttttagctttggcacttcgccatgggagtttcgtagaggtcggatgcttgttggatccaaattatctcagggccgatcaagttcaggacaaggtcaagcagattgcagcagagcaaggacttgaagataaagttgaaaagggatactacactgacataaccaaggatatgattctcttacatctgtctaagatattgtatgagaatcgtatccttggtgtatgccaaagttaaaatggctccggaagtgaagaacgggagggcacgaatgagtcagttactaaaggctgccaaataactgttgtacgtatgttaatcatgtatgatactaataatcatacgtatatgtatatgtgtagtgtgtatatgtatgcgtatgcgtatgcgtatgtgtgtatgtagtgtgtgtatccatgtgtacatacccatgtatatatgtatttgtgtatatacccaagtgtagctactccacactatattatctattggttgttggaaaaaaaaaaaaaaaaaaaa

SEQ ID NO: 5142 - protein, 381 aa, Panicum virgatum
  misc_feature: Ceres CLONE 1815989
  misc_feature (1)..(158): Pfam Name: FTCD_N Pfam Description: Formiminotransferase domain, N-terminal subdomain
MAAATSYATHAMASPAGQWAILALLSLSVSLTALPASTGFSENPKLICCKIYISESRDKSALDEIDKAARKDPENVVVLSKFGDHIYNRVRYTLVSYISTSEWIYSNEGDISKLTLNVSSPIKGVLLEMVKAAISSTLSLDSHQGEHPRIGIIDDLSFHPLGDAKMEDAVYLAKDVASDIASSKVPVFLYYEAHPQRKTLSDVRRDLGYYKKNGTAGQRSGVMELNTTEGNEPDVVFQKNKPDVCPAVVDQQILQKKGITTVGAMHFVEGYNVPVRSENFKKVEDIVKRLREQLGGRGGEGPPKFLALALRHGSFVEVGCLLDPNYLRADQVQDKVKQIAAEQGLEDKVEKGYYTDITKDMILLHLSKILYENRILGVCQS

SEQ ID NO: 5143 - DNA, 1583 bp, Panicum virgatum
  misc_feature: Ceres CLONE 1816084
  misc_feature: Encodes the peptide sequence at SEQ ID NO. 5144
aactacaacgtgccaccgcgaaactacagtctacattacaatccgaagtggcaaaagcaaagcttgccattttccagcacctcgccggtagtgcagccatgaaggtagagcgcgacctccacatgagccgtggcgacggcgagaccagctacgcctccaactccaggcttcaggagaagtcgatactgaagacgaggcccgtgctccacgaggccgtggcggccgcgcgcgcgtcggcgtcgctctcctccgccgccgcgatggtcgtcgcggacctcggctgctcgtcggggcccaacacgctcctcgtcgtctccgaggtgctcggcgcggtcgccaccggcggccgccgggaggcggaggagctgcggctggtgacgggcggccagcaaccgcagccgccgacgcagcacgtgcagttcttcctgaacgacctccccgggaacgacttcaacctcgtcttccagtccctggagctgttcaagaagctgaccgccagggacaagcgggactccttgccgccgtactacgtcgccgggctgccggggtccttctacaccaggctcttccccgaccgctccgtccacctcttccactcctcctactccctcatgtggcgatccaaggtacctgaggagctcgcgagaggcacggttctgaacgagggcgacatctacatctgggagtccacgccgccgccggtggtgaagctgtacaggaagcagttccaggaggacttctcgctgttcctcaagctgcgtcacaaggaactcgcgtccaacggccagatggtgctggcgttcctgggcaggaagaaccaagacgttctgcgtggcgaagtcagctacatgtgggggctgcttacgcaggctcttcagtcccttgtaaaagagggccttgtggagaaggagaagctggactccttcaacctcccgttctacgcgccttcggtggacgaggtgcgggacgtgatcaggcagagcgaggcgttcgacatcaaccacatccacctcttcgagtccaactgggatccccaagacgacctggacgacggcgacctcgtgctcgacagcgcccagagcggcgccaacgtcgcccagtgcatcagggctgtgatcgagcccctggtcgcgcaccattttggcgagcacatactcgacgatctcttcgagatttatgcgcggaacgtcgcggcgcacctccggaaagtgaagaccaagtaccctgtcatcgtcctgtccttggcggcgaggcgcgcgcccaagtaccaaacgaatggcgattgctattcgcttttcacacgaggccagttaatgtagaaatgactaataatttgggacagagggagtatataaaatgcagctacagaatatatatagttcgtggactattagtagcagagaatagttcctccactgcttcctttggatttaactggttcagcatttccaaaatgtcaatctatcaggttaaatatgtaccgtaatcttaagtgtctaggtaatgccttgtgctgtacgtaatctcgagttaatatattgaaaagttccaaatatttatatcaaaaaaaaaaaaaaaaaaaa

SEQ ID NO: 5144 - protein, 406 aa, Panicum virgatum
  misc_feature: Ceres CLONE 1816084
  misc_feature (1)..(344): Pfam Name: Methyltransf_7 Pfam Description: SAM dependent carboxyl methyltransferase
MKVERDLHMSRGDGETSYASNSRLQEKSILKTRPVLHEAVAAARASASLSSAAAMVVADLGCSSGPNTLLVVSEVLGAVATGGRREAEELRLVTGGQQPQPPTQHVQFFLNDLPGNDFNLVFQSLELFKKLTARDKRDSLPPYYVAGLPGSFYTRLFPDRSVHLFHSSYSLMWRSKVPEELARGTVLNEGDIYIWESTPPPVVKLYRKQFQEDFSLFLKLRHKELASNGQMVLAFLGRKNQDVLRGEVSYMWGLLTQALQSLVKEGLVEKEKLDSFNLPFYAPSVDEVRDVIRQSEAFDINHIHLFESNWDPQDDLDDGDLVLDSAQSGANVAQCIRAVIEPLVAHHFGEHILDDLFEIYARNVAAHLRKVKTKYPVIVLSLAARRAPKYQTNGDCYSLFTRGQLM

SEQ ID NO: 5145 - DNA, 1768 bp, Panicum virgatum
  misc_feature: Ceres CLONE 1816155
  misc_feature: Encodes the peptide sequence at SEQ ID NO. 5146
gtctgtgtactccgtatatccgtatttcatcagtgtcctgctcacctgctgagctgcactcacactgtgcatttcactgcaaacagtgtcgaactcgctgcccaagaagcaagaaccggcggccatggcaggagcagaggccgagcatggaggagccgcctctccttcccctctccacgtcgtggtgttcccgtggctggcgttcggccacatgattccgttcctcgagctctccaagcggctggcgcggcgcggccacgccgtcaccttcgtgtccacgccgcggaacgccgccaggctgggcgccgtcccgccggagctcgccgcgcgcctgcgcgtcgccgcgctggagctgccgggcgtcgagggcctgccccgcggcgccgagtccaccgccgacgtcccgcccgagaaggtcggcctgctcaagaaggccttcgacggcctcgccgcgccgttcgccgacctcgtcgccgaggcctgcgccggcgccaatggcgacgccaccgcggggttctcgaggaagcccgacttcgtcatccacgacttcgcgcagaattggatctggccagtcgccgaggaacacgagatcccatgcgccgtcttcatcatctttccggcggcgatcctcgccttcgtgggctcgcgggaggcgaacgaggcgcacccgcggagcacggcggcggaggactacatggtcccgccgccgtggatcgacttcccctccaccatggcgcatcgccgccacgaggcgcgggccatcgccgccctgttccggcccaacgactccggcgtgtccgacgtggagcgcttctgggagatgcagcggccctgctgccgcctcgtcgtgctccgcagctgccccgaggccgagccccggctgttcccgctcctcaccgagctctacgccaggccggtcgtccccgccggcctcctcctgcccgacgagctcgtcggcggcgacgacgacggcgccccgggcggcgaccggccgatcccggacgtcgtgcggtggctggacgggcagcccctgcggtccgtcgtctacgtcgctctcgggagcgaggcgccggtgacggcggagcacgtgcgggagctcgcgctcgggctggagctctccggcgcgcgcttcctctgggcgctccggcggcccgtcgggcactccggcgagctcctcccggacgggttcgagcgccgcgtcgcggggcgcggcgtcgtgcgcgccgggtgggtgccgcaggtgcgcgtgctggcgcacgccgcggtgggcgcgttcctgacgcactgcggctggggctccaccgtggagagcctcttccggttcgggcaccccctcgtgatgctgccgttcgtcgccgaccagggcctcatcgcgcgggccatggcggcgctcggggtcggcgtcgaggtgccgaggaacgaggacgacgggtcgttccgcggggacgacgtggcggcggcggtgcggcgggtgatggaggaggaggagggccaggagctcgcgcgcaatgccagggagctgcaggaggttgtgggggacagggcgaggcaggagcagtatgttgatgagctcgtggatcatctgcgacgctgtaaataaatgaagtgcgtgtaggtcccgtggatcagatagagagattatgaaaagctggtttgtagtttggggtttgtaaaagctagattgttaaaactcaagtctgtttgaatcgctctattttatcagggatttggattgttgcctttgaacgaaaaaaaaaaaaaaaaaaaa

SEQ ID NO: 5146 - protein, 491 aa, Panicum virgatum
  misc_feature: Ceres CLONE 1816155
  misc_feature (1)..(127): Pfam Name: Glyco_transf_28 Pfam Description: Glycosyltransferase family 28 N-terminal domain
  misc_feature (1)..(164): Pfam Name: UDPGT Pfam Description: UDP-glucoronosyl and UDP-glucosyl transferase
MAGAEAEHGGAASPSPLHVVVFPWLAFGHMIPFLELSKRLARRGHAVTFVSTPRNAARLGAVPPELAARLRVAALELPGVEGLPRGAESTADVPPEKVGLLKKAFDGLAAPFADLVAEACAGANGDATAGFSRKPDFVIHDFAQNWIWPVAEEHEIPCAVFIIFPAAILAFVGSREANEAHPRSTAAEDYMVPPPWIDFPSTMAHRRHEARAIAALFRPNDSGVSDVERFWEMQRPCCRLVVLRSCPEAEPRLFPLLTELYARPVVPAGLLLPDELVGGDDDGAPGGDRPIPDVVRWLDGQPLRSVVYVALGSEAPVTAEHVRELALGLELSGARFLWALRRPVGHSGELLPDGFERRVAGRGVVRAGWVPQVRVLAHAAVGAFLTHCGWGSTVESLFRFGHPLVMLPFVADQGLIARAMAALGVGVEVPRNEDDGSFRGDDVAAAVRRVMEEEEGQELARNARELQEVVGDRARQEQYVDELVDHLRRCK

SEQ ID NO: 5147 - DNA, 2377 bp, Panicum virgatum
  misc_feature: Ceres CLONE 1816157
  misc_feature: Encodes the peptide sequence at SEQ ID NO. 5148
attcgatgtgagcttagccactccgccccgtcggcttcccgagccctctccaaaaccctcctaaaaccctagcatccgtacgcctccgccgcaccgatggcctcctcggcgcaatcgggcggcgccggaggcggcgggacgatcacctccaacccccgcgtctggatcgtcgcagggatcgccgtcgccggcgtcatcgtcctcgcggaggcggcgcggcgccgcaggcggtggctgcggggcaagtccagcgcgccgcccgacgctggagccttctgcgaccgcttcgagctctcccctccgccacagccgccgcctcccgccgcgcgccacctgctctcgggcctaaccttcgccgccagtgacaacttcgagatcgagggttatgtagctgggtttggaaacccggactggaagaggactcacgaggcgccgaggcacacagcagtgactgtcacaatgctgctgaagcagggggccacctgcatcggaaggacagtcatggatgaactcggctttggtgtgactggagaaaatttgcactgcggaacaccaatcaatcctgcttctccatcacttgttcctggtggatcatgcagtggagctgctgtggcagttgctgcacaacttgccgactttgctcttggcaccgatacaattggtgatgtaagaattccagcttctttctgtgggttactcagtttcaggccttcttatggtgttgtatctactcttgggaccatagcaaattcacaaagtctagatacaatcggatggtttgcacgagatccaagtgttctgtatcgtgtcgcagaagctctattaccagctactgcaggtggacttaagcaaagaaggcaatttgtttttgccgatgattgctttcagctgctaaaggtgtctaaccagaaaactgtgcatgccataaaaaatgctgtccagacattacccggatatcagccacctaaacacatcaatatcggccaatatctttatttaaatgtacctagcctgaaggagttttgcgaacctgctacaaagttacaagaaggaatgtcagccttgaaagcgctctccatagtgatgctgttactgcaaagatatgagtttaaggcaagtcacgagaattgggttaacactgttaaacctaagcttggccttgatatctctactcgtgtattaagagctgtgaattttgcacatgataacatcaaatctttgtacgcaataagaaatgaattgagggcggcactccagaatcttctaaaggataccggaattttagttcttccaaccacagctggatatcctctgaagagaaactctaaagaaagactatcatctggatttgaggatagaatgtacaaatttgtgggcattgctgcactttctggctgttgtgaggtcactatccccttggcaaatctggatcatcatgtctctctttcatttgtagcaacacatggatcagataaatccctccttcgtactattttggatacatattctcttatccaggaacaagtagttttggcatccaagttggtaacggcaccggtaaccaatggtgacattgatgttgatattgatgttgatgcatcagaattgctgaaagaaaagggaaatagtgctttcaaaagaagacagtggagcaaggcggttgagttttattcagaggccatcagtttgagtgacacaaatgcaacatattactgcaatagagcagctgcttatctggaacttggcagttttaaacaagctgaagcagattgtgaccgggccttactgttggataaaaagaacgttaaagcatatctccggcgaggttttgcaagggaagttactttgaattacaaagaagctcttcaagatttccggcatgctttggctttggaaccacaaaacaaaacagcccttgcggcagagaggaggctgcaaaaactcctgaagtgatggggatcgccaacctccctacttgtaattttttggaagacgcaccttggttgaaggcaattttgatcgaccacttgtaaaaagaaagaagtgtccgtgcgacgtgttggttaaactattcacccgtcatagaactggagcgctccgtttgctgtcatgcataaatttccgtctcactggtcaggacggttgtgagaagattttggtatgcctgagagcagaggttcttttgttgagttccttaaacctggcagctttttgtgaggaaacttcaactaatttattctgtcagatacactattggccgtgcaatactgcaaccggcatgttttgtattaaaccgttatatacgctgtactgcttggacctggaaatcaagatctgtgacgagagagcttgtgcctaaaaaaaaaaaaaaaaaaaa

SEQ ID NO: 5148 - protein, 618 aa, Panicum virgatum
  misc_feature: Ceres CLONE 1816157
  misc_feature (1)..(424): Pfam Name: Amidase Pfam Description: Amidase
MASSAQSGGAGGGGTITSNPRVWIVAGIAVAGVIVLAEAARRRRRWLRGKSSAPPDAGAFCDRFELSPPPQPPPPAARHLLSGLTFAASDNFEIEGYVAGFGNPDWKRTHEAPRHTAVTVTMLLKQGATCIGRTVMDELGFGVTGENLHCGTPINPASPSLVPGGSCSGAAVAVAAQLADFALGTDTIGDVRIPASFCGLLSFRPSYGVVSTLGTIANSQSLDTIGWFARDPSVLYRVAEALLPATAGGLKQRRQFVFADDCFQLLKVSNQKTVHAIKNAVQTLPGYQPPKHINIGQYLYLNVPSLKEFCEPATKLQEGMSALKALSIVMLLLQRYEFKASHENWVNTVKPKLGLDISTRVLRAVNFAHDNIKSLYAIRNELRAALQNLLKDTGILVLPTTAGYPLKRNSKERLSSGFEDRMYKFVGIAALSGCCEVTIPLANLDHHVSLSFVATHGSDKSLLRTILDTYSLIQEQVVLASKLVTAPVTNGDIDVDIDVDASELLKEKGNSAFKRRQWSKAVEFYSEAISLSDTNATYYCNRAAAYLELGSFKQAEADCDRALLLDKKNVKAYLRRGFAREVTLNYKEALQDFRHALALEPQNKTALAAERRLQKLLK

SEQ ID NO: 5149 - DNA, 1339 bp, Panicum virgatum
  misc_feature: Ceres CLONE 1816186
  misc_feature: Encodes the peptide sequence at SEQ ID NO. 5150
acaatgatcaggaactgagagtggcaagagccaaggagtaagctcagtaggatacagttcgtgagtcacttctctgacatcaagcagttacactaggcttacctacccttctcatttgtagtaaacatatttttggatcaggacattctgataacaatcaaacttctttcagtcttctattttcagaaacctaccagacatattgtagccttagactgctttcattcttaaagttgcacagcactcacttcttatctgaattcacttctggttagaggagagagatagagtagaagcacacaattccacaatgcccatggagcaagtattcaggcacggcgacaaagatacgctgaagatggccatgctgaagcacgaacagactttcagacagcaagttcacgagctccatcgcttatacaggatccagaagcttctgatgcgagacctcaagagggagctcaagagccagaggaacctgtcgacctccccgaacggcggctccaccgagcacagcagaggcgcgctcggcatgtgcgcctacgagcaccgctacgccgctcgcggtcccggcggctacgtagcagtagcgacaccaacgccccgcacggcgctcagcttcgacgtcgtggcgccggacgtcgagtacgtgcggagcgcggaggaggaggaggacgacgacgcggaggaggagaccgacgacgacgcggagctggagctcacgctggccgtgggcggcggcggggccaagaagaggtacggcgagtacccgtccggcggggagagcctctcgtcgtcgtcgacggagtccgacgtgctcaacgcctccggccgcgagtggcgccaggcgcgcggcacgccgtaccaccacaagaggaggccgggcgccgggctggacgtggtacaggcggtggatgacggcgtcgggatgcaggcgccgccgccgctgctgttccactggctcagcctcaagatggcataacgctatgagagggggaaccaaagaaacacattgcatgtgtcgattgctgctcctagtgtcactgtgtgtgtcagggtgttgacttgctactgttcttcagttgaatgctgcgtgttcagatcaagtctagaaattaaatcaataattgactagtcgttcaggagaatgtaggagccacttcccaaaatgtaaggaggctgtaggggcttgcttttcagctacaagtgtgactacctaacggcaagtgcttctgcagttctgctcttgttgacgacagatacaaggcggcgaaaatgcaagacaagttcggtgaaaacaataggaccttgtgccctgcaaaaaaaaaaaaaaaaaaaa

SEQ ID NO: 5150 - protein, 223 aa, Panicum virgatum
  misc_feature: Ceres CLONE 1816186
  misc_feature: Great-hit functional homolog of the protein sequence given in SEQ ID NO 9593
  misc_feature: Useful for making plants with modulated cold sensitivity
  misc_feature: Useful for making plants with modulated salt sensitivity
  misc_feature: Useful for making plants with modulated cold sensitivity
MPMEQVFRHGDKDTLKMAMLKHEQTFRQQVHELHRLYRIQKLLMRDLKRELKSQRNLSTSPNGGSTEHSRGALGMCAYEHRYAARGPGGYVAVATPTPRTALSFDVVAPDVEYVRSAEEEEDDDAEEETDDDAELELTLAVGGGGAKKRYGEYPSGGESLSSSSTESDVLNASGREWRQARGTPYHHKRRPGAGLDVVQAVDDGVGMQAPPPLLFHWLSLKMA

SEQ ID NO: 5151 - DNA, 1383 bp, Panicum virgatum
  misc_feature: Ceres CLONE 1816223
  misc_feature: Encodes the peptide sequence at SEQ ID NO. 5152
acgaccacgtatcgctcagtcacagcgcccgagcgcaggagcagcgaggcaagcgcattccagagagatcctccgtgcgctcaccgcaccgctcgccgccgaagatgagctcccgcgccgccggatccgtcctcctgcaccacctgggcccgcgcgtcttcggccccgcttccttcccggcggccgccgcgccgaggcccctgctcgcgctggccggcggaggggaacggggagccgccgccgtgtgggtcaggcttctgtccaccgccgccgccgaggcgaaggaggaggcggccgcgtacaaggggaaggaggaggaggccgcgtccaaggggaacgctggcagcgccgtggccgccaaggtggaggcggccgcgtccaaggggaacgctggcagcaccgcggtcgccaaggcggaggcggtggaggccgccaaggaggggaacgatgggaagaagagccccggggtcaacagctactggggcatcgagccgtccaagctggtgaccaaggacggcgtcgagtggaagtggtcttgcttcaggccatgggagacgtacaagccgaacacctcgatcgatctcaccaggcaccacgagcccaaggtgctgctcgacaagctcgcctactggaccgtcaaatcgctgcgcgcgcccactgacatcttcttccagaggaggtacggctgccgcgcgatgatgctggagacggttgcggcggtgccggggatggtgggcggcatgctgctgcacctgcgctcgctccgccgcttcgagcacagcgggggctggatccgggtgctgctggaggaggccgagaacgagcgcatgcacctcatgaccttcatggaggtggccaagcccaggtggtacgagcgcgcgctcgtcctcgccgtgcagggcgtcttcttcaacgcctacttcctcggctacctcatctcccccaagttcgcgcaccgcgtcgttggctacctcgaggaggaggccatccactcctacaccgagtacctcaaggacatcgaggacggcaagatcgagaacgtccccgcgccggccatcgccatcgactactggcagcttccggccgatgccacactcaaggacgtcgtcaccatggtgcgggccgacgaggcacaccaccgcgatgtcaaccattttgcctcggacgtccatttccaggggatggagctcaaggagacacctgcgccgcttgaatatcattgaagaaaccggttttgtgacagttcttcatttttactagatgtaggtagttccacttcacacacacacacacacacactctgtatgtatgaactcctatatttccgttggttaatggagatggggcagggcctcgcgtcgataaaaaaaaaaaaaaaaaaaa

SEQ ID NO: 5152 - protein, 372 aa, Panicum virgatum
  misc_feature: Ceres CLONE 1816223
  misc_feature (2)..(283): Pfam Name: AOX Pfam Description: Alternative oxidase
MSSRAAGSVLLHHLGPRVFGPASFPAAAAPRPLLALAGGGERGAAAVWVRLLSTAAAEAKEEAAAYKGKEEEAASKGNAGSAVAAKVEAAASKGNAGSTAVAKAEAVEAAKEGNDGKKSPGVNSYWGIEPSKLVTKDGVEWKWSCFRPWETYKPNTSIDLTRHHEPKVLLDKLAYWTVKSLRAPTDIFFQRRYGCRAMMLETVAAVPGMVGGMLLHLRSLRRFEHSGGWIRVLLEEAENERMHLMTFMEVAKPRWYERALVLAVQGVFFNAYFLGYLISPKFAHRVVGYLEEEAIHSYTEYLKDIEDGKIENVPAPAIAIDYWQLPADATLKDVVTMVRADEAHHRDVNHFASDVHFQGMELKETPAPLEYH

SEQ ID NO: 5153 - DNA, 1287 bp, Panicum virgatum
  misc_feature: Ceres CLONE 1816236
  misc_feature: Encodes the peptide sequence at SEQ ID NO. 5154
gcattgcctgcactgcactgcacatcggttgttcgagtgcccagcaaaagggtgtgcgttgccgacaatggcgaggcaacaagttattgcctcttccatgcttgcagttgctctcatcgttggagcttttgcctccattcctacagccgtggaatccatcggcgtctgctacggcgtggtgggcaacaacatcccgtccaggagcgacgtggtgcagctctacaggtccaggggcatcaccggcatgcgcgtctacttccccgacagccaggccctcgacgccctccgcggctccggcatcgccctcatcctcgacaccggcaacagcgacgacgtcctcgcccgcctcgcctccagcgccgcgtcgtgggtccagaccaacgtgcggccctactacccggccgtcagcatcaagtacatcgccgtcggcaacgaggtccagggcgccgccgcgcagggccgcatcctcccggcgatgcggagcctcgacgccgccctggccgcggcggggctcggcgccatcaaggtctccacgtcggtgcgcttcgacgccgtcgccaactccttcccgccctccagcggcgcgttcgcgcaggggtacatggccgacatcgcgaggtacctggcgggcaccggcgcgccgctgctggccaacgtgtacccctacttcgcgtaccggggcaacccgcgcgacatcagcctcggctacgcgacgttccggccgggcaccacggtcagggacagcggcaacgggctggcctacacgaacctgttcgacgccatggtggacgccgtggtggcggcgctggagaaggccggggcgccgaacgtcagggtcgtggtgtcggagagcgggtggccgtcggccggcgggttcggggcgagcgtggacaacgcgcggagctacaaccaggggctggtcgaccacgtcgggcgcggcacgcccaagaggcccggggcgctggagaccttcatcttcgccatgttcaacgagaaccagaaggacggggaccccacggagaggaacttcgggctcttcttccccaacaagcagcccgtgtacccgatccggttctaaacaacctaaacctggtatatgctatgctatgcaagaagatgatgggagggagatgcctccctcttcttcattgcttttattttatcagcctaaataaacattaaaatactagagtaataagctgcatgcacagcagtggtaactactccataaagtgcagcgtgcacgtatgaataaagggaattaagtaaaaaaaaaaaaaaaaaaaa

SEQ ID NO: 5154 - protein, 336 aa, Panicum virgatum
  misc_feature: Ceres CLONE 1816236
  misc_feature: Great-hit functional homolog of the protein sequence encoded by LOCUS At4g16260
  misc_feature (1)..(305): Pfam Name: Glyco_hydro_17 Pfam Description: Glycosyl hydrolases family 17
  misc_feature (1)..(336): SWISSPROT Homolog: EC 3.2.1.39 Glucan endo-1,3-beta-glucosidase GII precursor
  misc_feature (30)..(336): SWISSPROT Homolog: EC 3.2.1.39 Glucan endo-1,3-beta-glucosidase GI
  misc_feature: Useful for making plants with altered cell wall content and/or composition
MARQQVIASSMLAVALIVGAFASIPTAVESIGVCYGVVGNNIPSRSDVVQLYRSRGITGMRVYFPDSQALDALRGSGIALILDTGNSDDVLARLASSAASWVQTNVRPYYPAVSIKYIAVGNEVQGAAAQGRILPAMRSLDAALAAAGLGAIKVSTSVRFDAVANSFPPSSGAFAQGYMADIARYLAGTGAPLLANVYPYFAYRGNPRDISLGYATFRPGTTVRDSGNGLAYTNLFDAMVDAVVAALEKAGAPNVRVVVSESGWPSAGGFGASVDNARSYNQGLVDHVGRGTPKRPGALETFIFAMFNENQKDGDPTERNFGLFFPNKQPVYPIRF

SEQ ID NO: 5155 - DNA, 1184 bp, Panicum virgatum
  misc_feature: Ceres CLONE 1816242
  misc_feature: Encodes the peptide sequence at SEQ ID NO. 5156
aagaagaagagccgcggcggcgttaatagtcgttccccgaggtcctcaagcgcgcagcacacacaaatacacctcgccttactcgcggaccacccacgagtccggcgagatcttccggcgggcggcgagatgagccgcggcacaggcgcgggatacgaccgccacatcaccatcttctcccccgagggccgcctctaccaagtcgagtacgccttcaaggcggtcaagtcggcgggggtcacgtcgatcggcgtccgcggcaaggactccgtctgcgtcgtcacccagaagaaagtgccggataagttgttggatcagacgagcgtgacgcacctgttcccaatcaccaagttcatcggattgcttgccactggccttacagctgatgcaaggtcgttggtttaccaagcaaggaatgaagcagctgagtttcgcttcaaatggggttatgagatgcctgtagatgtgttagcgaaatggatcgctgacaaagcgcaagtttacacgcagcatgcctacatgagaccccttggcgtagttgctatggtcttgggctatgacgaagagaaaaatgctcaactcttcaagtgtgaccctgctggtcacttctttggacacaaggcaactagtgccgggcttaaggagcaagaagcaataaattttcttgagaagaaaatgaaggatgatccacaattcacctatgacgaaactgttcagattgcaatctctgcgttgcaatcagttctccaggaagatttcaaggccacggagatcgaggttggtgttgtgaggaaagaagactgtgctttcagagcgctcacaacagaggagatcgatcagcacctgacggccattagtgaacgggactgagcctccatatgttggacatgtcactgtgtcacactgtgccgtgccattgtgcttcgactgtcatttcaattcatagccagcaaaggaacactgagtggaccatttcatgtctaacactgaaaacaagccactcccgctgtactcgttgcttcatctttctatgtggttgaatttgcaatggtttgattatgctttgctaatagcgtacctgaatgttgattatttggttccatgttgcatatactaaaagcgcatatagcttgactatatcagaaacaaactcgtttggcttccaaaaaaaaaaaaaaaaaaaa

SEQ ID NO: 5156 - protein, 246 aa, Panicum virgatum
  misc_feature: Ceres CLONE 1816242
  misc_feature (1)..(246): SWISSPROT Homolog: EC 3.4.25.1 Proteasome subunit alpha type 6
MSRGTGAGYDRHITIFSPEGRLYQVEYAFKAVKSAGVTSIGVRGKDSVCVVTQKKVPDKLLDQTSVTHLFPITKFIGLLATGLTADARSLVYQARNEAAEFRFKWGYEMPVDVLAKWIADKAQVYTQHAYMRPLGVVAMVLGYDEEKNAQLFKCDPAGHFFGHKATSAGLKEQEAINFLEKKMKDDPQFTYDETVQIAISALQSVLQEDFKATEIEVGVVRKEDCAFRALTTEEIDQHLTAISERD

SEQ ID NO: 5157 - DNA, 1250 bp, Panicum virgatum
  misc_feature: Ceres CLONE 1816245
  misc_feature: Encodes the peptide sequence at SEQ ID NO. 5158
atccatccatcgaccggtgcaaggcgaagcaagcagagcagtcggagagaacgaacaattgagaggcagaacaccggtggcaatggctggggtgcccatggaagtggagcaggacctcccgggcttccggttccaccccaccgaggaggagctcctcgacttctacctggaccgcatggtccacggcaagaagctccacttcgacatcatcggcacgctcaacatctaccgccacgacccctgggaccttcctgcgatggcgaagatcggggagagggagtggtacttcttcgtgccgcgggaccggaaggccggcagcggcgggcgaccgaaccggacgacggagcgcgggttctggaaggccacggggtcggacagggccatccggagcagcgccgacgcgaagcgggtgatcgggctcaagaagacgctcgtcttctaccaggggcgcgccccgcggggcaccaagacggattgggtcatgaacgagtaccgcctccccgacgccggcgccggcgccggctgcggagcacgagcaccgccgcctcccaaggaggacatggtgctatgcaagatctacaggaaagccaccccactgaaggagctggaacagagagcgtctgccatggaggagatgcagaggcgcagcaacgcgcagtactacatgaacacggccagggcaccccaggtccaggccgcggcctccgccggcgacgactacctgtcgtctgacgacgcccacgacagcttcctgttcccctcctcgtcctcgtcggcgccatcgggcgacagctacagcccacccatggaagccaagcaggaagcggacctggccgtcgtgcagcccccggcggtgaggcacgccgacctgcccagcctccaggtgccagcgaaccatggagtgctggactggatgcaggacctgtcccagctacgcagcccatggcaggaccagtttttcttgtctcccttggcgcatctgctctcttgaagggacaatactggaagcaggtgaaggaagtgtcccaacctagtacctactcacgtcgtcaaaacgggtttccagttcagcttgcaaagggcgagctgcaagcgtgatgctagcttagatgtgaattcgattgtacatactgaaactgaatagtagttttagatgcgatcaatcattttcggtgccttttggtatgtaatgtgtttgacatggctggagtcgcaataaatttaactcagaaaaaaaaaaaaaaaaaaaa

SEQ ID NO: 5158 - protein, 302 aa, Panicum virgatum
  misc_feature: Ceres CLONE 1816245
  misc_feature: The sequence is a functional homolog of  SEQ ID NO 745 in the  11/479,226 US patent application
  misc_feature: Useful for making plants with modulated growth and phenotype characteristics
MAGVPMEVEQDLPGFRFHPTEEELLDFYLDRMVHGKKLHFDIIGTLNIYRHDPWDLPAMAKIGEREWYFFVPRDRKAGSGGRPNRTTERGFWKATGSDRAIRSSADAKRVIGLKKTLVFYQGRAPRGTKTDWVMNEYRLPDAGAGAGCGARAPPPPKEDMVLCKIYRKATPLKELEQRASAMEEMQRRSNAQYYMNTARAPQVQAAASAGDDYLSSDDAHDSFLFPSSSSSAPSGDSYSPPMEAKQEADLAVVQPPAVRHADLPSLQVPANHGVLDWMQDLSQLRSPWQDQFFLSPLAHLLS

SEQ ID NO: 5159 - DNA, 1199 bp, Panicum virgatum
  misc_feature: Ceres CLONE 1816251
  misc_feature: Encodes the peptide sequence at SEQ ID NO. 5160
gcccgcacccacccaacccaaccaaccgcgcttgtttgtgtacactccactagtcccacccagctagcgccccctcccgcccaagccaggcatcagccagccaagaagcagagcagcgtccatggcggcggcgctgcggcgggccctgtccgcggcggtggcggtggcgctgctggcggcgccgtcggcgtcggcggactcgtggctgtacgagaagttcaccacggacggccacgtgcgcgccgactacaacgcgcaggggcagcaggtgacgtcgctcatcctcgaccgccagtccggcggcgccttctactcccgccagaagtacctctacggcgtcttcagcatccagatgaagctcatctgcggcaactccgccggcaccgtcacctccttctacctgacctccggcgacggccccgggcacgacgagatcgacatggagttcatgggcaactccaccggcgagccggtggtgctcaacaccaacgtctgggccgccggcgacggcaagaaggagcagcagttctacctgtggtttgacccggccgccgacttccacacctacaccatcatctggaacgacaagaacgtcatcttcaaggtggacgacctcttcatccgcagcttccgccgtcacgccgacctgccctaccccggcgggaagcccatgtcggtgcacgccacgctctgggacggcagcttctgggccacgcggcagggggaggtcaaggtcgactgggccgccgcgcccttcgtcgtctcctacagggggtactccgccgacgcctgcacgcccgacggcgaggggaggccgctccgctgccccaccggcaccgaccgctggatgagccggcagctcgacgccgccgagtggggcaccgtcgcctgggccaggaagaactacatgcactacaactactgcgaggatgggtggaggttcccgcaggggttcccagccgagtgctcccgcaactgattgattgcttgctgcttcttcttcttggttgatttgattgattgaatgattgatctgggatcgttgatgctgattccaaatttccaatccttcaaccaatcctgggtgtttgttcattgcatttgttcgtcgccgaccttcctcgggtcgatggacgattgttgcttgcatctctatacctgcgatttcttgcctccccgaaaaaaaaaaaaaaaaaaaa

SEQ ID NO: 5160 - protein, 285 aa, Panicum virgatum
  misc_feature: Ceres CLONE 1816251
  misc_feature (1)..(181): Pfam Name: Glyco_hydro_16 Pfam Description: Glycosyl hydrolases family 16
  misc_feature (1)..(284): SWISSPROT Homolog: EC 2.4.1.207 Xyloglucan endotransglycosylase/hydrolase protein 8 precursor
MAAALRRALSAAVAVALLAAPSASADSWLYEKFTTDGHVRADYNAQGQQVTSLILDRQSGGAFYSRQKYLYGVFSIQMKLICGNSAGTVTSFYLTSGDGPGHDEIDMEFMGNSTGEPVVLNTNVWAAGDGKKEQQFYLWFDPAADFHTYTIIWNDKNVIFKVDDLFIRSFRRHADLPYPGGKPMSVHATLWDGSFWATRQGEVKVDWAAAPFVVSYRGYSADACTPDGEGRPLRCPTGTDRWMSRQLDAAEWGTVAWARKNYMHYNYCEDGWRFPQGFPAECSRN

SEQ ID NO: 5161 - DNA, 1240 bp, Panicum virgatum
  misc_feature: Ceres CLONE 1816264
  misc_feature: Encodes the peptide sequence at SEQ ID NO. 5162
agagggaaaagggtaggtgaaagaactgaaggcgagcgcagagcccggcagcccgcccacatgctttgcccctgccaatggtaactggtaagtggtagcccacgtggatctcggatcctcgccgcctctcatctgcgtctgtttcttctgctcttcccgacttcgatcggacggagcgttcctggctccgtccctccgttggtacccggcgaggatcaggaagacttcatcggtaagatagcgatggcgccgccgatctccacaagacagcctctgcggattgctttgacgccaaacagtgggcacctgagatcatctgcagttagaataacctgttttgctaagcaaactattactcccaaacctttatcatctagtttggacgaggccaaaagaaatgagcctgtagtcaaaatgtgtggcattacatctgcaagggatgccgcaatagctgcaaaggctggcgctaaacttattgggatgattttttggcccaattccaaacgctcggtcccattatctgaggccaaggagatatccagagtagccaaatcttacggggctgaaccagttggcgtgtttgtagatgatgatgaagagaccatcttgagagcgtccgattcctgtgaccttgaacttatccagctccatggagatagctcccgagaactacttcctgtgctttggaagaataatcgaattatatatgtgcttaatgttgaagaggatggtaaacttatcaatgctcctccaagtgaagaatatgttgtcgattggtttttggtggacagtgcaaagggtggcagtggcaaagggttcaactgggagaaattccaaatgccatctgtcaatagcaagaatggctggctattagcaggaggccttcacgcggacaatgtatgccaagctgcttctgctctaaatccagatggcctggatgttagcagtggcatatgttatcctgacggtttacggaagaaccctgagagaatacattccttcatgagcagagtaaaaaggttgagtccccagtaaactgaaactgcagtttctgctctttctatcatagttttcttggtccagtatctcgaacttaaataaatagcattccttgataatgaaaataaatggagtccacagatgatgacagtgatggtctttgatatcaacctgtaacatactggctgaaatttcaaattttctgtctgattatttatgccaaaaaaaaaaaaaaaaaaaa

SEQ ID NO: 5162 - protein, 263 aa, Panicum virgatum
  misc_feature: Ceres CLONE 1816264
  misc_feature (1)..(199): Pfam Name: PRAI Pfam Description: N-(5'phosphoribosyl)anthranilate (PRA) isomerase
MAPPISTRQPLRIALTPNSGHLRSSAVRITCFAKQTITPKPLSSSLDEAKRNEPVVKMCGITSARDAAIAAKAGAKLIGMIFWPNSKRSVPLSEAKEISRVAKSYGAEPVGVFVDDDEETILRASDSCDLELIQLHGDSSRELLPVLWKNNRIIYVLNVEEDGKLINAPPSEEYVVDWFLVDSAKGGSGKGFNWEKFQMPSVNSKNGWLLAGGLHADNVCQAASALNPDGLDVSSGICYPDGLRKNPERIHSFMSRVKRLSPQ

SEQ ID NO: 5163 - DNA, 1767 bp, Panicum virgatum
  misc_feature: Ceres CLONE 1816296
  misc_feature: Encodes the peptide sequence at SEQ ID NO. 5164
atcaccagaagccgcaagctctttcctaccaaggctcgatcggctccctcccagcagcccaaccagctattggcctctagctagctaggagcacacaaggcactgatacgaattactcgctgatcgaaggcgcgctcagctctaagccagcacgccgtttcgattcactgagctagccctctttagccaaatgggtggtgccaataatggtgagctcctctcgaggatcgccgccggcgacggccacggcgagaactcgtcctacttcgaagggtggaaggcctacgacatgaaccctttcgacctgcaccacaaccccgacggcgtcatccagatgggcctcgccgagaaccaactgtcgctggacctgatcgaggagtggagcatcaaacacccggaggcctccatctgcacggcgcagggcgcctcgcagttccggaggatagccaacttccaggactaccacggcctgccggagttcagagaggcgatggccaagttcatggggcaggtgaggggcgggaaggtgacgttcgaccccgaccgcgtcgtgatgagtggcggggccaccggcgcgcaggacacgctcgccttctgcctcgccgaccccggcgacgcctacctcgtgccgacgccctactacccagctttcgaccgggactgctgctggaggtcagggatcaagctgctgccgatcgagtgccacagctccaacaacttcgccctcaccagggaggcgctcgtcgcggcgtacgacggcgcgcggagccagggcatccgcgtcaagggcatcctcgtcaccaacccctccaacccgctaggcaccaccatgggccgcggcacgctggcgatgctcgccgagttcgccacggagcaccgtgtccacctaatctgcgacgagatctacgccggctccgtgttcaccaagcccgacttcgtgagcatcgccgaggtcgtggagcgcgacgtccccggctgcgacagggacctcatccacatcgcctacagcctctccaaggacttcggcctcccgggcttccgcgtcggcgtcatctactcctacaacgacgccgtcgtggcctgcgcgcgcaagatgtccagcttcggcctcgtctcctcccagacgcagtacttcctggcgaggatgctctcggacagcgagttcatggcccgcttcctggcggagagcgcgcggcggctggcggcgcggcacgagcgcttcacctcgggcctccgcgacgtcggcatcagctgcctgcccggcaacgcggggctcttctcgtggatggacctgcggagcatgctccgggacaagacgcccgaggcggagctggagctgtggcgggtgatcgtccacaaggtgaagctcaacgtgtcgcccggcacgtcgttccactgcggcgagcccgggtggttccgcgtctgccacgccaacatggacgacgcgaccatggagatcgccctcgaccgcatccgcagcttcgtgcagcagcaagagcacaaggccaaggccaagcgcagctgggccgccagggggtccctccgcctcagcttgccgcgccggggtggcgccgccgcttcgcacctcgcgctctccagccccctggcgttgatgtcgccgcagtcacccatggttcacgctagctaatcaccgtgcattcggcaagggacggttggcagggtgcgccgtacatttcaacatttgtacgtgcatccttttttgcaatcacatggccggctgtacagcaaaaaaaaaaaaaaaaaaaa

SEQ ID NO: 5164 - protein, 485 aa, Panicum virgatum
  misc_feature: Ceres CLONE 1816296
  misc_feature (1)..(371): Pfam Name: Aminotran_1_2 Pfam Description: Aminotransferase class I and II
  misc_feature (1)..(484): SWISSPROT Homolog: EC 4.4.1.14 1-aminocyclopropane-1-carboxylate synthase
  misc_feature (8)..(485): SWISSPROT Homolog: EC 4.4.1.14 1-aminocyclopropane-1-carboxylate synthase
MGGANNGELLSRIAAGDGHGENSSYFEGWKAYDMNPFDLHHNPDGVIQMGLAENQLSLDLIEEWSIKHPEASICTAQGASQFRRIANFQDYHGLPEFREAMAKFMGQVRGGKVTFDPDRVVMSGGATGAQDTLAFCLADPGDAYLVPTPYYPAFDRDCCWRSGIKLLPIECHSSNNFALTREALVAAYDGARSQGIRVKGILVTNPSNPLGTTMGRGTLAMLAEFATEHRVHLICDEIYAGSVFTKPDFVSIAEVVERDVPGCDRDLIHIAYSLSKDFGLPGFRVGVIYSYNDAVVACARKMSSFGLVSSQTQYFLARMLSDSEFMARFLAESARRLAARHERFTSGLRDVGISCLPGNAGLFSWMDLRSMLRDKTPEAELELWRVIVHKVKLNVSPGTSFHCGEPGWFRVCHANMDDATMEIALDRIRSFVQQQEHKAKAKRSWAARGSLRLSLPRRGGAAASHLALSSPLALMSPQSPMVHAS

SEQ ID NO: 5165 - DNA, 1080 bp, Panicum virgatum
  misc_feature: Ceres CLONE 1816316
  misc_feature: Encodes the peptide sequence at SEQ ID NO. 5166
attgcattcgagcaaagcattgtgctctgccatcatactaaaccgctagctaatcgttagcgacttgagccatcacctaatcattagccagctcttttctctgctgtattgattgatacaagttacaagagagatcgctagctagctacctctttctctgtattaatacgtacgagtaatctttgatttggtgcgtgacccagatcgacggagataataatggcgcctaacggggacgcagcggtggcggccgcaccggcgccggcgccggcgccggtgccgaagccggcgcggcggcagtcgaagccgaggaggatatccatggaggggctccagcgcgccatgtccgacctggccctggagctggccagggacaggaaggccgccgacgccaagccggcgacgacgacgacgcagcagctgctgccggcgatcacggagcagcaccagcaggtggaggacgcgcggtgcgaatgctgcggcatgcaggaggagtgcacgcccgagtacgtgcgccgcgtccgggagcgctactgcgggcgctgggtgtgcgggctgtgcgcggaggccgtcaacggcgaggccgacagccgccacgggggccgcacggaggaggcgctggcggcgcacatggccgtgtgcggccgcttcaaccgcgtcggccgcgccaaccccgtgctcatgcagacggaggccatgcgggagatcctgaggaagaggtgcaggtccaacagccccagggatcacgccggcgccctcgccaggagctccagctgcatcccggccataaccaaggacttcaactgagctgcggcttcttcttcttggggtccggcttcatcagcttcttcatcattagctagctagtagctcggcatggatgggcttgtatcttttgtagtagcatgtatcaacatgcatgctagctaagtttgtaatttctggcattttgctaggtggataactggatatctttcagtaccattaggagcacttttttttcgtggctttgtactacgttttggttgtactacacacacataaatgatcaatactgatgaaaaaaaaaaaaaaaaaaaa

SEQ ID NO: 5166 - protein, 195 aa, Panicum virgatum
  misc_feature: Ceres CLONE 1816316
  misc_feature: Great-hit functional homolog of the protein sequence given in SEQ ID NO 9445
  misc_feature: Useful for making plants with modulated biomass
  misc_feature: The plant is abnormally small.
MAPNGDAAVAAAPAPAPAPVPKPARRQSKPRRISMEGLQRAMSDLALELARDRKAADAKPATTTTQQLLPAITEQHQQVEDARCECCGMQEECTPEYVRRVRERYCGRWVCGLCAEAVNGEADSRHGGRTEEALAAHMAVCGRFNRVGRANPVLMQTEAMREILRKRCRSNSPRDHAGALARSSSCIPAITKDFN

SEQ ID NO: 5167 - DNA, 1422 bp, Panicum virgatum
  misc_feature: Ceres CLONE 1816333
  misc_feature: Encodes the peptide sequence at SEQ ID NO. 5168
gtctcccgtggtcctcctccactccacctccttctccgccttccccctcgagctcgcctcgcctcgaccaggctccgcagccctcgcccgcagctggccggctctctcgcgtccagccgggagccgggctctggggggatggcgttccactacccggaccacgcgctggcgatggaccccgcggccggggtcggcgcggcggtcaaccctagcttcgtgtcccccggcggcggcggggtcgggggaggagggggcgggtgggagcgggagaaggcggccatcgcggcgcacccgctgtacgagcgcctgctcgaggcgcacgtcgcctgcctccgcgtcgccacccccgtcgaccagctcccgcgcatcgacgcgcagatagccgcgaggcccccgcccatggcggcggccgcggccgcggccgctgcggcggcgggcggggcgcagtcgggaggcgaggagctcgacctcttcatgacgcattacgtattgctcctctgttcattcaaggaacaactccagcagcatgtgcgtgttcatgcaatggaagcagtgatggcttgctgggagcttgaacaaactttacaaagccttactggggcatctcctggtgaaggcactcgggctactatgtctgatgatgaagacaatcaggtagacagcgagagcaacatatttgatggaaatgaggggtcagatggaatgggattcggtcccttaatgttgactgagggtgagagatccttagttgagcgtgtgcggcaggagctaaagcatgagcttaagcagggatacagagaaaaacttgtggatattagggaagagataatgcggaagcgaagggctggaaaactccctggggacacagcttctacgttgaaagcctggtggcaagctcattctaaatggccatacccaactgaggaagacaaggctagactggtacaggaaacagggctgcaactaaagcagatcaacaactggttcatcaaccagcgtaagaggaactggcacagcaatccggcatcatcctcatccgacaaaagcaagagaaaaaggtgatggcaatgctgagcaatcctggtagagcgtggtcggagaagaattatatgtaaataacgcgtctactgagaagaatggcaccatatttgttgcgtgggaaacaaccattcgagtgggtgtttcctgagccccatattcatacaaagatatcacacgatgtaataatgttgtaagtagtcatgtaaactaaataatttgtatagcgaatcactagagactagcattcatgtttggtattgtatagttttaattgattgagcgtactgtctctgtataactctacgatttaaatgtatttgactagcactcgatattgtattttgtattagtatgtcatgcgaaaaaaaaaaaaaaaaaaaa

SEQ ID NO: 5168 - protein, 307 aa, Panicum virgatum
  misc_feature: Ceres CLONE 1816333
  misc_feature: Great-hit functional homolog of the protein sequence given in SEQ ID NO 9179
  misc_feature (1)..(59): Pfam Name: Homeobox Pfam Description: Homeobox domain
  misc_feature: The sequence is a functional homolog of  SEQ ID NO 708 in the  10/374,780 US patent application
  misc_feature: The sequence is a functional homolog of  SEQ ID NO 710 in the  10/374,780 US patent application
  misc_feature: The sequence is a functional homolog of  SEQ ID NO 711 in the  10/374,780 US patent application
  misc_feature: The sequence is a functional homolog of  SEQ ID NO 712 in the  10/374,780 US patent application
  misc_feature: The sequence is a functional homolog of  SEQ ID NO 713 in the  10/374,780 US patent application
  misc_feature: Useful for making plants with altered Lignin content
  misc_feature: Useful for making plants with altered sterol content
  misc_feature: Useful for making plants with altered terpenoid content
  misc_feature: Useful for making plants with modulated flowering time
  misc_feature: Useful for making plants with modulated growth and phenotype characteristics
MAFHYPDHALAMDPAAGVGAAVNPSFVSPGGGGVGGGGGGWEREKAAIAAHPLYERLLEAHVACLRVATPVDQLPRIDAQIAARPPPMAAAAAAAAAAAGGAQSGGEELDLFMTHYVLLLCSFKEQLQQHVRVHAMEAVMACWELEQTLQSLTGASPGEGTRATMSDDEDNQVDSESNIFDGNEGSDGMGFGPLMLTEGERSLVERVRQELKHELKQGYREKLVDIREEIMRKRRAGKLPGDTASTLKAWWQAHSKWPYPTEEDKARLVQETGLQLKQINNWFINQRKRNWHSNPASSSSDKSKRKR

SEQ ID NO: 5169 - DNA, 1132 bp, Panicum virgatum
  misc_feature: Ceres CLONE 1816383
  misc_feature: Encodes the peptide sequence at SEQ ID NO. 5170
atgcctccaggaaaaagacagcggcaacggagaagaggaaggcaggaagagagccgagagcagagagagatggcgcccccgccccaccagcgggcgctgctcctgttcccgctcgtcttcctcctcctcctcctcctcctcgccccgccccgcgccgacgcgtggggcaaggagggccacatcatggtctgcaagatcgccgagaagtacctgtcggagaaggcggcggcggcggtgcaggcgctgctgccggagtcggccggcggggagctctcgacggtgtgcccgtgggcggaccaggtgcgctggcactaccattggtccagccccctccactacgccaacaccccgcaagtctgcaacttcaagtactctcgtgattgccacaattctcgtggcgagcaagggatgtgcgtcgtcggggccatcaacaactacaccgaacagctctacagctatggccagaagacttcgtataacctgacggagagcctcatgttcctggcgcatttcgtcggcgacgtgcaccagccgctgcacgtcggctacgaggacgatgagggcgggaacacgatcgtcgtgcactggtaccggaggaaaacaaacctccaccacgtgtgggatgtcagcatcatagacacggaaatcaaggacttctacaacaaaagcatggataccatggtagaggctctcaagacgaaccttacaggtggatggtctgatgacattacacagtgggaaaattgcgagaacaaacgggcaacctgcgcaaacgactatgccattgagagcattcattattcctgcaactatgcctacaaagatgtggagcaagacattactctaggagatgattatttcttcactcgatacccggttgtggagaagaggctagcacaggccggcatcagattagcattaatacttaaccggatatttgatggggataaagtagatgatataccattacaagtacagtaatagttataatcaatataaatatatgtggggttatcctttgttgccactattacaaggatgggtacattacattactagtttactacactagtaaatcagcatgaattctagtaaggaagcacatcgtctagaaaaaaaaaaaaaaaaaaaa

SEQ ID NO: 5170 - protein, 303 aa, Panicum virgatum
  misc_feature: Ceres CLONE 1816383
  misc_feature (1)..(260): Pfam Name: S1-P1_nuclease Pfam Description: S1/P1 Nuclease
MAPPPHQRALLLFPLVFLLLLLLLAPPRADAWGKEGHIMVCKIAEKYLSEKAAAAVQALLPESAGGELSTVCPWADQVRWHYHWSSPLHYANTPQVCNFKYSRDCHNSRGEQGMCVVGAINNYTEQLYSYGQKTSYNLTESLMFLAHFVGDVHQPLHVGYEDDEGGNTIVVHWYRRKTNLHHVWDVSIIDTEIKDFYNKSMDTMVEALKTNLTGGWSDDITQWENCENKRATCANDYAIESIHYSCNYAYKDVEQDITLGDDYFFTRYPVVEKRLAQAGIRLALILNRIFDGDKVDDIPLQVQ

SEQ ID NO: 5171 - DNA, 1145 bp, Panicum virgatum
  misc_feature: Ceres CLONE 1816406
  misc_feature: Encodes the peptide sequence at SEQ ID NO. 5172
acgcagttgttgaatatacaatcgtcttggtggtcttgttcctccattattccggcgccattgagtactgcagggccccagcaagcacagagtactgcagcggtgagcagcggcaacggcggcggccgagatgatggcggcggcgaggacgaccatgtcctggaccacgagtaccaagaggttacgccgtggagtgcggcgttactatgcgcggcaccggcgaggccttgcccgtgccggctacgccgtctacggcctcgactacgagggccacggccgctccgacggtctgcagggctacgtgccggacttccaggccctcgtccaggactgcgacgactacttcacctccgtcgcccgctcccaccctcaccggcgccgcttccttctaggcgagtccatgggcggcgccgtcgcccttctcctccaccgcgctcgccccgacttctgggccggcgccgtgctcgtagcgtccatgtgcaagatcgccgacgacatgcggcctcacccggtggtggtcaacatcctcagggccatgacctccatcatccccacctggaagatcgtgcccaccgccgatgtcatcgacgccgcctaccggatgcaggacaagagggacgagatccggggcaacccctactgctacaaggacaagccgcgactcaagaccgccttcgagctgctcaaggtcagcttggacgtggaggcaaacctcctgcacaaggtgtccttgccgttcctgatcgtgcacggcggtgcggacaaggtgacggacccttcagtgagcgagctgttataccaatcggcggcgagccaggacaagacgctcaagctctacccaggcatgtggcacgccctcacctctggtgagtcgcccaacaacatccggactgttttccaagatatcatcgcttggctggaccacagatcgacggaggagctgctgccagagctggagcagaaggccaggcatgaccaccaacatcaccaccagcatgcaggcaaatagctagctgctatagctatatatatgtatactacgtgagcatggagttaaattaaacagagtttgggttgttagattgactatatatattattgatgctagctgcaaggtgacctggcaaaaaaaaaaaaaaaaaaaa

SEQ ID NO: 5172 - protein, 292 aa, Panicum virgatum
  misc_feature: Ceres CLONE 1816406
  misc_feature (1)..(218): Pfam Name: Abhydrolase_1 Pfam Description: alpha/beta hydrolase fold
MMAAARTTMSWTTSTKRLRRGVRRYYARHRRGLARAGYAVYGLDYEGHGRSDGLQGYVPDFQALVQDCDDYFTSVARSHPHRRRFLLGESMGGAVALLLHRARPDFWAGAVLVASMCKIADDMRPHPVVVNILRAMTSIIPTWKIVPTADVIDAAYRMQDKRDEIRGNPYCYKDKPRLKTAFELLKVSLDVEANLLHKVSLPFLIVHGGADKVTDPSVSELLYQSAASQDKTLKLYPGMWHALTSGESPNNIRTVFQDIIAWLDHRSTEELLPELEQKARHDHQHHHQHAGK

SEQ ID NO: 5173 - DNA, 1210 bp, Panicum virgatum
  misc_feature: Ceres CLONE 1816409
  misc_feature: Encodes the peptide sequence at SEQ ID NO. 5174
aggctcggacccattgtctcatctctctcggtgccgccgcgtcgtctccttccccccaaaccccccaccccaaaccctacccgccggcagtcctggccgccagccgcccagcccgccacacccctcgtcctcggctccgcctgcgcgccgcgccgccgccaggagcgattcgcaatctcggtgtggaggagcccctgtagccggcacccgcgggccgctcccgccttccttaagcgccggcgccgccccgtacgcgcaaaatccctctcagagcccaccgggagagagcggaaaagcggggggagcagagggcgatggcgtcgtcggagggcgacgcgaacaagctgtggcgcatccggcgcacggtgatgcagatgctgcgcgaccgcgggtacctgatctctgaaaccgaggacatcggcctcactaaggcggacttcgtggcgcgctacggcgaccccgtccgccgcgacgacctcatcatcagccgccacaagaaggacagccccgccgaccagatctacgtgttcttcccgaacgaggccaagcccggcgtgaagacgatcaggaactacgtcgagaagatgaagcaggagaacgtcttcgccggcatactcgtcgtgcagcaggcgctcagcgcgttcgcacgcagcgccgtgcaggaggtctcccagaagtaccatctggaggtcttccaggaagctgagcttcttgtgaacattaaggagcatatcctagtgccggagcacgagctcctgacactggaagagaagaagacgttgctagagcggtacaccgtgaaggaaacccagctcccccggattcagattacagacccgatagcaagatactacggcatgaagcgtgggcaggttgtgaggatcatccgacccagtgaaactgctggaagatacatcacctaccgctacgttgtctgagcttcccctacatttcccatggcttgagcttctgccgtgaaccatgaccaagtgaaaattttcccctagcttctaatctcgctgtgtactttgaaacactgttaccgctgagaacttgaagtgccgtcgaagtgctctggtgcttttccctgagaactgattgacgttacgctgttttagcactataattagttttcctgtagctgtagctgcgttacatctatgaaatcgttgttccgatttgaagaggacaaaaaaaaaaaaaaaaaaaa

SEQ ID NO: 5174 - protein, 207 aa, Panicum virgatum
  misc_feature: Ceres CLONE 1816409
  misc_feature (1)..(90): Pfam Name: RNA_pol_Rpb5_N Pfam Description: RNA polymerase Rpb5, N-terminal domain
  misc_feature (1)..(74): Pfam Name: RNA_pol_Rpb5_C Pfam Description: RNA polymerase Rpb5, C-terminal domain
  misc_feature (1)..(207): SWISSPROT Homolog: EC 2.7.7.6 DNA-directed RNA polymerases II 24 kDa polypeptide
  misc_feature (5)..(206): SWISSPROT Homolog: EC 2.7.7.6 DNA-directed RNA polymerase II 23 kDa polypeptide
MASSEGDANKLWRIRRTVMQMLRDRGYLISETEDIGLTKADFVARYGDPVRRDDLIISRHKKDSPADQIYVFFPNEAKPGVKTIRNYVEKMKQENVFAGILVVQQALSAFARSAVQEVSQKYHLEVFQEAELLVNIKEHILVPEHELLTLEEKKTLLERYTVKETQLPRIQITDPIARYYGMKRGQVVRIIRPSETAGRYITYRYVV

SEQ ID NO: 5175 - DNA, 1268 bp, Panicum virgatum
  misc_feature: Ceres CLONE 1816436
  misc_feature: Encodes the peptide sequence at SEQ ID NO. 5176
cctttttgcctcgtcctcccgccgccgcttagctcgcgcggtcgcttgtcgccgccctccatccacgagctctcgcgggcaggtgggcgggcgtgaggcgaggcgatgctcgcgtggaaggagaaggtggcggaacgcctttcccgcctcatcgccgactcccccgtctccccttccccgggccccgccgccgtccagccgccgctggcaacatctctcccaacagaacattttacttcccccaataagtcatccttatcttcttatgtattgtcccttctaccaacctcaaactcagggcctgagcagaattcaccttgttcagggactttgagaccattacctcctgagtcacttcctaagagatggagagggagtgaattcacatggcaagatctgccgcaggaattgagtgaggagtctggttctgaaagtgagagagatgaaaggaatggggattttagtaagaaccaggtccatcagtcatacagatccgtgggaaactcgaatggaaatgaggaaacatcgacttcagactgtgcaggcgctcttcattatctaactgaaaagtctatgtttgtatctccaaaactgtttgccttctttgattcttctctccctgggaccttaaaggggtgccactgggtattgctatatagcacctggaagcatgggatatctctaagaacacttcttcgtagaactgagaatattcagggtccatgcctattgattgttggagatatgaaaggggctgtgtttggtggcttattgaacagtcctttgcggcctacagagaaaaggaaataccagggaacaaaccagacatttgtgttcacaacgatacatggtgaacctagacttttcagaccaactggtgcaaacagattctactatttgtgcttgaatgatgctttggcatttggaggtggtggaagcttcgcattgtgtgttgatgaagatttgttacatggaagcagtggatcatgcgatacatttggaaactcatgcttggcatatactccagagtttgaactaaagaatgttgagctgtgggggttcacgcattcgtggagccgttcgaagtagctgatgctgctagttgtccccatacggccctcagctgtggtcgatccagtgtatacttgtctacaaaaaaagaaaaagaaagaacgagacagtttacttgtttagctgatgctagttgcccccacacgaccgtcagctgtggttaaaccagtctactataaaaaaaaaaaaaaaaaaaa

SEQ ID NO: 5176 - protein, 327 aa, Panicum virgatum
  misc_feature: Ceres CLONE 1816436
  misc_feature: Great-hit functional homolog of the protein sequence given in SEQ ID NO 9366
  misc_feature: Useful for making plants with altered protein content
MLAWKEKVAERLSRLIADSPVSPSPGPAAVQPPLATSLPTEHFTSPNKSSLSSYVLSLLPTSNSGPEQNSPCSGTLRPLPPESLPKRWRGSEFTWQDLPQELSEESGSESERDERNGDFSKNQVHQSYRSVGNSNGNEETSTSDCAGALHYLTEKSMFVSPKLFAFFDSSLPGTLKGCHWVLLYSTWKHGISLRTLLRRTENIQGPCLLIVGDMKGAVFGGLLNSPLRPTEKRKYQGTNQTFVFTTIHGEPRLFRPTGANRFYYLCLNDALAFGGGGSFALCVDEDLLHGSSGSCDTFGNSCLAYTPEFELKNVELWGFTHSWSRSK

SEQ ID NO: 5177 - DNA, 2225 bp, Panicum virgatum
  misc_feature: Ceres CLONE 1816524
  misc_feature: Encodes the peptide sequence at SEQ ID NO. 5178
gccgtcacctaccttccctccacctctccacccgcccgtttgaccccgtcccctgctcgctttcccctcccccacctgctcctccgccagccgccccgtcctaggtttagcgcgctcctcagaacccaatcgcctccctccgggccgcccggagagcagttgcctggctgcacgccgcgggccctcgcatggtggcccccgcgacggcgtgagggctacgcgcgctcgtggtgtgcatcggggacatagagagatagatagatgagaccctccgccgctgccggccgcagcggcgctgtgatgagggccgctgctgtggggctcgtgctggtcggcctcgccctggccccgccgctggccgcggcgctgcggccgctccgggagcgcgtcgcgtccgctggagccgccgcctccgccggttcgttgggcgatgagcacgccttcttcaaaagggatgataatgatataggcccctattcatggaatattacgggaacgtataaagggagctgggcctttgctggtgccacaaatggttcatctaggtttcttgagtttgtgaaatctaaaggtgattcggttctggaattgttgagcactccaacaaagataagcggggtgcattatgttcagggatcaattacattccatgatgtcattgacaatgcccacgatcatggagtggctcaaataaggttggaaggagtgtacatatggccttttagacaacttcggatggtagcaaacagtggtgcagatggtgagccacttcaagaagaggattactttttgtcaaatccataccatttgctccggattttctcctctcaagtattccaagaatcttctgaagagaagaaccgaaggaagaattctctcacatatgacatggggaaacactgtaacacagaaattgctgctaaggtggttcgcgtgccatctaacccaaatgatggcgagcatgagaagtaccggttggagggtttggtggagagtccagccgtcgatgatgatggagagtgcttctcacctatcttactaaatgcgacttctttgaatgttgaagtctattacaacaaagcagtcaactacacactgatggtcacttttatctctttccttcaagttttgctgttgattagacaaatggagcatagcaacactcaatctggagctgctaaggtttctattttaatgattggccaacaagctatcatggatgcatatctctgtctgctccacctgactgctgggatattggttgagtcgctgtttaacgccttcgcaacggctgcattcttcaaatttgttgtattttctatttttgaaatgaggtaccttctcgccatatggaaagcaggtaggcctttaaacagtggagaaggttgggagataatgaggcgagaactgtctgttctttacagccgcttttatggtattcttttgggaggaatccttctaatgtatgagttgcacaatttcttacgcccacttcttctcctgatgtactccttttgggtaccccaaattgttacaaatgtcatcaaggatacaagaaaacctctgcacccacagtatattttaggcatgacagttacccgccttgctattccactgtatatagttggttgccctagtaacttcatgcgcattgagcctgacaagaaatggtgcatagctgttacggcattcatgggtatccaagcagcagtgcttttgcttcagcactatcttggttctcgctgctttattcctcgacagatcctgcctgagaaatactgctaccacaggaaggttgaggatagcacgaatcagcccattgattgtgttatttgcatgactacaatcgatcttacccaaagaacaagtgaatacatggtggcaccttgtgagcatatattccactcaggctgtttacaacgatggatggacatcaagatggagtgcccaacttgcaggcgctccctaccgccagcttagatgagggctttgtaccatatagttaacaagaagtaggtagctcagcttatacaaggtggaaactgaggtacaataaggcgaggctgcaactgcatgaaagctatcgacgtaactgtagagaagttttatgctattgattttaagtggtgttgtgttgtacgaactattgtatcaagtgtcccacggagaaatcgtcctcagctgcccttgcggttttcactgtcgcaaaaaaaaaaaaaaaaaaa

SEQ ID NO: 5178 - protein, 572 aa, Panicum virgatum
  misc_feature: Ceres CLONE 1816524
  misc_feature (1)..(44): Pfam Name: zf-C3HC4 Pfam Description: Zinc finger, C3HC4 type (RING finger)
MRPSAAAGRSGAVMRAAAVGLVLVGLALAPPLAAALRPLRERVASAGAAASAGSLGDEHAFFKRDDNDIGPYSWNITGTYKGSWAFAGATNGSSRFLEFVKSKGDSVLELLSTPTKISGVHYVQGSITFHDVIDNAHDHGVAQIRLEGVYIWPFRQLRMVANSGADGEPLQEEDYFLSNPYHLLRIFSSQVFQESSEEKNRRKNSLTYDMGKHCNTEIAAKVVRVPSNPNDGEHEKYRLEGLVESPAVDDDGECFSPILLNATSLNVEVYYNKAVNYTLMVTFISFLQVLLLIRQMEHSNTQSGAAKVSILMIGQQAIMDAYLCLLHLTAGILVESLFNAFATAAFFKFVVFSIFEMRYLLAIWKAGRPLNSGEGWEIMRRELSVLYSRFYGILLGGILLMYELHNFLRPLLLLMYSFWVPQIVTNVIKDTRKPLHPQYILGMTVTRLAIPLYIVGCPSNFMRIEPDKKWCIAVTAFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 5179 - DNA, 2529 bp, Panicum virgatum
  misc_feature: Ceres CLONE 1816545
  misc_feature: Encodes the peptide sequence at SEQ ID NO. 5180
aaaacgcgacgcgacgcaatcaacgaacgcccagcgcccagtcaaacactcctccccgttctccaccccccctcccttcccctccggccctacccgctcgccgccttcgctgaccccgcccgccccgatcccgcccgccccatggcgtcggagatcgaggtgctcgaggacaccaccacctccacccccctcgtcgcggcggcgtccacggcccctcccgccgaggatggcgtgggggcggcggcccccgaggacgagtcgctgaagaacgacgtgtacaccgcggcggcctacggcgatctggagaagctgcagcggctggtggagggggagggccggcccgtccgcgagcccgacggcggggggtaccacgcgctccagtgggccgcgctcaacaaccgcgtcgccgccgcgcagtacatcctcgagcatggagcagatattaatgctgtggatcacactggacaaacagcacttcactggagtgctgtgcgtggtcatattcaagttgctgaactacttttgaaagaaggagccaaggtggatgctgctgatttatacgggtatcaggccacacatgttgcagcacagtatggtcagactgcattcatttatcatattgttgcgaaatggaatgctgatccagatgtccctgataatgatggaagaagccctttacactgggctgcttataagggatttgcagactcaatacggcttcttttatttttggatgcatataggggacggcaagacaaagaaggttgtactcctttacattgggctgcaattcgagggaatcttgaggcctgcactgtgctagttcaggttggcaaaaaggatgacttgatggtgaaagacaaaactggtttaactccagcacagcttgctgctgataagaataaccggcaagttgcatttttccttgacaatgctagaagggtatatgacagaggatgtggtgcaaataccaaatttgggaaattttcaaaattagggcttgctccacttctttggtgcatcattatcgccatgcttattacgtacatacactccgttatatcaggacaatatgccacgaatatgacagcaccatttgggatgttcggatggtcaggagtttttcttgcaactgctgggttggtcatgttctataaatgtagcaggaaagatcctggctacatcaacataaatacaaggggctcacaaaatcaaagggatgatgaaccgttgctgaagatggagttagaaaatcctgcacttctttctggcaactggtcacagctttgtataacctgcaaaatagtgagacctgttcgttcaaaacattgctctacatgtgatcgttgtgtggagcagtttgaccatcattgcccctgggtatcaaattgcatcggaaagaagaacaaatgggaattcttcatgttcctcactttagaagtttttgcaatgatcattactggttctgctgccattatgagaattgtaggcgatccagattctccatcatcttttggtgattggattcattattatgcgtttcagcatactggagtggtttcgtttcttgcaatgatttttttccttttctttggcgttgcagttctaacggttgttcaagcgtcgcagatagcaaggaacattacaacaaacgagatggcgaattccgtgagatacgcctatcttagaggcccaggtggcagattcagaaacccatatgatcatgggatccgcaaaaactgctctgatttcttgttaaatggatacaatgaggacatcgaacggctagaacagacatcgcacactgatgaggaaatgggaatgatacagatgacaagtgcagtctcacagaatggtgacaaccctttacatcatggtaatggcactgaccacagtcgcagtgattcacaagcaaactcaaaacctcatagccaagtgggttcgtctcagtgttgtgaccacagtaagagggctgataggacgccgttgggcctaggattgggccttgggcgaaacagtgcatcccggcagtatgttcggtctcttatcccattgtgatccataagttggaaacttggagatcatgtgtttgtttcactgtagattgtacgtgttcgctgctcagactccatctttggtctacctgctcttgcatgatttagcatgcaagtattggctaggcattgttaacattgttggggcattaggttaagtactcatatatatagtgctgtaattttgcggtgaatacaaaggagatgaaggtagcgacttgctcgtgaatatcagctgatctgcagtttgaaaatgtcagctgagaggtgcagaaaagatatcagttatttggatgcagcagcacgaaatgtcttcacagttgttgtatacatcaggttcggtggctcccccattgttaagcatgatacgagtttagaaaatgtaactgtaaatcaagaaaattgtaaattgattagtaagctcactgtagcagagctgttttcctatttcattcaaaaaaaaaaaaaaaaaaaa

SEQ ID NO: 5180 - protein, 638 aa, Panicum virgatum
  misc_feature: Ceres CLONE 1816545
  misc_feature (1)..(65): Pfam Name: zf-DHHC Pfam Description: DHHC zinc finger domain
MASEIEVLEDTTTSTPLVAAASTAPPAEDGVGAAAPEDESLKNDVYTAAAYGDLEKLQRLVEGEGRPVREPDGGGYHALQWAALNNRVAAAQYILEHGADINAVDHTGQTALHWSAVRGHIQVAELLLKEGAKVDAADLYGYQATHVAAQYGQTAFIYHIVAKWNADPDVPDNDGRSPLHWAAYKGFADSIRLLLFLDAYRGRQDKEGCTPLHWAAIRGNLEACTVLVQVGKKDDLMVKDKTGLTPAQLAADKNNRQVAFFLDNARRVYDRGCGANTKFGKFSKLGLAPLLWCIIIAMLITYIHSVISGQYATNMTAPFGMFGWSGVFLATAGLVMFYKCSRKDPGYININTRGSQNQRDDEPLLKMELENPALLSGNWSQLCITCKIVRPVRSKHCSTCDRCVEQFDHHCPWVSNCIGKKNKWEFFMFLTLEVFAMIITGSAAIMRIVGDPDSPSSFGDWIHYYAFQHTGVVSFLAMIFFLFFGVAVLTVVQASQIARNITTNEMANSVRYAYLRGPGGRFRNPYDHGIRKNCSDFLLNGYNEDIERLEQTSHTDEEMGMIQMTSAVSQNGDNPLHHGNGTDHSRSDSQANSKPHSQVGSSQCCDHSKRADRTPLGLGLGLGRNSASRQYVRSLIPL

SEQ ID NO: 5181 - DNA, 2294 bp, Panicum virgatum
  misc_feature: Ceres CLONE 1816562
  misc_feature: Encodes the peptide sequence at SEQ ID NO. 5182
gctcctcgtcctctctcctctcggctctcgccctctctcctctcggctctcgcccctccctcctgtctccccctccctctaccaccactcttctcgactctctctaaaaaaagcttctcgagcttataaatacactcccctccctcccggtgccaatttcctcccccgatccccttccccccctccgcccgccgatcgccctccgctcgccccaccgcggcgggcgatcgctcctctccctccacctcaccatcgcgcgattcccgaggcgaggcgccacccaccacagattccgccgacggccgcggtcggctggctcgtcccctctcccacttcgccgatcggatcgcgtgctccccgaggtagagatgatgataaaagcatagtcgttgacttagtctgccttagctatttcctgaggctaagggaaataataattggcattatggcatttcgaaatacggtatgcactccccaagttgttgaccttacatctgagagagggcaagctcgtggaggcaatgccagtgagatatccaatcaaggtgcacaacatgctgtcagagttgtaggaaacacgactaacattggtctctctgatattagaaattactatgatgtgagcataaatcatcagcatcagcctgttcctaacccacccctgaatttaggtgctgattctggttttgtcttcacatcaactatgtacagtccctgcatgtcaccaacatcaatgaacagatatgcttctcatgctcagagctttggatcgacgaatcaaccattgcctttaaaccaagtcccaggaagtatggatgagagtagcagaaatgatagtactggtgaaagtgctagaggacatattaaaaggaaaaatgctgcagtcgtgggaagctaccattttgttaatagatttgcaagctcaagctcatcttctcatgcacctcagaatcctatgcttaggccttgggatccttcttttgaatccaatgtttcctctaatgttgcaccattcagaccatcagaatatcacggccacagcagttggcaatccttagaaggatcttctgtaactggaactaatgggttcaattcaatgcctgttcatccagaatcagcacagtgtgcgaactatacatttccagcaactcacattggccgttcatggatgtcccaggctgcaaattgtattgctgatggaattccccagtgggaatacatcaatgcaactactaatgttcaagcaggcagatttgcccattcaggagccacagaaatggcaaatggaggttttcatgaatatcagaatggcccttcagctgtttgtcggggacctgtaccttacttcccccagcacgtgatgcatggaatgcaagctcataatatgcttgatcataatcaaatgcaagtcccttatcaacaatgtcacaataatggtttattgcatggtggtgttaattatactggaaaccgtctccacttaggtccacaaattccagttctcttctccagttctgagcgtacttttgggcctccacagcatccgtttctggcaaatccagttaaccatcggaacataaggattctaccacctgagcagcatgccactataatggatttttcaagattgtatgaagtgtcaaattctgtagatgagcatagagatatgcggctagatatagacagcatgacttatgaggagcttttagcactagaagagcagatcggagatgtcaatactggtttgacaaaatgcctcattgtagataaattgaagactagcttatatgttccaggaacatccagcatgtctgatcagccatctaactcttctctagagaatgatgcttgcattatatgccaggaggagtaccaggttagagattgcattggcacccttgactgtggtcacaggtaccatgcagagtgcgtgcaccagtggctgttggtgaagaacctatgccccatctgcaagacaacagcattgtctaccgaccaaagacatggacaatgagcaggaatgaataagcctgttagctatttgcttcgacaaacgttcacctcaattttgtatataagaagtggtagacaatggtgctacttgtatttgctgttcaccttgttgtgatcgggagtactcaagcttcctgaaactgtacagccataacatttattatttttctccaaatgtagaatattttaagttgctcagttcgccccccttgtgtatgaagaggcgaaccggggaaacaaagcttccgtaatggcatcgctaaaaaaaaaaaaaaaaaaaa

SEQ ID NO: 5182 - protein, 522 aa, Panicum virgatum
  misc_feature: Ceres CLONE 1816562
  misc_feature (1)..(41): Pfam Name: zf-C3HC4 Pfam Description: Zinc finger, C3HC4 type (RING finger)
MAFRNTVCTPQVVDLTSERGQARGGNASEISNQGAQHAVRVVGNTTNIGLSDIRNYYDVSINHQHQPVPNPPLNLGADSGFVFTSTMYSPCMSPTSMNRYASHAQSFGSTNQPLPLNQVPGSMDESSRNDSTGESARGHIKRKNAAVVGSYHFVNRFASSSSSSHAPQNPMLRPWDPSFESNVSSNVAPFRPSEYHGHSSWQSLEGSSVTGTNGFNSMPVHPESAQCANYTFPATHIGRSWMSQAANCIADGIPQWEYINATTNVQAGRFAHSGATEMANGGFHEYQNGPSAVCRGPVPYFPQHVMHGMQAHNMLDHNQMQVPYQQCHNNGLLHGGVNYTGNRLHLGPQIPVLFSSSERTFGPPQHPFLANPVNHRNIRILPPEQHATIMDFSRLYEVSNSVDEHRDMRLDIDSMTYEELLALEEQIGDVNTGLTKCLIVDKLKTSLYVPGTSSMSDQPSNSSLENDACIICQEEYQVRDCIGTLDCGHRYHAECVHQWLLVKNLCPICKTTALSTDQRHGQ

SEQ ID NO: 5183 - DNA, 1311 bp, Panicum virgatum
  misc_feature: Ceres CLONE 1816595
  misc_feature: Encodes the peptide sequence at SEQ ID NO. 5184
actttccagtggtgtggtggagttatcgaaaggagcaagcaactgcagcgagcaagcggacagaggcggccggagggaggaagatgagggcggtggtgatcacgcgcggcggcgggcctgaggtgctagaggcccaggacgtggaggacccggcgccgctgggggaaggggaggtcctcctccaggtcgccgccgccggcgtcaaccgcgccgacacgctccagcgccacggccgccacccgccgcccgccggcgcgtccccgtaccctgggctcgagtgctccggcaccatcctcgcgctcggtcccaacgtgccctcgcgatggtccgtcggcgacaaggtgtgcgcggtgctaagcggcggcgggcacgcggagaaagtggtggtgccggcggggcagctgctgcccgtgccggagggggtgtcgctaacggacgcagccggcttgcccgaggtggcctgcactgtctggtcgaccgtattcatgatcagccacctctcccccggcgaatcattccttatccatggaggatcaagtggaatcggtactttcgctattcagattgcaaagcacctcggaattaaggtttttgtgactgcaggaagtgaagaaaaactagcggcctgcaaagatctgggtgctgatgtatgcataaactacaaaaccgaagacttcgttgaacgtgtcaaacaggaaaccaatggaaagggtgttgatgtcattctggacaatatcggaggatcatatctccagcgtaacctgaacagcttaggtgttgatggtagacttttcatcattggcttccaaggaggcgctgtagctgaagtgaacctgcaagctgttcttgcacggcgcttgaccatacaagctgctggactgcgtggcagaagccctgcaaataaagctcagattgtcagcgaggtggaaaagaatgtgtggcctgctgtcacagctggcaaggtgaagccggtgatttacaagacgttcccgttatctgaagcggctgaggcgcatagattgatggaagctagcacgcacatcggcaagatactgctgctcccttgacagtgcatgtagtgtttggactctcgctttgggaggaagtttagggctttgggcacatattcaacttctgtaacggcctctatgtatgttccggttgtggcatgtcgttttgtcttgtaaattctatccttgaagtgcttgacatttttctttgaactgtaatgtaataaattctgacatttttctgcgactagttatgcaataagaacctggtgcatggtcttaaaaaaaaaaaaaaaaaaaa

SEQ ID NO: 5184 - protein, 327 aa, Panicum virgatum
  misc_feature: Ceres CLONE 1816595
  misc_feature (1)..(83): Pfam Name: ADH_N Pfam Description: Alcohol dehydrogenase GroES-like domain
MRAVVITRGGGPEVLEAQDVEDPAPLGEGEVLLQVAAAGVNRADTLQRHGRHPPPAGASPYPGLECSGTILALGPNVPSRWSVGDKVCAVLSGGGHAEKVVVPAGQLLPVPEGVSLTDAAGLPEVACTVWSTVFMISHLSPGESFLIHGGSSGIGTFAIQIAKHLGIKVFVTAGSEEKLAACKDLGADVCINYKTEDFVERVKQETNGKGVDVILDNIGGSYLQRNLNSLGVDGRLFIIGFQGGAVAEVNLQAVLARRLTIQAAGLRGRSPANKAQIVSEVEKNVWPAVTAGKVKPVIYKTFPLSEAAEAHRLMEASTHIGKILLLP

SEQ ID NO: 5185 - DNA, 1201 bp, Panicum virgatum
  misc_feature: Ceres CLONE 1816621
  misc_feature: Encodes the peptide sequence at SEQ ID NO. 5186
ccctgatgggagtgtgctgtgttatccatttcttcccttctctctgctgtgctcccttccctccggcggggaacgccgccaccggccgcgcctcgagagcagctcagctcgatcccgctaggttagatatggcggccgggagtgccagtgccacggcgtcgctctccgtcgcggcggcggcggcggcggccctgcgcgtggggcggccgtgcggcggcgctcgcgcttgggtcccctcgcagccggcgcaacaagggtccctcctcaggctgaggccctgcgccgcagtggcgccgcatgccccgctgtggcgggcggagtcgggtggcgcgggcggcggggccggcgccggcgacgtcatgggcctcctcctccgggagcgcatcgtcttcctcggcaacgagatcgaggacttcctcgcggacgccgtcgtcagccagctcctcctcctcgacgccctcgacccggactccgacatccgcctcttcgtcaactcgcctgggggctcgctcagcgcaacaatggccatctatgatgtaatgcagcttgtgagggcagatgtctccactattggattgggcatagctggatcaacagcttctataatccttggtggtggcacaaagggcaagcgatttgccatgcccaacacgaggattatgatccatcagcctgtgggaggtgcaagtgggcaagccttagatgtagaagtccaagccaaggagatattggctaacaagaggaatgtcattcggcttgtatcaggcttcacaggccgcactcccgagcaggttgagaaagacattgaccgagaccattacatgggtcctcttgaggctgttgattatggaatcatcgatggtgtgatcgatggagacagtatcatcccacttgagcctgtcccagagagggtgaagcctaagtacaactatgaagagttgtataaggatccgcagaagtttcttacgccagatgtcccagatgatgagatatactagtagtttaaaagttgtgtttttgcgcaaatctgaacttgttcttcagcaaccagttgcttttgattacctgtagctgttaaacaaatcctagcactagcagtagcttgttgttctggtttgcgcctgttactgactgaatgttgattttgagcacgcagctagtcctgctggttgtgttttggcaaaaaaaaaaaaaaaaaaaa

SEQ ID NO: 5186 - protein, 330 aa, Panicum virgatum
  misc_feature: Ceres CLONE 1816621
  misc_feature (2)..(182): Pfam Name: CLP_protease Pfam Description: Clp protease
  misc_feature (109)..(291): SWISSPROT Homolog: EC 3.4.21.92 ATP-dependent Clp protease proteolytic subunit 2
  misc_feature (109)..(297): SWISSPROT Homolog: EC 3.4.21.92 ATP-dependent Clp protease proteolytic subunit 1
MGVCCVIHFFPSLCCAPFPPAGNAATGRASRAAQLDPARLDMAAGSASATASLSVAAAAAAALRVGRPCGGARAWVPSQPAQQGSLLRLRPCAAVAPHAPLWRAESGGAGGGAGAGDVMGLLLRERIVFLGNEIEDFLADAVVSQLLLLDALDPDSDIRLFVNSPGGSLSATMAIYDVMQLVRADVSTIGLGIAGSTASIILGGGTKGKRFAMPNTRIMIHQPVGGASGQALDVEVQAKEILANKRNVIRLVSGFTGRTPEQVEKDIDRDHYMGPLEAVDYGIIDGVIDGDSIIPLEPVPERVKPKYNYEELYKDPQKFLTPDVPDDEIY

SEQ ID NO: 5187 - DNA, 2000 bp, Panicum virgatum
  misc_feature: Ceres CLONE 1816623
  misc_feature: Encodes the peptide sequence at SEQ ID NO. 5188
acaaaggctgccgaacccaggaagccaccactccctgacaatcgcggagcggagcgcagcgaagccgcgggtgcggctacccgcagatgagccgcctcctctcgcggcggcaccttgccgccgccgccgcccgtcgatccgctcccctcgcgtgcgtgtccaggtggttgcacacaccgtcatttgcaacggtttccccgcaggagatttcaggatccagtcccgcggaagtgcagaattttgtgcagggaagctggacagcatccgctaattggaactggatagttgatcctctaaatggtgaaaaattcatcaaagttgctgaggttcagggaactgaaatagagccatttgtggagagcttatctaaatgccctaagcatggacttcacaacccacttaaagctccagagaggtacctcatgtatggagatatatctgcaaaagctgcacatatgctgggccaacctgcggtttcagatttctttgcaaaacttatccagagggtatctccaaagagctaccaacaagctcttgcagaagttcaagtttctcaaaagttcttggaaaacttctgtggagatcaggtgcgctttctggcaaggtcatttgctgtgcctggcaaccatcttggacaaagaagtaatggctaccgttggccttatggcccagttgcaattatcacaccattcaattttccattggagattcctttactacaagtaatgggagccctatacatgggaaataaaccggtcctcaaagttgacagcaaggttagtgttgtgatggaacaaatgctcaggttgcttcatgattgtggattgccagcagaggatatggatttcataaattctgatggtatcaccatgaacaagctcctgttagaggctaatccaaaaatgacccttttcactgggagctcacgggtagcagagaaattggctgctgatttgaatggccgaatcaaattggaggatgctggttttgattggaaaatccttggccccgatgttcaagaggttgattatattgcttgggtttgcgatcaagatgcttatgcttgcagtggtcaaaagtgctctgctcagtctgttctattcatgcacaagaattggtcttctagtggtctgcttgagaaaatgaagaaactttctgaaagaaggaagcttgaagatttgacaattggccctgtccttacagttactacagaagccatgacagagcacatgaacaaccttctcaagataccgggatcaaaggttctgtttggtggtgaacctttggagaatcactctattccaaaaatatacggtgctttgaagccaactgctgtatttgttcctctagaggaaatccttaaaagtgagaattttgagcttgtgacgaaggagatatttggtccattccaggtggttacagaatattctgaggatcagctcgagttggtattagaagcctgtgaaaggatgaatgcacatctgacagctgcagtagtttcaaacgatccattattcctgcaggacgtgcttggcagatctgtcaatgggacaacatatgctggaatcagagcaaggacaactggcgctccgcagaaccattggttcggtccggctggggaccccagaggcgcaggaatcggaactccagaagccatcaaacttgtttggtcctgccacagggagatcatatacgatatcgggcccgtgccaaagaactgggcactcccctccccgacataaacgtatggagattcatcagctagaagacaactcaaaataataaaagggtgcgagaagcggaagggttcagcatttgtttagagccgagtcgagttgtttcgaataatttgcccatctagccattctctgtaccctccagaaacgtaatgaaggaaagaaaagaattctgtagtggtggtttaggaatcagaattggagattggatcgataataatactagaattttgccacaaatctcaaaaaaaaaaaaaaaaaaaa

SEQ ID NO: 5188 - protein, 551 aa, Panicum virgatum
  misc_feature: Ceres CLONE 1816623
  misc_feature (1)..(462): Pfam Name: Aldedh Pfam Description: Aldehyde dehydrogenase family
  misc_feature (2)..(551): SWISSPROT Homolog: EC 1.5.1.12 Delta-1-pyrroline-5-carboxylate dehydrogenase 12A1, mitochondrial precursor
MSRLLSRRHLAAAAARRSAPLACVSRWLHTPSFATVSPQEISGSSPAEVQNFVQGSWTASANWNWIVDPLNGEKFIKVAEVQGTEIEPFVESLSKCPKHGLHNPLKAPERYLMYGDISAKAAHMLGQPAVSDFFAKLIQRVSPKSYQQALAEVQVSQKFLENFCGDQVRFLARSFAVPGNHLGQRSNGYRWPYGPVAIITPFNFPLEIPLLQVMGALYMGNKPVLKVDSKVSVVMEQMLRLLHDCGLPAEDMDFINSDGITMNKLLLEANPKMTLFTGSSRVAEKLAADLNGRIKLEDAGFDWKILGPDVQEVDYIAWVCDQDAYACSGQKCSAQSVLFMHKNWSSSGLLEKMKKLSERRKLEDLTIGPVLTVTTEAMTEHMNNLLKIPGSKVLFGGEPLENHSIPKIYGALKPTAVFVPLEEILKSENFELVTKEIFGPFQVVTEYSEDQLELVLEACERMNAHLTAAVVSNDPLFLQDVLGRSVNGTTYAGIRARTTGAPQNHWFGPAGDPRGAGIGTPEAIKLVWSCHREIIYDIGPVPKNWALPSPT

SEQ ID NO: 5189 - DNA, 1418 bp, Panicum virgatum
  misc_feature: Ceres CLONE 1816624
  misc_feature: Encodes the peptide sequence at SEQ ID NO. 5190
ctaccatctcccggtccggccaacacccgccacaacccctcccacacgccacgccatggcccgcgccaccaccgcccggcacctcctcctcctcctctgcctctccctcggcgcggccaccgcgcgggcgcacggcgggggcggggacgcggacgcggacgcgggcggcggctccccggcgcccgacctgcgcgcgcgcggcctggttgcggccaagctgtggtgcctggccgtggtgttcgcgggcacgctgctcggcggggtgtccccctacttcctgcgctggaacgaggcgttcctcgcgctgggcacgcagttcgccggcggggtcttcctcggcacggcgctcatgcacttcctcagcgacgccgacgagacgttcggggacctgctccccgacagcggctacccctgggcgttcatgctcgcctgcgccggctacgtcgtcaccacgctcgccgacgtcgtcatctcccacgtcgtctcgcggggccgcgccgccgctggttccggcgccggcggcgacggtgaaggccttgaggagggcaaggtgagcaccacaaatggcaccagctctgagccacacccagctgatgcgcacggatctgatcactcggttgcatcaatgctgcgcaacgcgagcaccctcggagatagcgttctgctcatcgccgccctctgctttcactccgtcttcgagggcatcgccatcggagtcgctgagacgaaggctgacgcgtggaaggcgctgtggaccatcagcctgcacaagatcttcgcggcgatcgccatgggcatcgcgctgctccggatgctcccgaaccgcccgctcctctcctgcttcgcctacgccttcgcgttcgccatctcgagccccatcggcgtcggcgtcggcatcgtcatcgacgccaccacgcagggccgggtggccgactggatattcgccgtctccatgggcctcgccacgggcatcttcgtctacgtctccatcaaccacctcctctccaaggggtacaagccccagaggcccgtcgccgttgacacgccggtcagcaggtggcttgccgtggtgctcggcgtggccgtcatcgccgttgtcatgatatgggacacctgatgtgactatgtgacagagagagacatgggattgttatgcacagtttggggcgtttggttcttgcaggagggagcgagggacttctcttacattatagattatagtaggggcgatgagaattgccttgacccggtgaaaggggaaaggaataaaacatacagttccaactgaggtcttgtttagtgcataaattttaccctgtaaatgtcacatcgaatatgccagtacacatttgaagtattaaaagtagactaattacaaaataaattatatattccatcaaaaaaaaaaaaaaaaaaaa

SEQ ID NO: 5190 - protein, 353 aa, Panicum virgatum
  misc_feature: Ceres CLONE 1816624
  misc_feature: Great-hit functional homolog of the protein sequence given in SEQ ID NO 9192
  misc_feature: Useful for making plants with altered Lignin content
MARATTARHLLLLLCLSLGAATARAHGGGGDADADAGGGSPAPDLRARGLVAAKLWCLAVVFAGTLLGGVSPYFLRWNEAFLALGTQFAGGVFLGTALMHFLSDADETFGDLLPDSGYPWAFMLACAGYVVTTLADVVISHVVSRGRAAAGSGAGGDGEGLEEGKVSTTNGTSSEPHPADAHGSDHSVASMLRNASTLGDSVLLIAALCFHSVFEGIAIGVAETKADAWKALWTISLHKIFAAIAMGIALLRMLPNRPLLSCFAYAFAFAISSPIGVGVGIVIDATTQGRVADWIFAVSMGLATGIFVYVSINHLLSKGYKPQRPVAVDTPVSRWLAVVLGVAVIAVVMIWDT

SEQ ID NO: 5191 - DNA, 1479 bp, Panicum virgatum
  misc_feature: Ceres CLONE 1816650
  misc_feature: Encodes the peptide sequence at SEQ ID NO. 5192
acaaccacacaccctccgatctcagatagtcagatcagtgaagaagcactcacggacagacagatgaagcattcgagcagcttgtgcctgctcttcttcctcgtggccctctgcagcctggtccaggcacaggtcctcttccaggggttcaactgggagtcgtacaagaagcagggcggctggtacaacagcctcaaggcccaggtcgacgacatcgccaagaccggcgtcacgcacgtctggctgcctcctccctcgcactccgtctccccacaaggttacatgccggggcgcctgtacgacctggacgcgtcgcagtacggcacggcggcggagctcaagtccctgatcgcggcgttccacggcaggggcatccagtgcgtcgccgacgtcgtcatcaaccaccggtgcgcggagaagaaggacgcgcgcggcgtctactgcatcttcgagggcgggacgcccgacgaccgcctcgactggggccccgccatgatctgcagcgacgacacccagtactcggacggcacgggccaccgcgacaccggcgaggggttcggcgccgcgcccgacgtcgaccacctcaacgcgcgcgtccagcgggagctcaccgactggctcaactggctcaagtccgacgtcggcttcgacggctggcacctcgacttcgccaagggctactccccggccatcgccagtatgtacgtagagaacacgaagccgagcttcgtggtcgccgagatatggaactccctgagctacacggacggcaagccgtcggcgaaccaggaccagtgccggcaggagctggtggactgggtggacgcggtcggcgcgccggcgatggcgttcgacttcccgaccaaggggctgctgcaggcgggcgtgcagggggagctgtggcggctgcgcgacggctctggcaaggcagccggcttgatcgggtgggcgccggagaaggccgtcacgttcgttgacaaccacgacaccgggtcgacgcagaggctctggccgttcccgtccgacaagttctacgaccacatgttcgactggaacctgaagcaggagatatcgacgctcgccgcgatcagggctcgcaacggcatccacgccgggagcaagcttcgaatcctcttggcggaggccgatgcgtacgtggccgtcgtcgacgacaaggtcatagttaaaatcgggacgaggtacgacgtcggcagcgtgatcccgtcggatttccaccccgccgcgcacggcaaggactactgcgtctgggagaaggggagcctccgcgtcccggcagggcgccacctttagcacttcatcaggaggcccctgcgctgctgcgacactctgatttgtgattagtccccacgctttcttttctcccccatagcgagagcatttccagaattgtagtactttcgtatttccatttcgaattcgacatcatgtaaacactgtcatcataataaacacataaat

SEQ ID NO: 5192 - protein, 415 aa, Panicum virgatum
  misc_feature: Ceres CLONE 1816650
  misc_feature (1)..(301): Pfam Name: Alpha-amylase Pfam Description: Alpha amylase, catalytic domain
  misc_feature (1)..(322): SWISSPROT Homolog: EC 3.2.1.1 Alpha-amylase isozyme 3D precursor
  misc_feature (2)..(322): SWISSPROT Homolog: EC 3.2.1.1 Alpha-amylase isozyme 3C precursor
MKHSSSLCLLFFLVALCSLVQAQVLFQGFNWESYKKQGGWYNSLKAQVDDIAKTGVTHVWLPPPSHSVSPQGYMPGRLYDLDASQYGTAAELKSLIAAFHGRGIQCVADVVINHRCAEKKDARGVYCIFEGGTPDDRLDWGPAMICSDDTQYSDGTGHRDTGEGFGAAPDVDHLNARVQRELTDWLNWLKSDVGFDGWHLDFAKGYSPAIASMYVENTKPSFVVAEIWNSLSYTDGKPSANQDQCRQELVDWVDAVGAPAMAFDFPTKGLLQAGVQGELWRLRDGSGKAAGLIGWAPEKAVTFVDNHDTGSTQRLWPFPSDKFYDHMFDWNLKQEISTLAAIRARNGIHAGSKLRILLAEADAYVAVVDDKVIVKIGTRYDVGSVIPSDFHPAAHGKDYCVWEKGSLRVPAGRHL

SEQ ID NO: 5193 - DNA, 1167 bp, Panicum virgatum
  misc_feature: Ceres CLONE 1816680
  misc_feature: Encodes the peptide sequence at SEQ ID NO. 5194
agcttgagttgagagcacctctggaggggatcatggaggaggagcggaaggtggatgcagcggcctttggtttcccggggccggtgcgcccgggggtcacgcgtgtcgggtggatcggcatcggcgtcatgggcggcgccatggctaagcacctcctcgcggctgggtttgcagtcactgtgtacgctcgcacgccggccaaggcggagagccttgtcgccgctggcgcgagcctcgcggactcgccggcggccgtggctgctgcatccgatgtggtgttcactatggtcggaaaccccggcgacgtccgcgcggtggttctggaccccaccacgggcgccctcgccggcctccgccctggcggcgtgctggtggactgcacgagctcctccccttccctcgcgcgcgagatcgccgcggccgcaagcgcgacaggctgctacgccgtcgacgcgccagtctcggggggcgacgtcggcgcccgcgacgggacgctggccatcttcgccggcggcgacgaggccgtggtcgcctggctcgccccgctcttcgcccacctcggcaaggcgacccacatgggtgcgcccggcagcggccagagcagcaagatcgccaaccagatcgcggtggccggcgcggtggtgggcctgggcgagtccgtggcctttgccaacgccgcggggctcgacgcgccgctgttcctcgacgcggtgtccaagggcgcggcgggctcgcgcgtcatggacatcttcggcgaccacgtgctgcgccgcgagttcgggtacgggggcagcgtgcgttacatcgtcaaggacctcggcatggcgctggaggtcggggacggtcaggaggagacgaatgtgctgcccggagccgcgctgtaccgccagatgttcaccgctatggtggccaatggcgacggcgacctgagcttgcagggactgatcaccgtcgttgagcgcctgaacggcattggcaaataaggtaggctgcaggcaagatgttcaccgtaatgccgcattgaatttgaaaacttctgtatttttttctgaataaagtttgggactcaaggagcatgtctcaattgttcatggactatgtcagtgactcggtatgtattaagcttgacttgctgatttgcggttgtcaaaaaaaaaaaaaaaaaaa

SEQ ID NO: 5194 - protein, 316 aa, Panicum virgatum
  misc_feature: Ceres CLONE 1816680
  misc_feature (2)..(164): Pfam Name: NAD_binding_2 Pfam Description: NAD binding domain of 6- phosphogluconate dehydrogenase
MEEERKVDAAAFGFPGPVRPGVTRVGWIGIGVMGGAMAKHLLAAGFAVTVYARTPAKAESLVAAGASLADSPAAVAAASDVVFTMVGNPGDVRAVVLDPTTGALAGLRPGGVLVDCTSSSPSLAREIAAAASATGCYAVDAPVSGGDVGARDGTLAIFAGGDEAVVAWLAPLFAHLGKATHMGAPGSGQSSKIANQIAVAGAVVGLGESVAFANAAGLDAPLFLDAVSKGAAGSRVMDIFGDHVLRREFGYGGSVRYIVKDLGMALEVGDGQEETNVLPGAALYRQMFTAMVANGDGDLSLQGLITVVERLNGIGK

SEQ ID NO: 5195 - DNA, 981 bp, Panicum virgatum
  misc_feature: Ceres CLONE 1816716
  misc_feature: Encodes the peptide sequence at SEQ ID NO. 5196
acctcacctccgcacccgctgtttcgtgcgccgcacttctccccccacctacctctccccctcaaaaactatccgcctccgcccgcccgctcggcggagatccccaagtggcgttgtttggtgtattcgatggtcacggcgggaagaacgcggcggagttcgctgctgagaacatgcccaagttcatggctgaagagttgaagaaggtaaacggcggagaaatcgaaggagcggtgaagaggggctaccttaagacggacgaggagttccttaagagggacgagagcgggggagcgtgctgcgtcacggctgtcctccaaaagggtggcctcgtcgtgtccaatgctggagactgccgcgcggtgctcagccgagcagggaaggcggaggcgctcacttctgaccacagggcctcgcgggaggatgagaaggagagaattgagaatttgggtggattcgtggtaaattatcgcggaacatggcgagtacagggctccttggcagtttcgagaggcattggagatgcacacctgaagcagtggatcgtggttgaccctgacaccaggaccctcctggttgaccagcagtgcgagttcttgatacttgcttctgatggcctctgggataagattgataatcaggaggccgtagaccttgcaagacctctctgcaccattaatgacaaggcctctcgcatggctgcctgcaggatgctcactgaaacatctatttccaggggctctactgacgatatcagtgttgtgatcatacagttgcagaaatttacaagtccttgactaatttttgagagaaactggatttagactctctagccagtagtgctaacagactgtttggaatggggtctgggtaggtagacatgacacatgttacttcgcaggcaatagttttcatgagcttgcgctactttgtggggattttaacattcattctttgacctaaaaaaaaaaaaaaaaaaaa

SEQ ID NO: 5196 - protein, 207 aa, Panicum virgatum
  misc_feature: Ceres CLONE 1816716
  misc_feature (53)..(248): Pfam Name: PP2C Pfam Description: Protein phosphatase 2C
MPKFMAEELKKVNGGEIEGAVKRGYLKTDEEFLKRDESGGACCVTAVLQKGGLVVSNAGDCRAVLSRAGKAEALTSDHRASREDEKERIENLGGFVVNYRGTWRVQGSLAVSRGIGDAHLKQWIVVDPDTRTLLVDQQCEFLILASDGLWDKIDNQEAVDLARPLCTINDKASRMAACRMLTETSISRGSTDDISVVIIQLQKFTSP

SEQ ID NO: 5197 - DNA, 1030 bp, Panicum virgatum
  misc_feature: Ceres CLONE 1816723
  misc_feature: Encodes the peptide sequence at SEQ ID NO. 5198
accactaccatcccaatctctctcctcccgcatcgcatcgcatcgcacccacctcccctatccggaaaacccccaaattgcaatcaggtcccaagcgggctcctcccccaaatccgcaacccaggcacccagctcgaggaaattcgagaattcatcgacggagcctgacggatcgggcggcgaggatgggcatctcgagcatgccgacgcccaaagacagcctgatggggttcgtcctgtacaacacggcggtgtcggtggcgatcctggctgggctggtgcgcgcggcgctggtgttcctgggcctggcggcgccgtctccgtgggagggcctcgccgccggcgagcaccaccaccgccgccaggtggtgtcgtcgatctcgcccctggggccgagcctcgcggaccggttccggagccggttccgcccgtcgcggttcgggcggcggcgcggcggcgccggcgcggactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgacgactacgcggccgtggcggcggcggcggccgtccggttttaggagagatctccaggaggccaccgggggccgggccggatcggcgcggccccgccgcgtgcgcgtaggaattcgagaggcaggcagaggctccattagctctagtgctccgctcccaattagtagctccttcctttttttttcatgtgttcttcctttttttttttcgtgctccctttttcccttctttcgttttcgtcgctctcgcttgctgctgtaccgtttgtaaatattcgcagcgtgctccgatggtgtagcacttgcagtactgtgtacaggcttttcgaaagcgaagagatgagaagaacaagtggtgtgtatagatcccacaaattttccatcaaaaaaaaaaaaaaaaaaaa

SEQ ID NO: 5198 - protein, 161 aa, Panicum virgatum
  misc_feature: Ceres CLONE 1816723
  misc_feature: Great-hit functional homolog of the protein sequence given in SEQ ID NO 9350
  misc_feature (1)..(42): Pfam Name: zf-C3HC4 Pfam Description: Zinc finger, C3HC4 type (RING finger)
  misc_feature: Useful for making plants with altered Lignin content
  misc_feature: Useful for making plants with modulated low light sensitivity
MGISSMPTPKDSLMGFVLYNTAVSVAILAGLVRAALVFLGLAAPSPWEGLAAGEHHHRRQVVSSISPLGPSLADRFRSRFRPSRFGRRRGGAGADCRVCLARFEPESVVNRLPCGHLFHRACLETWLDYDHATCPLCRLRLLPPAADDDYAAVAAAAAVRF

SEQ ID NO: 5199 - DNA, 2278 bp, Panicum virgatum
  misc_feature: Ceres CLONE 1816764
  misc_feature: Encodes the peptide sequence at SEQ ID NO. 5200
ataacctttggctccacgctgcagccgggtctttcttcctcctctccaccccctcccctccccccctcgggccaacgcgaggcgaaaaccaatacatctccgccctcgctcgccgaggaagctcgccaagaactgcatctacagcgggggagaggttgagagagaggcgataaaagtttctcctcgcctctctctctctctgtatctccttcccgtcttcctatctgtctgcgattctcgtcgcattggtttggtttccttgcaaaaggggacagctttttctgtcttcccttgatccagatgatggcgagcacgacgtcagcgaccgccgccgcggcggcattcgggggcccaaccaccgccaagacgcgggggtcgtcgtcggccatctgcccgagggtgtccaccggcggcaggaggcgctccggggtggtgcggtgcgacgccggcgtggagacccaggtgcaggtggtggccaaggcggccagcatcaccgcgctcgagcagttcaagatctccgccgaccggtacatgaaggaaaggagtagcatagctgtgattggcctcagtgtgcacacagcaccagtggagatgcgtgaaaaacttgctgttgctgaggaactatggccccgtgctattcaagaactcactagtctaaaccatattgaagaggctgctgttcttagtacctgtaatagaatggaaatttatgtggtggctctgtcatggaaccgtggtatcagagaagtaatagactggatgtcaaagaaaagtggcattcctgcttctgaactcagggagcacctgttcatgttgcgcgacagtgatgctacacgccatctgtttgaggtatcagctgggcttgactctttggttcttggagaaggacaaatccttgctcaagttaagcaagttgtaaggagcgggcaaaacagtggaggcctgggaaagaacattgataggatgttcaaggatgcaatcacagctggtaaacgtgtccgatgtgagaccaacatatcatctggtgcggtttctgtcagttcagctgcagttgaattggccctgatgaagcttccaaagactgaagcgctgtcagctagtatgctgctgattggtgctggtaagatgggcaaattagtggtcaagcatctcattgccaaaggatgcaaaaaggttgttgtggtgaaccgctctgtggaaagggtcgatgccattcgtgaggagatgaaagatatcgagattgtgtacaggcctctctcagagatgtatgaggctgcttctgaagccgatgttgtgttcacgagcactgcatctgaaaccccattgttcacaaaggagcacgcagaggcacttccccctatttctgatactatgggtggtgtccgtctatttgtcgacatatctgtcccgagaaatatcagtgcatgtgtgtctgaagttggctcggcacgagtatacaacgttgatgacttgaaagaggtggtggaagccaacaaggaggacaggctcaggaaagcaatggaggcgcagacaatcatcaccgaagaactgaaacggtttgaggcatggagggactcgttggagaccgttccgaccatcaagaagttgaggtcatatgctgacaggatccgggcctcagagcttgagaagtgtctgcagaagatcggggatgacaatctcaccaagaagatgcggagagctgtcgaggaactgagcaccggcatcgtgaacaagctcctccacggcccattgcagcacctgaggtgcgatgacagcgacagccgcaccctcgacgagacgcttgagaacatgcacgccctcaaccggatgttcagccttgacaccgagaaggcgatcatcgagcagaagatcaaggccaaggtggagaagacccaaaattgatgccaggaagcaaattttctaccccgtgtatacatactctgattcccagtttttttttgtaatccttcgcttacttagctccatccccgctcgctgagatcgccaactgtgtcgtgaattagcgccatggcagtagctcaatccattgagaggtagtggcaaattgtctctattccagctgcatgtctctgtaaattattgctctaactgctgtggcaagcggccattcttcttacgttgtatacgctatttggacgaaataaacaggaatccatcaatgtgtcagttgatgcccttttggtgtattatacttataagcttatactgatcatgtgtacctcttacgtttagccttgtattcagactgttgaacatc

SEQ ID NO: 5200 - protein, 533 aa, Panicum virgatum
  misc_feature: Ceres CLONE 1816764
  misc_feature (1)..(152): Pfam Name: GlutR_N Pfam Description: Glutamyl-tRNAGlu reductase, N-terminal domain
  misc_feature (1)..(533): SWISSPROT Homolog: EC 1.2.1.70 Glutamyl-tRNA reductase, chloroplast precursor
  misc_feature (2)..(533): SWISSPROT Homolog: EC 1.2.1.70 Glutamyl-tRNA reductase 1, chloroplast precursor
MMASTTSATAAAAAFGGPTTAKTRGSSSAICPRVSTGGRRRSGVVRCDAGVETQVQVVAKAASITALEQFKISADRYMKERSSIAVIGLSVHTAPVEMREKLAVAEELWPRAIQELTSLNHIEEAAVLSTCNRMEIYVVALSWNRGIREVIDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKTEALSASMLLIGAGKMGKLVVKHLIAKGCKKVVVVNRSVERVDAIREEMKDIEIVYRPLSEMYEAASEADVVFTSTASETPLFTKEHAEALPPISDTMGGVRLFVDISVPRNISACVSEVGSARVYNVDDLKEVVEANKEDRLRKAMEAQTIITEELKRFEAWRDSLETVPTIKKLRSYADRIRASELEKCLQKIGDDNLTKKMRRAVEELSTGIVNKLLHGPLQHLRCDDSDSRTLDETLENMHALNRMFSLDTEKAIIEQKIKAKVEKTQN

SEQ ID NO: 5201 - DNA, 1888 bp, Panicum virgatum
  misc_feature: Ceres CLONE 1816788
  misc_feature: Encodes the peptide sequence at SEQ ID NO. 5202
gacgaccacccccattccttcccccaacttctcggctccccaccttcctcgccgcggaacacgcgcccccgtcctccccccgtgttgatctcttcattccttggtgcggtagacgagcgctccggccatggccttcttccggggcctcaccgcggtctcgaggctgcgatcccgcgtggcgcaggaggccagcgcgctgggtggtgtcagatggttgcagatgcagagcgcttccgatctcgatctcaagtcccagttgcaggaactgattcctgaacagcaggatcgcctaaagaagcttaagtcagagcacggaaaggtccagcttggaaacataactgtggatatggtccttggtggaatgagagggatgatcgggatgctttgggaaacatcgctacttgacccagaggagggcattcgttttaggggtctctcaattccggagtgccagaacgtgctgccgacggcagttaagggtggtgagcctttgcctgagggtctcctttggcttcttttgacaggaaaggttccaaccaaagagcaagttgatgccctatcaaaggaattgctggcccgttcaagtgtcccagctcatgtctacaaggcaatagatgctctccctgtaactgcacaccctatgacacagtttaccactggagtaatggctcttcaggttgagagtgaatttcagaaggcatatgacaaaggattgtcaaaaacaaagttctgggagcctacttatgaagatgtcttaaatttgattgctcggcttccaccagtggcttcttatgtttaccggaggattttcaaggacgggaaatcaatagaagctgataattctctggattacgctgcgaatttttcacacatgcttggttttgacgatcccaaaatgttggagttgatgcgcctctatataacaattcacactgatcatgaaggtgggaatgtcagtgcacatactggtcatctggttggaagtgcactatccgatccctatctttcttttgcagcggctctgaatggtctagctgggccactccatggtctggctaatcaggaagtgcttctatggatcaaatctgtaattgaggaaactgggagtggcgttacaacagatcaactcaaagactatgtctggaagacactgaagagtggaaaggttgttcctggctttggtcatggtgttctgcgtaagacagacccgcggtattcatgtcaaagggtgttcgccctgaagcatttgcctgaggatccacttttccagttggtatccaagttgtatgaagtcgtgcctccgatcctcactgagcttggcaaggtaaagaacccatggccgaatgttgatgctcacagtggagttttgcttaaccactttggactatctgaagcacgatattacacagtcttgtttggtgtctcaaggagcatggggataggatctcagctcatatgggaccgtgcccttggcctaccactggagaggccgaagagtgtcaccatggagtggctggaaaactactgcaagaacaaggctgcttgaagctaaacaatggcttcttttttacacaccatgtcatctttcctgttaataagttacagtagtgtttttttttcttttggcggtccaataacaaagagcaagaggctcccagacggcagaattttgtatcctccgtcgctcgaggacatccagatagctaatctctgcggcacaaccaggcagacgagatcaggacacgattaatatttgatacatgatgacgcatgccaattctttttttttaaccttccaggtatttgggttttggcatgcacgagccgacagtcctttcttggaaaagcgagaatatattttgatgccgaaaaaaaaaaaaaaaaaaaa

SEQ ID NO: 5202 - protein, 472 aa, Panicum virgatum
  misc_feature: Ceres CLONE 1816788
  misc_feature (1)..(379): Pfam Name: Citrate_synt Pfam Description: Citrate synthase
  misc_feature (1)..(471): SWISSPROT Homolog: EC 2.3.3.1 Citrate synthase, mitochondrial precursor
  misc_feature (1)..(472): SWISSPROT Homolog: EC 2.3.3.1 Citrate synthase 4, mitochondrial precursor
MAFFRGLTAVSRLRSRVAQEASALGGVRWLQMQSASDLDLKSQLQELIPEQQDRLKKLKSEHGKVQLGNITVDMVLGGMRGMIGMLWETSLLDPEEGIRFRGLSIPECQNVLPTAVKGGEPLPEGLLWLLLTGKVPTKEQVDALSKELLARSSVPAHVYKAIDALPVTAHPMTQFTTGVMALQVESEFQKAYDKGLSKTKFWEPTYEDVLNLIARLPPVASYVYRRIFKDGKSIEADNSLDYAANFSHMLGFDDPKMLELMRLYITIHTDHEGGNVSAHTGHLVGSALSDPYLSFAAALNGLAGPLHGLANQEVLLWIKSVIEETGSGVTTDQLKDYVWKTLKSGKVVPGFGHGVLRKTDPRYSCQRVFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCKNKAA

SEQ ID NO: 5203 - DNA, 2033 bp, Panicum virgatum
  misc_feature: Ceres CLONE 1816866
  misc_feature: Encodes the peptide sequence at SEQ ID NO. 5204
gggccattcctcttcttccccactccgccgccgccgtggtttgtcttccgtcccttggcctcccgcagcggccagcgaccctccggcccctccaaatcacacctagatccctcgcgtttaaactattccctaatccaacccctgtcccctccagctcgctgctcacctgacaacgccgcctcctcaagtcctctataagggcgctgccggggagggagagaagcgatgacttcagctctccggcggaaggcggcggagatggcttccgcggcggcggcggcgcagtgcttcagctcctactcctcgtcccctgccacgcggttcctgcggcagcgcggcggcgcccgggtgctccagctctcttcccggcggagcttctgcgtctccgccgcagctggcggattcgacaaccagaaccgcgagtatgtgatcgtcggcggagggaacgcggcggggtacgcggccaggacgttcgtcgagcatggcatggctgatggccgcctctgcatcgtctccaaggagccagttccaccatatgagcggccagcattgaccaaaggctatctctttcctccggacaagaagccggcacgcctacctggttttcatacatgtgttggatctggtggacagcgacagactgctgaatggtacaaggagaatggtatagaggtgttgtatgaggatccagttgttgcatttgatggcaaaacacagaccttgaaaacttcgtcagggaaaattctgaagtatggctcacttattatttctactggctgtgaagcttcaagattacctgagaaaattggagggaaattacctggagttcactacattcgtgatgttgctgatgctgattctctagtatcctcactgggaagtgcaaaaaaggttcttgtcattggtgggggttatattggcatggaggtagctgcagcagcatgtggctggaatcttgacacaactattgtgttcccagaggaccacattatgccaagattatttacaccttcccttgctaagaagtatgaagatctgtatcagcaaaatggtgtcaaattcattaagggagctctaatcggcaaacttgaagctggatctgatggaagggtgtcttctgctgtacttaaatatggatctgtagttgaagctgatacagtagttgttggtataggagcaaaaccagttgtggggccctttgaagctgttggagtcaaccgtaaagttggtggaatagaggttgattccttgttcagaactagtgtacctggtatctttgctattggagatgtagcagcttttcctttgaagatgtacaatagaattgctcgagtggagcatgtggatcatgctcgcaaatctgcacaccactgtgttgaaacgcttctaacatcccagacaaaagcgtatgattaccttccgtatttttactcgagagtttttgagtatgaaggaagctcaagaaaagtttggtggcagttttatggcgataacgttggtgaaacagttgaagtagggaacttcgatccaaaaattgctactttctggattgactcagatagtcgactgaagggtgttttccttgagagtggaacctcagaggaattctcgcttcttccacaactcgctaagtctcagcccattattgacaaatctaagctccaggccgcagcttctgttgaagatgcattagagatcgcaagaagctctcttcagtctgccgcttcggtgtagttctcggcatctaggaacttcttgggctgagtacgggtgctgttgcatattttgaatcgtcaaggccacatcatcaataacaattccgcagcattcatttccacgggattgtgatattcttactgtacctgtaattgccatttccatcttgaaataaacttggtcaccctttgaggggttgatgaggatgatagaatgaaaccttcatgccacacttctttgattctctaatgtggttattacttgatacacactgttcatgtgatatgaaattaataacaaggcctgtcatattatcc

SEQ ID NO: 5204 - protein, 502 aa, Panicum virgatum
  misc_feature: Ceres CLONE 1816866
  misc_feature (1)..(296): Pfam Name: Pyr_redox_2 Pfam Description: Pyridine nucleotide-disulphide oxidoreductase
  misc_feature (3)..(498): SWISSPROT Homolog: EC 1.6.5.4 Monodehydroascorbate reductase, chloroplast precursor
MTSALRRKAAEMASAAAAAQCFSSYSSSPATRFLRQRGGARVLQLSSRRSFCVSAAAGGFDNQNREYVIVGGGNAAGYAARTFVEHGMADGRLCIVSKEPVPPYERPALTKGYLFPPDKKPARLPGFHTCVGSGGQRQTAEWYKENGIEVLYEDPVVAFDGKTQTLKTSSGKILKYGSLIISTGCEASRLPEKIGGKLPGVHYIRDVADADSLVSSLGSAKKVLVIGGGYIGMEVAAAACGWNLDTTIVFPEDHIMPRLFTPSLAKKYEDLYQQNGVKFIKGALIGKLEAGSDGRVSSAVLKYGSVVEADTVVVGIGAKPVVGPFEAVGVNRKVGGIEVDSLFRTSVPGIFAIGDVAAFPLKMYNRIARVEHVDHARKSAHHCVETLLTSQTKAYDYLPYFYSRVFEYEGSSRKVWWQFYGDNVGETVEVGNFDPKIATFWIDSDSRLKGVFLESGTSEEFSLLPQLAKSQPIIDKSKLQAAASVEDALEIARSSLQSAASV

SEQ ID NO: 5205 - DNA, 1595 bp, Panicum virgatum
  misc_feature: Ceres CLONE 1816881
  misc_feature: Encodes the peptide sequence at SEQ ID NO. 5206
ggcttcggatctagcatgccaccatgcatatgctcacattaaccccttgacaagggcgtccaacgctcccgtgcttcgtgccatgcatatgcccaggtagactagtcgtagtaagctgcaggtatagtactgtagtgtagatcgaccacgaagcaaatcgatctccgcaacaaacacatttatgatcctcaccagcacccactggtaggaatcatatataaagctagctatactaagaaagtgctcatgcatcttgattattgatactccatatatagcaataatcagagagttctattatctccttgtggtgacctgtgtaaaagttgcaagaagctagagcagtagctggtggctattggggtcgtcggtcgatcgatcgatcgatcagctgtccagatagacagatttataggtgatcgagcaagatggtggcgaagggcttgatcacattcacgggcgtgatgagctgggtgctggcggccctgctggtggtcgccgccgccgccggcgtcggcaccgcgtcggcgcaggcggcggggctgaagaaggggttctacaagaagagctgcccgcgggcggaggacatcgcgcgggaggtggtgtgggcgcgcgtcgccggcaaccgcgagctcgccgccaagttcctccgcatgttcttccacgactgcttcgtcaggggctgcgacgcgtcggtgctgctggactcgcggaccaacacggcggagaaggacgcggcgccgaacctgtcgctggccggcttcgacgtgatcgacgaggtgaaggcggcgctggagcgggcgtgccccggcgtcgtctcctgcgccgacatcgtcgcgctcgccgccagggactccgtctcgttccagtacaagaggaacctgtgggaggtggagacggggcggcgcgacggcacggtgtcgagcgaccaggaggcgctggacgacatcccggcgccgacctccaccttcgacatcctcctcgccaacttctccagcaaagggctcggcctccaggacctcgtcgtcctctcaggcggccacacgatcggcatcggacactgcaacctgttcagctcgaggctgttcaacttcaccggcaagaacaaccccagcgacatcgaccccgccctcaacccaccctacgccagattcctacaggggcagtgccggcgcaacctgcagaaccccaacgacaacacgacggtggtgcccatggaccccagcagcagcctctccttcgacaaccactacttcgtcaacctcaaggcgcaccagggcatgttcacctccgacgccacgctgctcaccgacggccgcgccgccaacatcgtcgacaagctgcaggacccgggcgtcttcttcgacgcattcaagaactccatcaagcgcatggggcagatcggcgtgctcaccggtgccaacggccagatcaggaagaaatgcaacgtcgtcaactgatgatctatgagagccatgcaacttaatttatatactatattattctgatgagtcatatatacttgaaattattggtgacatatatgattacctgtgcaacgtgcactgtaatagcaaaaaaaaaaaaaaaaaaaa

SEQ ID NO: 5206 - protein, 343 aa, Panicum virgatum
  misc_feature: Ceres CLONE 1816881
  misc_feature: Great-hit functional homolog of the protein sequence encoded by LOCUS At2g39040
  misc_feature (4)..(215): Pfam Name: peroxidase Pfam Description: Peroxidase
  misc_feature (32)..(343): SWISSPROT Homolog: EC 1.11.1.7 Peroxidase 56 precursor
  misc_feature (39)..(343): SWISSPROT Homolog: EC 1.11.1.7 Peroxidase 24 precursor
  misc_feature: Useful for making plants with altered cell wall content and/or composition
MVAKGLITFTGVMSWVLAALLVVAAAAGVGTASAQAAGLKKGFYKKSCPRAEDIAREVVWARVAGNRELAAKFLRMFFHDCFVRGCDASVLLDSRTNTAEKDAAPNLSLAGFDVIDEVKAALERACPGVVSCADIVALAARDSVSFQYKRNLWEVETGRRDGTVSSDQEALDDIPAPTSTFDILLANFSSKGLGLQDLVVLSGGHTIGIGHCNLFSSRLFNFTGKNNPSDIDPALNPPYARFLQGQCRRNLQNPNDNTTVVPMDPSSSLSFDNHYFVNLKAHQGMFTSDATLLTDGRAANIVDKLQDPGVFFDAFKNSIKRMGQIGVLTGANGQIRKKCNVVN

SEQ ID NO: 5207 - DNA, 1142 bp, Panicum virgatum
  misc_feature: Ceres CLONE 1817025
  misc_feature: Encodes the peptide sequence at SEQ ID NO. 5208
acgcgcaataaaccccggcaaaacccaccgctaaaagccacgctcagatccgcacagcgccgccgccccccaaaccaatcctcctcccctcgctagggtttttaccgccccccgcgccgccgcaatcccagccaccccccgagagaggcgccatggccggcggtcccgcggcggtgtcgttcctgaccaacatcgcgaaggcggcggcggggctcggcgccgcggcctccctcctctccgcgtcgctctacaccgtcgacggcggcgagcgcgccgtcatcttcgaccggttccgcggggtgctcccggagaccgtcaccgagggcacccacttcctcgtcccctggctccagaagccctacatcttcgacatccgcacgcgcccgcacaacttctcctccaactcgggcaccaaggacctgcagatggtcaacctcacgctccgcctcctctcccgccccgacgtcgaccacctccccaccatcttcacctccctcggcctcgagtacgacgacaaggtgctcccctccatcggcaacgaggtgctcaaggccgtcgtcgcccagttcaacgccgaccagctcctcaccgatcgcccccacgtctcggccctcgtccgcgacgcgctcatccgccgcgcccgcgagttcaacatcatcctcgacgacgtcgccatcacccacctctcctacggtatcgagttctctcaggccgtcgagaagaagcaggtcgcgcagcaggaggccgagcgctccaagttcctcgtcgccaaggcggagcaggagaggcgcgcggccatcgtgcgcgccgagggagagagtgagtccgcgcgcctcatctccgaggccacggcgatggctggtactgggctgattgagctcaggaggatcgaggcggccaaggagattgctgcggagctgtctcgctcgccaaacgtggcatacattcctgctggtgacaacggcaaaatgctgcttggtcttaatgctgccggatttggccggtgattcaccagtctgttttaattaagccttctgttgcttgagcatctgccttcctgtgctatgctatgcatgagtaaaactgtgaatcgaaagacaatgatatctgccacttttgcttaaaaaaaaaaaaaaaaaaaa

SEQ ID NO: 5208 - protein, 284 aa, Panicum virgatum
  misc_feature: Ceres CLONE 1817025
  misc_feature: Great-hit functional homolog of the protein sequence given in SEQ ID NO 9527
  misc_feature: Useful for making plants with modulated biomass
  misc_feature: The rosette leaves do not appear in the normal fashion, i.e., their phyllotaxy may be abnormal or too many leaves may be emerging in comparison to the control.
MAGGPAAVSFLTNIAKAAAGLGAAASLLSASLYTVDGGERAVIFDRFRGVLPETVTEGTHFLVPWLQKPYIFDIRTRPHNFSSNSGTKDLQMVNLTLRLLSRPDVDHLPTIFTSLGLEYDDKVLPSIGNEVLKAVVAQFNADQLLTDRPHVSALVRDALIRRAREFNIILDDVAITHLSYGIEFSQAVEKKQVAQQEAERSKFLVAKAEQERRAAIVRAEGESESARLISEATAMAGTGLIELRRIEAAKEIAAELSRSPNVAYIPAGDNGKMLLGLNAAGFGR

SEQ ID NO: 5209 - DNA, 1272 bp, Panicum virgatum
  misc_feature: Ceres CLONE 1817034
  misc_feature: Encodes the peptide sequence at SEQ ID NO. 5210
ctgcttgatttggacaccacaacgactgggcaccgccgcccactgcagagtccggccatggagctccgcgagatgggcggcacgggcctccgcgtcagcgccgtcggcttcggcgcctccccgctcggcaacgtcttcggggacgtgccccgcgacgccgcccgcgccgccgtccgccgcgcgctcgacctcggcgtcaacttcttcgacacctccccgtactacggcggcacggtctcggagtccgtcctcggcgactgcctccgccacgcggccgtcccgcgggaccaggtcgtcgtcgccaccaagtgcggccgctacaaggacgaagggttcgacttctccgccgcccgcgtcgcccgcagcgtcgacgagagcctcgcccgcctggggctcgactacgtcgacatcctccacgcccacgacatcgagttcacaagcctcgaccagattgtgaatgagaccgttcctgcgctccggaagatcaaggagagcgggaaggcgcggttcattggaatcaccgggctgcccctcagcatctacccgtacgtgctcgaccgggcgccgctgggctcggtggatgtcatcctgtcctactgccactacgggatcaacgacacctccctggtcgatctgctcccctacttgaagagcaagggcgtcggggttatcaccgcttcgccccttgcgatgggtcttctcacagataatgggcccccagactggcaccctgcaccggaacatcttaagtcagcatgcagggcagctgcagagcactgtagcaaaaaggggaaaagcatcacgaagctagctatgcaatacagcctgatgaacaatgaaatttctacagttcttgttggaatgaactcttcaaaacaggtggaggagaatgtagctgctgcattggagttgtcaacatctggcattgacgaagaacttctgcatgaagttgaagcaattcttgagcctgtgaagaacatgacttggcctagcggtatccagcaagcctaatgtctaatagcagcttgctcagttgaaaccttcggtgtgccagtatggcttggttggtaactatatgtgtccataacttcagttgccgggattttgacatgttaaagtatacacatgtcaattgtgtgcatccgcatctatcctggatagttgttgatcaaagcgaatgaaggatattgctgggattttatgggcggggcatcttgtaacatggacaataaaagatcgaagctgatcacggaaaaaaaaaaaaaaaaaaaa

SEQ ID NO: 5210 - protein, 317 aa, Panicum virgatum
  misc_feature: Ceres CLONE 1817034
  misc_feature (1)..(289): Pfam Name: Aldo_ket_red Pfam Description: Aldo/keto reductase family
MELREMGGTGLRVSAVGFGASPLGNVFGDVPRDAARAAVRRALDLGVNFFDTSPYYGGTVSESVLGDCLRHAAVPRDQVVVATKCGRYKDEGFDFSAARVARSVDESLARLGLDYVDILHAHDIEFTSLDQIVNETVPALRKIKESGKARFIGITGLPLSIYPYVLDRAPLGSVDVILSYCHYGINDTSLVDLLPYLKSKGVGVITASPLAMGLLTDNGPPDWHPAPEHLKSACRAAAEHCSKKGKSITKLAMQYSLMNNEISTVLVGMNSSKQVEENVAAALELSTSGIDEELLHEVEAILEPVKNMTWPSGIQQA

SEQ ID NO: 5211 - DNA, 1094 bp, Panicum virgatum
  misc_feature: Ceres CLONE 1817042
  misc_feature: Encodes the peptide sequence at SEQ ID NO. 5212
caagcagccaggtccaggtgaaggtgaggcctcgagggggaagccgggaagggctactgcctactagtactagccggtggtgatcttcttgcctcgggggtgacgccggagagtttgggtctgccgggcgcgtgagatgggggagcaggagaacaacaagaccggcggcggcaacaacgccatggcggtggcggacgaggcttcggcggcggcggccaaggagaagggccgcggcgccgcggacccgcgcctccagggcatttccgacgccatccgcgtcgtcccccacttccccaagccagggatcatgttcaacgacatcacgccgctgctgctccggccggccgtgttcaaggacgccgtggacatgttcgtcgagcgctaccgcggcatgggcatcgcggccgtcgcaggtattgaagccagaggcttcatctttggaccagccattgctttagccattggagcaaagttcataccgctgcgtaaacctaagaagcttccaggtgatgtattctctgaaagttatgtgcttgagtatgggacggattgtttggagatgcatgttggagctattgaaccgggggagcgcgcagtggtggttgatgacctggttgcaactggtggaactctttctgctgcaatcagacttcttgaacgcgccggagctgacgtggttgagtgtgcatgcctcattgggcttcccaagtttaaggatttctacaagctcaacggaaaaccagtttacattctggtggagtcccgcaaataggacgtggtaaaagatcaggcagaaaagcttaatttccagcttttcctcagaaaaacaagctcaaagcttcattgtttgcaagcagcgtgaggtggaagaatggacgccgagtactctccagtaaaccgtgttgaggccaggggccagagccagctgctatgtatctgcatgtagagggtgaggtggattgggtgaaacgttagtctctgtaccacgtcccgtctagtgtttttctagtagccgtgacaggggagagtttgtagctattcccgccgagaacatcggtgttggccagagaatggaaaaaaaaaaaaaaaaaaaa

SEQ ID NO: 5212 - protein, 211 aa, Panicum virgatum
  misc_feature: Ceres CLONE 1817042
  misc_feature (22)..(209): SWISSPROT Homolog: EC 2.4.2.7 Adenine phosphoribosyltransferase 1
  misc_feature (27)..(208): SWISSPROT Homolog: EC 2.4.2.7 Adenine phosphoribosyltransferase 2
MGEQENNKTGGGNNAMAVADEASAAAAKEKGRGAADPRLQGISDAIRVVPHFPKPGIMFNDITPLLLRPAVFKDAVDMFVERYRGMGIAAVAGIEARGFIFGPAIALAIGAKFIPLRKPKKLPGDVFSESYVLEYGTDCLEMHVGAIEPGERAVVVDDLVATGGTLSAAIRLLERAGADVVECACLIGLPKFKDFYKLNGKPVYILVESRK

SEQ ID NO: 5213 - DNA, 1587 bp, Panicum virgatum
  misc_feature: Ceres CLONE 1817048
  misc_feature: Encodes the peptide sequence at SEQ ID NO. 5214
tcaccagcacatcatcagctagcagccaagtgtaacagggtgccaagaagcagtagctattagcgaaagggctccgatccgtgctcgtgttcttggagcgatccatccagctgttctttgatttgtagagggagtgagtgagggagaaagcaagggcgtcaatggcgaccgccgggaaagtgatcaagtgcaaagccgcggtggcgtgggaggccggcaagccgctgtcgatcgaggaggtggaggtggcgccgccgcaggccatggaggtgcgcgtcaagatcctctacaccgcgctctgccacaccgacgtctacttctgggaggccaaggggcaaaccccggtgttcccgaggatcttaggacacgaagctggaggcattgtggagagcgttggagagggtgtgactgacctcgcaccgggcgaccatgtcctccctgtgttcaccggcgagtgcaaggagtgtgctcactgcaagtcagaggagagcaacatgtgtgacctcctcaggatcaacgtcgaccgaggtgtgatgattggcgatggcaagtctcgcttctccatcaatgggcagcctattttccactttgtcgggacatccaccttcagcgagtacaccgtcatccatgacggttgcctcgccaagatcaaccccgaggcgcctcttgacaaagtttgtgttctcagctgtggcatctcaaccggtcttggtgcaacactcaatgttgcaaaaccggctaagggttcgacggtggcgattttcggtcttggtgctgtaggccttgctgccatggaaggtgccaggctggctggggcatcaaggatcatcggtgtggacgtgaacccggcaaaatatgagcaagctaagaaatttggctgcactgactttgtgaaccccaaggaccacaacaaaccagtgcaagaggtgctcattgagatgaccaatggcggtgtcgatcgcagcgtggagtgcactggcaacgtcaacgccatgatttctgccttcgaatgtgttcatgatggatggggcgtcgccgtgctggtcggtgtcccgcacagggaggaccagttcaagacccaccccatgaactttctgaatgagaagacgctcaagggtaccttcttcggcaactacaagccccgcaccgacctccctaatgttgtcgagatgtacatgaagaaggagctggaggtggagaagttcatcacccacagcgtgccgttctcggagatcaacacggccttcgacctgatgctcaagggtgagggcctgcgctgcatcatgaggatggaggactagagctctccagcgtccgttgcaactactctgttgcacaaggaaggaaattgaaaagtttaatgcgcacctttgtgtagtagtaatgttgtggtcctgagatacgaacatgctcatcccctgtattccgtttcacggtttcatctttattgttagtgtgtggtaactggtcgagtttgggcccacgaaaaaaaaacaaaaaaagagaagtgtggtcaggcttcagagtccatgtaattaccattttgcataacaaataatgaaacgttgtcagtgttaaactgttcat

SEQ ID NO: 5214 - protein, 379 aa, Panicum virgatum
  misc_feature: Ceres CLONE 1817048
  misc_feature (1)..(130): Pfam Name: ADH_N Pfam Description: Alcohol dehydrogenase GroES-like domain
  misc_feature (1)..(379): SWISSPROT Homolog: EC 1.1.1.1 Alcohol dehydrogenase 2
MATAGKVIKCKAAVAWEAGKPLSIEEVEVAPPQAMEVRVKILYTALCHTDVYFWEAKGQTPVFPRILGHEAGGIVESVGEGVTDLAPGDHVLPVFTGECKECAHCKSEESNMCDLLRINVDRGVMIGDGKSRFSINGQPIFHFVGTSTFSEYTVIHDGCLAKINPEAPLDKVCVLSCGISTGLGATLNVAKPAKGSTVAIFGLGAVGLAAMEGARLAGASRIIGVDVNPAKYEQAKKFGCTDFVNPKDHNKPVQEVLIEMTNGGVDRSVECTGNVNAMISAFECVHDGWGVAVLVGVPHREDQFKTHPMNFLNEKTLKGTFFGNYKPRTDLPNVVEMYMKKELEVEKFITHSVPFSEINTAFDLMLKGEGLRCIMRMED

SEQ ID NO: 5215 - DNA, 1151 bp, Panicum virgatum
  misc_feature: Ceres CLONE 1817064
  misc_feature: Encodes the peptide sequence at SEQ ID NO. 5216
gcaagccattcaaaccccaaaacaaatccagctatctcctctgcctccggtcccggcggcgccatggcgctacagctacaggacgcggcgcgtccgcccctaccactcgccccctcccgctgccgtcttgctccgccggcgcctcccctcgtccgcttggctgccttctcttcaagctcgggcccctccgtgcgcctctcctgtcgtggccctgcgcctcgctggcggcgggcgagcgtgagggcgcgcgctggggccggcggcggcggtcggagggagtcaccgtacgaggtgctcggcgtgtcgccgtcggcggttttttacgagatcaagcgcgcgtaccggcgcctcgcgctcaagtaccatccggacgtcaacaaggagcccaacgctcaggaaaagtttctgcggatcaagcatgcttacaacacgctgatgaactcggagagccgatccaaatacgggggcgccagttcagattcgtcttggtcctccagctccagggagagcaaatcaactgctgcagaagagccgttctatggatttgcggaattccttaaagatctgcaaacagaatttcagaactgggaagttggcttaaattcagatcagaaacctaaaagcctttgggaagaattgtctgcaattggcgaggaatttgtagaatttctggaaaatgaactgaagatcgatgattccagctctagcaacaacatgggaaacgatccatacacgcagtttggagggcaatcaaaaaatgctaaggatgaaaagacatcaacaaatagttttgatgatggtgtttctgaaatagaggctgctcttgagaagctgaagaaggaacttggactcggctaaaccactgatgtggcaactaaagctgttgttgatgctgctacatactactgacttcatgttcatacaaagttgtttcttgtatgtaacagttggtgatactaattagtgattgtgatctagttgataactcatgagctcatacattcagctttcatgaatgtttctgatatctagagctgcagcatttttcggaaagcacaacgataagatatttgagtgccttcaaaactgttggtgaaaaggttctgatttttgtatgttgggataaaaaataaaaggtgctgcactgcatc

SEQ ID NO: 5216 - protein, 264 aa, Panicum virgatum
  misc_feature: Ceres CLONE 1817064
  misc_feature (1)..(61): Pfam Name: DnaJ Pfam Description: DnaJ domain
MALQLQDAARPPLPLAPSRCRLAPPAPPLVRLAAFSSSSGPSVRLSCRGPAPRWRRASVRARAGAGGGGRRESPYEVLGVSPSAVFYEIKRAYRRLALKYHPDVNKEPNAQEKFLRIKHAYNTLMNSESRSKYGGASSDSSWSSSSRESKSTAAEEPFYGFAEFLKDLQTEFQNWEVGLNSDQKPKSLWEELSAIGEEFVEFLENELKIDDSSSSNNMGNDPYTQFGGQSKNAKDEKTSTNSFDDGVSEIEAALEKLKKELGLG

SEQ ID NO: 5217 - DNA, 1449 bp, Panicum virgatum
  misc_feature: Ceres CLONE 1817070
  misc_feature: Encodes the peptide sequence at SEQ ID NO. 5218
tggcctctacctccaggcaccgcgatcctagcgaattaatcctcggagaattcttgaagcatccggccggatcgaccccgaccgatccgaatcgacctgcaccggctagcggcgccgcgcgcgcgcggatcgaccggcgaccggtacatggctcccgtggcggcggcggcggggcagcagcacacggggaaggcggcggcgctcgcggcgcgcgacgcgtccggccacctcgcgccgctcaccatcacccgcaggagcaccggagacgatgatgtagcgataaagattctgtactgtggaatgtgtcactctgacctgcacagcatcaagaacgagtggaataacgccatgtaccccatggtctctggtcacgagatcgccggagtggtgacggaggtgggcaagaacgtgaccaagttcaaggccggggaccgcgtcggcgtgggctgcatggtgaactcgtgccagtcctgcgaccgctgcgacgaggggttcgagaaccactgccggggcatcatcttcacctacaactcggtcgaccgcgacggcaccgtcacctacggcggctactccagcaacgtggtggtccacgagcggttcgtggtccggttcccggacgccatgccgctggaccagggcgcgccgctgctgtgcgccggcatcaccgtgtacagccccatgaagtaccacggcctgaacgtgcccggaaagcacgttggtgtgctggggctgggagggctgggccacgtcgcggtgaagttcgccaaggcgtttgggatgaaggtgacggtgatcagcacgtcgccggcaaaaaagcaggaggccctggagcggcttggcgctgatgccttcattgtcagcaagagcgccgacgaaatgaaggctgcggttgccaccatggatggcatcatcaacacggtgtctgccaacatgtccatagccccatacatgggtctgctgaagcccaacggcaaaatgatcatggtcggcctgcccgtgaagccgctcgagatcccgccgtttgatctcatcatggggaacaagaccttggcggggagctgcatcggcggcatgagggacactcaggagatgatcgacgtcgcggcgaagcacggcgtgacggcggacatcgaggtggtgggagcggactacgtgaacacggccatggagcgcctcgccaaggtcgacgtcaggtatcgcttcgtcatcgacatcggcaacaccctcaagagctccgagtgatgaccacttctggcattggcagcagctctgaggctgcttctcagatatatgatgaacagtctaagttttcgcatcagtgatgctgtaatgaggacggagataagtagcacatgttactgtgttggctatgttcaaataatgcaccttcgcattaaaattaatatattggtttgctagctatttgaacaaaaaaaaaaaaaaaaaaaa

SEQ ID NO: 5218 - protein, 364 aa, Panicum virgatum
  misc_feature: Ceres CLONE 1817070
  misc_feature: Great-hit functional homolog of the protein sequence encoded by LOCUS At4g37980
  misc_feature: Great-hit functional homolog of the protein sequence encoded by LOCUS At4g37990
  misc_feature (1)..(116): Pfam Name: ADH_N Pfam Description: Alcohol dehydrogenase GroES-like domain
  misc_feature (20)..(359): SWISSPROT Homolog: EC 1.1.1.195 Cinnamyl alcohol dehydrogenase 2
  misc_feature (4)..(364): SWISSPROT Homolog: EC 1.1.1.255 Mannitol dehydrogenase
  misc_feature: Useful for making plants with altered cell wall content and/or composition
MAPVAAAAGQQHTGKAAALAARDASGHLAPLTITRRSTGDDDVAIKILYCGMCHSDLHSIKNEWNNAMYPMVSGHEIAGVVTEVGKNVTKFKAGDRVGVGCMVNSCQSCDRCDEGFENHCRGIIFTYNSVDRDGTVTYGGYSSNVVVHERFVVRFPDAMPLDQGAPLLCAGITVYSPMKYHGLNVPGKHVGVLGLGGLGHVAVKFAKAFGMKVTVISTSPAKKQEALERLGADAFIVSKSADEMKAAVATMDGIINTVSANMSIAPYMGLLKPNGKMIMVGLPVKPLEIPPFDLIMGNKTLAGSCIGGMRDTQEMIDVAAKHGVTADIEVVGADYVNTAMERLAKVDVRYRFVIDIGNTLKSSE

SEQ ID NO: 5219 - DNA, 1450 bp, Panicum virgatum
  misc_feature: Ceres CLONE 1817099
  misc_feature: Encodes the peptide sequence at SEQ ID NO. 5220
agcacccggattacaaacccaccggcgagcggcgaaatcggaggcgactcgccgagggttcccggtcctccgctctctcgccggctcctctaccgcggccgcaactcgccggcggcagccggcgggacgctgcggtccagcgcccccctccccccggaagcctcttcggtctccttcgctaatcgggaggcgtcgaccccgccgcggctccccgccccgcgcccgccgccgaactctactagcgctgggctggcgcggattggagcggagatcggctccgtgccatgttggtgaagatgcattacgtgtagatcaagctccaatctgatggattctgatgaaaagaagtttggaaaagggcctagggagctttctggtgctgttgatttaatcaaccactacaaactgctcccgcaccatgatttcttttgcaagaaacctttgccactggcaatctcagatacacattatcttcataatgtcgtgggagacactgaaattcgcaaaggagaaggaatggagctggatcaacttgttcagaatgcatctacgaggaataagcctgcttttattcagccctttgatatggaaatactggggcaagcattccagcttcgagaaacagctccagtagatttgccctctgctgaaaagggtatacctactatttctggtaagccaaaaagtgagtccaaggacaaagagaagaaacataaaaaacacaaagacagggataaagataaggagcataagaagcataaacatcggcataaagaccggagtaaggataaagataaagacaaggacaaagataagaaaaaggataaaagtgggcatcatgattctggcggcgatcattcaaagaagcatcatgataagaagaggaagcatgagggaatggaggactcggcggatgtgcataagcacaagaagagtaagcacaagagttccaaaaccgatgaaatggggaatggacttagttaactacacttcctagttctagtcttcaatccttgtaacttgctgttaaaaggaaactccgatggtttctgtcatcaaaactctgcagaatggtggtatcattaccatgaactgaacctgtttgatgagaacaccataattgaggttgtcttgcagcatccattctgatgaaagttgtatttgttaatactaataggggactaatccattgtaccattgcgactttatgttcctccctgaagaataactggttgtaggaacacttgaaaggacttgcaacaagattgtttcgattactagggccagtgcacccttccaaaataggcttctaattgaactcgtgatgtagcatgagtacattgagtagtagtagtggacagatatagaatgtgcagcctagagatgtagctgagagcagggaatcaaagcatatttgtgtttcttgtgccaaaaaaaaaaaaaaaaaaaa

SEQ ID NO: 5220 - protein, 218 aa, Panicum virgatum
  misc_feature: Ceres CLONE 1817099
  misc_feature: Great-hit functional homolog of the protein sequence given in SEQ ID NO 9269
  misc_feature: Useful for making plants with altered oil content
MDSDEKKFGKGPRELSGAVDLINHYKLLPHHDFFCKKPLPLAISDTHYLHNVVGDTEIRKGEGMELDQLVQNASTRNKPAFIQPFDMEILGQAFQLRETAPVDLPSAEKGIPTISGKPKSESKDKEKKHKKHKDRDKDKEHKKHKHRHKDRSKDKDKDKDKDKKKDKSGHHDSGGDHSKKHHDKKRKHEGMEDSADVHKHKKSKHKSSKTDEMGNGLS

SEQ ID NO: 5221 - DNA, 1783 bp, Panicum virgatum
  misc_feature: Ceres CLONE 1817100
  misc_feature: Encodes the peptide sequence at SEQ ID NO. 5222
tccccacccaggcacccaagacccagcagccaccaccacactaccacaggaaggaaggcgagagctttccgtcccctcccctcccgcagaggctgtaaagggcagctccctcgtggcctgtcgccgcccgcctccactcctctcctctccggactcgccggcctggatctgccgcggggctctcatctctcctgccctcaagagagaccgccgccgccgccgcagatgctgcccaccaaccgcggcaggccgcagcagaggccgccgccgcccagatcttggtccttcctctcagagatggtggacttctccgatcccaagcgcaggccgcgctacctcaccaagctcgtcatggccgcgctcctcaccgccatgtgcgtcctcatgctcacccagccgccctgccacaggagggccagccccagcgtgttctccacccgtcaacctggggtcacgcacgtgctgctcaccgggggcgccggctacattggctcgcacgccgcccttcggctgctcaaggactccttcagagtcaccatagtggataatctttcgagaggaaatattggcgcgatcaaggttcttcagaacttgttcccagagcctgggcggctgcagttcatacaagctgatttaggagatccaaaagcagttaacagaatatttgcagagaatgcatttgatgctgtcatgcactttgctgctgtcgcttatgttggagagagcacacttgaacctctgaggtactatcataacatcactgcaaacactttagtggtgctggaagctatggcaacacacaatgtgaaaactctgatctactctagcacatgtgctacttacggagaacctgacaagatgcctatcactgaagaaactccccagtttccgatcaacccatatggtaaggccaagaagatggcagaggatatcattttggatttctcaaagtccaagaaagcagatatggctgtcatgattctaagatacttcaatgtcattggctctgacccggaaggaaggctgggtgaggctcctagacctgaattgcgtgagcatggtcgcatatcaggtgcatgcttcgacgcagcactgggtataatcccaggtttgaaggttaagggtaccgactacgaaactcctgatggcacttgtgtaagggattacattgatgtcactgacctggtcgacgcccatgttaaggcactcaacaaggcagaaagaggcagagttggcatatacaatgttggcacgggaaaaggtcggtcagtaaaggagttcgttgaggcctgcaagaaggcgaccggagtcgatatcaaggttgactacttcccccgcagaccaggtgactatgccgaggtgtacagcgaccccgccaagatcaaccgggagctgaactggacggcacaacacaccgacctccacgagagcctcagggtggcgtggacatggcagaaggcgcaccggagtgggtacgagccaccccaggccatgattttgtgaagatggtgatgggcctcgtagcaagcaaccagctggctggagcataggtgaacataaaagtattattagagacttctccttgaggacccatagtcgctcgctcacatatggtgaattatatacacatagtgttcatggtcattcgttcgattcttgagggttcatatttattgaaggctttagctgatcattgtaatagcataatactccatattcattgtaagttatagaataaaattccaataagctcgttttgagataaaaaaaaaaaaaaaaaaaa

SEQ ID NO: 5222 - protein, 425 aa, Panicum virgatum
  misc_feature: Ceres CLONE 1817100
  misc_feature: Great-hit functional homolog of the protein sequence encoded by LOCUS At1g30620
  misc_feature: Great-hit functional homolog of the protein sequence encoded by LOCUS At2g34850
  misc_feature: Great-hit functional homolog of the protein sequence encoded by LOCUS At4g20460
  misc_feature (1)..(264): Pfam Name: Epimerase Pfam Description: NAD dependent epimerase/dehydratase family
  misc_feature (7)..(417): SWISSPROT Homolog: EC 5.1.3.5 UDP-arabinose 4-epimerase 1
  misc_feature: Useful for making plants with altered cell wall content and/or composition
MLPTNRGRPQQRPPPPRSWSFLSEMVDFSDPKRRPRYLTKLVMAALLTAMCVLMLTQPPCHRRASPSVFSTRQPGVTHVLLTGGAGYIGSHAALRLLKDSFRVTIVDNLSRGNIGAIKVLQNLFPEPGRLQFIQADLGDPKAVNRIFAENAFDAVMHFAAVAYVGESTLEPLRYYHNITANTLVVLEAMATHNVKTLIYSSTCATYGEPDKMPITEETPQFPINPYGKAKKMAEDIILDFSKSKKADMAVMILRYFNVIGSDPEGRLGEAPRPELREHGRISGACFDAALGIIPGLKVKGTDYETPDGTCVRDYIDVTDLVDAHVKALNKAERGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 5223 - DNA, 1281 bp, Panicum virgatum
  misc_feature: Ceres CLONE 1817108
  misc_feature: Encodes the peptide sequence at SEQ ID NO. 5224
gctggaccgactggattatccacgctgtcaacgaaaagctccgcgaccgcgagccgtcggctcgcattcgcatccatccccatccgcattctccaacggccacccatggccgccgccgccctcgccgctcctcctctcctcctgtcctcgccgccggcgccggcgcgggcggcgaggatgaggaggagggcggcggcgaggcccttcctccgcgccgcgtgcgcctacgcgctccaggagggccagacccgccgcttccaccgcctgccgtgcggcctcgacctcgaggtcgtcgcgcagcccccgctggcgccgggggagcgccgcccgccgctggtgttcgtgcacgggagcttccacgcggcctggtgctgggccgagcactggctgcccttcttctcgcgggccgggttcccctgctacgccctcagcctccgcgcgcagggtgaaagtagtgttccacaggaggcagtggctggcacactcgagacacatacttgcgatattgctgatttcatccagaaggagatcccctctccacctgtactaattggacattcatttggaggcttgattgtgcagcaatacatatcatgcttgcaaggctcagaatctcatccaaagcttgctggtgctgtccttgtatgttctgtgcctccctcaggaaatagtgggttggtatggcgttaccttttgactaaaccagttgctgcggtcaaggtgactctcagcttggctgcaaaagcatatgcaaattcattgtccctctgtaaggaaacatttttctcaccacaaatggatgatgaacttgtgttaaggtaccaagcactaatgaaggagagctcaaaattgccattgtttgacttaaggaagctaaatgcagcactgcctgtaccttctgtaccaaataatacaacagaagttcttgtcatgggtgcaatcaatgattttattgttgattctgaagggctctcagaaacttcgagattttatggagtgcaaccagtatgtgtggaaggtgtagctcacgatatgatgttagattgttcatgggagaaaggagctgaaataatcttgacgtggttagaaaaactgaaaccatgatttcagtccaacagccgggttcaacattttgtagtgattcttagtcttttttcttttgtcggacatgttggtaggtattttcttgttagtgctgggaaatctcatccaatattattgttcacttggaataaagtaaagtttatcatttcattgttatctaaaaaaaaaaaaaaaaaa

SEQ ID NO: 5224 - protein, 332 aa, Panicum virgatum
  misc_feature: Ceres CLONE 1817108
  misc_feature (1)..(212): Pfam Name: Abhydrolase_1 Pfam Description: alpha/beta hydrolase fold
MAAAALAAPPLLLSSPPAPARAARMRRRAAARPFLRAACAYALQEGQTRRFHRLPCGLDLEVVAQPPLAPGERRPPLVFVHGSFHAAWCWAEHWLPFFSRAGFPCYALSLRAQGESSVPQEAVAGTLETHTCDIADFIQKEIPSPPVLIGHSFGGLIVQQYISCLQGSESHPKLAGAVLVCSVPPSGNSGLVWRYLLTKPVAAVKVTLSLAAKAYANSLSLCKETFFSPQMDDELVLRYQALMKESSKLPLFDLRKLNAALPVPSVPNNTTEVLVMGAINDFIVDSEGLSETSRFYGVQPVCVEGVAHDMMLDCSWEKGAEIILTWLEKLKP

SEQ ID NO: 5225 - DNA, 1255 bp, Panicum virgatum
  misc_feature: Ceres CLONE 1817114
  misc_feature: Encodes the peptide sequence at SEQ ID NO. 5226
actcaagctgagtccaacgcggacgcggttggggaaaaaatggaggcgtcagcggacgcgggggcggcggccgccgccgccgctgccgctgcgcgaacgctgcggtgggcgggccgcgctgggcacctgggcggcttcccccgcgctgcggtgttcgccgccgtgggcgcgttcgccaaggcctacgcctcgctgcttaacaccaccaccgtccacaacgccgacgtgctgctccgcctcgtctcggcgcggcccctcgggactccgctcctcaccgtcagcaaccacatgtccacggtagatgatccgcttatgtggggattcaagggttttccaacttcagatgcaaagcttggaaggtgggtgctgacagcagaagatatatgcttcaggaatgtagtcatgtcttacgtgtttcgacttgggaaatgtgtaccaatcacacgagggggtggaatctatcaagaacacatgaatgaagctcttgacgtgcttgtcaatggaggctggttgcattcattccctgaaggaaaaattgcccaggatgatcagccaattagaagattgaaatggggaactcccagtcttattgtccgagcaccaataactccaattgttttaccaattgttcactctggttttgaaaaggtcatgccagagaatttgttctttggacggcgaccaccagtgccactctggggcaagaagatagatatcatcattggagagccaatagagtttgacatggcaagcttgaagcaagaggcagcaatggtaccccacgatccatcctctgtaaggaaggggtggccgaccattacaccaggtgggctggacgaggctgcacagagatggctttaccagaagatgtcagataagatccagtctgtgatggagagactgcggaaaaaacttctgaatctgaagcagcactgatctttttgctcttcttctataaggccatggtaggtttctgttgctttttgcacctacccttggttaggatttattaacaagcactggttatttcaatttatacacaaatgggtgaatgtccgtcacaactgccaaaattatgagccagagctattggaatagaattagagtccagattggtacatgtgttgtcttttatgggcagtagttttgaatgatttcttcattattttactatcaacagttcaagtgccaattttattgcggcatgaataaagccttctactgttcaattgcataaaaaaaaaaaaaaaaaaaa

SEQ ID NO: 5226 - protein, 298 aa, Panicum virgatum
  misc_feature: Ceres CLONE 1817114
  misc_feature (1)..(141): Pfam Name: Acyltransferase Pfam Description: Acyltransferase
MEASADAGAAAAAAAAAARTLRWAGRAGHLGGFPRAAVFAAVGAFAKAYASLLNTTTVHNADVLLRLVSARPLGTPLLTVSNHMSTVDDPLMWGFKGFPTSDAKLGRWVLTAEDICFRNVVMSYVFRLGKCVPITRGGGIYQEHMNEALDVLVNGGWLHSFPEGKIAQDDQPIRRLKWGTPSLIVRAPITPIVLPIVHSGFEKVMPENLFFGRRPPVPLWGKKIDIIIGEPIEFDMASLKQEAAMVPHDPSSVRKGWPTITPGGLDEAAQRWLYQKMSDKIQSVMERLRKKLLNLKQH

SEQ ID NO: 5227 - DNA, 1241 bp, Panicum virgatum
  misc_feature: Ceres CLONE 1817116
  misc_feature: Encodes the peptide sequence at SEQ ID NO. 5228
agacaagacgagtcaggagccaaccaggcctaagcgtcaatcaagaggtggaagagccaaagccatagtggctgaggaagcaaggcacaaagtagaagcaagcaagctcatggcgattcccaaggtcgacctgtgcaggctggatcccagcagccctggatgggcctcagctcgtgctacggtgacggtgtccatggtggagcacggctgtgttgtcgtcgcgtgcgacgcgctcggcgcggagctccggcgggccctgttcgagcgttgcatgccggagctctttgagttccccgccgagaccaagcagcggaacgtctcagccgactctgcgttgaggggctacgtcgggaagcttcccggcctggacttcgagagcttcaatgtcgcagagatcacggagccccgcagtgtccgtgacttcagcagcatcttctggccgcatggaaacccggagttctgcgacacagtcatttcattcgtcagtaacctactcgaactggagcatacggtggagaagatgaccctggaaggcctcggcgtccgggaagagaccattgctgcccaccgccagacgctcacccacagtcttcgcctgtcacactacggcgtgccggaggagtcgaagatgggcgtgaccctgccaaggcacaccgatcctagcttcacgacggcgatcgtgcagcatgaggtggaaggcctcgaggtgcaggctaaggatgggagctgctggatcaccatccctcccgaggcggacacgatcaccatcatcgccggcgacctgctcacagtggtaacaaacgggagggtacccgcgtgcgttcaccgtgtaaagaccgcaagcaatcgcgaacgcttctcggtgctgttcaccgtcgtggcaaagaacggagctgtgttgagtgccatggatgaacttgtcgacccggaccatcctctgatgtacaaccccttgaagatagatgagtacatgctgttccgttactcggaggaagcatttaagttaagcgatccattggaggagttctgcggagtgcacaagagtggatcgtccacagagtgatcttagcccaacaaactgtgtcatgtggctaggatccgtccctagagctattgctatctgtaacactcatctatctggcttttaatttcctactttcagatcaacgaacggcaaaatatcacgtttgtaatgaataaaatgttccttgtttatgtattaaaaaaaaaaaaaaaaaaaa

SEQ ID NO: 5228 - protein, 317 aa, Panicum virgatum
  misc_feature: Ceres CLONE 1817116
  misc_feature (3)..(95): Pfam Name: 2OG-FeII_Oxy Pfam Description: 2OG-Fe(II) oxygenase superfamily
MAIPKVDLCRLDPSSPGWASARATVTVSMVEHGCVVVACDALGAELRRALFERCMPELFEFPAETKQRNVSADSALRGYVGKLPGLDFESFNVAEITEPRSVRDFSSIFWPHGNPEFCDTVISFVSNLLELEHTVEKMTLEGLGVREETIAAHRQTLTHSLRLSHYGVPEESKMGVTLPRHTDPSFTTAIVQHEVEGLEVQAKDGSCWITIPPEADTITIIAGDLLTVVTNGRVPACVHRVKTASNRERFSVLFTVVAKNGAVLSAMDELVDPDHPLMYNPLKIDEYMLFRYSEEAFKLSDPLEEFCGVHKSGSSTE

SEQ ID NO: 5229 - DNA, 1245 bp, Panicum virgatum
  misc_feature: Ceres CLONE 1817134
  misc_feature: Encodes the peptide sequence at SEQ ID NO. 5230
aaaggtcagctccgtcacgtgctcacgggccacggttgcgccgaggcggcggcggcggaagggggcgacgccgtcacgccgatatcgccgccgcacctgcacggtgggcctagtcaagtagatccaagtcctgaagtaggtaggctgctagaaccaaagagtgagagggtcttcgagttcggtgaccccttgtgcgacacagctttccgatctctccaacgccatgtctgacatcggcgccggcggcggtgacgaggtcatcctcgacgcgcctggcttcatccgcgtgtacaggagcggccgcgtcgagcgcttcctgccggtggacttcgccccgccctccaccgacgccgccaccggcgtcgcctccaaggacgtccccatccttccggaagccggcgtgtcggcgcgcgtctacctcccggcgccccgctcctccggaggctacggcggcatgctccccgtcctggtgctcttccacggcggcgggttctgcctcggctccgcgttcgaccccagggtgcacgcccacgccaaccgcctcgccgcggcggccggcgcgatcgtcgtgtcggtcgattaccgcctcgcgccggagcacccggtccccgcgatctacggggacgcgtgggcggcgctccagtgggtggccgcgcacgccgcgggtcaggggcccgagccctggctggccgcgcacgcggacctcggccgcgtccacgtcggtggcgagagcgcgggcgccaacatcgcgcaccacgccgcgatgcgcgccggcgccgaggacctgggccacggcgtcaagctgagctcgctcgtgctgatccacccctacttcctggggggccacagctccgagacggacgagatgggcatggtgttgctccgcgagctcgtccggctgtggccggtggtgtgcccgggcacgagcgggtgtgatgacgacccgttgatcaacccgatggcggagggcgcgcccaacctcgctagcttggggtgccggcgcgtgctggtttgccttgggggaaaggacccgatgaggggtagaggaagtctgtattgtgagaagttgaagggaagtggttggtgcggggaggtggaggactgggaggcacatggccaggggcacggtttccatttcttgcgtccaacgagcgcagaggcggaggcgcaagtcggtgtcattgctgagtttctaagctatggatgacatctctgtttatccactaaaaaaaaaaaaaaaaaaaa

SEQ ID NO: 5230 - protein, 327 aa, Panicum virgatum
  misc_feature: Ceres CLONE 1817134
  misc_feature (1)..(225): Pfam Name: Abhydrolase_3 Pfam Description: alpha/beta hydrolase fold
MSDIGAGGGDEVILDAPGFIRVYRSGRVERFLPVDFAPPSTDAATGVASKDVPILPEAGVSARVYLPAPRSSGGYGGMLPVLVLFHGGGFCLGSAFDPRVHAHANRLAAAAGAIVVSVDYRLAPEHPVPAIYGDAWAALQWVAAHAAGQGPEPWLAAHADLGRVHVGGESAGANIAHHAAMRAGAEDLGHGVKLSSLVLIHPYFLGGHSSETDEMGMVLLRELVRLWPVVCPGTSGCDDDPLINPMAEGAPNLASLGCRRVLVCLGGKDPMRGRGSLYCEKLKGSGWCGEVEDWEAHGQGHGFHFLRPTSAEAEAQVGVIAEFLSYG

SEQ ID NO: 5231 - DNA, 1401 bp, Panicum virgatum
  misc_feature: Ceres CLONE 1817155
  misc_feature: Encodes the peptide sequence at SEQ ID NO. 5232
agagcatagcagcacatcgcagagcaccagcgcccctgagagctcatcagcggctagctagctagcggcctatctagctggtgcaattagcttattgagaaacatcatgaggctctcggcggctgtgctctgcgccctggtggccgtccaggcggcggtgctcctcgccgccgtgccggcggcgcaggccggcgagctgcaggtcgggtactacggcaagaaatgcaagggcctggagaacatcgtcaagtggcacgtcatcagggcgctcaaggccaaccgccgcaccggctccgcgctcgtccgtctgctcttccatgactgcttcgtcagggggtgcgatggctctgtcctcctggacgcgtcctacgacaaccctcacccggagaaggaggcgccggcgaacatcggcctcaccgccttcgacctcctggaggagatcaaggccgccgtcgaggacaagtgccccggcgtcgtctcctgctccgacctcctcatctacgccgcccgcgacgcgtccagcatcctcagcaacggccatgtccacttcgacgtccccgccggccgcctcgacggcttcgtctccaaggccgaggaggcccaggccgagctcccggactccgccgacgacgtgcacaagctcatcgccaacttcgccaggaagaacttcaccgtcgaggagctcgtcatcctctccggcgcccactccatcggccagacgcactgctcgtccttcgccggccgcctctccgagcccgccgaccagatcgtcccggcctaccgcgagctcctcaagtacaagtgctcccagggctccaacccgcccgtggtcaacaacgtccgcgacgaggactacgacgtcgtggcgcggtacacgccggggttcaccagccgggtgcgcaaggtccccgactaccttgacaactcgtactaccacaacaaccttgccaagatcgtcaccttccactccgactggacgctgctgacgcacaaggaggcgctcggccacgtcaaggagtacgccgagaacggcacgctctgggacgaggatttcgccgactcgctggtcaagctcagcaagctgcccatgccggcggggagcaagggcgagatcaggaagaagtgcagcgccatcaaccaccgcctgtactaagctgcaggccgccgtgctcctgcagcaatggatcagaggtcgaagaagaagaagccgtgagtgcccagccaactcaacacacacacggtcatagatcaagttgccgtaaagcttggtttttgtcgtccatccattcttttgattctcattggttttatttgtactacactttggtgtgcatttttcatgtttgccaatctgttacgtagcatacatgcatgtctcacggaaataaaattatacgatat

SEQ ID NO: 5232 - protein, 348 aa, Panicum virgatum
  misc_feature: Ceres CLONE 1817155
  misc_feature (1)..(262): Pfam Name: peroxidase Pfam Description: Peroxidase
MRLSAAVLCALVAVQAAVLLAAVPAAQAGELQVGYYGKKCKGLENIVKWHVIRALKANRRTGSALVRLLFHDCFVRGCDGSVLLDASYDNPHPEKEAPANIGLTAFDLLEEIKAAVEDKCPGVVSCSDLLIYAARDASSILSNGHVHFDVPAGRLDGFVSKAEEAQAELPDSADDVHKLIANFARKNFTVEELVILSGAHSIGQTHCSSFAGRLSEPADQIVPAYRELLKYKCSQGSNPPVVNNVRDEDYDVVARYTPGFTSRVRKVPDYLDNSYYHNNLAKIVTFHSDWTLLTHKEALGHVKEYAENGTLWDEDFADSLVKLSKLPMPAGSKGEIRKKCSAINHRLY

SEQ ID NO: 5233 - DNA, 1375 bp, Panicum virgatum
  misc_feature: Ceres CLONE 1817161
  misc_feature: Encodes the peptide sequence at SEQ ID NO. 5234
gcgcatccagttctgttacaatcttgaacgtcgaacagtatccgctaccgtgtcatagcaaggcctctatttcagtggagaaagacaggcaggaaggttagaagattttttttctttctgcagagagagagaaagagagagaggcttggtggtaagggcgaagccatggacatggagcagcagatcgagcacaggcacatccccatccgaggcctcaacctccacgtcgcccaggccggcaaaggcgacaaggggacggtggtgttcttgcacgggttcccggagatttggtactcgtggcgccaccagatggtagccgtggccgccgccgggtaccgcgccgtcgcgccggactggcgcggctatgggctctccgaccaaccgccggtggaggaggaggtgtcgtacgacgacctgctggatgacctcctcggcatcctcgacgccctctctgtccccaaggcattccttgtggggaaggatttcggagccgtgcccgcctacgatttcgctctccggcaccctgatcgagtctgcggtgtgatgtgcttaggcatccctttcactcctttcacttcctccttcgccaccatgccggaaggattctacatgttgcgttggctggaacctggaagagcggaggcggacttcgacaggtacgatgtcaagagagttgtgcgaaccatctacattctgttctcaggcagtgagatccccatagcgaaagcagatcaagagatcactgacctagcagacttgtcgacgccccttccagagtggttcagtgaggaggatctcgctgtctacgcatccctctatgagaagtccggtttccggtatccactgaagatgccatacagatcactccataagaggcacacgattgtgggtccaaagttccaagtcccggtgtttgtcgtcatgggggtgaaagactacgtctacaagctcttcgagtccgttttgaaagaaggcaccatggggatgtttgcgccggacctgaagatcgcctacgtccctgaaggaagccacttcgtgcaggagcagttccctgacaaggtgaatgagctgctcattggcttcttgaaggaccatccggttccagtggctgcgtagatgctaaagttgaccgcgctagctgcacctcaggcctgctcgattccatgagccctgttttatatggatctccaataaaggaatctgtcagctgtgacctctggcattgttgtgagtatgcgatttatgcttgaagcaagggtatagtgtattctgtttgtaaatgtataatcttggtacttatcaacaatatacatacttctttctctttcaaagaacaatatacatattcttgtccgaaaaaaaaaaaaaaaaaaaa

SEQ ID NO: 5234 - protein, 316 aa, Panicum virgatum
  misc_feature: Ceres CLONE 1817161
  misc_feature (1)..(251): Pfam Name: Abhydrolase_1 Pfam Description: alpha/beta hydrolase fold
MDMEQQIEHRHIPIRGLNLHVAQAGKGDKGTVVFLHGFPEIWYSWRHQMVAVAAAGYRAVAPDWRGYGLSDQPPVEEEVSYDDLLDDLLGILDALSVPKAFLVGKDFGAVPAYDFALRHPDRVCGVMCLGIPFTPFTSSFATMPEGFYMLRWLEPGRAEADFDRYDVKRVVRTIYILFSGSEIPIAKADQEITDLADLSTPLPEWFSEEDLAVYASLYEKSGFRYPLKMPYRSLHKRHTIVGPKFQVPVFVVMGVKDYVYKLFESVLKEGTMGMFAPDLKIAYVPEGSHFVQEQFPDKVNELLIGFLKDHPVPVAA

SEQ ID NO: 5235 - DNA, 1319 bp, Panicum virgatum
  misc_feature: Ceres CLONE 1817205
  misc_feature: Encodes the peptide sequence at SEQ ID NO. 5236
atcagctcaactgagccttcttgtcttgttaactcgccaaccatgcctgccgtctcagctgccgcctgctgcgccgccgctacgccggctagcgaagtcgtcgaggacctcttcggcttcctgcgcgtcctcagtgacggcaccatcctccggtcgccggcggaaccggtgttctgcccgaccaccttccccaccagccacccgtccgtgcagtggaaggaggccgtgtacgacaaggccaagaacctccgcgtccgcatgtacaagccggcggtcgctgcagccgccgcctccggcggcagcggcgatgcctccgggaacaagctgccggtgctcgtgcacttccacggcggcggcttctgcctcgggtcgtgcacgtgggggaacgtccacgcgttctgcctccgcctcgccgcggacgccggcgccgtcgtgctctccgccgggtaccgcctcgccccggagcaccggctcccggcggccctcgacgacggcgccagtttcatgcgctggctccgggatcagtccgcgaacgccgccgaggccgatgcctggctcaccgaggccgccgacttccggcgcgtgttcgtcaccggcgactcggcgggcggcaccatagcgcaccacctcgccgtgcgcgccggctcggccgcggcggcggagccaggcgagacgacagcggcggcggaccccgtcacggtcctcggctacgtcctgatgatgccgttcttcggcggcgtccggcgcacctcgtcggaggcggagtgccccgcggaggcgttcccgaacctcgacgtggtcgaccggttctggcggctgtcgctgccggccggagccaccagggaccacccggcggcgaacccgttcgggccggacagccccgacctcgccgcggcggagctccggccggtcctcgtggtggccggcggcctcgacctgctacgcgaccgcaccgtcgactacgcggagcggctggcggcgacgggcaagcccgtggagctcgccgagttcgccggcaaggtccacgggttctacctgcacgagccggggtccgaggccaccggcgagctgatccaggccgtggcccgtttcgtcgacggctgcgtcgctgcgacagaggctgctgctgctgctgctgcttaattatttactccgatccgtgcatgtgtcacgtccctataggaggcgtcgacgaccgtcaagttcaataacttgcgtgtgtatcagtgtgtgctgaggtgtccatttatgcgtgccattctctcttagtcgcatgatgatgtatgaattcaggcgtgtaaaaaaaaaaaaaaaaaaaa

SEQ ID NO: 5236 - protein, 366 aa, Panicum virgatum
  misc_feature: Ceres CLONE 1817205
  misc_feature (1)..(230): Pfam Name: Abhydrolase_3 Pfam Description: alpha/beta hydrolase fold
MPAVSAAACCAAATPASEVVEDLFGFLRVLSDGTILRSPAEPVFCPTTFPTSHPSVQWKEAVYDKAKNLRVRMYKPAVAAAAASGGSGDASGNKLPVLVHFHGGGFCLGSCTWGNVHAFCLRLAADAGAVVLSAGYRLAPEHRLPAALDDGASFMRWLRDQSANAAEADAWLTEAADFRRVFVTGDSAGGTIAHHLAVRAGSAAAAEPGETTAAADPVTVLGYVLMMPFFGGVRRTSSEAECPAEAFPNLDVVDRFWRLSLPAGATRDHPAANPFGPDSPDLAAAELRPVLVVAGGLDLLRDRTVDYAERLAATGKPVELAEFAGKVHGFYLHEPGSEATGELIQAVARFVDGCVAATEAAAAAAA

SEQ ID NO: 5237 - DNA, 1141 bp, Panicum virgatum
  misc_feature: Ceres CLONE 1817220
  misc_feature: Encodes the peptide sequence at SEQ ID NO. 5238
gcgctcgccgcaagacagccttcctccccctcgccgcggaggcgccggagatgcaggccacggcggcggccttcctcgcccgcccgcacccgcggctcctccgcatcggacgatggggcccggatggcgtcgcgttggtgcgcggcgggatcctcgcgctgccgccgcggctgcggggcccgcggtgctccatgagcgtctccatcggccgtggcgccggcgccagcgaagaccgcgggttcagctacgagcatgttccagtgttcccaagataccgaattcgagatccctacaagcttcttggcattgatcgtgacgcatctgaagaagagatccgaagtgcaaggaagtttcttattcaacaatatgctgggcatgaaccgagtgaagaagctattgaaggcgcttatgagaagataattatgaagagctaccagcagcggaagaagacaaaaatcaatctgaaaaccaagttaaagaagcgagtagaggaatccccatcatgggtcaaggcattgcttggttactttgaggttccatcaatggatatcatttccagaagattgttcttctttgctttcattgctgggtggagcatagcaacttctgctgagaatggacctgcattccagcttgcaatatcactcttctcatgcatatacttcctcaacgacaagatgaagaacctcctcagggcctcaaccaccgggtttggagtacttgttggcggctggattgttggttctctattggtcccactgatcccgacattcatcatcccaccttcatggtccctagagcttctcacctcgctggttgcttacgttttcttattcctgggatgcacattcctcaaataaaactcttttcaatcttgtaacccaaaaccgtagaatcgtttgaaaaaattttgtgatgactgacagccctgcatctgagttccagaaagtttccacgcgtgctagcgttacttttgagcactaaatctcggctttcaaccgcctgttcgaatattttaagtcagctcatgtgcactattgttttctccatagtgacagtgcatggaggaaggtgatgttctgtccttccagcggtcaattttgtgctttatttagtgaactaaaaaaaaaaaaaaaaaaaa

SEQ ID NO: 5238 - protein, 269 aa, Panicum virgatum
  misc_feature: Ceres CLONE 1817220
  misc_feature: Great-hit functional homolog of the protein sequence given in SEQ ID NO 9338
  misc_feature: Useful for making plants with altered protein content
MQATAAAFLARPHPRLLRIGRWGPDGVALVRGGILALPPRLRGPRCSMSVSIGRGAGASEDRGFSYEHVPVFPRYRIRDPYKLLGIDRDASEEEIRSARKFLIQQYAGHEPSEEAIEGAYEKIIMKSYQQRKKTKINLKTKLKKRVEESPSWVKALLGYFEVPSMDIISRRLFFFAFIAGWSIATSAENGPAFQLAISLFSCIYFLNDKMKNLLRASTTGFGVLVGGWIVGSLLVPLIPTFIIPPSWSLELLTSLVAYVFLFLGCTFLK

SEQ ID NO: 5239 - DNA, 1171 bp, Panicum virgatum
  misc_feature: Ceres CLONE 1817238
  misc_feature: Encodes the peptide sequence at SEQ ID NO. 5240
caccttccaaccccaatctcctagatagccccaagccaagatctgcgcgggcagtcaccggcgaagcaccggctaccatggccgtggacctcatgggctgctacgcccctcgccgcgccaacgaccagctcgccatccaggaggcggcggcggccggcctccgcagcctggagctcctggtctcgtccctttcctcccaggccgcggcaccgcacaaggccgcccagcaccttcagcagcagcagcagccgttcggcgagatcgccgaccaggccgtctccaagttccgcaaggtgatctccatcctggaccgcaccggccacgcccgcttccgccgcgggcccgtggactcgccggccccggccgccgccccagtggtggcttcccctgctcctcccccggcgccgctgcagcacgtggcgcccgtcagcgtggcgcagccggcgccggccccgcagccgcagagcctgacgctggacttcacgaagccgaacctgaccatgtccggcgcgacgtccgtgacctcgacgtccttcttctcctcggtgaccgccggcgagggaagcgtctccaagggccgcagcctgatgtccgccgggaagccgccgctgtccgggcacaagcggaagccctgcgccggcgcgcactccgaggccaccgctaacggcagccgctgccactgctccaagagaaggaaaaaccgtgtgaagaggaccatcagagtgccggcgatcagctccaagatcgccgacatcccgccggatgagtactcctggaggaagtacggccagaaacccatcaagggctccccttacccacggggctactacaaatgcagcaccgtccgtgggtgcccggcgaggaagcacgtggagcgcgccaccgacgaccccgcgatgctggtggtgacgtacgagggcgagcaccgccacacgccgggagccgccgggccgagccccctggcgacggcgtcgccggtggccgcccctctagccagcgtctccgccggcaacggccatgtctgagcctctgactaggatcagtagcttccttttgccccccttcttttttgagtcgcttctcaatctgatccccgtgtaaaaaagaaacaagattgtactagaaaagagggagaggacaccttcgatgccaaaaaaaaaaaaaaaaaaaa

SEQ ID NO: 5240 - protein, 315 aa, Panicum virgatum
  misc_feature: Ceres CLONE 1817238
  misc_feature: The sequence is a functional homolog of  SEQ ID NO 1277 in the  11/479,226 US patent application
  misc_feature: The sequence is a functional homolog of  SEQ ID NO 2442 in the  10/374,780 US patent application
  misc_feature: The sequence is a functional homolog of  SEQ ID NO 48 in the  11/375,241 US patent application
  misc_feature: The sequence is a functional homolog of  SEQ ID NO 590 in the  10/412,699 US patent application
  misc_feature: The sequence is a functional homolog of  SEQ ID NO 632 in the  11/435,388 US patent application
  misc_feature: Useful for making plants with modulated growth and phenotype characteristics
MAVDLMGCYAPRRANDQLAIQEAAAAGLRSLELLVSSLSSQAAAPHKAAQHLQQQQQPFGEIADQAVSKFRKVISILDRTGHARFRRGPVDSPAPAAAPVVASPAPPPAPLQHVAPVSVAQPAPAPQPQSLTLDFTKPNLTMSGATSVTSTSFFSSVTAGEGSVSKGRSLMSAGKPPLSGHKRKPCAGAHSEATANGSRCHCSKRRKNRVKRTIRVPAISSKIADIPPDEYSWRKYGQKPIKGSPYPRGYYKCSTVRGCPARKHVERATDDPAMLVVTYEGEHRHTPGAAGPSPLATASPVAAPLASVSAGNGHV

SEQ ID NO: 5241 - DNA, 1148 bp, Panicum virgatum
  misc_feature: Ceres CLONE 1817243
  misc_feature: Encodes the peptide sequence at SEQ ID NO. 5242
gccgaaaggaggactgcgaaatatccgaagagctcgcggaaatggcgacggtgccgccgttcgccgtgctcgccgccgccccggcctcggctgcgccgagggtttgcatctccggagcctcagtccccgagcccttcctcggaacccgcgcgcgtctccgcctccgcagcgcgccgcggggcgtcgcctacgccctccgccgtaggccctccaaatacaagactaaaatccagagcgaggaggaggtggtggctgcagaagatgtcatggacgacgacgaggaggaggatggtgcattggaagcacttttcaagcagctggaagaagatcttgagaatgatgatttgtctgtcgatgacgatgaggatgagatatcagaagaagatatggccagatttgaaaaggagttggcagaagcaattgaagaagtcggtggtgttgctgaatcagcaggagattcattactgcgctctgcagaccacggtagtgatgagaaactagatgggggcgaacgaccagagctgaaaacctggcaactcaggagattggctcgtgcgctgaaaataggtcggcgtaaaactagtataaagaatcttgcaggggagttaggcttagatagggctttggtcattgaactgctccgcaatccaccaccaaaacttctactcatgtctgattctttgcctgatgaagccccttctaagcctgaagtgaaggaactagaaccccctagttcagccacagttgatgaggtcgataccactgaaactaagccgcaggaggagcttccagttcatgtcatgagtgcagaatggtctgcacggaaaagactaaaaaaggtgcaacttgagaccttggaaagagtctatttgtggagtaaacgccccacgaatacaatgatcagcagcatagttcaagtgacaaatcttccacgaaagaccattgttaagtggtttgaggatagaagggaacaagatggagtccctgaccatcatgttgcattcaagagatctttatctgagactgtagctagttcataacttcttcagataagcctttattatagtgtttgcatggaaaccattacgagcctgtaatttgaacttttaaagtatgacaagtttttgcaaaaaaaaaaaaaaaaaaaa

SEQ ID NO: 5242 - protein, 332 aa, Panicum virgatum
  misc_feature: Ceres CLONE 1817243
  misc_feature: Great-hit functional homolog of the protein sequence given in SEQ ID NO 9623
  misc_feature (1)..(50): Pfam Name: Homeobox Pfam Description: Homeobox domain
  misc_feature: Useful for making plants with altered alkaloid content
MATVPPFAVLAAAPASAAPRVCISGASVPEPFLGTRARLRLRSAPRGVAYALRRRPSKYKTKIQSEEEVVAAEDVMDDDEEEDGALEALFKQLEEDLENDDLSVDDDEDEISEEDMARFEKELAEAIEEVGGVAESAGDSLLRSADHGSDEKLDGGERPELKTWQLRRLARALKIGRRKTSIKNLAGELGLDRALVIELLRNPPPKLLLMSDSLPDEAPSKPEVKELEPPSSATVDEVDTTETKPQEELPVHVMSAEWSARKRLKKVQLETLERVYLWSKRPTNTMISSIVQVTNLPRKTIVKWFEDRREQDGVPDHHVAFKRSLSETVASS

SEQ ID NO: 5243 - DNA, 1310 bp, Panicum virgatum
  misc_feature: Ceres CLONE 1817266
  misc_feature: Encodes the peptide sequence at SEQ ID NO. 5244
gggcaccatcccaaaaacccgaaagaaatcgaatcaagttgggggagaaaaaaagaaaaagggggaagagcacgcgccgccgccagcaccgcgcccgccatggccgctgcctcctcccgccgcgcgtcgcagctgctggggtccgccgcctcccgcctcctccacgcgcggggcttcgcagcggctgccgccgccgcgccctcgccggcggtcttcgtcgacaagagcacccgcgtgatctgccagggaatcacggggaagaatggcaccttccacaccgagcaggccatcgagtacggcaccaacatggttggtggagtgactcctaagaaaggtggaactgaacatttagggcttccagtgtttaactctgtagctgaggctaaggctgaaacaaaggccaatgcatctgttatatatgttccaccaccatttgctgctgctgctataatggaggcaatggaggctgagctcgaccttgttgtctgcattacagaaggaattcctcagcatgacatggtgaaagtgaaggctgcattaaacaagcagtcaaaaactcgattgattgggccgaattgccctggtatcattaagcctggtgaatgtaaaattggaatcatgccaggttacatccacaagcctgggcgtgttgggatcgtatctcgttctggtaccttgacatatgaagcggtgtttcaaacaactgctgtcggcttggggcagtcaacttgtgtaggcattggtggtgacccattcaatggcacaaattttgttgattgccttgaaaagtttgttgacgatcctcaaacagaaggtattgttctcattggtgaaattggaggtactgctgaggaggatgctgcagcattcatccaggaaagcaaaacacaaaagcctgttgttgcattcattgctggacttacggcacccccgggccgtcgcatgggtcatgctggagcaattgtatcaggaggaaagggtactgcccaggacaaaatcaaggcactcagagaggctggtgtcactgtcgtcgagtcgccagcaaagattggttctaccatgtttgaaatcttcaagcagcgtggaatggtagaatagagggacgaaatagtacagttgagattggaaaacctctttttggtgctcgtggggtaattgcgagcaattccttggtagagccgcgtcgctggccactaaacaaaaccacttcggcttccttttcttcctcaattgtatgcggtgtgcaccaggatcctttccatgagctcatcaataagacattctggagtcaaaaaaaaaaaaaaaaaaaa

SEQ ID NO: 5244 - protein, 332 aa, Panicum virgatum
  misc_feature: Ceres CLONE 1817266
  misc_feature (1)..(143): Pfam Name: Ligase_CoA Pfam Description: CoA-ligase
  misc_feature (2)..(332): SWISSPROT Homolog: EC 6.2.1.4 Succinyl-CoA ligase [GDP-forming] subunit alpha-1, mitochondrial precursor
  misc_feature (20)..(332): SWISSPROT Homolog: EC 6.2.1.4 Succinyl-CoA ligase [GDP-forming] subunit alpha-2, mitochondrial precursor
MAAASSRRASQLLGSAASRLLHARGFAAAAAAAPSPAVFVDKSTRVICQGITGKNGTFHTEQAIEYGTNMVGGVTPKKGGTEHLGLPVFNSVAEAKAETKANASVIYVPPPFAAAAIMEAMEAELDLVVCITEGIPQHDMVKVKAALNKQSKTRLIGPNCPGIIKPGECKIGIMPGYIHKPGRVGIVSRSGTLTYEAVFQTTAVGLGQSTCVGIGGDPFNGTNFVDCLEKFVDDPQTEGIVLIGEIGGTAEEDAAAFIQESKTQKPVVAFIAGLTAPPGRRMGHAGAIVSGGKGTAQDKIKALREAGVTVVESPAKIGSTMFEIFKQRGMVE

SEQ ID NO: 5245 - DNA, 1448 bp, Panicum virgatum
  misc_feature: Ceres CLONE 1817267
  misc_feature: Encodes the peptide sequence at SEQ ID NO. 5246
acacctgcacgccccgcgccagcgacggccatggcggccgagctcctgtcgccgctcctaccgcggcgtcgacggggcctcgctgtcgccgcggcggcgccactgctcgcgctcctcctcgtcgctgtcatcttcttccgcgcaccgctgacgacgacggtgagctctccggagcgcgtcgacctgactctggtcgccggcgctcgggagaagggcgcggtgtgcttggatgggagcccgcctgcttaccaactgcggagaggctccggctccggtgctcacaactggctcatctatcttgagggaggaagttggtgcaacaccacacaaagttgctatgcgcaaacaatgagcaactttggttcatctaagtttatgagaccagtaaactttagtgggatactcagcaaagatcacctagaaaatcctgatttctacgactggaatatagtttatgtaaggtactgtgacggagcatcatttgctggggatgcagagggtgaagatctggatggaaccaaacttttcttcagaggattgcgcatctgggaagcagttgttgatgaactaatgggaaaaggaatggacaatgctaaacagacgttgctcacaggctgttctgctggttctctagctgcattgctgcactgtgataattttcgtggacggttacctcaagaggttccagttaaatgcctttctgatgctggattttttattgacgtgaaagatttatctggagaaaggtccatatggtcgttcttcaatggagtagttcaccttcataatattagagaagttctacccaaggactgcctccaaaataaggatccaacagagtgtttctttgcttctgaactgattaagagcatcagcacccccacatttattctgaactcagattacgatgtttggcagatacaaaacattctcgcaccaaatggatcctatcctggacaggcatggtcgagttgcaaagcagatattcggaactgcagttccacacaaattgatgtgctgcatggattcaggaagaaattagtcagtaaattgaaggttgctgaagataagaggaactgggggctcttcatcgattcatgcttcacccactgtcaaacgccatccaacatctcatggcattcgccggtctcaccaagacttgatgacaggactatcgcagaggctgttggggattggtattttggtagaaggcaagatgtgaaactgatcgactgcgagtacccatgtaatcccacatgcagcagtcttctatctactgcttgattcactcaggactgcgttgatatcaccagtcttttctcatttttcacagttcttttttacctcaagtacaaatttgttttgatgtggattcaataatattcatctgtttgggatttggagaataaagttggttatcttttggttaaaaaaaaaaaaaaaaaaaa

SEQ ID NO: 5246 - protein, 417 aa, Panicum virgatum
  misc_feature: Ceres CLONE 1817267
  misc_feature: Great-hit functional homolog of the protein sequence encoded by LOCUS At3g09410
  misc_feature: Great-hit functional homolog of the protein sequence encoded by LOCUS At3g09420
  misc_feature (14)..(368): Pfam Name: PAE Pfam Description: Pectinacetylesterase
  misc_feature: Useful for making plants with altered cell wall content and/or composition
MAAELLSPLLPRRRRGLAVAAAAPLLALLLVAVIFFRAPLTTTVSSPERVDLTLVAGAREKGAVCLDGSPPAYQLRRGSGSGAHNWLIYLEGGSWCNTTQSCYAQTMSNFGSSKFMRPVNFSGILSKDHLENPDFYDWNIVYVRYCDGASFAGDAEGEDLDGTKLFFRGLRIWEAVVDELMGKGMDNAKQTLLTGCSAGSLAALLHCDNFRGRLPQEVPVKCLSDAGFFIDVKDLSGERSIWSFFNGVVHLHNIREVLPKDCLQNKDPTECFFASELIKSISTPTFILNSDYDVWQIQNILAPNGSYPGQAWSSCKADIRNCSSTQIDVLHGFRKKLVSKLKVAEDKRNWGLFIDSCFTHCQTPSNISWHSPVSPRLDDRTIAEAVGDWYFGRRQDVKLIDCEYPCNPTCSSLLSTA

SEQ ID NO: 5247 - DNA, 1262 bp, Panicum virgatum
  misc_feature: Ceres CLONE 1817361
  misc_feature: Encodes the peptide sequence at SEQ ID NO. 5248
aatcccgcccaccgccagtccgccgcccgccgtcgcgaacccgcggcccgccgctcccgactgcaccgcacgatgaggtccctgcgagcggcgcggactttccgctccctcctctccgcccgcccgctccacggcgcggcctccccagcggcggctgccgccgcctccgccgccgctggctcgaggtggtgcgctccgctggtgccatcgccccgcttgccgcctccatccccgagggcgatgccggccggggtcgctggcgccgtgtccttctccctcaccttcgctactgtagcggcggcggaggcgaaggcgaaggagcggccgcctacggatctgttgccgcggaatgtggtgctgtaccagtaccaggcgtgccccttctgcaacaaggtcagagcctttttagactatcatgatataccatacaaggttgtggaagttaatccattgagcaaaaaggaaatcaagtggtctgattacaagaaagtcccaatattgacggtagatggtgaacagcttgttgattcatcagatataatcaatatactacagcacaggatcagacctgatgatgaactcacaaatgaagaagaagcaaagtggcgaaggtgggttgatgagcaccttgtgcacatgttgtctcctaacatatatcggacaacttcagaagctctagaatcttttgactacattgcccaacatggtaatttcagttttacagagaggtttgctgtgaagtatgctggtgctgcggccatgtacatggtatcgaagaagctaaagaagaaatacaatatcactgacgagcgtgcttcattgtatgatgctgccaacacatgggtcgaagccctgaatggaagagatttcctaggtggttccaagcctaacttggcagaccttgccgtcttcggtgttctgagacctattcggtacttgagagctggaaaagatatggttgagaatactcaaatcggtgagtggtaccagcgaatggaagatgcagttggagaaccatcaagaattcaggagtagaaggaaactatacttttgacatcggaatatgtcctagacatcaaactattcaaaattttgccaaaatctagtgtatgaaataattctttgccatacacaatgcacggaggaactgtgttttgacctggaaacatctttgtggttgtttgtactctgacaatggggtgcaactttgaataccacggcggaaccgagtgttttgacttgaaaaaaaaaaaaaaaaaaaa

SEQ ID NO: 5248 - protein, 320 aa, Panicum virgatum
  misc_feature: Ceres CLONE 1817361
  misc_feature (1)..(51): Pfam Name: GST_C Pfam Description: Glutathione S-transferase, C-terminal domain
  misc_feature (1)..(58): Pfam Name: Glutaredoxin Pfam Description: Glutaredoxin
  misc_feature (174)..(316): SWISSPROT Homolog: EC 5.3.99.3 Prostaglandin E synthase 2
MRSLRAARTFRSLLSARPLHGAASPAAAAAASAAAGSRWCAPLVPSPRLPPPSPRAMPAGVAGAVSFSLTFATVAAAEAKAKERPPTDLLPRNVVLYQYQACPFCNKVRAFLDYHDIPYKVVEVNPLSKKEIKWSDYKKVPILTVDGEQLVDSSDIINILQHRIRPDDELTNEEEAKWRRWVDEHLVHMLSPNIYRTTSEALESFDYIAQHGNFSFTERFAVKYAGAAAMYMVSKKLKKKYNITDERASLYDAANTWVEALNGRDFLGGSKPNLADLAVFGVLRPIRYLRAGKDMVENTQIGEWYQRMEDAVGEPSRIQE

SEQ ID NO: 5249 - DNA, 953 bp, Panicum virgatum
  misc_feature: Ceres CLONE 1817452
  misc_feature: Encodes the peptide sequence at SEQ ID NO. 5250
cctccgaatcatccacgaacaagaggagaggagaggagaccacgtcctgcgcttgcgcagtggttgcccgccaccaactccaagaagagctcgcgcgcggctcgccagaggcggcagctagctagcagcaatggcggccaccaacccatgaccaggcgccacggctacctatactaaaccctcctccagccgccgccgcaccgtcggtcaagaaacgcaagtagctaggcgcggagatcctgcgcccaccgtctccggcgatcgacgatgatggtgatgggctacttccggtccaccaaggcctccaccgcgacgtcgccgccgacggccaggaagaaggcgaagaaggacggtcgccgggcggcggcgcaagaggacgcgggccttcgggagtcgctgctggagcagccggccgcggccgcggcggagggcggcgtgcccaaggggtacttcgcagtgtacgccggggaggagtcccggcggttcgtcgtgcccacggggtacctccgggagccggcgttccgggaactcatggagcgcgccgccgacgagttcggcttcgcgcaggccggcggcctgcgcgtgccgtgcgccgaggaggacttcgaggacctcctgcgccgcctccagcgcaagaacgccgccgccggcaaggggaagaaggccatcctgtaggcgagtggagaattgcttgacgtgtagatgagatcagctctgctcagctgagggtgcagctctcctgtacagacaatacagagtgcgagcaagcagccacatgcatgcaggcgtagcatagcataggtgaatgcatggtgtgttgattcactgttcgttccgtgaaacatggagtatgtagaaaattcttggggggaattgagttatttagtcttcaaaacttgtaagatttgaatttgagtcaaatttctagtgttgaaaaaaaaaaaaaaaaaaaa

SEQ ID NO: 5250 - protein, 135 aa, Panicum virgatum
  misc_feature: Ceres CLONE 1817452
  misc_feature (10)..(92): Pfam Name: Auxin_inducible Pfam Description: Auxin responsive protein
MMVMGYFRSTKASTATSPPTARKKAKKDGRRAAAQEDAGLRESLLEQPAAAAAEGGVPKGYFAVYAGEESRRFVVPTGYLREPAFRELMERAADEFGFAQAGGLRVPCAEEDFEDLLRRLQRKNAAAGKGKKAIL

SEQ ID NO: 5251 - DNA, 1188 bp, Panicum virgatum
  misc_feature: Ceres CLONE 1817500
  misc_feature: Encodes the peptide sequence at SEQ ID NO. 5252
gcccagtcccgcggccgagccagcgacggaagaacagagcacaccggaccggcggcggcgaacccgcgcagagctcggctcaatcatggatccggagatgggcgacagctactgggaggagacgcagcgctacctcgagtaccaggagctcagcatctacctggaggcgcaggaggacgccatgtcctgctacgactccagctcgccggacgggtccaactcccattcctcctcggctccggcaggtgatggtaagggagccggcagcggcggcgccggccgcgccacggatggggccaacaagaacatcatcatggagcgcgaccgccgccgcaagctcaacgagaagctctacgcgctgcgcagcgtcgtgcccaacatcaccaagatggacaaggcgtcgatcatcaaggacgcgatcgagtacatccagcagctgcaggcggaggagcggcaggtgctgcaggaggtgcgagcgctcgagtccgccgccggcgtgccgcaggcggaggagtgctacgcgctcggcgacgagggcctcctcccgctcgaggcggcggagcggacgaagaagccgaagcgcgcgcggtcggtgccgccgtccgtcgccgcgccgccgccgcccccgcccgtggaggtcctggagctgcgcgtgtcggaggtgggcgagcgcgtgctggtggtgagcctgacgtgcagcaagcgccgcgacgccatggcccgggtctgccgcgccatcgaggagctccagctccgcgtcatcaccgccagcgtcacctccgtcgccggatgcctcatgcacaccgtcttcgtcgaggtagatcaaatggatgggatccagatgaagcagatggtcgaggttgctctcgcccagatcgacgccaccggaagcccgccaagttccatgagctattaggatgagggctgactatatcaagatatggtagtttttcgtctagtttgccaacgtagtccctcgccggataagaagtatgctgtgtgtttgctgtgtgctgcccttttctcaacatcccccttacgcatatgggaggtgaggcagcgggtcaaagtttaggtagtagactgagcaagagtttggacttccaagtttcagaactattgcacgtatatggtaatgaagaataacaaggggactcacccgttaatgaaaaaaaaaaaaaaaaaaaa

SEQ ID NO: 5252 - protein, 276 aa, Panicum virgatum
  misc_feature: Ceres CLONE 1817500
  misc_feature (1)..(48): Pfam Name: HLH Pfam Description: Helix-loop-helix DNA-binding domain
  misc_feature: The sequence is a functional homolog of  SEQ ID NO 1195 in the  11/479,226 US patent application
  misc_feature: The sequence is a functional homolog of  SEQ ID NO 538 in the  10/412,699 US patent application
  misc_feature: Useful for making plants with modulated growth and phenotype characteristics
MDPEMGDSYWEETQRYLEYQELSIYLEAQEDAMSCYDSSSPDGSNSHSSSAPAGDGKGAGSGGAGRATDGANKNIIMERDRRRKLNEKLYALRSVVPNITKMDKASIIKDAIEYIQQLQAEERQVLQEVRALESAAGVPQAEECYALGDEGLLPLEAAERTKKPKRARSVPPSVAAPPPPPPVEVLELRVSEVGERVLVVSLTCSKRRDAMARVCRAIEELQLRVITASVTSVAGCLMHTVFVEVDQMDGIQMKQMVEVALAQIDATGSPPSSMSY

SEQ ID NO: 5253 - DNA, 1455 bp, Panicum virgatum
  misc_feature: Ceres CLONE 1817533
  misc_feature: Encodes the peptide sequence at SEQ ID NO. 5254
attactcgtggcccctcgttagcttgccctcttcctcctctttatcagtttcccttccattgcatttgcatgcctttacattgcaatcgcaagcctcctcctaccacccttcctccctctcaaagcagccaagcaagaagccaaacagccagccagcgagcaagaagccgcgcgagctagcagagggagcaggaaggcgaggaggtgaggagcgaggtggctgcggcggcggcaatggcggcggacctggggttcgaggagaccgagctccggctgggcctgcccggtggcggcgggggaggggttggagacggcgaggggacaaggagcgcctccggcaagaggggcttcgccgagaccatcgacctcaagctgaagctggagccggcggcggcggccgtcgtggaagaggagaaggaggtagtggatgccgccaaggaggccgcggcggcgaccgaggagtccccggccgggaagatgaagcggtcgcccagccagagcagcgtcgtcaccgccgccgcctcgcagcccgaccccgccgagaagccgcgcgcccccaaggctcaggtggtcggatggccgccggtgcgctcgttccggaagaacatcatgtctgtgcagtccgagaagggcgccggcagcaaggacgccgacgccgacaagtcctcgccggcagccggcggcggcgccgcgttcgtgaaggtgagcctggacggcgcgccgtacctgcgcaaggtggacctcaagatgtacaagagctaccaggagctgtccaaggctctcgagaagatggtcagctccttcaccaatggaagctgtgggtcccaagggatgaacggcatgaacgagagcaagctggtggatctgcttaacggctccgagtacgtgctgacctacgaggacaaggacggcgactggatgctcgtcggcgacgtcccatgggagatgttcgtcgaatcgtgcaagcgccttcggatcatgaagggatcagaagccattggcctggcgccaagggccatggagaaatgcaagaacagaagctgaacacatgggccgccagccagatgcaaggaccaagtctctagctctgcagctctgctcgtctctgtatcatactcgtccctgttctccaagcctgtacctcctgatcagtgaagtcattttggtgtgtcaactgttctatcagttccagtgagtcagtcagccagccaggcagtcagtcagtcagtgttcaagtttcatcttgtcatatacaaaagagagaaaccatgaataacatgtatctgtcctataacaatgtctttttgctctacctgctctttttctttgttgggcacaaaatgcaaaggcaccctgctcctaatcaaggggcccttttgcatcttgtccaccaaaagttgtttaattatattaccatggtgtgtcaatggaacaaataattgttgcaaaaaaacg

SEQ ID NO: 5254 - protein, 269 aa, Panicum virgatum
  misc_feature: Ceres CLONE 1817533
  misc_feature (1)..(265): Pfam Name: AUX_IAA Pfam Description: AUX/IAA family
  misc_feature: The sequence is a functional homolog of  SEQ ID NO 2006 in the  10/374,780 US patent application
  misc_feature: The sequence is a functional homolog of  SEQ ID NO 288 in the  10/412,699 US patent application
  misc_feature: The sequence is a functional homolog of  SEQ ID NO 664 in the  11/479,226 US patent application
  misc_feature: Useful for making plants with modulated growth and phenotype characteristics
MAADLGFEETELRLGLPGGGGGGVGDGEGTRSASGKRGFAETIDLKLKLEPAAAAVVEEEKEVVDAAKEAAAATEESPAGKMKRSPSQSSVVTAAASQPDPAEKPRAPKAQVVGWPPVRSFRKNIMSVQSEKGAGSKDADADKSSPAAGGGAAFVKVSLDGAPYLRKVDLKMYKSYQELSKALEKMVSSFTNGSCGSQGMNGMNESKLVDLLNGSEYVLTYEDKDGDWMLVGDVPWEMFVESCKRLRIMKGSEAIGLAPRAMEKCKNRS

SEQ ID NO: 5255 - DNA, 1492 bp, Panicum virgatum
  misc_feature: Ceres CLONE 1817599
  misc_feature: Encodes the peptide sequence at SEQ ID NO. 5256
acccttcccgctccgccgccgaagccgcagcgccgctccccctcgccgccgctgcaaatggccgccgccgcgcgccccctggtctccgtgagggccctggagggcgatatggcgacggactccgccggcgccccgctgccggacgtcctccgcgcgccgatccgccccgacatcgtccgcttcgtccacaagctcctgtcctgcaacagccgccagccctacgcggtgtcgcgccgcgccggtcaccagacctccgcggagtcctggggaacggggcgtgcggtgtcccgtatcccccgtgttcccggcggcggaacccaccgcgctggccagggagccttcggtaacatgtgccgtggcggacgcatgttcgcgcccaccaagatctggcgccgctggcaccgtcgcgtcaacatccacctccgccgcgtcgccgtcgcctccgccctcgccgccaccgctgtcccgtccctcgtcctcgcccgcggccaccgcgtggagtccgtccccgagctcccgctcgtcgtctccgactctgcggagtccattgagaagacgacccaggccatcaagatcctcaagcagctcggtgcatacgctgatgctgagaaggccaagaactccgttggcatccgccccggcaaggggaagatgcgcaaccgtcgctacatcaaccgcaaggggcccctcattgtctacggcactgagggctctaagatcgtcaaggctttccgcaacctcccaggtgttgatgttgccaatgtcgagcgcctcaacctactcgacctcgcccctggtggccaccttggccggtttgtgatctggaccgaatgcgcgttcaagaagcttgatgaggtgtacggtaccttcgagacgccttcggctaagaagaagggtttcgtgctcccgaggcccaagatggccaacgctgacctgtctaggctcatcaactctgatgaggtgcagtctgtcgtgaagcccatcaacaaggtggttaagcgcagggagcctaggaagaacccgctgaagaacatggccgctgtgctcaagctgaacccgtacttgggcactgcgcgcaagatggcagctcttgctgaggcagcgcgtgtcaaggccaggaaggagaagttggactccaagaggaccaagctcagcccagaggaggcttctaaggtcaaggctgctggaaaggcgtggtacaagaccatgatctcggacagcgactacacagagtttgagaacttctccaagtggcttggtgtgacacagtgatcttccagcccaagtcttcgtagtttatcactgccacagtcaggaattatgattttgtttgctattatcttatgtcacttgctattgagatcatcagacatggtatcttgttttggttttggctttggtagttgtttaccgctggtcttttattacttccagactcctattatgagaacaaagtatatgcgaattttgacaaaaaaaaaaaaaaaaaaaa

SEQ ID NO: 5256 - protein, 404 aa, Panicum virgatum
  misc_feature: Ceres CLONE 1817599
  misc_feature: Great-hit functional homolog of the protein sequence given in SEQ ID NO 9421
  misc_feature: Useful for making plants with modulated biomass
  misc_feature: The plant is abnormally small.
MAAAARPLVSVRALEGDMATDSAGAPLPDVLRAPIRPDIVRFVHKLLSCNSRQPYAVSRRAGHQTSAESWGTGRAVSRIPRVPGGGTHRAGQGAFGNMCRGGRMFAPTKIWRRWHRRVNIHLRRVAVASALAATAVPSLVLARGHRVESVPELPLVVSDSAESIEKTTQAIKILKQLGAYADAEKAKNSVGIRPGKGKMRNRRYINRKGPLIVYGTEGSKIVKAFRNLPGVDVANVERLNLLDLAPGGHLGRFVIWTECAFKKLDEVYGTFETPSAKKKGFVLPRPKMANADLSRLINSDEVQSVVKPINKVVKRREPRKNPLKNMAAVLKLNPYLGTARKMAALAEAARVKARKEKLDSKRTKLSPEEASKVKAAGKAWYKTMISDSDYTEFENFSKWLGVTQ

SEQ ID NO: 5257 - DNA, 1635 bp, Panicum virgatum
  misc_feature: Ceres CLONE 1817641
  misc_feature: Encodes the peptide sequence at SEQ ID NO. 5258
actccacacaggcagtgacaccaacaccacccgaccaccgtgcgcgcggcgcggcgcggcggcatggcgagcgcggccgctcccagtcccctccccgtggccaccctctccgcgccccgcgcggtcgccgccgcggctccccacgcgctggggttcccgaggcgtctcaagccctccacgggagtcgcgccgcgctgcagcctgcgcgtcgtggcctccagttcgaaggtggacccggtcgaggagagagctcccgtcgcgccgcttgcgggctttcctgttccggccggtgcgtccccgccgggcccgtcgctggagcctcagccccaagtaagcaccggcacatggaaatggaggggctacaacattcgctaccagcaggccgggacgtcgggcccggcattggttctgattcatgggtttggggcaaacagtgatcattggcggaaaaatgttcctgttcttgccatggcaaatagggtttatgcaatagatctaattggttatggctattctgataagcctaatccgcgtgagcttggagagaacttttatacttttgagacatggggagagcagctgaatacgttttgtgctgaagtggtaaagagtgaagctttcttcatatgtaattcaattggaggggttgttggtctgcaggcagccgttatggaacctcagaaatgtaagggaattgttttattggatatttcactaagaatgcttcatatcaagaagcagccgtggtttggaaagcctttcatcaaatctttccaaagtctcctaaggaacactattgttgggaagctattttttaatgctgtcgctacaccagaatctgtgaaaaatatactttgccagtgctatcatgacacatctgcagtgacagatgagctagttcagattattctacagccagggcttgatccaggcgcagtggatgtattccttgagttcatctgctactctggaggacctctacctgaagagttgcttccattgatgaagtgtccagttttggtagcatggggggagaaggacccatgggagcctgtggagcttggaagagcctatgcatcttttgatacagttgaagattttgttgtcttgccagatgttggacactgccctcaggatgaagcacctgaacttctaaacccacttgtccaatcatttgttgagcgtcatagttagcacatgggtgaacctgctcttctatgtttcctgggaagggaacgcgtggttatgttattttgggataataaatgggcccttctgttgtaggccatgtacttgcatcttagtgccgttggcaaacatcatttggcaaattattattcaagtataggaaatcacaaggaaatatctgattttgttacagcaataggaagaacatgtctcctccgagcagagaggttagtaccagcaggcagcagcacagacacaatggttctattctagttgaagttatagtgaaagtgaacgcaagttcctacatgtatgtgtatatattacagcaaaaaaaaaagttcctgcatgatttgtatagacataacatttatgttgacacttgacttgaagtatctctttcggcaataaagaggaaaaagaaacgaaaaaaaaaaaaaaaaaaaa

SEQ ID NO: 5258 - protein, 376 aa, Panicum virgatum
  misc_feature: Ceres CLONE 1817641
  misc_feature (1)..(234): Pfam Name: Abhydrolase_1 Pfam Description: alpha/beta hydrolase fold
MASAAAPSPLPVATLSAPRAVAAAAPHALGFPRRLKPSTGVAPRCSLRVVASSSKVDPVEERAPVAPLAGFPVPAGASPPGPSLEPQPQVSTGTWKWRGYNIRYQQAGTSGPALVLIHGFGANSDHWRKNVPVLAMANRVYAIDLIGYGYSDKPNPRELGENFYTFETWGEQLNTFCAEVVKSEAFFICNSIGGVVGLQAAVMEPQKCKGIVLLDISLRMLHIKKQPWFGKPFIKSFQSLLRNTIVGKLFFNAVATPESVKNILCQCYHDTSAVTDELVQIILQPGLDPGAVDVFLEFICYSGGPLPEELLPLMKCPVLVAWGEKDPWEPVELGRAYASFDTVEDFVVLPDVGHCPQDEAPELLNPLVQSFVERHS

SEQ ID NO: 5259 - DNA, 1453 bp, Panicum virgatum
  misc_feature: Ceres CLONE 1817664
  misc_feature: Encodes the peptide sequence at SEQ ID NO. 5260
aagaaaacggaccggaaaacagagcagtcgaaccccaccggccaccggattccggatccacaccgccttccttctcctccctccctctcgcgggagccagatcagatacacgctgccgtctcatctgatggctcctctcctttccccgccgctgctcgcggactccgtcaccaagttccatacggcctcaacggcggtcccctgctccggcagctcactgcgatatgccatcacgtggttggccggggcaggaagaagagaccggcaccggtgtcggaggacgtggggaagtaggggcttgagggtggaagcggtggcggcggagtctcgcagctcggatggtggcgtcgctgaagattattacgctgttcttggcgtgatgccagatgcaacacctaagcagattaagaaagcgtactacaattgcatgaagtcatgccatcctgatcttagtgggaatgaccctgatgtgacgaatttctgcatgtttatcaacgaggtttacacggtgcttaccgatcccatccaacgggcagtgtatgatgagatccatggatacgctgctactgcaaccaatcctttcttggatgacagtgcaccccgggatcacgtgtttgtcgatgagtttagctgcataggatgcaagaactgtgctaatgtgtgttctaaggtctttcaaattgaggaagattttggacgggcaagagtttatgaccagtcaggcgacatagaactgattgaagaagctatcgagagttgtccagttgactgcattcattggacttcagctgcacaactatcactccttgaggatgaaatgcgcagagtagagagagtaaatgttggattgatgcttgctgggatgggaggttcaattgatgtgttccggatggcaagttcacgttgggagaaaagacaagccaaagtcctggaaaaggtgagaaggcgggtgagccaagatgattccagtaagggcggctcatggagtgatatctggggagcaccaacaagataccagaaaaatgaggaggagacaaaggagagagctaagcgagcggcggcggcggcgaggaggtggcgagagtactcgaggaaaggcgccgacaagccccccacattcaaactaccagaggcagtgtccaacaagcagtgagaacacggcaatgggagatttatgcagtactgcagccgatacttaacccccaatttacatcacgtatagcctaattattcacaggagagctgtagcctgtatagcggtagctctcccgccctcgattccacatcctatacctgtaaatcctctgttagtgatagctcagttcgtccattgcccatacctgtaaatcccagacgcgaaacaactgcacacaaaaatgcggcacttgcttctcttacaatcatgattttgtctgaagcatggacacatgcataaaaaaaaaaaaaaaaaaaa

SEQ ID NO: 5260 - protein, 341 aa, Panicum virgatum
  misc_feature: Ceres CLONE 1817664
  misc_feature (1)..(63): Pfam Name: DnaJ Pfam Description: DnaJ domain
MAPLLSPPLLADSVTKFHTASTAVPCSGSSLRYAITWLAGAGRRDRHRCRRTWGSRGLRVEAVAAESRSSDGGVAEDYYAVLGVMPDATPKQIKKAYYNCMKSCHPDLSGNDPDVTNFCMFINEVYTVLTDPIQRAVYDEIHGYAATATNPFLDDSAPRDHVFVDEFSCIGCKNCANVCSKVFQIEEDFGRARVYDQSGDIELIEEAIESCPVDCIHWTSAAQLSLLEDEMRRVERVNVGLMLAGMGGSIDVFRMASSRWEKRQAKVLEKVRRRVSQDDSSKGGSWSDIWGAPTRYQKNEEETKERAKRAAAAARRWREYSRKGADKPPTFKLPEAVSNKQ

SEQ ID NO: 5261 - DNA, 1136 bp, Panicum virgatum
  misc_feature: Ceres CLONE 1817693
  misc_feature: Encodes the peptide sequence at SEQ ID NO. 5262
aaaaaacccttgctctccccgcccacccattccttccttgctctccccccaaaggcatagctagctgctcctgcttccccaatccgcttcggcggtggatcggatcagcagcgatcgcatcgcgcctgctgctttccatggagagtgagagggagagggagatggagatggaggccgatcccgatagctcctccccctcggccggggccgacggcgccgccaccgcctccggcgagaccaaggcctgcgccgcctgccacaccaccaagaccccgctctggcgcggagggcccgagggacccaagtccctctgcaacgcctgcggcatccgctaccgcaagaggagacaggccctcggccacgccgccgccgacacgcagcaagatcagcagcggcagccgaaacggaaggccgccgatccgccggcggaggatcagcagcagctgctgctgccgaagaagaaggccgccgatccgccggcggaggatcaacagccgccgaagaagaaggccgcctccgccgccagcagcagcaccacctccaccaagaaagagaaagagagagacagggacaggaagcgaaaggatcggcaagtcaccgtggagctccgcgtggtggggttcggcaaggaggcggtgctcaagcagcgccgccagatgcgccgcgacaagtgcctgagccggctgagcgaggaagagatggcggccgtccacctcatggcgctctcctcgggcgtcatctacgcctcatgattagttcccatggccgcgtgccatcatccatccaaggggagagggagttgcagatctccctttttccccccttgcctcctctcatctccccacctccaagatcagatcatctgtagcagtcactagtcagtagtagttaagtgggagccgaagctgaacaacaagactccttaactttcctcctcccaataatccttgaaatcaatcaatcaatcctgtactagcatagtttttttttgcgaggactgtactggcttagctcatgggtctgtaatgctctagtagcaagtaagtatcccattcatgtaacaattgtgttttaggagcatcatcatgtatgtaatctccagtcctgtcctgacccaaaaaaaaaaaaaaaaaaaa

SEQ ID NO: 5262 - protein, 204 aa, Panicum virgatum
  misc_feature: Ceres CLONE 1817693
  misc_feature: Great-hit functional homolog of the protein sequence given in SEQ ID NO 9457
  misc_feature (1)..(36): Pfam Name: GATA Pfam Description: GATA zinc finger
  misc_feature: Useful for making plants with altered terpenoid content
MESEREREMEMEADPDSSSPSAGADGAATASGETKACAACHTTKTPLWRGGPEGPKSLCNACGIRYRKRRQALGHAAADTQQDQQRQPKRKAADPPAEDQQQLLLPKKKAADPPAEDQQPPKKKAASAASSSTTSTKKEKERDRDRKRKDRQVTVELRVVGFGKEAVLKQRRQMRRDKCLSRLSEEEMAAVHLMALSSGVIYAS

SEQ ID NO: 5263 - DNA, 1385 bp, Panicum virgatum
  misc_feature: Ceres CLONE 1817702
  misc_feature: Encodes the peptide sequence at SEQ ID NO. 5264
atctcaaatccatcagctgcaaacctacaactcaagcatcaaagccctactagtgctactacagcaactgcataacaacacttcacttccgttccagttgcacacttgcacataatctcctctcctcttccccggacacacaatcaacaatggtggtcccggtgatcgacttctccaagctcgatggcgccgagagagccgagaccatggcgcagatcgccaatggctgcgaggagtggggattctttcagctggtgaaccatggcatcccgctggagcttcttgagcgcgtcaagaaggtgtgctccgagtgctaccgcctccgggaggtcgggttcagggcgtcggagccggtgcgcacgctggaggcgctcgtgcaggcggagcagcgcggcgaggcggtgacgccggtggacgacatggactgggaggacatcttctacatccacgacggcaaccagtggccgtccgacccgccggcgttcaaggagacgatgcgcgagtaccgcgccgagctcaggaagctcgccgagcgcgtcatggaggccatggacgagaacctcggcctggagaagggtgccatccagcgcgccttctccggcgacgggcggcacgagccattcttcggcaccaaggtcagccactacccgccgtgcccgcggccggacctcatcacgggcctgcgcgcgcacacggacgccggcggcgtcatcctgctgttccaggacgaccaggtcggcggcctggaggtgctcaaggacggcgagtggaccgacgtgcagccgctcgcgggcgccatcgtcgtcaacaccggcgaccagatcgaggtgctcagcaacgggcgctaccgcagcgcgtggcaccgcgtgctgcccatgcgcgacggcaaccgccgctccatcgcctccttctacaacccggcgaacgaggccaccatctcgccggcggtggccagcggcgaggcgtaccccaagtacgtcttcggcgactacatggatgtctacgccaagcagaagttccaggccaaggagccaaggttcgaggccgtcaaggcgccgaagtcatctccagcagcttaaaagtaaaaaaaatattagtgaaattgaaaacaattatttattggtttgttggataaaatagcctaaataaatatttgaggtgtttcactgtgtaactatagtggcatggtatggtgatatattgctctagtaagtagtaataacaagtttgttaagcctttgatctcaaaaaaaaaaagagagagaaaggtttgtcaagtcttggtataggatagagttatggacatgcatatccatctcttggggtggttttcatgtacttaatgtgacaacgattgtaaaatcaaaactgtgatactattgttc

SEQ ID NO: 5264 - protein, 309 aa, Panicum virgatum
  misc_feature: Ceres CLONE 1817702
  misc_feature (1)..(101): Pfam Name: 2OG-FeII_Oxy Pfam Description: 2OG-Fe(II) oxygenase superfamily
  misc_feature (1)..(302): SWISSPROT Homolog: EC 1.14.17.4 1-aminocyclopropane-1-carboxylate oxidase
  misc_feature (4)..(309): SWISSPROT Homolog: EC 1.14.17.4 1-aminocyclopropane-1-carboxylate oxidase 1
MVVPVIDFSKLDGAERAETMAQIANGCEEWGFFQLVNHGIPLELLERVKKVCSECYRLREVGFRASEPVRTLEALVQAEQRGEAVTPVDDMDWEDIFYIHDGNQWPSDPPAFKETMREYRAELRKLAERVMEAMDENLGLEKGAIQRAFSGDGRHEPFFGTKVSHYPPCPRPDLITGLRAHTDAGGVILLFQDDQVGGLEVLKDGEWTDVQPLAGAIVVNTGDQIEVLSNGRYRSAWHRVLPMRDGNRRSIASFYNPANEATISPAVASGEAYPKYVFGDYMDVYAKQKFQAKEPRFEAVKAPKSSPAA

SEQ ID NO: 5265 - DNA, 1705 bp, Panicum virgatum
  misc_feature: Ceres CLONE 1817779
  misc_feature: Encodes the peptide sequence at SEQ ID NO. 5266
gtctcgcaccacccgcgctgaggggaggggcggtgcgcgctgcgcggcgggcggagatctcgggagggctccgatcgagccgaagcggcgggaggagggagggtggagcggagcggggcggagcgcggagcttgaggagaggagtagattggttcgatggtaagggagacggggtactacgacgtgctgggagtgaccccggcggccaccgaggcggagatcaagaaggcgtactacgtcaaggcgaggcaggtccatccggacaagaaccccaatgatccgctcgcggcggagaagttccaggaattgggggaggcataccaagtactcagtgaccccgcgcagcgtcaagcctatgactcatatgggaaatctggtatttcaacggaagccattattgatcctgcagcaatatttgcaatgctgtttggtagcgagctctttgaggattacattggtcaactggcgatggcatccatggcttcacttgatggttttagtgaagacgaacaaatcgatgccaggaagttgcaagagcaaatgcgagttgtacagaaggaaagggaagagaagctagcagaggcactgaagaatagattgcacctttatgttcaaggaaacaaagaggaatttatccagcatgctgaagctgaggtgactagactctctaatgcagcatatggtgttgacatgctgagtactattggttatgtgtactcaagacaagctgcaaaggagcttggaaagaaagctttatatcttggtgttccgtttatagctgaatggttcagaaacaaagggcattttattaaatcacaagtaacagctgcgacaggtgcaatagctcttatgcagctgcaggaagacttgaagaaacatctcagtgctgagtgcgactacaccgaagcggaactggaggcttacatgcagactcacaaaagtgttatggtggattccttgtggaagcttaatgttgctgatatagaggcaaccctatcacatgtgtgtcaaatggtgcttcaagacagcagtgtcaggaaagaggaactgagagctcgagctaaaggactgaaaactttaggcaaaatattccagcgtgttaagcaggctaccgagggagagccagcagcaatgaaaaatacaataaataactcagatgacaatgatggtagttctccggattcatcaccaaaatctcctagggatcaaatgttcgatgcaaatccaccttatgcccagagtccatacgtggaggcccctcgatccggcgattatttcttcccaatgcctgccgcaccacctggtgcacagagggaccccattccatgactgcttggagagcagcagctccgttttgtgtggatcgtcattttgtacaatattacttctgtagtagatgatggcatggtcaccatttttatttgtaacattagtagcattagagtgaggcagcagcttggtatccattgcatcttttcttttcttattttcttcagttgtgtaatcaatcgatcaagcatgcaacgacgtcagccttgtgttgtgtatagggctgcgggcaggcttgtgctgctgttgtgtgttgaggcagcaacaggtcagccattgttgtacatgaactatcacctccccgttgtttcatgtgtttatgggtgcataattgttttagcctaaggcctatctgcaaaaaaaaaaaaaaaaaaaa

SEQ ID NO: 5266 - protein, 390 aa, Panicum virgatum
  misc_feature: Ceres CLONE 1817779
  misc_feature (1)..(63): Pfam Name: DnaJ Pfam Description: DnaJ domain
MVRETGYYDVLGVTPAATEAEIKKAYYVKARQVHPDKNPNDPLAAEKFQELGEAYQVLSDPAQRQAYDSYGKSGISTEAIIDPAAIFAMLFGSELFEDYIGQLAMASMASLDGFSEDEQIDARKLQEQMRVVQKEREEKLAEALKNRLHLYVQGNKEEFIQHAEAEVTRLSNAAYGVDMLSTIGYVYSRQAAKELGKKALYLGVPFIAEWFRNKGHFIKSQVTAATGAIALMQLQEDLKKHLSAECDYTEAELEAYMQTHKSVMVDSLWKLNVADIEATLSHVCQMVLQDSSVRKEELRARAKGLKTLGKIFQRVKQATEGEPAAMKNTINNSDDNDGSSPDSSPKSPRDQMFDANPPYAQSPYVEAPRSGDYFFPMPAAPPGAQRDPIP

SEQ ID NO: 5267 - DNA, 1877 bp, Panicum virgatum
  misc_feature: Ceres CLONE 1817796
  misc_feature: Encodes the peptide sequence at SEQ ID NO. 5268
tcttccgaggagcccggcgcgaaaaagaaaggagccgcgaatttcgctacggccacaacgcgcagccgccgcggcgcgccgtgctcgctcctttctcgccgcgtctggtgtccggccaccccacgtcggcccacccccgctgcggctgcctgtcccgatgaggccgccggaggtggcggtggccgttaccgcggccgtcgcggtggcggcgctcctcacgccctgggcggccgcggccgcagcggcctcggttccgttgctgccggcggcactggcgctgcagcgcgcggtgccgcacaagggggtcgccctggaggagctgaggcagcgggactgggtgcggcaccggagctccaggagggggcttctcgggggcgtcgccggtgtggtggacttccccgtcgagggctccgccaacccgttcatggtcgggctctactttacccatgtgaaattgggaaacccggcaaaggaattctttgtccagattgacactggcagcgatatactgtgggtaacttgcagtccttgtactggttgcccgacatcaagtggactcaatatccagttggagtccttcagccctgacacttcatcaacatcatccagaataacatgctctgatgatagatgtacagctgcactccaaacaggggaagcagtctgccaaacctcagattccccaagcagcccttgtgtgtacactttcacctatggtgatggaagtgggacatcaggttactatgtgtctgacaccatgtattttgatactgtcatgggaaatgagcagactgccaattcgtctgcctctattgttttcggatgtagcaactcacagtcaggagacctgacaaaggcagatagagctgttgatgggatttttgggtttggacagcatcagttgtctgtcatctcacaactgaattcacttggagtgtcccctagggtgttttctcactgcctgaaaggttctgacaatggtggtggcattcttgtgcttggtgaaattgtggagccaggcttagtctataccccactggttccatcacagcctcattacaacttgtatctggaaagcatcgctgtcaatggtcaaaagctacccattgattcctccttgtttacaacgtcaaatacacaaggaacaattgtggattcaggaacaacattggcataccttgcagatggagcctatgatccatttgttactgcgatagctggtgcagtctctccatctgtacgctctcttgtcagcaaagggaaccaatgctttcttacttccagcagtgtcgactcatcatttccaaccgtgaccctttattttaggggtggtgttgcgatgacggttaagccagagaactatcttttgcagcaggcttcagttgacaacaatgtattgtggtgcattggttggcaaaggaaccagggccaagaaataactatactcggagatcttgtcttaaaagataagatattcgtgtacgacttggcgaacatgcgcatgggctgggctgattacgactgttcgatgccggtgaacgtcaccacatcgtcagggaagaaccagtacgtgaacactgggcagtacgacgtgaacggctccacgcggcgcgcgtcgtacaagagcttgataccagccgggatcgccgccatggttgtgcatatgctcgttttcggtggcggcgtctcgcatagatagcagtgcaggcagggttactgacaatgtgattcgattctttattgcgttggtgtattcagagctgagagacgccgccgtctctgctgcccctagtcagtcgtcagttccacgggcggagaagaactgccatgacctgagcattcttactgtacatacagaaaaaaaaaaaaaaaaaaaa

SEQ ID NO: 5268 - protein, 513 aa, Panicum virgatum
  misc_feature: Ceres CLONE 1817796
  misc_feature (1)..(360): Pfam Name: Asp Pfam Description: Eukaryotic aspartyl protease
MRPPEVAVAVTAAVAVAALLTPWAAAAAAASVPLLPAALALQRAVPHKGVALEELRQRDWVRHRSSRRGLLGGVAGVVDFPVEGSANPFMVGLYFTHVKLGNPAKEFFVQIDTGSDILWVTCSPCTGCPTSSGLNIQLESFSPDTSSTSSRITCSDDRCTAALQTGEAVCQTSDSPSSPCVYTFTYGDGSGTSGYYVSDTMYFDTVMGNEQTANSSASIVFGCSNSQSGDLTKADRAVDGIFGFGQHQLSVISQLNSLGVSPRVFSHCLKGSDNGGGILVLGEIVEPGLVYTPLVPSQPHYNLYLESIAVNGQKLPIDSSLFTTSNTQGTIVDSGTTLAYLADGAYDPFVTAIAGAVSPSVRSLVSKGNQCFLTSSSVDSSFPTVTLYFRGGVAMTVKPENYLLQQASVDNNVLWCIGWQRNQGQEITILGDLVLKDKIFVYDLANMRMGWADYDCSMPVNVTTSSGKNQYVNTGQYDVNGSTRRASYKSLIPAGIAAMVVHMLVFGGGVSHR

SEQ ID NO: 5269 - DNA, 1621 bp, Panicum virgatum
  misc_feature: Ceres CLONE 1817808
  misc_feature: Encodes the peptide sequence at SEQ ID NO. 5270
acacgacgcccgccgctcctgccccggcggctactctccccccacggcgctccgcccgctgctcgccggcttccttccgccagctccagtccgctcgcgatgaagatcgcggtggagggatgcatgcacggggagctggacatcgtctacgacacgcttcgcaggctcgaggaggccgaggggatcaagattgacctcctcctctgctgtggcgacttccaggctgttaggaatacagatgatttacggtgtgttaatgtcccactaaagtatcgtaccatgaactcattttgggagtactactcaggacaagcagttgctccatacccaaccatctttatcggtggaaatcatgaagcatccaattatctgtgggaattgtactatggaggatgggcagcacctaacatatactttttagggttttctggtgttgttaagtttggaaacatccgaattggtgggctgtcaggaatacataagcaacacaattatcactcaggacactatgagaggcctccatacaatgaacagactatacggtctgtataccatgtaaggcattatgatgttctcaagctcatgcatttgaaggagccactagatatattcttatcacatgattggcctctgggcattaccgagtatgggaactggcagaagctcattcgcgcgaaaaggcactttgaagaagaggttaacaatagaacgctaggtagcaaacctgcagctgaattactgaacaaactaaaaccaccctactggttttcagcacatttgcattgccggttcccagctatcatccaacatggagagaatggacctacaacgaagtttcttgcccttgataagtgccttcctgggcgaaattttttgcaggttatagacattccgtccaatcctggaccatatgaaatccagtacgatgaagaatggcttgcgataacaagaagattcaatatcattttcctcttaactcgaaggcgatttactattcgggatgagcagcttgacactcaagatgaccgagaatgggttcggaacaagttgaatactagaggggttaagccatttgactttgtccagactgcaccatctttcaatccttccaatccagtctccaattcctccattacaagaagttgcaggaatccacaaactgagtctttcctccagcttctggaactcccttatctgctggactcatctaattctgaggaggtcgatagaaccgagtcaagctctcagccaggaaacatgcttgatgatgaagatatagaactaccggatgaagatgaaggtgccatagatgaatagacgatgatgagtgaatgagccggagtagttggacaagttctgttgctccatcccagttgcaggtttgccttgagggatgggtttgtctctgtagagagaggaactaaaatgtactagattgtagtgacatagctggttggttatgggagaatgtctgtggactcgtaggctagcccaatgcaaactttcttcggtgttgaattgttggtgtcctttaaagttcgaactattcggtgtccgtcaaagttggaactacattcacactgattgttcagctaactcagaaaaaaaaaaaaaaaaaaaa

SEQ ID NO: 5270 - protein, 405 aa, Panicum virgatum
  misc_feature: Ceres CLONE 1817808
  misc_feature (1)..(230): Pfam Name: Metallophos Pfam Description: Calcineurin-like phosphoesterase
MKIAVEGCMHGELDIVYDTLRRLEEAEGIKIDLLLCCGDFQAVRNTDDLRCVNVPLKYRTMNSFWEYYSGQAVAPYPTIFIGGNHEASNYLWELYYGGWAAPNIYFLGFSGVVKFGNIRIGGLSGIHKQHNYHSGHYERPPYNEQTIRSVYHVRHYDVLKLMHLKEPLDIFLSHDWPLGITEYGNWQKLIRAKRHFEEEVNNRTLGSKPAAELLNKLKPPYWFSAHLHCRFPAIIQHGENGPTTKFLALDKCLPGRNFLQVIDIPSNPGPYEIQYDEEWLAITRRFNIIFLLTRRRFTIRDEQLDTQDDREWVRNKLNTRGVKPFDFVQTAPSFNPSNPVSNSSITRSCRNPQTESFLQLLELPYLLDSSNSEEVDRTESSSQPGNMLDDEDIELPDEDEGAIDE

SEQ ID NO: 5271 - DNA, 1355 bp, Panicum virgatum
  misc_feature: Ceres CLONE 1817847
  misc_feature: Encodes the peptide sequence at SEQ ID NO. 5272
acggaacgccagcgcgagccatggccgccggactctccggcgccgcgatgaccagcttcgccgccaacaagaaccccgcgctgctggccgcggcctcgcgccgcagggcgccgcctgccctcgccgggcgtgcgctgccgttctcgccgctcaccaccgcgcgggccccgcgccgccgcgggctcgggaccgtcacgtgcttcgtgccgcaggacacggagcgcccggcggccgcccacgtgccggtgccggtgcccgagacggcgctggaggaggtggccagggccgcggctgcgcggcgcgtcgcggagaggaaggcgcggaagctgtccgagcggcggacgtacctggtggccgccgtgatgtccagcctcggggtcacgtccatggccgtcgccgccgtgtactaccgcttcagctggcagatggagggcggcgaggtgccggtggccgagatgttcggcacgtttgcgctctccatcggcgcggcggtcgggatggagttctgggcgcggtgggcgcaccgggcgctgtggcacgcctccctgtggcacatgcacgagtcgcaccaccggccgcgggaggggcccttcgagctcaacgacgtgttcgccatcatcaacgccgcgccggccatctccctcctcgcctacggcttcttccaccgcggcttcgtgcccggcctctgcttcggcgcgggcctcgggattacgctgttcggcatggcctacatgttcgtccacgacggcctggtccaccggcgcttccccgtcggccccatcgccaacgtgccctacttccggcgagtcgctgccgctcacaagatccaccacacggacaagttcgagggcgtcccgtatgggctcttcctgggacccaaggagctggaggaggttggtggcctggacgagctggagaaggagctcgcgcgaatccgcagccggggcatgtgacttcgaccggcgccgcggcggcgtggacggagcgcgcggcaggctccgctccaggatttttgtttttggtcgctttttcgttgattcgatcgtgggggagtcgaggacaacgagaaattggtttggttgtttggggcgtggatgctgtagagaacatttgtaaggtctggggtcggagggcaccgttcgtacatggaagagtccggtgccatggaattgtttttttttcctttcccctgccattttcaggtcggcgtctccgtggagacgtcgcacgttctggtccccctgtattgttcttatggctaggattctgtgcataacacatgtagggaaatgttatgaagcacatcaatgaaagcaaaattcagtggttgcaaacaaaaaaaaaaaaaaaaaaaa

SEQ ID NO: 5272 - protein, 310 aa, Panicum virgatum
  misc_feature: Ceres CLONE 1817847
  misc_feature (1)..(159): Pfam Name: Carotene_hydrox Pfam Description: Carotene hydroxylase
MAAGLSGAAMTSFAANKNPALLAAASRRRAPPALAGRALPFSPLTTARAPRRRGLGTVTCFVPQDTERPAAAHVPVPVPETALEEVARAAAARRVAERKARKLSERRTYLVAAVMSSLGVTSMAVAAVYYRFSWQMEGGEVPVAEMFGTFALSIGAAVGMEFWARWAHRALWHASLWHMHESHHRPREGPFELNDVFAIINAAPAISLLAYGFFHRGFVPGLCFGAGLGITLFGMAYMFVHDGLVHRRFPVGPIANVPYFRRVAAAHKIHHTDKFEGVPYGLFLGPKELEEVGGLDELEKELARIRSRGM

SEQ ID NO: 5273 - DNA, 1324 bp, Panicum virgatum
  misc_feature: Ceres CLONE 1817895
  misc_feature: Encodes the peptide sequence at SEQ ID NO. 5274
atgagcttcatcctccacggccaccagacgacagaagcggagcgagaagagaagcgcgcggtaaggagcttgcacgtacgggtagatagctaggtggctagcctgaggatcgatcggaccagatgatcccctacgcaaccacggcggaggcggaggcggcgctggggcgcgccatgacatgggcggaggctgcgtggtaccagtactcggcggcgatgccagattcctggctccactgccacaccacatttatcctcttcgtcatctacacgatcacgccgctgcccctcgtggtcctcgagcagtttgctccctccatcgtgctgccgtacaagctgcagccccgggtacggctgccgctggcggcctccctccgctgctacatggaagcggcgtgcttctttcccctcgccgtcggcttccagctcgtctcctaccctgccgctgtcaagatactgaggactcgaatgggactgccgttgccgtcggtcagggagacaattgcgcagcttgtggtatactctctcatggaggactacctgagctactggatccaccgtcttctgcacacccagtggggctacgaaaagatccaccgcgtccaccatgagtttacggctcccacaggcttcgccatgtcatacagccactgggctgagaacctcttcctttccatccccgccttggctggcccagtcattgtgccatgccacatcaccacgcaatggctctggttctgcatccgcctaatcgagggcatcaacacgcacagcggctaccacttcccattcagcccttccaagttgattcccttctatggaggcgccgaataccatgactatcatcactacgcaggagggcgcagtcagagcaactttgctcctcttttcacctactgtgattatatatacaggacagacaaaaaatcgcgtccatctgatgtgtgtgaattggttcatctttgtgtttttcttcgaaaatggctacagataccacaagttaaagcatgcgaagctcaagagtctggaagaaaataatgtggagaagaaaggaggcagcactgcattcaacaccgttcaggactgagatacttttgttcctaaacagtgggtataaatagtttgttactattattaccggttttgttcggatgggagatctacaaataaaaaatctctatttactgcagaggctcttgattgatggacgaacaaatgtacacttgtaatatctctactgttctgtatctggcaataataaatatagtttgtataatttatgtatatgtaagagaatattgcgtcaaaaaaaaaaaaaaaaaaaa

SEQ ID NO: 5274 - protein, 304 aa, Panicum virgatum
  misc_feature: Ceres CLONE 1817895
  misc_feature (1)..(207): Pfam Name: Sterol_desat Pfam Description: Sterol desaturase
MIPYATTAEAEAALGRAMTWAEAAWYQYSAAMPDSWLHCHTTFILFVIYTITPLPLVVLEQFAPSIVLPYKLQPRVRLPLAASLRCYMEAACFFPLAVGFQLVSYPAAVKILRTRMGLPLPSVRETIAQLVVYSLMEDYLSYWIHRLLHTQWGYEKIHRVHHEFTAPTGFAMSYSHWAENLFLSIPALAGPVIVPCHITTQWLWFCIRLIEGINTHSGYHFPFSPSKLIPFYGGAEYHDYHHYAGGRSQSNFAPLFTYCDYIYRTDKKSRPSDVCELVHLCVFLRKWLQIPQVKACEAQESGRK

SEQ ID NO: 5275 - DNA, 1990 bp, Panicum virgatum
  misc_feature: Ceres CLONE 1817977
  misc_feature: Encodes the peptide sequence at SEQ ID NO. 5276
ttcgttcccctcctctcacacggacaaattccgctggttgtttacagcagcggcgcgggttgcgtctacgcccgcgccccgaagcttccgccgtgcgggcgaccgcttcctgctcatccccgtccgcccgagggagcaccgccggcgccgggggattccgccgccgatttgcacgccggttcgggggcggcccggatcggcccgcccgccagagggcaggcattcttatggctcaaagcaaccacggccatatccagctgccagagatggatcatattcaacccatgaatgttccacacaatgaatccctgcctttaggtcagaagcttctagtgcatcatgatgcaccccttagaattggccattcaagtcatgggaatgtgacagttagatcaagtgaccttccatcttcaggtcaccctgagcagactttaggttatagagttgggaacccaggaacctcacatgctccctttgttcattgtcctgctggaagctccagcagccatttagcagagcctgctgtgagttatccacatagatctgaggaaggctttgctccagtgagctcccatatggagaacagaagggccgcagtgaaacgaaaaaatcctgtcataaaccctgtggggatcagtgctaatggttattatgttggaagctcttccaatactcagttatctaactcagtgcagccaaatcctgctccacttcctgaaccgtttattcctcaaatgcctttaagaattggccaaagtggttggaatggccaacatttaatccagcaagaaggatttcaaaggaatgtgagagcacggcacaatcataatatttcactggaagctcgaccggctccagcttacacagcaaacaccattcatctcccgtcatttggttcagctgcaagtgctgttcccctaggtacatcagtggaaaggaaccaagcacctgtttctgcaccatcaggtgttccaggactcgctagcagggctctggataggacttattatcctgctattggaagcagcaattcaagtgttggtgctgtcccaactgtcccatcatccagcagtgcaacatttgctaatggtggctatgttcctaggattgttcatggtggcgctgttcatgtctaccctcatccagctcccacagcttcctctggccccagagcattgcccgttgagacagtcattcggagctatccacctgctatctctgcagctacatctacatctgtgcggatggaaccatcacctgccagatctgcagcatcttctagacattcaaggcatatagctgtggggcatgctactaatggaaggaatagaagggctaggagttcttactatggttttcatcctttgatgattgaggcagagcggtttatgatggaccaattggtcttttacgaatcaagagcagcagcagctgacccccacagaaacatgagactggacattgacaacatgagttacgaggacctgttggctttaggagaatttatgggtaatgtcaacacaggcttggctgatgaaaaaattttgaagtgtgtgagagaagtggtctgctgcagctctgaccaaacgcaaaacgatctagatgaccaagatgacgggagatgtgtcatttgcctggaggattacaaagacaaggatgtgctgggaacactgaaatgcaaccatgacttccacgctgattgcatcaagaagtggctgcagacgaagaattcatgcccggtgtgcaaagcagccgcggcttaggacaccagtggagcaccaattgtgctcctcgatccattgattttaggctcaggtcatattatcccattttattctttcccccctagcaatgtaaataaatgctaaggtgatgaatcgattattgcatgggttgcagtaagcccaaattcttttgttgtagtgtaacaatcaagttaaagtaaattaaccatcaagtggttacatgctaaaaaaaaaaaaaaaaaaaa

SEQ ID NO: 5276 - protein, 511 aa, Panicum virgatum
  misc_feature: Ceres CLONE 1817977
  misc_feature (1)..(41): Pfam Name: zf-C3HC4 Pfam Description: Zinc finger, C3HC4 type (RING finger)
MAQSNHGHIQLPEMDHIQPMNVPHNESLPLGQKLLVHHDAPLRIGHSSHGNVTVRSSDLPSSGHPEQTLGYRVGNPGTSHAPFVHCPAGSSSSHLAEPAVSYPHRSEEGFAPVSSHMENRRAAVKRKNPVINPVGISANGYYVGSSSNTQLSNSVQPNPAPLPEPFIPQMPLRIGQSGWNGQHLIQQEGFQRNVRARHNHNISLEARPAPAYTANTIHLPSFGSAASAVPLGTSVERNQAPVSAPSGVPGLASRALDRTYYPAIGSSNSSVGAVPTVPSSSSATFANGGYVPRIVHGGAVHVYPHPAPTASSGPRALPVETVIRSYPPAISAATSTSVRMEPSPARSAASSRHSRHIAVGHATNGRNRRARSSYYGFHPLMIEAERFMMDQLVFYESRAAAADPHRNMRLDIDNMSYEDLLALGEFMGNVNTGLADEKILKCVREVVCCSSDQTQNDLDDQDDGRCVICLEDYKDKDVLGTLKCNHDFHADCIKKWLQTKNSCPVCKAAAA

SEQ ID NO: 5277 - DNA, 1601 bp, Panicum virgatum
  misc_feature: Ceres CLONE 1818064
  misc_feature: Encodes the peptide sequence at SEQ ID NO. 5278
aaccccgaaccgctcacatcggatccgccccatctccgacgacgagatgggctccatggaagcgttgaccgcgccggagaacggctccgccgccgccggcggagctgggggcacggcgtgcaacggggccggcgcagcgacgaacggaggaggcatggagcgaaggctgaggtcctcggccgcgtccgcgtcgtgggcgcacctgcccctggaggtgggcacgcgcgtgatgtgccggtggcgcgaccagaagctccaccccgtcaaggtcatcgagcgccgcaagggctcctcgtcctcttcccccgccgactacgagtactacgtccactacacggagttcaatagaaggcttgacgagtgggttaagcttgagcaacttgatcttgatactgttgaaaccgttgtcgatgaaaaagtagaagataaggcaacgagcttaaagatgactcggcaccagaaacgtaaaattgatgaaacacatgtggagcaaggtcatgaggaacttgatgcagccagcttgcgggaacatgaagaattcacaaaggtgaagaacatcgcgaagatagaacttgggagatatgagatagatacatggtatttttccccttttccaccagagtacaatgactgcccgaagctgtttttctgtgaattttgcctcaatttcatgaagcgcaaagaacagcttcagaggcacatgaaaaagtgtgatctgaaacatcccccaggtgatgaaatctatagaagtggtactctgtcgatgttcgaggttgatggcaagaagaacaaagtttatggacagaatctttgttatttggccaagctatttcttgatcacaagacattgtactacgacgttgatttattcttgttttatgtcctatgtgaatgtgatgaccggggatgtcatatggtgggatatttctctaaggaaaaacactctgaagaatcttacaatttggcttgcatcctcactctccccccataccaaagaaaaggatatgggaagttcctgattgctttctcatatgagctttccaagaaggaaggcaaagttgggacaccggagcgccctctttctgatcttggtctactcagctatagaggttattggactagagtgcttctagaaattctaaagaaacataagggcaacatatctataaaggaactcagcgatatgacggcaataaaagcagatgacatcttgagcacgctgcagagcctggacctaatccagtaccgcaaagggcagcacgtcatctgcgccgaccctaaggtcctggaccgccacctcaaggcggcgggccgcggcggcctggacgtcgacgttagtaagctgatctggacgccctacaaggagcaaggctagcacagcactgccacagcagcagctcccagccccggattagagacgctaaccgatccagtcctgtacatttgctaggattcatctcccctcactcgtgtactttcaaactgtagtggtctgtaactacaacatccacattgttgtgtttgtgctgcagtagtctccgaaagggaaagaaacgcaacccagctgagctcttggttcccaaaaaaaaaaaaaaaaaaaa

SEQ ID NO: 5278 - protein, 442 aa, Panicum virgatum
  misc_feature: Ceres CLONE 1818064
  misc_feature (1)..(23): Pfam Name: zf-C2H2 Pfam Description: Zinc finger, C2H2 type
  misc_feature (160)..(437): SWISSPROT Homolog: EC 2.3.1.48 Histone acetyltransferase HTATIP
  misc_feature (53)..(441): SWISSPROT Homolog: EC 2.3.1.48 MYST-like histone acetyltransferase 2
MGSMEALTAPENGSAAAGGAGGTACNGAGAATNGGGMERRLRSSAASASWAHLPLEVGTRVMCRWRDQKLHPVKVIERRKGSSSSSPADYEYYVHYTEFNRRLDEWVKLEQLDLDTVETVVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYRGYWTRVLLEILKKHKGNISIKELSDMTAIKADDILSTLQSLDLIQYRKGQHVICADPKVLDRHLKAAGRGGLDVDVSKLIWTPYKEQG

SEQ ID NO: 5279 - DNA, 1369 bp, Panicum virgatum
  misc_feature: Ceres CLONE 1818120
  misc_feature: Encodes the peptide sequence at SEQ ID NO. 5280
aagcgagcagcagcggggcgaggaggaccagcagccaagcccccccggcgaggcgtccccaatggccgctgcagctttgcccgccgcggccgctcccgcttttccccacctcttctccatctcctcctgatccccttccatttctccccatccccctcttccttcctccacgcctgtttgctccgcaaccgtcgcagtcgccgccgccgcattgggagccgaggaagggcgacgcaatggagcagtacgagaagcaggagaagattggggagggcacctacggggtggtgtacaaggcggtggacaaggccaccaacgagttcatcgcgctcaagaagatccgcctcgagcaggaggatgagggtgtcccctccaccgccatccgcgagatctctctgctcaaggagatgaaccacggcaacatcgtcaggctacatgatgttatccacagtgagaaacgaatatatcttgtcttcgaatacctggatctggacctcaagaagttcatggattcttgcccggactttgccaaaacccccactttgatcaagtcctacctctaccagatactccgtggcgttgcttactgccattctcatagagttcttcatcgagatttgaaacctcagaatttattgattgatcggcgcactaatgccctgaagcttgcagactttggtttagccagggcatttggaattcctgtccgtacatttactcatgaggtagtgacattatggtacagagctccagaaattcttcttggagcgagacagtattctacaccagttgatgtatggtctgtgggctgtatctttgctgaaatggtgaaccaaaagccactattccctggtgattcagagattgatgaactgtttaagatattcagggtactaggtacaccaaatgaacaaagttggccaggagtcagctgtttgcctgacttcaagactgctttccccaggtggccggctcaggacctggcaacaatcgtcccaaatcttgaacctgctggtttggaccttctctctaaaatgcttcgttacgagccaagcaaaagaatcacagctaggcaggctcttgagcatgagtacttcaaggaccttgagatggtacagtgacctgctggtgtggtactgtgatgtgttggcatttgtatgagctgagtcactcgtttcattcctttttatgaacccctgtactccctccctccctccctgtctctgcatttttgtcgttcagctggatatttcggatctggtgtgctttgaggtgtattcaggaatatcaactagattaccgtcttggtctctattcgatgaaagtaaatatccttcacatgtttatccaaaaaaaaaaaaaaaaaaaa

SEQ ID NO: 5280 - protein, 294 aa, Panicum virgatum
  misc_feature: Ceres CLONE 1818120
  misc_feature (1)..(294): SWISSPROT Homolog: EC 2.7.11.22 Cell division control protein 2 homolog
  misc_feature (1)..(294): SWISSPROT Homolog: EC 2.7.11.22 Cell division control protein 2 homolog 1
MEQYEKQEKIGEGTYGVVYKAVDKATNEFIALKKIRLEQEDEGVPSTAIREISLLKEMNHGNIVRLHDVIHSEKRIYLVFEYLDLDLKKFMDSCPDFAKTPTLIKSYLYQILRGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRVLGTPNEQSWPGVSCLPDFKTAFPRWPAQDLATIVPNLEPAGLDLLSKMLRYEPSKRITARQALEHEYFKDLEMVQ

SEQ ID NO: 5281 - DNA, 1641 bp, Panicum virgatum
  misc_feature: Ceres CLONE 1818145
  misc_feature: Encodes the peptide sequence at SEQ ID NO. 5282
agccgttcgctcgcccgcccgcccggccgcttcgccatgccgcccccctccctcctctccctcctccctgccgtgtccatctcacctcgagctcgaagacgccaagccaagcaccacaaggcccccgccccgagacacttgctctgctcccgacgagcagccgccccattaccgctccaagtccacgcctcgtcctattcctcagccgacggcggcggaggcgggggtggaggcgacgagctccacctcctcgagaagccgcccccctccgccgcggaggatgccgaggaggagcccgagcccgtcccggtgctgtccacggaggaagcgctcgcgcctttcctcaagttcttccaggtgaagagcactgaccccgacgcgggagcagaggcggccgcaggagggcgcgcggagagcgacgcggcgaggacctatggtggagtgtccgccggcgggcgtggggtcaggtactacgaccccaagccaggggacctcgtcgccggcgtcgtggtccgaaacgacgggaggacgctagacgtcgacatcggcgccggtggcgagccggcgttgatgctgacgaaggaggcggtgccggtgcccggagaggagttcgggtacctggcgtgcgacaccgggtcggagcgtgcggccgagttcgccacggaagggagggtgggcgtcgtggtcaggcaggtcggcgccggagaggagggtggggaattgacgagcggcaggaatgggaaggagaaacgcgcggcagtgatgggcgttggcacgatcgtgttcgctgaagtcctcggtcgaacacttggtgggcggccgctgctgtccgcacgcaggctgttccggcgcgtcgcgtggcacagagtgaggcagataaaacagctagatgtacccatcaaggtcaaaatttatgggtggaatgctggtggcttgctgtctagaatcgatggccttcgggcattcctccctaagcctgagatgataactagaccaagaaatttcacagatctaaagaataaagttggtcaagaagtgcacgtctgcattacaaggattgacgaagctaataacgaattgataattagtgaaaaagaagcatgggcggtgacataccttaaagaagggacgctcttgcaagggacagtccacaagttattttcatatggtgcgcaaattaggattggcgagactaacagaggtggcttacttcacatgtcgaacattacaaatggtcagctgagatctgtcgctgatgtgctaaaagtgggcgagacagtgaaagctcttgtcattaaatcggcatctccagaaagaattgccctcagcacaaaggatctcgagagtgaacctggactgtttatcactaacaaagagaaggtgttttctgaggctgaagagatggcgcgaagataccgggagcaaattgcagagcccccgcgaccggctgaggcagaagactcctgcaactgcaacgatgctgttcctttcaacaacgaggcccaatcctatgctaactggaagtggttgaaattttaagccagatgaagtagcaaaccgcaaatctaattctgaattctaattgccgtacaggagttgtgtagaaattttggtcgattcaatattcaatttcaagcttac

SEQ ID NO: 5282 - protein, 500 aa, Panicum virgatum
  misc_feature: Ceres CLONE 1818145
  misc_feature (1)..(73): Pfam Name: S1 Pfam Description: S1 RNA binding domain
MPPPSLLSLLPAVSISPRARRRQAKHHKAPAPRHLLCSRRAAAPLPLQVHASSYSSADGGGGGGGGDELHLLEKPPPSAAEDAEEEPEPVPVLSTEEALAPFLKFFQVKSTDPDAGAEAAAGGRAESDAARTYGGVSAGGRGVRYYDPKPGDLVAGVVVRNDGRTLDVDIGAGGEPALMLTKEAVPVPGEEFGYLACDTGSERAAEFATEGRVGVVVRQVGAGEEGGELTSGRNGKEKRAAVMGVGTIVFAEVLGRTLGGRPLLSARRLFRRVAWHRVRQIKQLDVPIKVKIYGWNAGGLLSRIDGLRAFLPKPEMITRPRNFTDLKNKVGQEVHVCITRIDEANNELIISEKEAWAVTYLKEGTLLQGTVHKLFSYGAQIRIGETNRGGLLHMSNITNGQLRSVADVLKVGETVKALVIKSASPERIALSTKDLESEPGLFITNKEKVFSEAEEMARRYREQIAEPPRPAEAEDSCNCNDAVPFNNEAQSYANWKWLKF

SEQ ID NO: 5283 - DNA, 1816 bp, Panicum virgatum
  misc_feature: Ceres CLONE 1818158
  misc_feature: Encodes the peptide sequence at SEQ ID NO. 5284
agagaagaagaggcttccttccaacgctacgccgaagccaattaataatccccccttcccttcataacttcgtcctccaccaaagcctaatggcttccccctcgcctcctcatgccgccgcgctgccctagaaccctcggccccccgccgctcctcctcgaattcccctctcgctccgatcggccccgctgacacgcccgcgccggatccctaccccggaattccgggccggatcgaaatcgaactgcctgcccgcccgcctcctctctcgatcaaataaacgcacgcctgaggcggttggatccccgggcgggggtcggtggggggcgtctcctgatttcggtttcttctcccccgtgccccgatgggggcgccgaagcagcgctggacgcccgaggaggaggccgcgctcaaggccggcgtcgccaagcacgggcccggcaagtggcgcaccatcctcagggacccggacttcagcactctcctgcgcctccgctccaatgttgacctcaaggacaagtggcgcaacttgagtgtcaccgcgggaggttatgggtctcgggagaaggcaagaatggcgttgaagaaaggcaagcgtgtggtgcctaagcttactgctgagccaatggatgttgatgcgaatggtttgggcaatgttcatgatgtggtcatcgatgctgagccattggcaatgtccgtggagcccttggcactcgaggaaagtccggaaaaatcagttgctaggcttgatgacctcatattagaagctataaagaagcttaaggagccttctgggtccaataaggcagccattgctgcatatattgaggagcaatactggccacctgctgattttcaacggctgctgtctacaaaattgaaggcattggttaatgctggaaaattgatgaaggtaaaccaaaagtacagaattgcaccaagttcaccttccttgggtggaataagcaccaaggtgtactctgctgaagagatgaatggagagaataatgctaaacagctaactaagcctcaagtggatgctgatttggaaaagatgaaaggcatgactaaggaagaggcagctgcctttgctgccaaggcagttgctgaggcagaagtagcgatcgcagaagctgaggaagcagctaggattgcggaggctgcagaaaatgatgctgaagctgccaaagcttttcttgaagctgtcactttgtctatgagggacagaaatgctgcttccatgatgcttcgagcttgctgatcctttacccatgccaacatattgttttggtcagcagagcaacagtgttctgctgcaaagattttccggatagacgagtttcttgtatagccttatagatcatgatgcttcaatgggaggggttttcaacatctcgctgctggtcccgactgctgtgcagccaatcgacaaatataatgacaagaacaatcgggaaagtagtcttcatttttttcttttatttttcccccattgtgttgctttgtaattaaactctagccttttcccttttgtagttgaagtgatgttgtcaaatagaacaactgtagtggaaagaaaatgtcagaaagccgcttagtccatgttttaaatagtgggctataggatttagcggcagtgtcctcaaaacgctattagcgccgctatagcgcgctattttgtactgcagtgatcatagcggtagctccgtgaaaactgttatagcgctgctatagcaccgctatttaaaacaatgcgcttagttaatccaagttgctgtgataagatgtttctagataaaaaaaaaaaaaaaaaaaa

SEQ ID NO: 5284 - protein, 298 aa, Panicum virgatum
  misc_feature: Ceres CLONE 1818158
  misc_feature: Great-hit functional homolog of the protein sequence given in SEQ ID NO 9511
  misc_feature (1)..(53): Pfam Name: Myb_DNA-binding Pfam Description: Myb-like DNA-binding domain
  misc_feature: Useful for making plants with altered alkaloid content
MGAPKQRWTPEEEAALKAGVAKHGPGKWRTILRDPDFSTLLRLRSNVDLKDKWRNLSVTAGGYGSREKARMALKKGKRVVPKLTAEPMDVDANGLGNVHDVVIDAEPLAMSVEPLALEESPEKSVARLDDLILEAIKKLKEPSGSNKAAIAAYIEEQYWPPADFQRLLSTKLKALVNAGKLMKVNQKYRIAPSSPSLGGISTKVYSAEEMNGENNAKQLTKPQVDADLEKMKGMTKEEAAAFAAKAVAEAEVAIAEAEEAARIAEAAENDAEAAKAFLEAVTLSMRDRNAASMMLRAC

SEQ ID NO: 5285 - DNA, 1236 bp, Panicum virgatum
  misc_feature: Ceres CLONE 1818171
  misc_feature: Encodes the peptide sequence at SEQ ID NO. 5286
aaaaaaactagaaaccaagcaagcgaaccaccagccaataccgaacgcccgccggcactcgccgccgatgggggtggactactacaaggtgctcgccgtcggccgcagcgccaccgacgacgagctcaagaaggcctaccgccgcctcgccatgaagtaccacccggacaagaacccctcgccacaggccgattccctctgcaagcaggtctccgaggcctacgacgtgctcagcgacccgcagaagcgccccatctacgaccagtacggggaggacggcctcaaggccggcgcgcccccgccctccgcctccacgcacggcgccggcgcccacgggttccgcttcaacccgaggagcgccgaggatatcttctcggagatattcggcggctcgttccctggggcgggtccccgaaccccaggcggaggcgttcccccggggttcccgggattcggcggcgccgctcggccaggggaggcatctagcgcggggctgcagaggaaggcgccgatgatcgagcggcagctggcttgtagtctggaggaactgtacaagggcgccactaagaagatgaagatctccagggatctccttgacgccaccgggaaaccaacaaacgttgaggagatcctaacgattgatatcaaacctggatggaagaagggcacaaaaatcacatttcctgagaaaggcaatgagatgcgcaatgttgtaccatcagatctagtgttcataatagaagaacgggcacatcccaagttcaagagagatgggaacgaccttatttacacacataaggtctctcttgtggaggcattgacgggcagcacagtccaagtggcaactctggatgaacgaaccctgactattcccgtgaaatctgttgtcagtcctacctatgaagaagttgtgcagggagaaggcatgccaatcacaagggaaccttctaagaaggggaacctgcggattaagtttcagatcaagttccccacttatctaacgtctgaccaaaaggctgggatccaacagcttctatcttagcctatttgtacaatatatgagtctctgtttattcgtgtgtggagcagttgtagtgactttagctgaacatactgtcactctatttgtgctagtgtcggtgtattcttttgtagctactgcaaaattatgcgagttctaacctgccgctggagctgaagctatttgtcccatctacaaaaaaaaaaaaaaaaaaa

SEQ ID NO: 5286 - protein, 324 aa, Panicum virgatum
  misc_feature: Ceres CLONE 1818171
  misc_feature (1)..(64): Pfam Name: DnaJ Pfam Description: DnaJ domain
  misc_feature (1)..(123): Pfam Name: DnaJ_C Pfam Description: DnaJ C terminal region
MGVDYYKVLAVGRSATDDELKKAYRRLAMKYHPDKNPSPQADSLCKQVSEAYDVLSDPQKRPIYDQYGEDGLKAGAPPPSASTHGAGAHGFRFNPRSAEDIFSEIFGGSFPGAGPRTPGGGVPPGFPGFGGAARPGEASSAGLQRKAPMIERQLACSLEELYKGATKKMKISRDLLDATGKPTNVEEILTIDIKPGWKKGTKITFPEKGNEMRNVVPSDLVFIIEERAHPKFKRDGNDLIYTHKVSLVEALTGSTVQVATLDERTLTIPVKSVVSPTYEEVVQGEGMPITREPSKKGNLRIKFQIKFPTYLTSDQKAGIQQLLS

SEQ ID NO: 5287 - DNA, 1488 bp, Panicum virgatum
  misc_feature: Ceres CLONE 1818189
  misc_feature: Encodes the peptide sequence at SEQ ID NO. 5288
accgcgtataaaggaagccaagattattagcgagccccaggccaagaaacgcgtcagagtttggctcttgataggacgccgccggtgcaagaggcagagagaggagagagagagagagagagaaagagagagagagagagagagaggcggcggaggaagaggaaggaggaggaggaggtgaggtcaggggccgagagggagccagccgctatacggccagccatggcggccagggccgggttcttgctcgccgccgcggcgtgggtgtgcctatcggctgtgtccgcctccgccttcgacgacgtgccgaccgcagccttcgacgagcggttctcgtcgctgttcggcgacggcaacctcgtccgctcctccgacgacaggagcgtccgcctcctgctcgaccgccgctccggttccgggttcatgtcctcgcactactacctccacggcttcttcagcgcctccatcaagctgcccaaggactacacggccggcgtcgtcgtcgccttctacctgtcgaacggggacgtgtacgagaagacgcacgacgagctggacttcgagttcctgggcagccggtggggcggccagtggcgcgtgcagaccaacgtctacggcaacggcagcaccagccgcgggcgcgaggagcgctacctcctccccttcgaccccaccctcgaggcccaccgctactccgtcctctgggctcccacccacatcatcttctacatcgatgacacgccgatccgggaggtgatccggcacccggacatgggcggcgacttcccggcgaagccgatggcggtgtacgccaccatctgggacggctccgcgtgggccacggaggggggcaagtacaaggtcaactacaagtacgcgccgttcgcgtccgagttctcggacctcgccgtcgtcggcccccgcgccgacccggtgctccgcgtcccccgccgcggcggcgcgggtgaccaggacgacgaccaggacctgctggggctcatgacggccgactacgccgtcatgacgccgcagaagcgcgccgccatgcgcgcgttcagggcgcggcacatgacgtacaccgtgtgctacgacgccgcgcggtacgcgtcgggccccatcccggagtgcgacaactcggacgaggagcgcgagaacttctccgcctggggcgagtccaagaccgtcgtcatgaggcctcgcgcccgtggccgccgccgggggcgcaaggccggcggcgccgccgccgccaggggacgcgcggcaagcagctgagatcagaagcaatcaggaatagatcgggttgcgaaagctattggcacaatggttgcagatgatcaattgatccgggactgtaattcgatctacctttttggggtgtccgttgcagatgcaggttgtaaaggtaggtgtagggactagtagggattaatgcgttatgattattctttcatttcttgggtggcagctaataataatatggagtatgat

SEQ ID NO: 5288 - protein, 349 aa, Panicum virgatum
  misc_feature: Ceres CLONE 1818189
  misc_feature: Great-hit functional homolog of the protein sequence encoded by LOCUS At1g32170
  misc_feature (1)..(186): Pfam Name: Glyco_hydro_16 Pfam Description: Glycosyl hydrolases family 16
  misc_feature: Useful for making plants with altered cell wall content and/or composition
MAARAGFLLAAAAWVCLSAVSASAFDDVPTAAFDERFSSLFGDGNLVRSSDDRSVRLLLDRRSGSGFMSSHYYLHGFFSASIKLPKDYTAGVVVAFYLSNGDVYEKTHDELDFEFLGSRWGGQWRVQTNVYGNGSTSRGREERYLLPFDPTLEAHRYSVLWAPTHIIFYIDDTPIREVIRHPDMGGDFPAKPMAVYATIWDGSAWATEGGKYKVNYKYAPFASEFSDLAVVGPRADPVLRVPRRGGAGDQDDDQDLLGLMTADYAVMTPQKRAAMRAFRARHMTYTVCYDAARYASGPIPECDNSDEERENFSAWGESKTVVMRPRARGRRRGRKAGGAAAARGRAASS

SEQ ID NO: 5289 - DNA, 1261 bp, Panicum virgatum
  misc_feature: Ceres CLONE 1818198
  misc_feature: Encodes the peptide sequence at SEQ ID NO. 5290
atattgaagaacgaagggatgcaagaggagggggctgagaagaagatgaggagcacggtggtgtgcgtcaccggcggcgccggctacatcgggagctggctcgtcaggaagctcctaggcagaggctgcgtcgtccacgccaccctgacgaacctcgaggacgacaagaaggccgggctgctgcgggcgctccccggcgcggcggagcggctgcggctgttccaggcggacatgtacgacgcgtcgacgccgacaccttcgagccggccatcgcggggtgcgagttcgtcttcctcgtcgccacgccgctggtgcacgaccccaccagcaccaagggtcttgcatgggcagtacaagaacacgacggaggcgacggtggacgcggcgcgcatcatcctgcggcagtgcgagcgctccggcactgtgaggcgcgtcatctacacggcctcggtcacggccgcctcgccgctgagagagggcggcggcgggtacaaggacttcatcaacgaatcctgctggacgccgctcgacctctcctacgggttcaccaacgtccacctggacgcatacgtgtggtccaaaacgctgtcggagaaggagctgctgcgctacaacgacgacgagtcctcctcccgccgggcgttcgaggtggtctcgctggtgtgcgcgctcgtcggcggcgacaccatccagccgcacctttggagcagcatcccggtgatggtggcgccgctgacgggccacgccgcccaccacaactccctgctcttcatgcaggcgctgctgggctccgtgccgctggcgcacgtggaggacgtctgcgaggcgcacgccttctgcatggaccagccggccatggccggccgcttcctctgcgccgccgggtaccccaacatgcgcgacatcctcggccgcttcgccgccaggttccccgacatcaagatacggctccaacaggtgacaggagagggggtgagggtgcgagctgacaccagcaagcttgaggacctggggttcaggtacaggtatggcgcggaggagacgctgggcggcagcgtcgagtgcgccaagaggttgggggagctctaggcgttactacgtttacatgcttgtgcagatgcgtgccagttcggactcgattgcagctattatcgtacggcatggtgtgtttcagtgtgttgtatccttcgtgcgtgaatttccatcgacgactccttgtcccaaatcctaatttcttttccaaaaaaaaaaaaaaaaaaaa

SEQ ID NO: 5290 - protein, 356 aa, Panicum virgatum
  misc_feature: Ceres CLONE 1818198
  misc_feature (1)..(263): Pfam Name: Epimerase Pfam Description: NAD dependent epimerase/dehydratase family
MQEEGAEKKMRSTVVCVTGGAGYIGSWLVRKLLGRGCVVHATLTNLEDDKKAGLLRALPGAAERLRLFQADMYDASTPTPSSRPSRGASSSSSSPRRWCTTPPAPRVLHGQYKNTTEATVDAARIILRQCERSGTVRRVIYTASVTAASPLREGGGGYKDFINESCWTPLDLSYGFTNVHLDAYVWSKTLSEKELLRYNDDESSSRRAFEVVSLVCALVGGDTIQPHLWSSIPVMVAPLTGHAAHHNSLLFMQALLGSVPLAHVEDVCEAHAFCMDQPAMAGRFLCAAGYPNMRDILGRFAARFPDIKIRLQQVTGEGVRVRADTSKLEDLGFRYRYGAEETLGGSVECAKRLGEL

SEQ ID NO: 5291 - DNA, 1299 bp, Panicum virgatum
  misc_feature: Ceres CLONE 1818207
  misc_feature: Encodes the peptide sequence at SEQ ID NO. 5292
tcacaccacacctcaggccctgacactcccggccttctgctctgccaccccatccatcccctcctcccagagtctccagcaggcagctgctagcctcctgctccggccaactaaccgtgccagcatggccgcgcgctgcccttacttcgccgccgacgagaccacccgcgtcatccgcccgggggagtccccggccgcggcgttccgccggatcctcgccaaacccggcgcgcaccaggcgccctgctgcttcgacgcgctcgccgcccgcctcatcgagcgcgccggcttcgagatcggcttcatgagcggtttctgcgtttcggccaccaggcttggcttgcctgacgttggcctcatttcctatggagaaatggtggaccaagggcgtctgatcaacgaatctgtatcgattccagtgcttggtgatggggacaatggctatggaaactctatgggcatcaagagaaccatcaaagggtacatcaatgctggttttgctggaatcatgcttgaagatcaggtgtcgcctaaagcatgtggacataccgaaggaaggaaagtggtctcaagggaggatgccgtcatgcacataaaagctgctgttgatgccaggaacgaaagtggctctgaccttgtcattgtggcaaggacagattcacgtcaagccatttcttttgaggaagcattatggagagtacaagcttttgccgatgttggtgctgatgtcctcttaattgacgcccttggttcagtggaagagatgaaggcattctgtgcagttgccccaggaattccaaagatgataaacattatagaaggtggtaaaactcccatactgagccctgtggaacttggagaaattggttacagcctcatagtctattcagtatccttacttggcgtgtcaatgcgtgcaatggaggatgctttagcttcaataaaaggtggcggtgtagctccacctagcatcatgccatcttttcaggatatcaaggacaccctagcgttcgaccgctactacaaagaagacaagcgataccaagtggtctccaaaggcacaaatggacacatatgaatctaccgaagtttgaaaattctggattgtgctggatatatgctgccatgcaagttgctcatgcatggctgcaagtaccatatgtgggagatttgatatctgggaagctgtagccttctatattattgctcattttttttcattttctgatctgttgtgatttcaatcattcagaattttatgttccaaatttcaataaaacagacctactattggaagac

SEQ ID NO: 5292 - protein, 317 aa, Panicum virgatum
  misc_feature: Ceres CLONE 1818207
  misc_feature (1)..(83): Pfam Name: ICL Pfam Description: Isocitrate lyase family
MAARCPYFAADETTRVIRPGESPAAAFRRILAKPGAHQAPCCFDALAARLIERAGFEIGFMSGFCVSATRLGLPDVGLISYGEMVDQGRLINESVSIPVLGDGDNGYGNSMGIKRTIKGYINAGFAGIMLEDQVSPKACGHTEGRKVVSREDAVMHIKAAVDARNESGSDLVIVARTDSRQAISFEEALWRVQAFADVGADVLLIDALGSVEEMKAFCAVAPGIPKMINIIEGGKTPILSPVELGEIGYSLIVYSVSLLGVSMRAMEDALASIKGGGVAPPSIMPSFQDIKDTLAFDRYYKEDKRYQVVSKGTNGHI

SEQ ID NO: 5293 - DNA, 1335 bp, Panicum virgatum
  misc_feature: Ceres CLONE 1818225
  misc_feature: Encodes the peptide sequence at SEQ ID NO. 5294
acagccaagcaactctcgatccctaatcagcagctcgatcgagctcgctttagcttgagagaagcagtgcctgtgtgtgttcgcagcaatggcgaccgccaatgtcctcctcgtcctgctctgctcaaccctctgcttcctcgcccgccgggccgccggcgactacggcgggtggcagagcgcccacgccacgttctacggcggcggcgacgcgtccggcacaatgggcggggcgtgcgggtacgggaacctgtacagcaccgggtacggaaccaacacggcggcgctgagcacggcgctgttcaacgacggcgcctcgtgcgggcagtgcttcgagctccgctgcgacaacgccgggcagtcgtgcctgcctggcaccatcaccgtgacggccaccaacttctgcccgcccaactacggcctccccagcgacgacggcggctggtgcaacccgccgcgcccgcacttcgacatggcccagccggccttcctccagatcgcgcagtaccgcgccggcatcgtgcccgtcgcctacaggagggtaccgtgcgtgaagaagggcgggatccggttcaccatcaacggccactcctacttcaacctggtgctggtgaccaacgtggccggcgccggcgacgtgcaggccgtctccatcaagggctccgccaccgggtggcaggccatgtcccgcaactgggggcagaactggcagagcaactcgctcctcgacggccaggccctctccttcaaggtcaccgccagcgacggccgctgcgtcaccagcgacaacgccgcgccggctggctggcagttcggccagaccttcgagggcggccagttctgatctagccgccggccggccccgcgccgccgctcgacgaggacgacccatcatcggtttgcattgcgttcggagaaggaaaccggccggcctcttcgccgtagtaaagaagagagcccgccggccattctgaggctgcttattatcactagcacccgcttaggcctttccttctccgatgatggtaggattaagttaatatttttctgcaccagtgagtgattgtgtagccttggactaaggggatcgattaaaaaaaagaagtacctgctgcagagccgattattgtagagcaagctgcaggggagtgtgtggtgtcgtgttcgtgtaacttttgttgttgttacatgggttgggtgggagatgtctgctggggatctatccaccgatggcacctttgggaccgtgaccaatgcttgtttatggccggtctgtacgtgcagtatatatggtatgctttgtgctttgttgaccaaaaaaaaaaaaaaaaaaaa

SEQ ID NO: 5294 - protein, 251 aa, Panicum virgatum
  misc_feature: Ceres CLONE 1818225
  misc_feature: Great-hit functional homolog of the protein sequence encoded by LOCUS At1g69530
  misc_feature: Great-hit functional homolog of the protein sequence encoded by LOCUS At2g03090
  misc_feature: Useful for making plants with altered cell wall content and/or composition
MATANVLLVLLCSTLCFLARRAAGDYGGWQSAHATFYGGGDASGTMGGACGYGNLYSTGYGTNTAALSTALFNDGASCGQCFELRCDNAGQSCLPGTITVTATNFCPPNYGLPSDDGGWCNPPRPHFDMAQPAFLQIAQYRAGIVPVAYRRVPCVKKGGIRFTINGHSYFNLVLVTNVAGAGDVQAVSIKGSATGWQAMSRNWGQNWQSNSLLDGQALSFKVTASDGRCVTSDNAAPAGWQFGQTFEGGQF

SEQ ID NO: 5295 - DNA, 2013 bp, Panicum virgatum
  misc_feature: Ceres CLONE 1818246
  misc_feature: Encodes the peptide sequence at SEQ ID NO. 5296
gttgccgccttctttattcttcgtcttctccacacgcccaaccgaccccaaactcccaaagcagagaaggcgcagggaggagagagatccgccaccccctgctgctcgcgctacccctgctcgtcttgcacctctgcatcgcgccgccgttttggcttgcacggcacggacgccagggtctcgagcgccccaaggcccagcgctctcggccccttgccttcccccctgcctcgcatagccgccgccttcacctcccccagcccacccttccctggcgcccccatccccgcgggccccctcctccgcgagcaggcatcaccagcggatctccccctccacgctgcgccgcctgtgctttcccttgtccccggacggtggatcatggagcacgggattcttggctccaggtgcgccgccggggccgggcaaatcttgacgaccaagtccagggccgctgcgtcatgtggctatagaacgtcaacaagtgttgccagttctcccaaacatgatgttaagccatttcaattagcagcaaatggatcctcttgtttggctaacacaagtccagtacttaaaaagcagcggaatctttctgttaggtctagctccgcacatgtggttaccacttttgatgatgccaaaggtgtatcttccagtgttgttgaagaaaaaattggagtcctcttgttaaatcttggtggaccagagaccctggatgatgttcaaccatttttgttcaacctatttgctgatccagatatcattcgactccctaggctgttcaggtttcttcaaagaccactggccaaacttatttctacttttagagctcccaagagtaaagaggggtatgcatcgataggtggtggatcaccattgaggaaaattactgatgagcaggcaaatgctctgaagattgcactggaaaagaaaaacttgcacacgaatatttatgttgggatgcgttattggtaccctttcacagaagaagccattgatcagattaagaaggataagattaccaagctagttgttctcccactttaccctcagtactccatatcaacaagtggatcaagcattcgtgttctccaaaacatcgtcaaggaagattcatattttgctggcttgccaatttctatcattgaatcatggtaccaacgtgatggctatgtgaagtcaatggctgacttaattgagaaagagctatctgccttttccaatcctgaagaggttatgattttcttcagtgcacatggtgtgcctctgacctatgttgaggatgctggagatccttacagagatcagatggaggactgtattgctttgatcatgggggaattgagatccagaggaatcttaaacagtcacactctggcataccagagtcgggtggggccagttcaatggctgaagccatatactgacgaagttctagttgaacttggtcaaaagggtgtaaagagcctcctggctgttccagtaagctttgtgagcgagcacattgagactctggaagagatcgacatggagtacaaggagttggctctggaatctggaatcgagaactggggcagggttcctgctcttggatgtacttcctcattcatctctgaccttgctgatgctgttgtcgaagccctgcctactgcctcggcactcgtgaccagaaagcccgatgacaccgactctgacctggacctgatgcattacctgactaagatgttcttcggctcaatcttggcattcatcctgctgttatcaccaagactaatttctgctttccggaacactatgctttaggttggttaggtaagtagaaaaacgtgtgataagcacttatccaaaacttagttttgagattgataagtgaagaagaaacaacttgttaatcataactagaggttgcctttgactttaaggtggaggcttgtagtttgctggttgtaatattgctcacaggaaaaactgaaactattgttcacatagctcgactacagatcaaagttcatc

SEQ ID NO: 5296 - protein, 473 aa, Panicum virgatum
  misc_feature: Ceres CLONE 1818246
  misc_feature (1)..(325): Pfam Name: Ferrochelatase Pfam Description: Ferrochelatase
  misc_feature (21)..(472): SWISSPROT Homolog: EC 4.99.1.1 Ferrochelatase-2, chloroplast precursor
  misc_feature (60)..(473): SWISSPROT Homolog: EC 4.99.1.1 Ferrochelatase-2, chloroplast precursor
MEHGILGSRCAAGAGQILTTKSRAAASCGYRTSTSVASSPKHDVKPFQLAANGSSCLANTSPVLKKQRNLSVRSSSAHVVTTFDDAKGVSSSVVEEKIGVLLLNLGGPETLDDVQPFLFNLFADPDIIRLPRLFRFLQRPLAKLISTFRAPKSKEGYASIGGGSPLRKITDEQANALKIALEKKNLHTNIYVGMRYWYPFTEEAIDQIKKDKITKLVVLPLYPQYSISTSGSSIRVLQNIVKEDSYFAGLPISIIESWYQRDGYVKSMADLIEKELSAFSNPEEVMIFFSAHGVPLTYVEDAGDPYRDQMEDCIALIMGELRSRGILNSHTLAYQSRVGPVQWLKPYTDEVLVELGQKGVKSLLAVPVSFVSEHIETLEEIDMEYKELALESGIENWGRVPALGCTSSFISDLADAVVEALPTASALVTRKPDDTDSDLDLMHYLTKMFFGSILAFILLLSPRLISAFRNTML

SEQ ID NO: 5297 - DNA, 1405 bp, Panicum virgatum
  misc_feature: Ceres CLONE 1818301
  misc_feature: Encodes the peptide sequence at SEQ ID NO. 5298
acttgcgactccgcccccaaatgctcgccggcatctcccgttccctcgctcgccgcggcccgccctttccccttgccgctaccgctaccgccgccgccgctgctgcagccatgtcgtcgtcatcgacgggagcggacgtctccgatcgcccgatctctccggacaccacccgcgtggcctgggtggggacgggcgtcatgggccagtccatggccggccacctcctcgccgccggctacgcgctcaccgtcttcaaccgcacggcctccaaggctcagggcctcgtctcccgcggcgccagcctcgcggacagcccgcgcgcggccgccgcggctgccgatgtcatcttcctcatggttggcttcccctccgacgtccgctataccgccctcgatccatccaccggcgccctcgccggcctcgccccaggcggtgtccttgtcgacatgacaacctcagaccccaccctcgccgccgagatagccgcggcggccgccgccgccggctgctcggccgtggacgcccccgtctccggcggcgaccgcggggcccgcaacgccaccctctccatcttcgcgggcggcgacgccgccgtcgtcgcccgcctggcgccgctcttcaagctcatgggaaacgcgctgtacatgggcgggcccggcgcggggcagcgcgcgaagctgggcaaccagatcgccatcgcgtccaccatggtgggcctcgtggagggcatggtgtacgtgcacaaggccgggctggacgtggccaagtggctggaggccatctccaccggcgcggcaggttccaagtcgctggagctgtacgggaagcggatcctggagcgggacatggcggccggcttctacgtccggcacttcgtgaaggacctcggcatctgcctctcggaatgccaggccatggggctgtcgctgccggggctcgcgctcgcgcaacagctctacgtgtcgctgatggcgcacggcgagggcgggctcggtacgcaggcgctcatactggccatcgagaggctgaacaataccagcctcgagaagaaggactagctcgcggctccagctctggtgaacttgtcaatcggtggaagctttgcttgatgcaatgcagtttgagctgaatctaggtggcgtttcagagttttacatttgtgtactagtgtgctgtgcaagaactatggggcttggatgctgcttaaatgcttggctcaacttgtttattacactttacagcgtcaattagctcaaataagattctgcaaacaatgaggtgttgccttgtttggttgcccaagcttgctatttgtcagtcaacatgtaatgactttgttcagctatggtaaagaaaatgccatatatatagagttaaaattcagcaaaaaaaaaaaaaaaaaaaa

SEQ ID NO: 5298 - protein, 345 aa, Panicum virgatum
  misc_feature: Ceres CLONE 1818301
  misc_feature (1)..(164): Pfam Name: NAD_binding_2 Pfam Description: NAD binding domain of 6- phosphogluconate dehydrogenase
MLAGISRSLARRGPPFPLAATATAAAAAAAMSSSSTGADVSDRPISPDTTRVAWVGTGVMGQSMAGHLLAAGYALTVFNRTASKAQGLVSRGASLADSPRAAAAAADVIFLMVGFPSDVRYTALDPSTGALAGLAPGGVLVDMTTSDPTLAAEIAAAAAAAGCSAVDAPVSGGDRGARNATLSIFAGGDAAVVARLAPLFKLMGNALYMGGPGAGQRAKLGNQIAIASTMVGLVEGMVYVHKAGLDVAKWLEAISTGAAGSKSLELYGKRILERDMAAGFYVRHFVKDLGICLSECQAMGLSLPGLALAQQLYVSLMAHGEGGLGTQALILAIERLNNTSLEKKD

SEQ ID NO: 5299 - DNA, 1742 bp, Panicum virgatum
  misc_feature: Ceres CLONE 1818432
  misc_feature: Encodes the peptide sequence at SEQ ID NO. 5300
aatttattctgtgctcttgctgtatagcttcgttcgatcgattcctctgagaaaaaaaaagagttttttggtagttcgatcttggattccagctcgatcgaggccggccggccggccggagaatcatcggcgatccatcatggacggccgggacgacttcttcagcgacttcatggtgctgcggccggacaagggcggcttccggagcctgctccacctgctgtgctcctgcaaggtcgccgacaacgacgccgtcgactgccccgtcggcaccgaggtcgccgagcggcggcagcggtgggtcatcttcgtctccctcgtcgtccagatgctgctgctgtcggtcaagaggcccatggccgcgctcgggagggcaatcgagtactggatgaacctgctcaccgacaatggcggcagcgtcctcgggctcgtcaggaacgctatgcaaggtaaagtacgaactccggacaggaattctccaaattaccggtcgttcatcggactaatcgacacgagggttgacctggacaatgagatcaggccaggagacagcaactaccacgcagctcttggaatcatggcgtccaaactagcctacgagaaggagctcgtcatcaaaaccgttgtggaaaaccactggcagatgacattcttggagttcttcaattgttggaacgaattcagaggcgactacaccacccaggccttcatgctggccgacaagccggcggacgcggagctcgccgtggtggcgttccgcggcacgcagccgtttgacgcagagcagtggtgcacggacgtggacttctcgtggtacgagatccccggcgtgggcaaggtccacggcggcttcatgaaggcgctcggcctgcagaagaacaccgggtggccgccggagcccgccaccgagccggcggcgcccgccgccgccgaggagccgcggcggcggtacgcgtactacgccatccgcgagcggctccgcgcgttcctggcggcgaacccgcgcgcccggttcgtggtgacggggcacagcctcggcggcgcgctcgccgtgctgttcccgaccgtgctggcgctgcacggcgaggcggcgctgctggggcggctggccggggtgtacacgtacgggcagccccgcgtcggggacgcggcgctggggcggttcgcggcggcgcgcctgggccggcggggctacgtccggttcgtctactgcaacgacgtggtgccgcgggtgccctacgacgacgcggcgctgctgttccggcacttcggccgctgcctctacgtcgacagcctctaccggccggcggcggtggcggaggagccgaacaagaacttcttctcgccgctgttcgtggcgcccaagtacgcgaacgcggcgtgggagctggtccggggcctcctcatcgggcgcgtcgccggcgcggagtacgcggaggggtgggcgatgcgggccgccagggcggtcgggctcgtcgtccccggcctgccgccgcacgcgccgcaggactacgtcaactccaccaggctccgcgccgcctcgctccagcggctgctcgccgacgacgaccaatagccctccctgcgccgcccgcgatctagcgctgctgcattgtgcaaaaagaaaaaaaacaaagttcacggaaaatagaggaacgaaattaataaacgttatgcagatgataaacattactgtaattagtctgacatatacgtagtacacgtggatattatacattagc

SEQ ID NO: 5300 - protein, 478 aa, Panicum virgatum
  misc_feature: Ceres CLONE 1818432
  misc_feature (1)..(176): Pfam Name: Lipase_3 Pfam Description: Lipase (class 3)
MDGRDDFFSDFMVLRPDKGGFRSLLHLLCSCKVADNDAVDCPVGTEVAERRQRWVIFVSLVVQMLLLSVKRPMAALGRAIEYWMNLLTDNGGSVLGLVRNAMQGKVRTPDRNSPNYRSFIGLIDTRVDLDNEIRPGDSNYHAALGIMASKLAYEKELVIKTVVENHWQMTFLEFFNCWNEFRGDYTTQAFMLADKPADAELAVVAFRGTQPFDAEQWCTDVDFSWYEIPGVGKVHGGFMKALGLQKNTGWPPEPATEPAAPAAAEEPRRRYAYYAIRERLRAFLAANPRARFVVTGHSLGGALAVLFPTVLALHGEAALLGRLAGVYTYGQPRVGDAALGRFAAARLGRRGYVRFVYCNDVVPRVPYDDAALLFRHFGRCLYVDSLYRPAAVAEEPNKNFFSPLFVAPKYANAAWELVRGLLIGRVAGAEYAEGWAMRAARAVGLVVPGLPPHAPQDYVNSTRLRAASLQRLLADDDQ

SEQ ID NO: 5301 - DNA, 867 bp, Panicum virgatum
  misc_feature: Ceres CLONE 1818507
  misc_feature: Encodes the peptide sequence at SEQ ID NO. 5302
agcaagtggagatgtcgtcatcatccccgccggtgaagctcatcggcttcttcggcagcccgtacgcgcaccgcgccgaggcagccctgtgcctcaagggcgtgccttacgagctcctcctggaagacctgctgcgaaccaagagcgacctgctgctccagcacaaccccgtgcacaagaaggtgcccgtgctcctccatggcgaccgcaccgtctgtgagtgcctcgtcatcgccgagtacatcgacgaggccttcgacgggccgccgctcctgcccgccgacccctacggccgcgccatggcccgtttctgggcggacttcatcgaaaacaagggcgaggcgcgggaggggttcgagaaagagggcttggagctgctggcgcttctggaggcgcagctcaaggggaacaagttcttcggcggcgaccggcccggctacctcgacattgcggcttccatgctgggtccctggcgcagcgtcgttgaggaggtgaccggggtgaccgtggccaaggaggaagagcaccctgctctctgccagtgggccagggattacagttccaacgaagctctcaagccctgcattccggacagagacaggctcctcgcctacttcaccaagaacaaggagatgtacagagctggcgtcatagcaatgttgcagcagtgattgggttttatgcgcgtataggatcagctaaaaggacgcattgtgctatttcaagagcacaagcactctagtctgaactcatctagtgtatggtttgtgctagtgagttactcgagtcagattgtaatgacgctgttacttatagttaataaagctccccttttcttttatctattaaaaaaaaaaaaaaaaaaaa

SEQ ID NO: 5302 - protein, 219 aa, Panicum virgatum
  misc_feature: Ceres CLONE 1818507
  misc_feature (1)..(76): Pfam Name: GST_N Pfam Description: Glutathione S-transferase, N-terminal domain
  misc_feature (11)..(96): Pfam Name: GST_C Pfam Description: Glutathione S-transferase, C-terminal domain
MSSSSPPVKLIGFFGSPYAHRAEAALCLKGVPYELLLEDLLRTKSDLLLQHNPVHKKVPVLLHGDRTVCECLVIAEYIDEAFDGPPLLPADPYGRAMARFWADFIENKGEAREGFEKEGLELLALLEAQLKGNKFFGGDRPGYLDIAASMLGPWRSVVEEVTGVTVAKEEEHPALCQWARDYSSNEALKPCIPDRDRLLAYFTKNKEMYRAGVIAMLQQ

SEQ ID NO: 5303 - DNA, 1680 bp, Panicum virgatum
  misc_feature: Ceres CLONE 1818521
  misc_feature: Encodes the peptide sequence at SEQ ID NO. 5304
aaagcagaggtaaactcgccgaatcccctgccgggatctcgtcttgctctgttctttttgcgttttagatcgcgctagctcgtcccgggctccgtttcggtggatttggtccagccattttggttctcctccttgtcttcttgaccccgcgcggcatgacccccggctggtcgccgccgcctgcatgcacgatggggatgcggttctcggcatagtgaatccacgcgcacagaggctttggtgaaatcggcggcgagaactgggggagcggaatcgagaatggggagcagcgagaagactgttactgcttatggcgagtacacctatgctgagctggagagggagccctactggccaagtgagaagttgaggatttcgattactggggctggtggtttcattggatcccacattgctcgccgtctgaagagcgagggccattatatcattgcctctgactggaagaagaatgagcacatgaccgaggacatgttctgccatgagttccacctggttgatctcagggtcatggacaactgtctgaaggttacccaaggcgtcgatcatgtattcaatcttgctgctgatatgggtggcatggggttcatccagtcaaaccactctgtcatcatgtacaacaacaccatgatcagtttcaacatgctagaggctgcacgtatcaatggtgtgaagaggttcttctacgcctccagtgcatgcatttaccctgaattcaagcagcttgacacaaatgtgagcctgaaggaatccgatgcctggcctgctgagcctcaagacgcctatggcttggagaagcttgcaactgaggagttgtgcaagcactacaccaaggactttggcatcgagtgccgcattggccgtttccataacatctatggtcccttcggtacatggaaaggtggtcgtgagaaggcacctgctgccttctgcagaaaagctcagacatcaaccgagaggtttgagatgtggggcgatggcctccaaacccgatccttcactttcatcgacgaatgcgtcgagggtgttctaagattgaccaagtccgacttccgcgagccagtgaacattgggagtgacgagatggtgagcatgaacgagatggctgagatcgtgctgagctttgaggataggaagctgcccatccaccacatccctggtccagagggtgtccgcgggcgcaactctgacaacacccttatcaaggagaagctcgggtgggctccgacaatgaagctcaaggacgggcttcggttcacctacttctggatcaaggagcagatcgagaaggagaagatccagggcatcgacatcgcggcgtacgggtcctctaaggtggtgtcgacccaggcgcccgtgcagctgggctccctccgcgccgccgacggcaaggagggcctctgagtgccgatcccatagctgcatacggaagctgtcggagagttgttgggacggtagaaagagtacacaacagcaaacatacggtttagcccctttgaggggggttagagacgatcgatcgtgttccattctgtattcaccaccccattagtttttgtgtcatcttggtaattgcctgtgtattttcacattcagtttgctcctatgcccgtgatggacaataaaatcccctgtttctatcaaaaaaaaaaaaaaaaaaaa

SEQ ID NO: 5304 - protein, 380 aa, Panicum virgatum
  misc_feature: Ceres CLONE 1818521
  misc_feature (1)..(240): Pfam Name: Epimerase Pfam Description: NAD dependent epimerase/dehydratase family
  misc_feature (1)..(378): SWISSPROT Homolog: EC 5.1.3.18 GDP-mannose 3,5-epimerase 1
  misc_feature (13)..(378): SWISSPROT Homolog: EC 5.1.3.18 GDP-mannose 3,5-epimerase 2
MGSSEKTVTAYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRIGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKIQGIDIAAYGSSKVVSTQAPVQLGSLRAADGKEGL

SEQ ID NO: 5305 - DNA, 1615 bp, Panicum virgatum
  misc_feature: Ceres CLONE 1818527
  misc_feature: Encodes the peptide sequence at SEQ ID NO. 5306
ccaagctagctagttcttgagcagccatggcgacggcgggggaggcggcgtctccggcggcgggctccgttggcggacgccggcggcgcgtgctgctgttcccggtgccgttccagggccacctcaccccgatgctgcagctggccggggcgctgcacgcgcggggcggcggcggcctgggcgtcaccgtcttctacgccgccttcaacgcgccggacccggcgcgccaccccgcggcgttccgcttcgtccccgtcggggagggcgtgccgtcggccgacctgctcccgtccggcagcgacgcggacttcgccggcgcgctgctgcggctcaacgaccacctccgggagccgttccgggaccgcctgcgccaggcgctcgccgaggaggaggagggcggcggggcggcggcgtgcctggtggtggactccaacctgcgcgggatgcagctagtggcggaggagctcggcgtgccgacgctggtcctgcgcaccggcgccgccgcctgtctcgtcgcctacatggcgttcccggcgctctgcgacaagggcctcctcccaccggcatcccaagataaagcccagttggacatgccattggatgagcttacaccactacggctgagagacatggtgttctcgcccactactacgcatggtaatatggcaagatgcctacaacatttactggatgcagcaaggagttcttccggtgtcatcctcaacaccttccaagaccttgaggattcagatctccaaaagatcaccaacggcctcggtgtgccgatgtacacggtagggccacttcacaagatttcttcaggcaccgagagcagcttgctagcacaagaccagacttgcttgaagtggttggacaagcaagaggccgattctgttctttatgtgagcttggggagcctggcatccatggatgagaaggaactgttggagacagcatggggcttggccaacagccagagcccgtttctgtgggtgatccgtcacaacatggtcaggtcctcacaccaggtgagccttcctgaaggcttcgaggaggcgacacatggtaggggaatggtcgtgccctgggccccacagcaagaagttcttgctcaccatgccattggtggcttttggactcacaatggatggaactcgactctggagagcatttgcgagggtgtcccgatgatatgtaggccccaatttgctgaccagatgataaacatgaggtacgtccaggaggtgtggaagatagggtttgaactagaaggggagttggagagggggaaggtcgagatggctattaccaagttactgtgtacggaagaaggtagacagatgagacagagggccaaggatctgagggacaaagctgtgatgtgcattgaggatgaaggctcttccaaatctgcaatagatttgctgctcaagcgcataatgtcattttagatatattttttcatgtaatgaagaaactattatcgttagatgtgttatatgttgttgttcccataaattgagaaggtagtgatcattgttaggtcacactcttcatcagataaatgagatatttctcagatggtttcaaattgtaaaaaaaaaaaaaaaaaaaa

SEQ ID NO: 5306 - protein, 474 aa, Panicum virgatum
  misc_feature: Ceres CLONE 1818527
  misc_feature (1)..(132): Pfam Name: UDPGT Pfam Description: UDP-glucoronosyl and UDP-glucosyl transferase
MATAGEAASPAAGSVGGRRRRVLLFPVPFQGHLTPMLQLAGALHARGGGGLGVTVFYAAFNAPDPARHPAAFRFVPVGEGVPSADLLPSGSDADFAGALLRLNDHLREPFRDRLRQALAEEEEGGGAAACLVVDSNLRGMQLVAEELGVPTLVLRTGAAACLVAYMAFPALCDKGLLPPASQDKAQLDMPLDELTPLRLRDMVFSPTTTHGNMARCLQHLLDAARSSSGVILNTFQDLEDSDLQKITNGLGVPMYTVGPLHKISSGTESSLLAQDQTCLKWLDKQEADSVLYVSLGSLASMDEKELLETAWGLANSQSPFLWVIRHNMVRSSHQVSLPEGFEEATHGRGMVVPWAPQQEVLAHHAIGGFWTHNGWNSTLESICEGVPMICRPQFADQMINMRYVQEVWKIGFELEGELERGKVEMAITKLLCTEEGRQMRQRAKDLRDKAVMCIEDEGSSKSAIDLLLKRIMSF

SEQ ID NO: 5307 - DNA, 933 bp, Panicum virgatum
  misc_feature: Ceres CLONE 1818633
  misc_feature: Encodes the peptide sequence at SEQ ID NO. 5308
gaggaggcgaggagtctcggagacctagttgacaggttgaactcaacccaccagcgtcagggcggtggcgccgccgaatcgctgcgccggcgcgcagcgcgctcccccgccgattgccgggccgcttcactgagcttgttccgcagcctccgctgggatttgcaacccggtttctcgctagccgtttcgaaggatgaccgcggcgtcggcggcgttcatggagcgggcgctcgagcaggccaagttcgcgctggacaacctcgaggtccctgtaggatgcgtgattgttgaggatgggaaggtgatttcctctggtagcaacaggacgaatgccactcgaaatgctaccagacacgctgagatggaggccatcgatatcctacttcgggagtggcagaagatgggtcttgatcaggcacaggttgcggataaattcgcaggatgcgacctttatgtcacttgtgaaccctgtataatgtgtgcaacggcattgtcgatccttggaataagagaagtatactttggttgtgccaatgacaaatttggaggatgtggctcaatcatgtcgttgcaccagggttctacttcatcagatgatttgtcagggagccaaccccctaaaccaaaaggtttcaaatgcaccggagggatcatggctggagaggcagtggctctttttaagtgtttctatgagcaaggaaacccgaatgcaccaaggcctcacagaccagtacgaatacctctacagtgacaggtttctttagcttgactacaaacttaatgcggaggatatcagttctcagcagcgcaggcatacagactctgtacaagatacaatgccaccttttccacttgactctttaaacaatatgcatttcttttcgcgaagaatgcctttgacatataattttacaaaaaaaaaaaaaaaaaaaa

SEQ ID NO: 5308 - protein, 185 aa, Panicum virgatum
  misc_feature: Ceres CLONE 1818633
  misc_feature (6)..(110): Pfam Name: dCMP_cyt_deam_1 Pfam Description: Cytidine and deoxycytidylate deaminase zinc- binding region
MTAASAAFMERALEQAKFALDNLEVPVGCVIVEDGKVISSGSNRTNATRNATRHAEMEAIDILLREWQKMGLDQAQVADKFAGCDLYVTCEPCIMCATALSILGIREVYFGCANDKFGGCGSIMSLHQGSTSSDDLSGSQPPKPKGFKCTGGIMAGEAVALFKCFYEQGNPNAPRPHRPVRIPLQ

SEQ ID NO: 5309 - DNA, 1493 bp, Panicum virgatum
  misc_feature: Ceres CLONE 1818640
  misc_feature: Encodes the peptide sequence at SEQ ID NO. 5310
accagtgcagtgaagcctgctcccccagacccccactccccgtttggccgcggagcccggcggcgactcggattccatcggatccttcctcggctggcgtccagcgcgcgacggaaccggccggccaatggcagctgcgcggcggccggcggcgggggcgaaggcgaggggcggcggtggaggcgcggggaggaggagcgcgtggctggccgcggacgggagcaaacgctggggggaggccttcttcctgctctacacgcccttctggctcacgctctgcctcggcgtcatcgtccccttcaagctctacgagaggttcacggagctggagtacctgattctcggattggtgtccaccgtgccggcgttcctcatccccctcttcctcgtagggaaggcagatagtgtgagaagtttgaaagatcgatactgggtcaaggctaatatctggattataatttttagctatgttggtaactacttctggacacattacttcttcacggttcttggtgcttcgtatacttttccctcatggcggatgaataatgtgccccacacgacgtttctcctgactcatgcttgtttcctgttctatcatatggcatcaaatatgacacttcgcagattacgtcactctacagctcacttaccacagtctattcgatggttatttgatgccgcatggattttggcactttcatacttcatcgcatacttggagaccctagccattgcaaatttcccgtattatgaatttgttgatcgggatataatgtacaaagtaggttcattgttctacgcaatatatttcattgtcagcttcccaatgttttcaaggatcgacgagaaagatgagaagtggaacctgtccagggtagctgttgactctttgggcgcagccatgctcgttacgataatactggacctctggcgcatatttctggggccaatagtacccatccccgagtccaggcggtgcggtcagccggggctcgcgtggttccatgcgcagaactaaagcatctgacccggcgaagctgcaatgatcctgtgtttccacgagcattattagagactgataaaatcctcctctcccgtcggctgaggctgcaccagaggcatgatgtgaagtgcagagcggctgtgtcatcgtgaatatttgcgtgttgtcgtcttgtaatgttatgtatcaggtccatgccatattggtactggtactctgctgaattctgcttggtctttgctaggatgcgtcagccacaggtgaagctagtagtgaataaagcttcgcacagagcagtaatttgcatgtctgtggtctatctgtacgatgtagcttcgccttcccgtggtccgcaacattgttgtagaaaggagagtggtttttttttttttttggttttgttctgcatttcattatggccatccatttgattgattaatagctatcgtgcaagggtgcattccagcaaaaaaaaaaaaaaaaaaaa

SEQ ID NO: 5310 - protein, 297 aa, Panicum virgatum
  misc_feature: Ceres CLONE 1818640
  misc_feature: Great-hit functional homolog of the protein sequence given in SEQ ID NO 9417
  misc_feature (19)..(293): SWISSPROT Homolog: EC 5.5.1.9 Cycloeucalenol cycloisomerase
  misc_feature: Useful for making plants with altered sterol content
MAAARRPAAGAKARGGGGGAGRRSAWLAADGSKRWGEAFFLLYTPFWLTLCLGVIVPFKLYERFTELEYLILGLVSTVPAFLIPLFLVGKADSVRSLKDRYWVKANIWIIIFSYVGNYFWTHYFFTVLGASYTFPSWRMNNVPHTTFLLTHACFLFYHMASNMTLRRLRHSTAHLPQSIRWLFDAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRRCGQPGLAWFHAQN

SEQ ID NO: 5311 - DNA, 2305 bp, Panicum virgatum
  misc_feature: Ceres CLONE 1818680
  misc_feature: Encodes the peptide sequence at SEQ ID NO. 5312
aaaaaaaaatccacccatccacctcccacactcttccgtgtacccgtgaaggtcgagaactcgagatgcaacgcatggcgatgcgccgctgccaatgccgtgattggattggatcccgttccgtttggcgccacccccgatgtggactgacgacgaggtcgtgttgccttcgtcttcctcgtcctgttggcccgcggacgcctcaaacattgcaacacgcccctcgcattggccaataattgcccccaccattagggcagagcgaaaggaagcatctttggcgattcccgtggccgacgggaccggccgattttattggccatctgccaccgctggaaggattggtttttgccttccttgattcgattctcctggccgagaggagaggaggaggcattgattgcgcgccccctgctcccatctctgccttcgggcctccatccaattgctgttctgagcattgagggggcgagcaaggaactcgctgcccggccggccggcgatgggggaggagggcacttggccgttgctcaaggagtaccactaccacccggggtgccccggctgcgcttacgaccggaggaaggacctcctcaggggaatgccgtacaaggagttcctctatgtctggatggtttctctcacggccgctttaccaatatcatcattgttccccttcttgtattttatgataagagacttgaatgttgctaaaagaacagaagatatcggcttctatgccggttttgtaggtgcttcatttatgtttggtagatgcttgacttcaacagcttggggaatagcggcagaccgtattgggaggaaaccagttgtcatgtttggcattttctccgtggttgtgttcaatactttgtttgggctaagtgtcaactattggatggcaattgctactcgatttttgctgggtgctttaaatggtctacttggaccaattaaggcttatgccattgaagtttgccgaccagaacatgaatccctagcattatcacttgtcagcacagcatggggaataggtctcatcattggtcccgctctaggaggctaccttgcactgcctgcagaaaattttccaaatatcttttcacctgactcgttctttggaaggtttccatatttcttaccatgcttatgcacatcagtctttgctgttgttgttctcataagctgcatatggatgccgaagactttgcacaagcataaagttagtgaaaatgaaaaccagagcattgaagctttggaggctcatctgattgatccaaaagaaaaggttgaagaaagtggaagtttgggtaccaagaagaagagcttattcaagaatcggccattgatgtcatcaataattatctattgcatcttctccttccatgacatggcttacacagaggtgttctctctatgggctgaaagtgacaagaagtatggtggactcagtttatcgtccgaggatgtaggtcaagtcctggcagttacaggtgccagtcttcttgtatatcaactgttcctgtaccctcgtatcaataaagttattgggcctataaattcttctcgaattgcagcaatcctgtgcatacctatcctctttgcctacccttatatgacatacctttcagaacctggattatcaatcgttctcaatattgcatcggtgataaaaaataatctttctgttaccatcattacaggcactttcatccttcaaaacaatgccgtgcctcaggatcaaagaggagctgcaaatggattgtctatgacaggaatgtcgtttttcaaggcagttgctccagcaggagcaggcattgtgttctcgtgggcacagaaaaggcagcatggttttttctttccaggtgatcagatggtgttctttcttctgaatgtgattgagttgcttggacttatcctcacattcaaaccctttttggctgtgcctgagcaatataatagaaattagaactcaaattgtagaagcttagggatattcaaacagagtcttgcaccagtgaggtagagggcataatgcccatccacaaggaggaacctgaaagagggagattgagtagttgttgcgtgtaactgcaagtgttgtatgtaattgcagcaatgcagtagaggaaatgtatagttggtaaatggcagccaatcgatttcttgcttttgattaggcaggcattttgtgccgagttgctgcactgtaaagtagaaataatgtgaggaacaggagctcgaaattatttgttcgacgtgaaattcgtagacatttctatccgaaaaaaaaaaaaaaaaaaaa

SEQ ID NO: 5312 - protein, 488 aa, Panicum virgatum
  misc_feature: Ceres CLONE 1818680
  misc_feature: Great-hit functional homolog of the protein sequence given in SEQ ID NO 9326
  misc_feature: Useful for making plants with modulated flowering time
  misc_feature: The plant flowers significantly late compared to wild-type.
MGEEGTWPLLKEYHYHPGCPGCAYDRRKDLLRGMPYKEFLYVWMVSLTAALPISSLFPFLYFMIRDLNVAKRTEDIGFYAGFVGASFMFGRCLTSTAWGIAADRIGRKPVVMFGIFSVVVFNTLFGLSVNYWMAIATRFLLGALNGLLGPIKAYAIEVCRPEHESLALSLVSTAWGIGLIIGPALGGYLALPAENFPNIFSPDSFFGRFPYFLPCLCTSVFAVVVLISCIWMPKTLHKHKVSENENQSIEALEAHLIDPKEKVEESGSLGTKKKSLFKNRPLMSSIIIYCIFSFHDMAYTEVFSLWAESDKKYGGLSLSSEDVGQVLAVTGASLLVYQLFLYPRINKVIGPINSSRIAAILCIPILFAYPYMTYLSEPGLSIVLNIASVIKNNLSVTIITGTFILQNNAVPQDQRGAANGLSMTGMSFFKAVAPAGAGIVFSWAQKRQHGFFFPGDQMVFFLLNVIELLGLILTFKPFLAVPEQYNRN

SEQ ID NO: 5313 - DNA, 1471 bp, Panicum virgatum
  misc_feature: Ceres CLONE 1818729
  misc_feature: Encodes the peptide sequence at SEQ ID NO. 5314
aagtgtgtgtgtgtagctagtcaactcttctcgatctcctctctggcctgttctctgcctgctgctgctttaatttagagtatttgttttccaatcaatccctggcagttagttgaataatcgtcttggtcgtcgatcgcaaattgggccaattcaactccattatatccaactccgccgccgcgccggtggtcttgttccattattcctgccccagaacagagtactgaagagatgagcagcggcaacggcggcggcggcgaggacgacgacgtcctggaccacgagtaccaagaggtaggattctcgatatgatactccgtcgtccgtcctcctatttgatagatctcgtctaagactaattaacagctcgatcgatctgctgcgcgcggccatggatcgatctatctactgcatgattattaataggagtatgtgaggaactcgcgggggatgagcctgttcgcatgcagatggctgcctgggaagaggtggacgacgaagcagggtcctcccaaggcgctcatcttcctctgccatggttacgctgtggagtgcggcgttaccatgcgcggcaccggcgagcgtctggcccgtgccggctacgccgtgtacggcctcgactacgagggccacggccgctccgacggcctgcagggctacgtgccagacttccaggccctcgtccaggactgcgacgactacttcgcctccgtcgtccgccgctcccacgtccgcaggttcttccttctcggcgagtccatgggcggcgccgtcgctctcctcctccaccgcgctcgccccgacttctgggccggcgccgtgctggtggcgcccatgtgcaagatcgccgacgacatgcggcctcacccggtggtcgtcaacatcctgagggccatcacctccatcatccccacctggaagatcgtgcccaccgccgacgtcatcgacgccgcctacaggatgcaggagaagagggacgagatccggggcaacccctactgctacaaggacaagccgcgactcaagaccgccttcgagctgctcaaggtcagcttggacgtcgaggccaacctcctgcacaaggtgtcgttgccgttcctgatcgtacacggcggtgcggacaaggtgacggacccttcggtgagcgagctgttataccaatcggcggcgagccaggacaagacgctcaagctctacccaggcatgtggcacgccctcacctctggtgagtcgcccaacaacatccgcactgttttccaagatatcatcgcttggctggaccacagatccatctcgatggaggacctgccagcagaggtggagcagaaggccaggcatgacgaccaccaccaccatgcagcaggcaacaccaaatagctagctgcatattgtctctcaatgtatacacacacatgaatgcatgtagctaggatccaatataatggagcaatagttcaattattgtgat

SEQ ID NO: 5314 - protein, 308 aa, Panicum virgatum
  misc_feature: Ceres CLONE 1818729
  misc_feature (1)..(225): Pfam Name: Abhydrolase_1 Pfam Description: alpha/beta hydrolase fold
MSLFACRWLPGKRWTTKQGPPKALIFLCHGYAVECGVTMRGTGERLARAGYAVYGLDYEGHGRSDGLQGYVPDFQALVQDCDDYFASVVRRSHVRRFFLLGESMGGAVALLLHRARPDFWAGAVLVAPMCKIADDMRPHPVVVNILRAITSIIPTWKIVPTADVIDAAYRMQEKRDEIRGNPYCYKDKPRLKTAFELLKVSLDVEANLLHKVSLPFLIVHGGADKVTDPSVSELLYQSAASQDKTLKLYPGMWHALTSGESPNNIRTVFQDIIAWLDHRSISMEDLPAEVEQKARHDDHHHHAAGNTK

SEQ ID NO: 5315 - DNA, 1577 bp, Panicum virgatum
  misc_feature: Ceres CLONE 1818839
  misc_feature: Encodes the peptide sequence at SEQ ID NO. 5316
aaacctcttcaagtccacacaaggcgaagcagcagcaaacccgacgcgaaagcaaccaccgcaaaaggacgcgaccccacccacccgagatccatggccggcggcgacgtcgaggccgccgccgcggcgccgcttctgcccccgccggcgtcggacgggccctccccctccccggcgccgccccccgccgaccgcctcggcgtcggctacctcgtcttcttcaccctgggcgccggcttcctgctcccctggaacgccttcatcaccgccgtcgactacttcgccttcctctacccgggcgcgcccgtcgaccgcgtcttctccgtcgcctacatgctctcctgcctcctgccgctgctcctcatcgtgctctgcttccccaagtccagcgcccccgcccgcatcaactcgggcctcgcgctcttcacgctcgcgctcctcatcgtccccgccatggacgccgtctacgtcaaggggaggcccggtctgtacggcgccttcgacgtcactgtcggggcaaccgtactgtgcggggtcgccgacgcgctcgtgcagggaggggttatcggcttcgccggggagctgcccgagaggtacatgcaggccgtcgtcgccggaaccgccgcctcaggtgtgcttgtctcagcaatgagagtctttaccaaggcactctacccacaagacgcacatggcctaaggcaaagcgcaatcctctacttcatcgtcggcattgtggtcatgatcatgtgcattgtgtgctataatgtggctgacaggcttccagttgttgtgtactacaagaacatcaagaagagagctcagaaggcagaggttggcggtggcatgacaggtcctgcctggcgatcaactttgtggagcatcgttgggacagtgaagtggtatggaataggagtgatcctcatctacgcggttacactctccatattcccaggatacatcacagaggacgtgcactctgagacactcaaggactggtatcccatcctcctcatcagtgcctacaatgtgtttgacctcgttggcaaggctttgccagctgtttacttcctccagaatgccaacatcgcggtcgcaggctccttcgctaggcttctgttctaccccctcttctatggctgcctgcacggccccaagttcttccgcacagagatcccagtcacagtactgacatgcctgctgggtctcaccaacgggtacctgacctccatcctcatgatcctcgcgcccaaggctgtgcccatccaccactcagagaccgccgggatcgtcatagtgctgttccttgtggttggtcttgtcattggttcgtttgtagcttggttctgggtcatctgatagggattcctctgtgtattcatgccaatgtatcatagcaccatgttcaagcttcctgcttgctgctgtttcatttgcgcaacccaatggccaagggtacctgtaattcattagtgtagcccaggtgaaagactgggcaaatgtgtgtaatttacattctatggaaagcagccaaatgttcatatcaacaaacttagctccaaaaaaaaaaaaaaaaaaaa

SEQ ID NO: 5316 - protein, 420 aa, Panicum virgatum
  misc_feature: Ceres CLONE 1818839
  misc_feature (1)..(281): Pfam Name: Nucleoside_tran Pfam Description: Nucleoside transporter
MAGGDVEAAAAAPLLPPPASDGPSPSPAPPPADRLGVGYLVFFTLGAGFLLPWNAFITAVDYFAFLYPGAPVDRVFSVAYMLSCLLPLLLIVLCFPKSSAPARINSGLALFTLALLIVPAMDAVYVKGRPGLYGAFDVTVGATVLCGVADALVQGGVIGFAGELPERYMQAVVAGTAASGVLVSAMRVFTKALYPQDAHGLRQSAILYFIVGIVVMIMCIVCYNVADRLPVVVYYKNIKKRAQKAEVGGGMTGPAWRSTLWSIVGTVKWYGIGVILIYAVTLSIFPGYITEDVHSETLKDWYPILLISAYNVFDLVGKALPAVYFLQNANIAVAGSFARLLFYPLFYGCLHGPKFFRTEIPVTVLTCLLGLTNGYLTSILMILAPKAVPIHHSETAGIVIVLFLVVGLVIGSFVAWFWVI

SEQ ID NO: 5317 - DNA, 1946 bp, Panicum virgatum
  misc_feature: Ceres CLONE 1818858
  misc_feature: Encodes the peptide sequence at SEQ ID NO. 5318
ggcggcctcctccctcccaaaaagcagagcaagagcatggagaggaatagggtgggcatagttggcgcaggtgtgagtggcctagcagcctgcaagcatgtgctcgacaagggatttagcccagtggtgtttgaggctgacggaagcatcggtggagtgtgggcgcatacctttgagtcgacaaggcttcaagcgccaacaacagcataccgcttctcagatatggcttggccagagagtgtgacagaggcatacccaagccaacacaaggtcatgaagtatataaggtcatatgcatgcagatttcaactcctcaagtacatcaagttcaatagccaggtgcttggtgttgagtaccttggtgcgactgaggaagagataatgagctgggagcaatggtcaggcaatgggacagcattcggaactgggaaggatggagggtggcgcatcacagtgaaaaacttgaaggtcggtgacactcaggtttttcaagtggattttctcatcttgtgcattggaaggcatagtggaaccccaaatatccccaaaattccggcaaatgggcctgagttgttcaagggcaaaatattgcactcactggactactcttacatagataatgttgctcattttgttaagggtaagcacgtcacaataattgggtctggaaaatcagcatttgacatagctgcagaggttgccaaggtgaatggtgcagttcagccatgcaccatcatatatagaacaagacactggctggtccacaaatctagcatatggggagttgacctcagttacttctatctaaatcgcatctcgcagctgctacttcataaacctggtgaaggatttctacgatatatgttggctactgcactgtctcccttgcgatgggcgatctcaaaagtgatcgaaacttacttcaagtgcagcattcccttacaaaagcatgggatggtacctgattacagcttctcctttgctatgtcctcatgcttgattgcaatgctgccggaagggttttatgacagggttgacgaaagcagcattattctcaagaaatccaaggcattcaacttctctaatgatggaatcatcctgcaagacagaaaggaaaacataaaaagtgatattgtgattctagcaacaggattcagaggagatcagaagcttaggaacatcttcacagcaaattggtgtagaaagatagtggcaggatcacaggatacatcagctcctctatacagagaatgcatccatccgcggattcctcagttggcgatagttgggtactctgagagccttactaacatatatgcctcagagaggatggccaattgggttgcccatttcctggctggtggtttcaaattgccaagcataacatgcatggaaaagagtgtagcagaatgggccaagtacaagaatgtatacaacgggaagtattttcgcaggtcctgcataagcaccattaacatctggttaaatgatctgttttgccaagacattggatgcaaccctaaaaggaagaaagggttcctggctgaatggttccagccatatggacctgctgattatgaaggtctctcctgcaggtagttgcatctctcttagtccatattcatagagaatgatgaagagaccagagttattacatccattactgcacagacgatttggaagggctttatcttcaaaagttaatgttactgtcagtacaggagaatatttccacgatgttctgcatccagttttaattcaggcaggagaaataatgagctatcattagcaatgtgtaacctacaagtaaaatctgtatggtgtttcaactgtatggtttgaattaccagatcgacctaaaattagtctgcaatgttctgtctacagcttcaaattcaagcacagagaagataatatcgaacattcaaaaaaaaaaaaaaaaaaaa

SEQ ID NO: 5318 - protein, 520 aa, Panicum virgatum
  misc_feature: Ceres CLONE 1818858
  misc_feature (1)..(505): Pfam Name: FMO-like Pfam Description: Flavin-binding monooxygenase-like
  misc_feature (1)..(28): Pfam Name: Amino_oxidase Pfam Description: Flavin containing amine oxidoreductase
  misc_feature (1)..(36): Pfam Name: DAO Pfam Description: FAD dependent oxidoreductase
MERNRVGIVGAGVSGLAACKHVLDKGFSPVVFEADGSIGGVWAHTFESTRLQAPTTAYRFSDMAWPESVTEAYPSQHKVMKYIRSYACRFQLLKYIKFNSQVLGVEYLGATEEEIMSWEQWSGNGTAFGTGKDGGWRITVKNLKVGDTQVFQVDFLILCIGRHSGTPNIPKIPANGPELFKGKILHSLDYSYIDNVAHFVKGKHVTIIGSGKSAFDIAAEVAKVNGAVQPCTIIYRTRHWLVHKSSIWGVDLSYFYLNRISQLLLHKPGEGFLRYMLATALSPLRWAISKVIETYFKCSIPLQKHGMVPDYSFSFAMSSCLIAMLPEGFYDRVDESSIILKKSKAFNFSNDGIILQDRKENIKSDIVILATGFRGDQKLRNIFTANWCRKIVAGSQDTSAPLYRECIHPRIPQLAIVGYSESLTNIYASERMANWVAHFLAGGFKLPSITCMEKSVAEWAKYKNVYNGKYFRRSCISTINIWLNDLFCQDIGCNPKRKKGFLAEWFQPYGPADYEGLSCR

SEQ ID NO: 5319 - DNA, 1979 bp, Panicum virgatum
  misc_feature: Ceres CLONE 1818872
  misc_feature: Encodes the peptide sequence at SEQ ID NO. 5320
gtcgaccctccagcagccggtagtttaccacttctgcccctccggcgagcgccggcccgttccttcccgcccgcgcccatggcctctcccggcgtgacgcctccgccgtcgacgtcgcctcccccgccccctccacctcgcccgcctcccccaccgccgccgcctgccgggagccccaaccacagccagagccacccaccggcggcgatctcgtcgccgctgctgcagcagcccgacgcggacgcgccgccgctctcgcggtggctgcgccgcctggaggcgttcctctcggcggcggggctggcggcgtcgacccgcctcggcgtggccgccgcggcctccgcgctcgccgtgctgggcctcgcgctgcccgccgcggccgtcgcgctctccccgtgccacggccgccgcctcgcctgcgacgacttcgaggtcgaggcgttcgaggtctgcgtgctgctctcgcaggccgccgccggggccgtcgcgctcgcctgcgtgtccaggaagatggccatgtacggcatccgcaagttcctcttcgtcgacccggagctcgggatgaggatccggttccagaaggagtacgtcgccaaaatccaggactttttccgcacacttacctggtggatattgccatgctttgttgtgaaggttactcgagaattcttccgtttttcccacattgtccaggagtcggtctggggagcatgtgttgtattttttgcttccatcatgtcatggatgtatttgacaacaatattactgtcatcctgtatgctcttcaacctggtttgcaatctgcaagttatccactttgacgactatggaaaacttctagagcaagatgcggatcctttggtctatttgaaagagcacctgcagctccgccataacctctccaagatcagtcacaggtttcgcatgttcctcttactgctcttcctttctgttacagcaagccagtttgccattcttttcaagacaacagcctacaatggtccgatcaatttcaccaatggaggtgacatagctgtttcttcagttgttcaagttgttggtctcgtcctctgtttacacgctgctgctaagatctcccacagagctcaaaacatctcttcaatagctagtcgatggcacgcactagcaacatgctctactgattctaattatgtgaccaccccaaatggttctgggaaccttgtgccctttcctgcacatctgtttctgagggattattcagaaagtgatctggagtccctggagactgcctccctacatggcaattctgctggcacagcgcagttggcttcgtacatgtcttcataccacaagagagaatcacttgtgctgtaccttctagcgaatccaggcggcatcacaatatttggctggatcgttgaccggacattcctaaacaccatcctgatgctcgagttaactcttgtgctctttgtgcttagcaagaccgttgtggtcccaggcaaaacactcatgcacagttacatcgggttcccatgactacaactacaacaccatcgcagtgcacggattcaaacattcagggtcagttaaaaggccatgattttgatggtgacacgttgccagggcttgcacgccagagtgggagaaaatggtagcaatggtggcaaatttggtttctctcaaggcgcagatcatatgcacattatgccactccaggcatttgggatcaatgggctccaaggctggctgatgcaaaggatatgccgtgtacagttttgggcgggttaagtggtttgaggcatctattctttttttttgctgtgtatatacgaaatgtatatgctactataaaccactagacaaaatattttttatcggcctcttttgtcaatcatggagtgcattatgtaagtgtatatatatacatttctaacaagctagatgagccatgatgccattttggctctctttacgaaaaaaaaaaaaaaaaaaaa

SEQ ID NO: 5320 - protein, 480 aa, Panicum virgatum
  misc_feature: Ceres CLONE 1818872
  misc_feature (175)..(233): Pfam Name: Peptidase_M10_C Pfam Description: Peptidase M10 serralysin C terminal
  misc_feature (4)..(51): SWISSPROT Homolog: EC 3.4.21.10 Acrosin precursor
MASPGVTPPPSTSPPPPPPPRPPPPPPPPAGSPNHSQSHPPAAISSPLLQQPDADAPPLSRWLRRLEAFLSAAGLAASTRLGVAAAASALAVLGLALPAAAVALSPCHGRRLACDDFEVEAFEVCVLLSQAAAGAVALACVSRKMAMYGIRKFLFVDPELGMRIRFQKEYVAKIQDFFRTLTWWILPCFVVKVTREFFRFSHIVQESVWGACVVFFASIMSWMYLTTILLSSCMLFNLVCNLQVIHFDDYGKLLEQDADPLVYLKEHLQLRHNLSKISHRFRMFLLLLFLSVTASQFAILFKTTAYNGPINFTNGGDIAVSSVVQVVGLVLCLHAAAKISHRAQNISSIASRWHALATCSTDSNYVTTPNGSGNLVPFPAHLFLRDYSESDLESLETASLHGNSAGTAQLASYMSSYHKRESLVLYLLANPGGITIFGWIVDRTFLNTILMLELTLVLFVLSKTVVVPGKTLMHSYIGFP

SEQ ID NO: 5321 - DNA, 1615 bp, Panicum virgatum
  misc_feature: Ceres CLONE 1818933
  misc_feature: Encodes the peptide sequence at SEQ ID NO. 5322
acactctccactgtactagcaatctatctccagagtccagatccccgcccacatcctcctaggtcctagccgactactgtgccggcgatgaggaagacgggggtgacctccgccaccacaggcgcagccgcaggaggaggaggggcaggctggccgtgcggcggcggcctcaacctcagcgtgaggctcaacgtgctgctgctgctgtcggtggtggccaccaacctggtgtccctctaccacctctccctccgcgccgacaccgcgccgccggtcctcctccagcagcgccagcagcagggcggcgaccaggaggagctggccctgatccggcagctggacgccatccgcgcgggcgtgtcgcagctgaaccacctccgttcctcgtccccgccgccgccgcctcccccgctggagctgctcctctactcccgcctcgcccccgtcgcctccgcctgctccgcgcacccggaccttctccaccggtacatgtcctacacccccttcgcgccctgccccgacgacgccctctccctcgccgagccgctcctcctccgcggatgccacccgctcccgcgccgccggtgcttctcccccaccgcctccgcgtccgcgtccaagctcctccccgacgaccccttctccccgctccccgacgccgccgtccgctggcccaaggaggggaattgcaaatctttctcctgcctgcagccgtcgctgggcttcgacgtggcgcgcacggaggccgctcggttcctccgcgcgcggagcgccctggacctgacggcgccgcagctcctgcggctggcgtcgttgagccgcgcggggcccatccggctggggctcgacgtcggcggcggcacgggcacgctggcggcgcggctcaagaagctcgccaacgccacggtggtgacgaccaccatgaacctgggcgcgccgtactcggaggcggcggcggcgcgcggggtggtgccgctgcacgcgccgctgcagcagcggttcccggtgggggacgggaccatggacctggtgcaggcggggcacgccgtcaaccgctggatcccggaggtggcgctggagttcctgtggtacgacgccgaccgggtgctgcgcccgggcgggctgctctgggtcgaccacttctggtgccggaggagcgacctggagggcgtctacgccgccatgctgcggaggctcggctacaagaccatcaagtgggccatcgccgacaagagcgtcgccggcggcggcaacggtggcaaggacgaggtctacctcaccgcgctgctgcagaagccattcagctaggtgggtggcgcacaatgtgaaattgaagttcatcgatcaatggagcatcgatcttcttggctgaagaccgaagcaatgcagattgcagtcagcttgtgctatacgcttgcagtttctgcagcaatgtgtgcaagccaagctgttgaactgatgggcaagcaaccttggcattttttcatcattgtatgtaaatgggagtattaatgtcataattagcagccgtcctctagagaatttcgtccagtgattaacaggcctcaccatatgacagcaatttttcctccactaaaaaaaaaaaaaaaaaaaa

SEQ ID NO: 5322 - protein, 406 aa, Panicum virgatum
  misc_feature: Ceres CLONE 1818933
  misc_feature (1)..(96): Pfam Name: Methyltransf_11 Pfam Description: Methyltransferase domain
MRKTGVTSATTGAAAGGGGAGWPCGGGLNLSVRLNVLLLLSVVATNLVSLYHLSLRADTAPPVLLQQRQQQGGDQEELALIRQLDAIRAGVSQLNHLRSSSPPPPPPPLELLLYSRLAPVASACSAHPDLLHRYMSYTPFAPCPDDALSLAEPLLLRGCHPLPRRRCFSPTASASASKLLPDDPFSPLPDAAVRWPKEGNCKSFSCLQPSLGFDVARTEAARFLRARSALDLTAPQLLRLASLSRAGPIRLGLDVGGGTGTLAARLKKLANATVVTTTMNLGAPYSEAAAARGVVPLHAPLQQRFPVGDGTMDLVQAGHAVNRWIPEVALEFLWYDADRVLRPGGLLWVDHFWCRRSDLEGVYAAMLRRLGYKTIKWAIADKSVAGGGNGGKDEVYLTALLQKPFS

SEQ ID NO: 5323 - DNA, 1996 bp, Panicum virgatum
  misc_feature: Ceres CLONE 1818949
  misc_feature: Encodes the peptide sequence at SEQ ID NO. 5324
attcgcctgatcaaatcaaccggccggggaggttggggaaagggaggaaattttagttcctggctcttcttgttgttgttgttgctgttccgtagtattgttgttggagctagcggtgttagttcttcacaagatcgctcgctcgtgtcacccatgctgggcttctgcgcccccgcggccgggtcccctccggacgacgccacgccggagccgttccgctcgctgcagatcgccaccacggccgccgccgccgccacgacgaagaagaagcgccggccagccggcacaccagacccggacgcggaggtggtgtcgctgtcgccgcggacgctgctggagtcggaccggtacgtgtgcgagatctgcgggcaggggttccagcgcgaccagaacctgcagatgcaccggcggcggcacaaggtgccgtggaagctgctgaagcgggaggccggggaggcggcgcggaagcgggtgttcgtgtgcccggagccgagctgcctgcaccacgacccctcccacgcgctgggcgacctcgtcggcatcaagaagcacttccgccgcaagcacagcggccaccgccagtgggcctgcgcccgctgctccaaggcctacgccgtccactccgactacaaggcccacctcaagacctgcggcacccgcggccactcctgcgactgcggccgcgtcttctcccgggttgagagcttcatagagcaccaggacacctgcaccgccgggcgggcacgggcgggcgcctcgccggcgtgtggaggcggcggcggcggcgtgggcgtggctgctgctagtgccgggtcgcggcagcaggcgccgccgccggccctgtcgctgtcacggacagcgtcgagcaccagcccgtcaagcgacgtcgtcatcagcccggcggcctggccgggtccgccgttgccgagccctacggccgccgcgttccacggccggttcgatcgtgtcccgtcgccgcggacgccaccgtcagagcaccactgcggcggtcgcacgcacaacctcgagctgcagctcatgccgccgtcctgcagcgtcgcgggcggcggtggtgcgccgggaatggcggcgttccgcggcgcgcagagctcgcctgccgtttcctcgcggggcgacgccgccgccgccattcagctgcagctgtccatcggcgtcttcggcggcgggcccggggacgcgggcgagcgcggcggcgaggcgctggtcgcggcggcgagggcgaggcaggaggtggaggcgcgggagctgctgcggcaggcggtggcggagaaggcggcggcggacgaggcccgcgcgcaggcgaggcggcacgcggagctggctgagcaggagctggcgagcgccaagcggatgcggcggcaggcgcaggtggagctgagccgcgcgcacgcgctccgcgagcacgccgtgcgccaggtcaacgcgacgctgctccagatcacgtgcctcggctgccgccacaagttccgcgcgcggccggcgccgccccccgatgtcgcctgcagctacgtctcctccgtcgtgaccgagggcggcgacgccgaggtcgacgagccgccgcccctggacgccgatggcggcggcatgcggcggcgccagcacgccatggccatggccatggacatcgtcctctaggtagaggctggatcgagctagctagccttcttcctggtctacctttcaattacttgttgttttatcaacgagacgcccgtgttggcgcattcgcggtgagcttgttgtaattgatcagatgctgctgatatggaagatagctagcttgatcgccccggatagctgcttagtgttggagtccagtgagagcagcaggagaggtagccaagcggagacgaagacgaaggctagctgctagctcactgtgacgtgcatggaatcttttggtgtttgcttcccattggatctagttggaaaaacatttctcatgcatgaaaagcaaaaaaaaaaaaaaaaaaaa

SEQ ID NO: 5324 - protein, 500 aa, Panicum virgatum
  misc_feature: Ceres CLONE 1818949
  misc_feature (1)..(23): Pfam Name: zf-C2H2 Pfam Description: Zinc finger, C2H2 type
  misc_feature: The sequence is a functional homolog of  SEQ ID NO 178 in the  10/225,068 US patent application
  misc_feature: The sequence is a functional homolog of  SEQ ID NO 1785 in the  10/374,780 US patent application
  misc_feature: The sequence is a functional homolog of  SEQ ID NO 358 in the  10/374,780 US patent application
  misc_feature: Useful for making plants with modulated growth and phenotype characteristics
MLGFCAPAAGSPPDDATPEPFRSLQIATTAAAAATTKKKRRPAGTPDPDAEVVSLSPRTLLESDRYVCEICGQGFQRDQNLQMHRRRHKVPWKLLKREAGEAARKRVFVCPEPSCLHHDPSHALGDLVGIKKHFRRKHSGHRQWACARCSKAYAVHSDYKAHLKTCGTRGHSCDCGRVFSRVESFIEHQDTCTAGRARAGASPACGGGGGGVGVAAASAGSRQQAPPPALSLSRTASSTSPSSDVVISPAAWPGPPLPSPTAAAFHGRFDRVPSPRTPPSEHHCGGRTHNLELQLMPPSCSVAGGGGAPGMAAFRGAQSSPAVSSRGDAAAAIQLQLSIGVFGGGPGDAGERGGEALVAAARARQEVEARELLRQAVAEKAAADEARAQARRHAELAEQELASAKRMRRQAQVELSRAHALREHAVRQVNATLLQITCLGCRHKFRARPAPPPDVACSYVSSVVTEGGDAEVDEPPPLDADGGGMRRRQHAMAMAMDIVL

SEQ ID NO: 5325 - DNA, 1108 bp, Panicum virgatum
  misc_feature: Ceres CLONE 1818974
  misc_feature: Encodes the peptide sequence at SEQ ID NO. 5326
ttttttttccgcaggctccaccaagcagccagcaggaggcttagcagcagaagagcagaagcctcccctaccttcgctatgcagcccatcaaggtgtacgccgaccggcggtcgcagccctcccgagccgtcatcatcttctgcagggtgaatcagatcgatttcgaggagatcacggtggatctgttcaagtctcagcacctcactgccgaattcagaaaaataaacccaacgggacaagtgcctgcaattgttgatggaagattcaaactatatgagagtcatgctattttgaggtatcttgcgtccgtgttccccggagttgcagatcactggtatcctgctgacttgttcactagagccaaaattgagtcaatcttggattggcatcactcaaatctgcgtcgtggtgcagcaacccttgtaatgcacacagcactggctccctttcttggtcttgcaacaagtcctgatgctgtaaaacaagcagaaaaacttctaatgcagtcactaggaaggattgaatcagtgtggctgaaggatgatgcaaagttcttgctaggtagcccccaaccatcaattgcagatctaagccttgtttgtgaaataatgcagttggagatccttggcaattacgtacgtgaccgatttctgggagctcatgagaagatcctcatctggatggataatgtgaagaaagccaccagccctcattttgaggaagcccatgagctccttttccaagtgaaggccagcaggctaaacaatgctgctgcagcaaaccagacttccgagccaagcacgaagctcaaaattgtgtcaaagctctgagctgtagaggggaagatgctgttgcaacttgcaagtataaatagaacattgcaataagcgttgggaagagatgatgggcgctgtgaagattgtggagctttgcatagatcagcaagtaacccccaccatactaagtggttccttgcggatcatattgtgttgtccgtgaggaaagtttaaaataaaactggacttgtatgaaaactgcttatctacgctgtacatgatccttactagtgaatccattgcctgaatcgaaaaaaaaaaaaaaaaaaaa

SEQ ID NO: 5326 - protein, 250 aa, Panicum virgatum
  misc_feature: Ceres CLONE 1818974
  misc_feature (3)..(76): Pfam Name: GST_N Pfam Description: Glutathione S-transferase, N-terminal domain
MQPIKVYADRRSQPSRAVIIFCRVNQIDFEEITVDLFKSQHLTAEFRKINPTGQVPAIVDGRFKLYESHAILRYLASVFPGVADHWYPADLFTRAKIESILDWHHSNLRRGAATLVMHTALAPFLGLATSPDAVKQAEKLLMQSLGRIESVWLKDDAKFLLGSPQPSIADLSLVCEIMQLEILGNYVRDRFLGAHEKILIWMDNVKKATSPHFEEAHELLFQVKASRLNNAAAANQTSEPSTKLKIVSKL

SEQ ID NO: 5327 - DNA, 1560 bp, Panicum virgatum
  misc_feature: Ceres CLONE 1818989
  misc_feature: Encodes the peptide sequence at SEQ ID NO. 5328
aaaccaaccctacccccaaaccagatcgaatccgatccctcgcctcccctcgcctccccccctcctcgccgaatccgcgctgatccgcggcgatggacaacgacgacgacgacgtgtcgcccgacgcctccccgtcgccggcgtcctccccgggggcgccctccgccgcgctccccgtcgccgaccccgtcaccgtcgcctccgcgccgcccgggggcgcctacccggtcgcgctcccgatccaccggaccgcggcgtccttgtacgccaccgccagcggcggcggcgggggcgagggaggcggcggcggcgggagggaggacgcgtggagcgagggcgccacctccgcgctcatcgacgcctggggggagcgcttcgtcgcgctcggccgcggcagcctccgccacccgcagtggcaggaggtcgccgacgccgtctcctcccgcgacggctactccaagtcgcccaagtccgacgtccagtgcaagaaccgcatcgacacgctcaagaagaagtacaaggtcgagagggccaagccggtatcctcctggcagttcttcgaccacctcgacgttctcctcgcacccacctacggcagcaagcccggctccggctccgccggcggcagcggcggcgggaacaactctaacagccgcagcccgctccctgcgccgctgcggatgggcttcccgcagcgcagccgcacgccgttgatgccctccgccgcagcggcggcggccaagcggagagccccgtcgccggagccgtcggtgtcttccgagtcctcagacggcttcccgccagtgccggcgctcctggcggcgaacggaaagaggaggaggacggacgaagggcgcgccgatggtggcagcggcggcgaccgcacacagggcctccgtgacctggctcaggcgatacgccgcctcggggaggcgtacgagcgggtggaggccacgaagctggagcaggcagctgagatggagcgtcagcgtatagacttcgcgcgggagctggagtctcagcgcgtgcagttcttcctcaatgcgcagatggagctcacgcaggccaagaatcacgcttctgccgcggccgccatccctgccggtgccaccactgttggtggctcatctaggagaatgtcgttggcgaacgatgctggtggcagcagtaatcaccatagccgttactgctgcggccgtggggaccggcaccatcatgccccgtgctcacattaccagcaataccatgacaacaatcatgctgccgccgctgcaagtgagggtgatcagtccgaggaggaggacgatgaggaggaagaagaagagagccagtaatttcggcgattcgccgtgtttcaagaatttgtattggtattgtcatagaattattgcattgctccaatttaacttatatgtgatctcaaaggagagatgatgacctgggagcagtggaaattggtcatcttagtaaaagtactagtattagcattagatagtccttgctgtaccacgatgttagtcaattctttgcttgtttctccaaaaaaaaaaaaaaaaaaaa

SEQ ID NO: 5328 - protein, 413 aa, Panicum virgatum
  misc_feature: Ceres CLONE 1818989
  misc_feature: The sequence is a functional homolog of  SEQ ID NO 2856 in the  10/374,780 US patent application
  misc_feature: The sequence is a functional homolog of  SEQ ID NO 466 in the  10/225,066 US patent application
  misc_feature: Useful for making plants with modulated growth and phenotype characteristics
MDNDDDDVSPDASPSPASSPGAPSAALPVADPVTVASAPPGGAYPVALPIHRTAASLYATASGGGGGEGGGGGGREDAWSEGATSALIDAWGERFVALGRGSLRHPQWQEVADAVSSRDGYSKSPKSDVQCKNRIDTLKKKYKVERAKPVSSWQFFDHLDVLLAPTYGSKPGSGSAGGSGGGNNSNSRSPLPAPLRMGFPQRSRTPLMPSAAAAAAKRRAPSPEPSVSSESSDGFPPVPALLAANGKRRRTDEGRADGGSGGDRTQGLRDLAQAIRRLGEAYERVEATKLEQAAEMERQRIDFARELESQRVQFFLNAQMELTQAKNHASAAAAIPAGATTVGGSSRRMSLANDAGGSSNHHSRYCCGRGDRHHHAPCSHYQQYHDNNHAAAAASEGDQSEEEDDEEEEEESQ

SEQ ID NO: 5329 - DNA, 1768 bp, Panicum virgatum
  misc_feature: Ceres CLONE 1819027
  misc_feature: Encodes the peptide sequence at SEQ ID NO. 5330
gtttgcctgctcggtttcgatcggtcgcctccccacgtcctcttttcctcctccgctcctccccgtgcgggaaggcaggcaaagctcagaccgggggcgtggaatccgacgccctccctctctcgccgaccggcggctagccttcgtccgcgtcttcttcttcctcgtcgccgccgccgagcggcttcggctccgaccaccttcggctgtcccgcgggcttcctctacgatttcaccccgaccgatcgattcgattccatggccggctggagcaattccaccggcggcggcggcgggcgaggagcaggaggaagaggcttcacgaatcgccactttactagttataccagcgacatgatccacggtggttccagcagcggtggcggcggcggcggtggcaggtggagaggagacaggtcgagggggaggccgcccccgcagcctcactattgctaccgccctgtagatgctgctcatcgccaagcccaacccgtatctgaacaacaggcggcctcctcctcttccagccgcatccaacagcgaacatatccgatcccaacggcagacaagtcatctgcctccgggaccgcggctccacccagcaccagggagcctgatgacaaggctacacgcagtgctgccaattttgagtgcaatgtctgctttgacatggctgctgagcctgtcgtcaccaagtgcggacatctcttctgctgggagtgcctctatcagtggctccatgtgcactccaaccaccgtgaatgccctgtatgcaagggccaggttgccgacgacgcgatcatacccatctatgggcgtggtggctctgcagcctctgtggacaacgcactgccaaggcccaccggagccagagtcgagagctccaggcagcagcagcagctaccaactttccctcccaccgtatatgtggatgatgatgaagaagacccctttgatttcccaggcatgatgaacttcggctttggagctacagctacctcactcagagatgctgttatgagcttcatgcctcccagctttcaagacatggcgatcgaagagtttgatgactactcctatgagtatgacaccgatgactttgatgaggtctatgactacaattggctgggctttccagtgtttggatccgctggggctgaggctggcaatcccatttcttcacaggcacatgctgatatgataaatattaggaacaacattgttggcactaccactggcatctatcatcagcaagaagttggctaccctggtgcaaaccctagtaacagagggagacgtcgccgtaaccgtgcaaggccatcagcagataagtcgagcaccaacgggattgtgatgggtggaagcggtggtgctttctaccgtaacaatggtgccagttataatgttaccgcaggtgcttcttctcggcctaacggcggctgggttgagagacaaggaagaagcagcaggaattcaaattcagctggtggaagaggagggatgcaggatagcaggagacagaggacaaattacaattgatgctaatatccggtgaggctcgatgacagcagggttgagataaacaaacaaagttgtcaatccttcttttttgtttttctctcttcatccttttgtagtccgtggctgtgtgcagccttggtaaacatactggacgcattttctttctttttccctgatggaatgtgtggtagactggctgaaatactctgcttgcttgcttgctgttagtacattcgatacctgcact

SEQ ID NO: 5330 - protein, 426 aa, Panicum virgatum
  misc_feature: Ceres CLONE 1819027
  misc_feature (1)..(41): Pfam Name: zf-C3HC4 Pfam Description: Zinc finger, C3HC4 type (RING finger)
MAGWSNSTGGGGGRGAGGRGFTNRHFTSYTSDMIHGGSSSGGGGGGGRWRGDRSRGRPPPQPHYCYRPVDAAHRQAQPVSEQQAASSSSSRIQQRTYPIPTADKSSASGTAAPPSTREPDDKATRSAANFECNVCFDMAAEPVVTKCGHLFCWECLYQWLHVHSNHRECPVCKGQVADDAIIPIYGRGGSAASVDNALPRPTGARVESSRQQQQLPTFPPTVYVDDDEEDPFDFPGMMNFGFGATATSLRDAVMSFMPPSFQDMAIEEFDDYSYEYDTDDFDEVYDYNWLGFPVFGSAGAEAGNPISSQAHADMINIRNNIVGTTTGIYHQQEVGYPGANPSNRGRRRRNRARPSADKSSTNGIVMGGSGGAFYRNNGASYNVTAGASSRPNGGWVERQGRSSRNSNSAGGRGGMQDSRRQRTNYN

SEQ ID NO: 5331 - DNA, 1847 bp, Panicum virgatum
  misc_feature: Ceres CLONE 1819036
  misc_feature: Encodes the peptide sequence at SEQ ID NO. 5332
ataacttgcctttctttccccggcgtcgcctccctcctccttccattccgcccccctctctcttcttcaatcctccccgcgccggagttggagggagaggggatacgctttccgccgccaacccagcggcccgagtcgccaatccgcgcgccgagccgatccggttgatcaagcacatcactgcctttagggaagccctttgaacagtagtttgttccgcaaatcagataattctgtcacagcatggcctcagcaggggttacacgctcttctttgggatttcagaatgacacaagttctagcagtgatgcagatcgacttccgaacgagttgggcaatatgaacattagggatgataaggacgttgaagatattgtagtcaatggcaatgggacagagcctggtcatatcatagtgactagcattgatgggagaaatgggcaggcaaagcagaccattagctacatggcagagcgcgtggtaggtcatgggtccttcgggactgttttccaggccaagtgtctggaaactggtgagaccgtagctataaaaaaggttcttcaagacaagagatataagaaccgtgagctgcaaactatgcgagtgcttgaccacccaaatgtggttgctctgaagcactgtttcttttcaaagactgagaaggaggagctttacctcaatttggtgcttgaatatgtgccagagactgcacatcgtgtcattaaacattataacaagatgaaccagcgcatgcctttgatatatgcaaaactttatatgtatcagatttgtagagctttggcatacattcataactgcatcggagtgtgccacagggacataaagccgcaaaatctcctggtgaatcctcatactcatcagctgaaattgtgtgactttggcagtgcgaaagttctggtaaaaggagaaccaaatatttcttacatctgttctaggtactacagagctccagagctcatatttggtgctactgaatacacaacagcaattgatgtttggtctgctggctgtgttcttgctgagctgcttctagggcagcccctgttccctggagacagtggtgttgaccagcttgttgaaatcatcaaggttctgggcacaccaacacgtgaagaaatcaagtgcatgaatccaaattatactgagtttaaattcccgcaaatcaaagctcacccatggcataagattttccataaaaggatgcctgctgaagcagttgatcttgtatccaggcttctgcagtactcacctaagcttcggtctactgcattggaagcattgatccatccattctttgatgaacttcgggatccaaacacacgcttaccaaatggtcgtttccttccacctctcttcaacttcaacccccatgagctgaaggatgtgccgatggactttctggtgaagttgatccctgagcatgcacggaagcaatgcacctttgtaggatggtgatctgtgactgagaggatggcttgaagattagttaaggaccaaattgatgtctgttagaaaccagtggagaccgacattgcctgctgtgctataagatgggcaatgcgtgatttttttgtccgagtatcaccccccaacccccacaaaggaaaacaaaatgttgtcaatgtaaccagatcatccgccattctgtaaagtattagaagagtgttggaggcttggagcatgccccctgagtccatgtatcagtttgcctgatttgtagtagcaccatgcaaggatgcaccctttgtatgacaatgttcggtccaacatttgctttggatcgaggctattcattcatttgtactcaaaaaaaaaaaaaaaaaaaa

SEQ ID NO: 5332 - protein, 410 aa, Panicum virgatum
  misc_feature: Ceres CLONE 1819036
  misc_feature (1)..(408): SWISSPROT Homolog: EC 2.7.11.1 Shaggy-related protein kinase gamma
  misc_feature (1)..(409): SWISSPROT Homolog: EC 2.7.11.1 Shaggy-related protein kinase alpha
MASAGVTRSSLGFQNDTSSSSDADRLPNELGNMNIRDDKDVEDIVVNGNGTEPGHIIVTSIDGRNGQAKQTISYMAERVVGHGSFGTVFQAKCLETGETVAIKKVLQDKRYKNRELQTMRVLDHPNVVALKHCFFSKTEKEELYLNLVLEYVPETAHRVIKHYNKMNQRMPLIYAKLYMYQICRALAYIHNCIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFHKRMPAEAVDLVSRLLQYSPKLRSTALEALIHPFFDELRDPNTRLPNGRFLPPLFNFNPHELKDVPMDFLVKLIPEHARKQCTFVGW

SEQ ID NO: 5333 - DNA, 1704 bp, Panicum virgatum
  misc_feature: Ceres CLONE 1819063
  misc_feature: Encodes the peptide sequence at SEQ ID NO. 5334
agccttctaccagcattccgttcgtttccaattggccctccactcctccactcgtcaactcatccagcgcgctctgctgctcttctccaatcagcgcccccagctgacccgccacgagcgccaatggcagccgccgcggctctggccgccgtcctggcgctgtcctgctgcggcgccgcgtccgccacggccgtgacggcagcggcggaggcggaccgcatcggaagcctgccgggccagccgccggtcaacttctccatgtactccggctacgtcaccgtcgacgcggccgcggggcgggcgctcttctactggctcatcgaggcggccggcgtgccctcggagtcctcgccgctcgtgctctggctcaacggcggtcccgggtgctcctccgtcggctacggcgcgtcggaggagctcggcgccttccggatcaacgccgacggcaggacgctctccttgaacgcctacccctggaacaaagtggcgaacatgctgttcttggactcgccggccggcgtcggctactcctactccaacaccacctccgatctgtacactgccggtgacaacaagacagcccatgactcgtacactttcttggtgaattggttggagcggtttccacaatacaagtatcgagatttctacatcacaggagagagctatggaggtcactatgtgcctcagttgtctcagctagtataccggaataacaaaggagttgaaaagccaatcctaaacttcagaggcttcatggtcggaaatgcggtaattgacgactaccatgactacattggaacatttgagtactggtggacgcatgggcttatctcagatgaaacctatgagaagttgcagctggcctgtgagttcgatgtatctgagcacccgtcggaggagtgtaagaagattttagaagttgctgcggcggagcaagggaaaattgatgcatacagcatctatactccaacttgtaagaagacttcattgcataagcgccggctaataagaggaagaacgcactggcttcccagaggatatgatccctgcaccgagaagtactccacaaagtactacaacttacctgaggtgcagaaagctttacatgccaatgtcactggaataccatatgcctgggtaggctgtagcgacccaatttatgaatattggaaagattcaccgaggtccatgcttcctatttaccgtgaacttattgcagcaggcaaacggatatgggtgttcagtggtgatgctgattctgttgtccccctcactgggacgagatactccatcgatgcactctctctaccaacagtgacaaactggtacccttggtatgatggcaaagaggttggtggatggtgccaagtgtacaagggtttgacactggtgactatccgaggtgcggggcacgaggttcccctccacggcccgcagcaaggtctgaagctcttcgagcacttcctgcgcgatgaagccatgcccaagcctgtacatagcattcagacgttttagaatgtgctgtctcgcttgatgaagaagaacagggtgcgccaagccatggtgttgtaaaacatttgctgccttcagtgaacgattttgcctgtgctaacgttggccgggcgtcacatttccactgttacggacgatttcataaaatcagaatagaataaggcaatgtagtttcaactttcaagctgc

SEQ ID NO: 5334 - protein, 464 aa, Panicum virgatum
  misc_feature: Ceres CLONE 1819063
  misc_feature (1)..(413): Pfam Name: Peptidase_S10 Pfam Description: Serine carboxypeptidase
  misc_feature (3)..(455): SWISSPROT Homolog: EC 3.4.16.6 Serine carboxypeptidase 2 precursor
  misc_feature (30)..(455): SWISSPROT Homolog: EC 3.4.16.6 Serine carboxypeptidase 2 precursor
MAAAAALAAVLALSCCGAASATAVTAAAEADRIGSLPGQPPVNFSMYSGYVTVDAAAGRALFYWLIEAAGVPSESSPLVLWLNGGPGCSSVGYGASEELGAFRINADGRTLSLNAYPWNKVANMLFLDSPAGVGYSYSNTTSDLYTAGDNKTAHDSYTFLVNWLERFPQYKYRDFYITGESYGGHYVPQLSQLVYRNNKGVEKPILNFRGFMVGNAVIDDYHDYIGTFEYWWTHGLISDETYEKLQLACEFDVSEHPSEECKKILEVAAAEQGKIDAYSIYTPTCKKTSLHKRRLIRGRTHWLPRGYDPCTEKYSTKYYNLPEVQKALHANVTGIPYAWVGCSDPIYEYWKDSPRSMLPIYRELIAAGKRIWVFSGDADSVVPLTGTRYSIDALSLPTVTNWYPWYDGKEVGGWCQVYKGLTLVTIRGAGHEVPLHGPQQGLKLFEHFLRDEAMPKPVHSIQTF

SEQ ID NO: 5335 - DNA, 1494 bp, Panicum virgatum
  misc_feature: Ceres CLONE 1819093
  misc_feature: Encodes the peptide sequence at SEQ ID NO. 5336
gctgatcgtcgtcatcgcccagcgtgcccgctcggccgccttcctgcccatacggtcataccatacggcccaacgaactcgatcggaaacgtgcacgcatcgtcccgcgaccgcgaaccaaacacccccaaccggtcggtcttcctatccccctcatagtcatctccgactctctctgcaagtctgaaactccaaggcatagccagaggcaaccatggagcagcagcggcagcaaggggccgcggccaggcggatggccacgctcgcctcccacctgcgcccgcaacgcgcatcctctcaccctcagatggaggagggacccctcctaatgggatccaattgtcgtgcaaaaggggcggcgccaggcttcaaagtcgcgatcttaggtgcagctggtggaatcgggcagccactcgcgctactgatgaagatgaaccctctcgtttcggtgctccatctatatgatgtcgtcaacacacctggtgtcacagctgacattagccacatggatactggtgctgtggtgcgtggattccttggccagccacagttggaaaatgctctaactgggatggatcttgtgataattcctgctggtgtccctcggaaacctgggatgacaagggatgatctgtttaacatcaatgctggaatcgcccgtactctttgtgagggaattgcaaaatgctgccccaaggcgattgtgaatgtgatcagtaatcctgtcaattctaccgttcccattgctgctgaagttttcaagaaagctgggacatatgatcccaagcgccttttgggggttacaacacttgatgtagtgagagccaacacttttgtgggagaggttcttggacttgatcccagagaagtcaatgttcctgtcattggtgggcatgctggagttacgatattaccactcctttcacaggtaaatcctgcctgctcattcacttcagaagaggttaatcacctcacttctcgcatacagaatggtgggacagaagtagttgaggctaaagctggggcaggatcagcaactctttcaatggcgtatgccgctgctaaatttgcagatgcttgcctaagaggattgcgtggtgatgctggaatagtggagtgctcttatgtagcttctcaggtgacggatctacctttctttgcatccaaagttcggttagggcgctctggcgttgaggaaattttgccacttgggccgttgaatgagtttgaaagagctggtctcgagaaggcaaagaaagagctggcccagagtatccagaagggcgtctctttcatcaacaagtgaggcaggacatctagcaaatgtccaaccccaacatagagaaagatttgccgtgttttggcttcctgctggaaaccattgtattgtaatgtctctgtaaaactgtgtacatggcgtgaatgaatgatctacacggctgtactaaaaaggataaatcttttctttggtcgcaaaaaaaaaaaaaaaaaaaa

SEQ ID NO: 5336 - protein, 363 aa, Panicum virgatum
  misc_feature: Ceres CLONE 1819093
  misc_feature (1)..(165): Pfam Name: Ldh_1_C Pfam Description: lactate/malate dehydrogenase, alpha/beta C-terminal domain
  misc_feature (12)..(361): SWISSPROT Homolog: EC 1.1.1.37 Malate dehydrogenase, glyoxysomal precursor
  misc_feature (9)..(363): SWISSPROT Homolog: EC 1.1.1.37 Malate dehydrogenase, glyoxysomal precursor
MEQQRQQGAAARRMATLASHLRPQRASSHPQMEEGPLLMGSNCRAKGAAPGFKVAILGAAGGIGQPLALLMKMNPLVSVLHLYDVVNTPGVTADISHMDTGAVVRGFLGQPQLENALTGMDLVIIPAGVPRKPGMTRDDLFNINAGIARTLCEGIAKCCPKAIVNVISNPVNSTVPIAAEVFKKAGTYDPKRLLGVTTLDVVRANTFVGEVLGLDPREVNVPVIGGHAGVTILPLLSQVNPACSFTSEEVNHLTSRIQNGGTEVVEAKAGAGSATLSMAYAAAKFADACLRGLRGDAGIVECSYVASQVTDLPFFASKVRLGRSGVEEILPLGPLNEFERAGLEKAKKELAQSIQKGVSFINK

SEQ ID NO: 5337 - DNA, 1483 bp, Panicum virgatum
  misc_feature: Ceres CLONE 1819189
  misc_feature: Encodes the peptide sequence at SEQ ID NO. 5338
acgcccacacactccacagtccacaccaccgcagcccactgccagctcctcagctcgcgcaaccgtagaggggaaccgaccggccggcgttcgtgcacgcgtcgagagagagagcgagagcgaggacgatgaagttgagctccgccgtgcccgcggtgtcggcggcggcggcggtgatgctgatgctgctgctgctgctgctctcggcggcggcgaccgcgaggggccaggcgctggtgcccggcgtgatgatcttcggcgactcggtggtggacgccggcaacaacaaccggctggccacgctggtgcgcgccgacttcccgccctacggccgcgacttcccggcgacgcacgcgcccacggggcgcttctgcaacggcaagctcgccacggactacaccgtggagaacctggggctgaggtcgtacccgccggcgtacctgagcgaggaggcgcagagcaacaacaagagcctcctccacggcgccaacttcgcctccggcgccgccggctacctcgacgccaccgccgcgctctacggcgcgatctctctgagccggcaggcggagtacttccgggagtaccagtcgcgggtggcggcgtcggccggcgagcagcgcgccaagacgctgacgtcggggtccatctacgtggtgagcgccggcaccagcgactacgtgcagaactactacgtgaacccggtgctgggcgccgcctacacgcccgaccagttcgccgacgcgctcatgcagcccttcacctccttcgtcgagcgcctgtacagcctgggcgcccgccggatcggcgtgacgtcgctgccgccgatggggtgcctcccggcgtccgtcaccctgttcggcggcggcaacccgggctgcgtggagcgcctcaacaacgactccctcaccttcaaccgcaagctcggcgccgccgcggacgccgtcaaacgccgccgcccggacctcaagctcgtcgtcttcgacatctaccagccgctgctcgacctcgtcaacaaccccaccagcgccgagttcttcgagtcgcggcgggcgtgctgcgggacgggcacgatcgagacgtcggtgctgtgccaccagggtgccccggggacgtgctccaacgccacgggctacgtcttctgggacggcttccaccccacggacgcagccaaccgggtgctcgccgacgcgctgctgttccagggcctgcagctcatagcctgatcgagatgcgcggcagcctccggggagaaaatacacgccaattcccgctgcccttccatcatcctacctaccagcaaatgtaccttgctttagtttttctgttgttctgtgctgcttgcttgctgtttgtttgtttgctgtctgtcttatctgtccatccatgatctctcgtagtcgttttgtgctgcttagaaacagttggacttgtgtaagagtgtcgctctgtataatttttgtgttcaaaaaaaaaaaaaaaaaaa

SEQ ID NO: 5338 - protein, 364 aa, Panicum virgatum
  misc_feature: Ceres CLONE 1819189
  misc_feature (1)..(318): Pfam Name: Lipase_GDSL Pfam Description: GDSL-like Lipase/Acylhydrolase
MKLSSAVPAVSAAAAVMLMLLLLLLSAAATARGQALVPGVMIFGDSVVDAGNNNRLATLVRADFPPYGRDFPATHAPTGRFCNGKLATDYTVENLGLRSYPPAYLSEEAQSNNKSLLHGANFASGAAGYLDATAALYGAISLSRQAEYFREYQSRVAASAGEQRAKTLTSGSIYVVSAGTSDYVQNYYVNPVLGAAYTPDQFADALMQPFTSFVERLYSLGARRIGVTSLPPMGCLPASVTLFGGGNPGCVERLNNDSLTFNRKLGAAADAVKRRRPDLKLVVFDIYQPLLDLVNNPTSAEFFESRRACCGTGTIETSVLCHQGAPGTCSNATGYVFWDGFHPTDAANRVLADALLFQGLQLIA

SEQ ID NO: 5339 - DNA, 1605 bp, Panicum virgatum
  misc_feature: Ceres CLONE 1819192
  misc_feature: Encodes the peptide sequence at SEQ ID NO. 5340
aactcagcccagcccattagccagtgccccgcaccacgcacgacgtgtccggccgggctcgcctcgccgccgccgcgaaccgcagcgccgtcaccgatggcggacgtggcggcggcgtcgctcttcggcgctgaccgccgcctctgctccgctgacatcctcgcacccgctgaggttcgggcaaggatcgaggtggcggtgctcaacttcctctccgcgctcgcctcccccacctcgccggcaatctccgtcctccccctgattagccggacctctgccaactgcagcctacgcagcagcttgctgagtgacgtttcgtcagtttatctctcgtacgccttctgcaagaggtctctgatgagagaaaacaacgcaaaggcgttcgtaagagtatggaaggtcatggagatgtgctacaagatcttgggggaggggaagctggtccaccaacgggagttgttctacaagctcctctcggactcgcccaagtacttcagttgtcagcgccacgtcaaccgagccatccaagatgtagtttccttgctgcggtgtacaaggcagagcctaggagtcatggcatcaagcagaggggcactgattgggcgcctcgtgttacatgaaccagatgaagaacagactgactgttccattcttggagcttcagggcatgcaattactggagacctcaacgtattgagcaaattaaatttgtcttcagatgctcggtatatcattgttgtggagaaggatgccatattccagaggctagctgaagaccgcttgtataatcagcttccttgcatcctgatcactgcaaaaggatatcctgatattgccacaaggtttatcttgcatcgattgagtcagacttttcccaatatgccgattttcgcattagtggactggaacccagcagggcttgctatactgtgcacttacaaatatggaagcatatcaatgggtttggagtcatacagatatgcttgcaatgtgaaatggcttgggctaagaggggatgatctgcagcttatccctgggagtgcattccaagagctgaagccacgtgattcgcagattgccaaaagcttgctgtcatcaaagttcctacaggagagtcacagagctgagctgacgctgatggtggagagtggcaagcgtgcggagatcgaagccctctactcccacgggttcgatttcttggggaagtacatcgcgagaaagattgtacagggcgactacatctgacggacgctgccatgtgccgtgttgtttattcctctgcttgtactgagcgcagaaatgttagcatggttgcatgggacaattagctgcatgaaccacagttacatccaatgcctgtagattgttacagtgatgatgtcgaatttatacacaaataggaaagactgctgttaatgaactcgaggcatgctcgtctcgtcagcgtctgaagagatcaccttcctgttcggccgagtttctgaagtttgagtaactttggtttgaggagcgaccggtgtactagatgtaaagtttcgttatccctgtccgtgcttttttttatggaaaactggacaacaactgactaaacactggagttctatc

SEQ ID NO: 5340 - protein, 382 aa, Panicum virgatum
  misc_feature: Ceres CLONE 1819192
  misc_feature (1)..(72): Pfam Name: TP6A_N Pfam Description: Type IIB DNA topoisomerase
MADVAAASLFGADRRLCSADILAPAEVRARIEVAVLNFLSALASPTSPAISVLPLISRTSANCSLRSSLLSDVSSVYLSYAFCKRSLMRENNAKAFVRVWKVMEMCYKILGEGKLVHQRELFYKLLSDSPKYFSCQRHVNRAIQDVVSLLRCTRQSLGVMASSRGALIGRLVLHEPDEEQTDCSILGASGHAITGDLNVLSKLNLSSDARYIIVVEKDAIFQRLAEDRLYNQLPCILITAKGYPDIATRFILHRLSQTFPNMPIFALVDWNPAGLAILCTYKYGSISMGLESYRYACNVKWLGLRGDDLQLIPGSAFQELKPRDSQIAKSLLSSKFLQESHRAELTLMVESGKRAEIEALYSHGFDFLGKYIARKIVQGDYI

SEQ ID NO: 5341 - DNA, 1163 bp, Panicum virgatum
  misc_feature: Ceres CLONE 1819239
  misc_feature: Encodes the peptide sequence at SEQ ID NO. 5342
aactcctctcttcctccaccatccccccgtgttccctctagcaccgcctgctcgtctcgccgcgacccgcggccgccctcccccgcgccggaaccctagcgaccgccattgcccccagcgcgccgcgcccgatggacggcgggggctccggggcggcgccgtacgcggcgcgcaccgcggaggaggtcttccgcgactaccgcgcccgccgcgccggcatgatcaaggccctcaccaccgatgtggacaagttcttcaagctctgcgaccccgaaaaggagaacctgtgcctttatgggtatcccaatgagacgtgggaggttaccttgccagctgaggaggtgcccccagagatccctgaaccagcattaggaatcaactttgctagggatggtatgaatgagaaggactggctggcgctagttgcagttcacagcgattcctggttactgtctgttgcattctactttggtgcccggtttgggtttgacaaagaagctaggaagcgactctttagcatgataaacaacattcctacaatatttgaggtagtgacaggatcggccaagaagcagacaaaggagaagacgcctaacagtagcagcaagagcaacaggcctagttcaaaagtgcagtcaagagctgagtctcgttcaaaggccaaggtccccaaagatgaagaagagagtggcgacgatgatggggatgaggcggaagagcacgacaacaccctgtgtggaacttgcggaaccaatgatggcaaggaccagttctggatctgctgtgataactgcgagaagtggtaccatggcaagtgcgtcaagatcacgcccgcccgagctgagcatatcaagcagtacaagtgcccggattgcaccaacaagagggccagggcgtgagtgaccgagcagcgagcatcggtggacccatgttaggaggaaatcatctcctggcgccgagatcatccctagatatggcgtagtttcctagcctgtattatggctatatctgttgattagttgttcgacctagctgtgtctaaaacgtggcatgtctcgtgttgagttgttgacgtgagcctctctcttctctctagtatgtaaacgttgccactgaagctacctcccaactgaccatttcttcaaaaaaaaaaaaaaaaaaaa

SEQ ID NO: 5342 - protein, 255 aa, Panicum virgatum
  misc_feature: Ceres CLONE 1819239
  misc_feature: The sequence is a functional homolog of  SEQ ID NO 1645 in the  11/479,226 US patent application
  misc_feature: The sequence is a functional homolog of  SEQ ID NO 782 in the  10/412,699 US patent application
  misc_feature: The sequence is a functional homolog of  SEQ ID NO 816 in the  10/412,699 US patent application
  misc_feature: Useful for making plants with modulated growth and phenotype characteristics
MDGGGSGAAPYAARTAEEVFRDYRARRAGMIKALTTDVDKFFKLCDPEKENLCLYGYPNETWEVTLPAEEVPPEIPEPALGINFARDGMNEKDWLALVAVHSDSWLLSVAFYFGARFGFDKEARKRLFSMINNIPTIFEVVTGSAKKQTKEKTPNSSSKSNRPSSKVQSRAESRSKAKVPKDEEESGDDDGDEAEEHDNTLCGTCGTNDGKDQFWICCDNCEKWYHGKCVKITPARAEHIKQYKCPDCTNKRARA

SEQ ID NO: 5343 - DNA, 1217 bp, Panicum virgatum
  misc_feature: Ceres CLONE 1819436
  misc_feature: Encodes the peptide sequence at SEQ ID NO. 5344
gaacgcctcccaataaaaacgccaccgccccactcaccgccgtcaccggagcccggccgccgggatgcctcaagattcgcgcccagcggggatgcgcctcttcggcgtcaccatcgcgccggtgccaccgccggcgcccgaggcggatccgccggaccgggatccgagccccaacccgcccgtggcggtcagggaggacgtgatgcgcaagtgcaagagcatgggcaacctcgccgcccttggcgctgccgcggacggcggaggagccggcgctgacggtggaggtgccggcgacgggtacctctccgatggcgggctgatgcagtcgtccgggaagcggcggagggcgcaggagaggaagaaagctgttccttggactgaagaagagcacaggacatttcttgctggtcttgaagagctagggaagggagactggaggggtatagcaaaaaatttcgttaccaccagaacaccaactcaagtagcaagtcatgctcagaaatattttcttagacagactaatccaaacaagaagaagcgcagatctagtctttttgacatgatgccaggcgagctgtcaccagcacccaattgccccatcttaccaccatcaatggcaaaagtacatgatgtggtagctatgacgagacaactccaaaatagcaacttggaaggaggctcatcttcgaacgcagctaatatagcacctcaagttggaagagatcttcccccagttccagcttttagggcaacaaatatggactcaagtttcagcaaactgaaccgcatggagcccttctggagaacaccctatccattcagaccagttccaagttctcctgacgggacatctccatcaactcctgttgctgccaatatagcttctcaggtttccaaagctaacccaattgcatgtactagcacattcttgagcccgcgaagtgaggcatcatcattgcctccgaaggcagatcctccagcagagatgaaggatttggaactgactgttgccccaacctcccaacaaaacatgaccaatatgtcttcccagaatgcggtaggcgtgattcatgtcatctaaactaatatttttttttggaagctactatgtttattgactgttgatcaaataatcattaacattctattagcaatacatcaataaaaagcatgggttataagataaccattatctgcaaaaaaaaaaaaaaaaaaaa

SEQ ID NO: 5344 - protein, 338 aa, Panicum virgatum
  misc_feature: Ceres CLONE 1819436
  misc_feature (1)..(48): Pfam Name: Myb_DNA-binding Pfam Description: Myb-like DNA-binding domain
MPQDSRPAGMRLFGVTIAPVPPPAPEADPPDRDPSPNPPVAVREDVMRKCKSMGNLAALGAAADGGGAGADGGGAGDGYLSDGGLMQSSGKRRRAQERKKAVPWTEEEHRTFLAGLEELGKGDWRGIAKNFVTTRTPTQVASHAQKYFLRQTNPNKKKRRSSLFDMMPGELSPAPNCPILPPSMAKVHDVVAMTRQLQNSNLEGGSSSNAANIAPQVGRDLPPVPAFRATNMDSSFSKLNRMEPFWRTPYPFRPVPSSPDGTSPSTPVAANIASQVSKANPIACTSTFLSPRSEASSLPPKADPPAEMKDLELTVAPTSQQNMTNMSSQNAVGVIHVI

SEQ ID NO: 5345 - DNA, 1643 bp, Panicum virgatum
  misc_feature: Ceres CLONE 1819497
  misc_feature: Encodes the peptide sequence at SEQ ID NO. 5346
tccgagcccaacgaacgcctttctttcctctcgctcgctcgctccccttcctcgccgccattaccatcctctctctcgctgcaacaagctcttgccaagtaaggaaccgcgcgcctcaccagacgccggttcgccacccctgcccatgcagccgagcggccgcgaaatgcagggcgtaggtggaggcgggcaggacgacttcttcgaccagatgctgtccacgctgccggccgcgtggtccgagctcggctccggcaagtccccctgggagctccccgccgcgggggcctccgaggacgccgcgttcgacgagtccgcgctcctcgcctcgcggctccgccaccaccagatcggcggcggcggggtggacaagcccgtcatgctccacctcagcgacctgcacggcctcgccgccggcggggaggacggcggcgccgcggggttcctgccgctgccgctgttcaccgaccgggggagggaggacatggacgccgccttcaagtcccccaatgccgctggtggcgaccaggcactgtacaacggattcggagccgccgggatgcatggcgccgccgccgtgcagccgcagtttgggcagggcggatcagtgccggcgcagagcttcggaggaggcgcggccgcgggtggcggcgggtcggcaccggcgggcgctccggcagctggagcgtcgccgggcggaggggctgcgccgccgcgccagcagcgcctgcgggcgaggaggggacaagcgactgatcctcacagcatcgccgaacgtctccggagggagaggatagctgagaggatgaaggcgctgcaggagctggtccctaacgccaacaagaccgacaaggcatcgatgcttgatgagatcattgattatgtgaagttcctccagctccaagtcaaggttcttagcatgagccgattgggtggagctgcaggggtcggccctctagttgctaacatgtcatcagagggtaatgggaatgggaacggtatgagcgacagcggagatggcaatggtgctaacggctgtggcaatggtgaaaatggcggcggcagcctgaaggtgacggagcaacaagttgccaggttgatggaggaggacatgggcaccgccatgcagtacctgcagggcaaggggctctgcctgatgcccatctctctagcctcggccatctcctctgccacatcgtcgtccctcctatcccgcccctccattggctcaatgggcagtgctagaggccctgcgcatgaaggcggcaaccctgcgtcgcctccattgatgaacggcgccggcggcgatgactcccggaccgtcaaggacgctggtgccggcagtaaacagtgaaggcagaggcagtgttcttgacttgtcaggaggttgtgtgctcaaaagcgtggtcttgtaggggtggaattgtgaaatggtgcagcaggccttttccctccacctttcctgccctccttttgtttgtttatattataagaaatgatgttgaatcatgccacctttagctctgtcttttcatgttcttgcgaaatagcttttctggtctctttacctctccttttctgggctgtgagctcctcctctaatccctagctttctttttctgcaaaaaaaaaaaaaaaaaaaa

SEQ ID NO: 5346 - protein, 402 aa, Panicum virgatum
  misc_feature: Ceres CLONE 1819497
  misc_feature (1)..(50): Pfam Name: HLH Pfam Description: Helix-loop-helix DNA-binding domain
  misc_feature: The sequence is a functional homolog of  SEQ ID NO 1488 in the  11/479,226 US patent application
  misc_feature: The sequence is a functional homolog of  SEQ ID NO 712 in the  10/412,699 US patent application
  misc_feature: The sequence is a functional homolog of  SEQ ID NO 901 in the  11/479,226 US patent application
  misc_feature: Useful for making plants with modulated growth and phenotype characteristics
MQPSGREMQGVGGGGQDDFFDQMLSTLPAAWSELGSGKSPWELPAAGASEDAAFDESALLASRLRHHQIGGGGVDKPVMLHLSDLHGLAAGGEDGGAAGFLPLPLFTDRGREDMDAAFKSPNAAGGDQALYNGFGAAGMHGAAAVQPQFGQGGSVPAQSFGGGAAAGGGGSAPAGAPAAGASPGGGAAPPRQQRLRARRGQATDPHSIAERLRRERIAERMKALQELVPNANKTDKASMLDEIIDYVKFLQLQVKVLSMSRLGGAAGVGPLVANMSSEGNGNGNGMSDSGDGNGANGCGNGENGGGSLKVTEQQVARLMEEDMGTAMQYLQGKGLCLMPISLASAISSATSSSLLSRPSIGSMGSARGPAHEGGNPASPPLMNGAGGDDSRTVKDAGAGSKQ

SEQ ID NO: 5347 - DNA, 1217 bp, Panicum virgatum
  misc_feature: Ceres CLONE 1819523
  misc_feature: Encodes the peptide sequence at SEQ ID NO. 5348
gcttctgcggctcaagtattctggagcactgctcacctgactccccagagcgatgcgctttaaaggggcggacgggctcgcctcgcctggctccttccccccgcatccacctctatccacctccgtctcccgcagcagcgagaaacgcacgaggggtacgcctcctgagatcgccgcgaggctcccagtcctcgcgtcccgctgtgcctccgctcccaaaggtttttgaaaaagagtttgttggtgttaggtgtttctcaaaagggtaaatgggatcagaaggaccttcagttgtgactgtccatgttactggatttaagaagtttcatggggttgctgagaacccaactgagaaaattgtgaccaatcttaagtcttttatggaaaagagagggttgccaaaaaatcttgtcctcagcagctgcacagttcttgaaacagctgggcagggtgcacttggcacattacataaagttttagaatctgctattacagacagagagaacgggtcgtcgacgcagggacaagtaatctggatccactttggtgtcaacagtggcgcaacaaggtttgcccttgagaaccaggctgtaaatgaagccaccttccgttgtccagatgagctaggatggaaacctcagagggtcccaattgtgccatctgatggaagcatctcgcggacgagagagactaccctaccagtgaacgaattaaccaagtcactccggaagataggctacgacgtggtgccttcggatgacgctggccgattcgtgtgcaactatgtgtactaccactctcttctgtttgcagagcaacatggcatcaaatcgctgttcgtgcatgtgcccctcttcttgacgatcgatgaggaggtccagatgcactttgctgcttcccttctcgaacttcttgcatgctcgaactaggaagaacagtctgaagcatagcggattgatctgaaagatgtaaagttggaagcagactgaataaggtggtgtggtgattgataagttaatcttgctccaaggggtgtgtttgggagggtgggaaaggtgctgcatagagtcattgtatcttcctgtggtcaatttgcggcttgtatgcatgcacgtgtgctgtaaacatgcctgaaactgaaaaattgagaacttggttatcaataaaattagagcggatgcattacacgtaaaaaaaaaaaaaaaaaaaaaaaaaaa

SEQ ID NO: 5348 - protein, 219 aa, Panicum virgatum
  misc_feature: Ceres CLONE 1819523
  misc_feature (1)..(203): Pfam Name: Peptidase_C15 Pfam Description: Pyroglutamyl peptidase
MGSEGPSVVTVHVTGFKKFHGVAENPTEKIVTNLKSFMEKRGLPKNLVLSSCTVLETAGQGALGTLHKVLESAITDRENGSSTQGQVIWIHFGVNSGATRFALENQAVNEATFRCPDELGWKPQRVPIVPSDGSISRTRETTLPVNELTKSLRKIGYDVVPSDDAGRFVCNYVYYHSLLFAEQHGIKSLFVHVPLFLTIDEEVQMHFAASLLELLACSN

SEQ ID NO: 5349 - DNA, 1227 bp, Panicum virgatum
  misc_feature: Ceres CLONE 1819538
  misc_feature: Encodes the peptide sequence at SEQ ID NO. 5350
gtgcctgccgtctgccgtgttgagggggaagagagaaggaaggggaaagaggcctggaggacggggagcctgcagccaccatggattccgagctgtggatctcgcgcctcatggccgccaagcggcagttcgcgctgcagcgcgcccagcgccagcatgccactccggcttcccatcacgatcggtttgggtatgatgatattgaaccagaggatgagggacgctcagacttcccatgtccttactgctatgaagaccatgatattacatcactttgcacccatttggaggatgagcacccatttgagtctaaagttgtggcttgcccagtttgctcggccaggatttcgaaggacttgttggaacatataactcttcagcacggctacctgttcaaattgcaaagacatcacaggttacgtagagttgctggtgctggcaaccacactctctcttatgcagggagagatcttcaagagacctacttaaaggtgctgcttggaaatagcggtcgaagcagcagcaccaccaatacatcaacttcagtcactgattcactgctatcttcattagttttaaatttatcttcatcagaagcagaagacacctcaaaatcttctgctcctgctgtggccgaaaatagttggtttaaaagatcactaccttcaaagaattggaagataagttctgctgattccaaccttagtcatgaagagagggagcagagaaggaggcgagctgtggtgagatcagcgtttgtacagcatatccttgtcactacccttttcgatgactagcaggacatagctcatgcattgaaatcatgtgggctttttgcccactcatttatctggatgaataatgagctaatcacctccggtatctcgaagttgttcatcaaactgaggctggtacctgattccatgaagctcgatgataaattgaagactcagagggcctcttaccttatatgttttatatggaagcagctctgaacatttgctgtccagatcaaattcagactgctaggcttttaactagtgttcttatagtagagtcttgatgtttctttcattggatttcgttttgtgctgcagaacgtgttgtaccttatcctatttattattactatggacatttgaatgttggctttccaactatggcgtatgcttatgaaatctatttgaaccttgcgttcatttatttcaaaaaaaaaaaaaaaaaaaa

SEQ ID NO: 5350 - protein, 238 aa, Panicum virgatum
  misc_feature: Ceres CLONE 1819538
  misc_feature (8)..(216): Pfam Name: Di19 Pfam Description: Drought induced 19 protein (Di19)
MDSELWISRLMAAKRQFALQRAQRQHATPASHHDRFGYDDIEPEDEGRSDFPCPYCYEDHDITSLCTHLEDEHPFESKVVACPVCSARISKDLLEHITLQHGYLFKLQRHHRLRRVAGAGNHTLSYAGRDLQETYLKVLLGNSGRSSSTTNTSTSVTDSLLSSLVLNLSSSEAEDTSKSSAPAVAENSWFKRSLPSKNWKISSADSNLSHEEREQRRRRAVVRSAFVQHILVTTLFDD

SEQ ID NO: 5351 - DNA, 1509 bp, Panicum virgatum
  misc_feature: Ceres CLONE 1819618
  misc_feature: Encodes the peptide sequence at SEQ ID NO. 5352
acacgctcccctcggcaagccgctgcggttgccgggcgcctgtcactccggccctgcttttttttgctctctctctctttgttggatgcagctgcttggttagcccggcccgtcgtctagcatccggccctgctgccccggccaggccgcgaccgcgattggacgccggccggccggccggcctcgctcgcaggcctttttaacaggacctcgccgtgagctctcggcggcggcggcggcggcggaatatacatatagatacatctaaccatatagctaggtgggatatatagatcatggggcggcagccgtgctgcgacaagctgggggtgaagcgggggccgtggacggctgaggaggaccggaagctcatcagcttcatcctgagcaacggccattgctgctggcgcgcggtgccgaagctggccggcctgctgcgctgcggcaagagctgccgcctgcgctggaccaactacctccgcccggacctcaagcgcggcctcctcaccgacgccgaggagcaggtcgtcatcgacctccacgccaagctcggcaacagatggtcaaagattgctgccaaactaccaggaaggactgacaacgagatcaagaaccactggaacacccacatcaagaagaagctgatcaagatgggcatcgacccggtcacgcacgagcccctcgaccggaagaccagcaacagcccggccacaacctcgcagtccgtcgtcacggccgattcaaccaagtccgacgaggcgaccaagcagcagagcccgcaaagcgacgccgtcggggacgtgttggccgacggttccagcccgacggaatcgagcgcgacgaacaccaccgtcagcacgggcggaagcatcagcagcagccacgaccaggacccgctggtgaagtggctcctggaagtggacccgcccaccggcgacgagccgtggctcaacttcaccggcagtgtcgaggtggacggcgagttcagcagcatcgccgccggtccggagttgccgtgggacggcgccaccgactggctgctcgactaccaagattttggattgggggacttgggcttggtcgatggctacatgatcaacagctcaaacggagcaaattaagttctattagctagctacatgccggtgaagatgacgatgatgcatcagctttgtgttgctaccagtgtagataagtaataaaaaaacaagcatatggaggttgtgaaaggtgaaatgaccagatcgaagggctctctctctcctagcttgatcgatccaaccaacggttgtgatgcatatttgatgggggtgtggtagagacgattagagagaggtgtgtagatttagctgtgttacttttttttctccctttgaggtcaagggatttgtgtttcttctcaaagagaagtggtagaacttcttgctgtgtagttatattttggtaatttggtgtatatatatgtgtgtattattgtacgttaagtttcactaaaaaaaaaaaaaaaaa

SEQ ID NO: 5352 - protein, 274 aa, Panicum virgatum
  misc_feature: Ceres CLONE 1819618
  misc_feature: Great-hit functional homolog of the protein sequence given in SEQ ID NO 9682
  misc_feature (1)..(48): Pfam Name: Myb_DNA-binding Pfam Description: Myb-like DNA-binding domain
  misc_feature: The sequence is a functional homolog of  SEQ ID NO 1863 in the  10/374,780 US patent application
  misc_feature: Useful for making plants with altered alkaloid content
  misc_feature: Useful for making plants with modulated nitrogen use efficiency
  misc_feature: Useful for making plants with modulated growth and phenotype characteristics
MGRQPCCDKLGVKRGPWTAEEDRKLISFILSNGHCCWRAVPKLAGLLRCGKSCRLRWTNYLRPDLKRGLLTDAEEQVVIDLHAKLGNRWSKIAAKLPGRTDNEIKNHWNTHIKKKLIKMGIDPVTHEPLDRKTSNSPATTSQSVVTADSTKSDEATKQQSPQSDAVGDVLADGSSPTESSATNTTVSTGGSISSSHDQDPLVKWLLEVDPPTGDEPWLNFTGSVEVDGEFSSIAAGPELPWDGATDWLLDYQDFGLGDLGLVDGYMINSSNGAN

SEQ ID NO: 5353 - DNA, 918 bp, Panicum virgatum
  misc_feature: Ceres CLONE 1819643
  misc_feature: Encodes the peptide sequence at SEQ ID NO. 5354
gcaacagcagcagcagcggaggaggagcggagctccagccatggcagagaagggcgtgaaggtgctgggcatgtgggcgagcccgatggtgatccgggtggagtgggcgctccggctgaagggcgtggagtacgagtacgtcgacgaggacctcgccaacaagagcgccgacctgctccgctacaatccggtgaccaagaaggtgcccgtcctcgtccacgacggcaagcctatcgccgagtccaccatcatcgtcgagtacatcgacgaggcctggaagggcggccaccccatcatgccggccgacccctacgagcgtgcccaggcgaggttctgggccaggtacgctgaagacaagtgcaaccccgcgctgtaccagatcttcaccacgaccggcgaggcgcagcgcgaggtggtgcgcgcggcccagcagtgcctcaagcccctggaggcggcgctgaaggggcggaggttcttcggcggcgacgccgtgggctacctcgacatcgtcgtcgggtggctcgcgcactggctgccggtcatcgaggaggtgtccggcgccagcgtcgtcaccgacgaggagctcccgctgatgaaggcctggttcggccggttcctcgccgtggacgcggtcagggcggccctgcccgacagggacaggctcctcgccgccaacaaggcccgccgcgagcagatcctctcctccgccgcgtagacggcttgctagggattctagcgcagacacgcaccatcaacgccatctatatatatagcagaataaggattgcacgggcacgttgtgcaacagaggtttggaagaccattttacccatgtaaatcgttactaattactatgctgttgaatcatacgagttgcctacttattcggttattcctcaaaaaaaaaaaaaaaaaaaa

SEQ ID NO: 5354 - protein, 224 aa, Panicum virgatum
  misc_feature: Ceres CLONE 1819643
  misc_feature: Great-hit functional homolog of the protein sequence encoded by LOCUS At3g09270
  misc_feature (1)..(74): Pfam Name: GST_N Pfam Description: Glutathione S-transferase, N-terminal domain
  misc_feature (1)..(95): Pfam Name: GST_C Pfam Description: Glutathione S-transferase, C-terminal domain
  misc_feature: Useful for making plants with modulated nitrogen use efficiency
MAEKGVKVLGMWASPMVIRVEWALRLKGVEYEYVDEDLANKSADLLRYNPVTKKVPVLVHDGKPIAESTIIVEYIDEAWKGGHPIMPADPYERAQARFWARYAEDKCNPALYQIFTTTGEAQREVVRAAQQCLKPLEAALKGRRFFGGDAVGYLDIVVGWLAHWLPVIEEVSGASVVTDEELPLMKAWFGRFLAVDAVRAALPDRDRLLAANKARREQILSSAA

SEQ ID NO: 5355 - DNA, 1481 bp, Panicum virgatum
  misc_feature: Ceres CLONE 1819666
  misc_feature: Encodes the peptide sequence at SEQ ID NO. 5356
atctagacgaagaaacgaaaccaggcgaattcgctgccgaggcaggtagaagcccgcaaacagtcacgcggctgcttgctttcggagcgcggctgtccctgcttctctcctcctcgacgccggggcggcactggtaggtgagcgctgtgcccgcgtgccgccgcgccgtgggaggcgggtagccggagatgcacagatcggggacggcgatggcgtggaacgtgttcaagttctgcacggcgttgcgggggttgggctccgtcatgatcctcctcgtcctcggtatcgtcggcgtcacctactacgcgctcgtcctatgcaactacgggccagcgctgctcgctgccacggcggcgcttgacgccctcgtcgcactcgcagtcctcctcctcttccacttcttgcttgtcatgcttctctggagctatttctctgttgtgtttactgaccctggtggtgttccaccaaattggaggccagatgttgacgaagagaggggtgaaactgcaccattgtccaccacagagctcaatgatacagggagttcaaggatcaggtactgcaggaagtgtaaccaactaaagccacctcggtgccatcactgttctgtttgtggaagatgtgtgcttaagatggatcatcattgtgtatgggttgtgaattgtgttggggcactgaactacaagttcttccttctgttcctgttgtatacttttctggagacagcacttgttaccctgtccttattgccccactttattgctttcttcagtgatgttgagattccaggaactcctggagcacttgcaaccacattcctgacctttgttctgaacctggcctttactttgagtgtccttggttttatgatcatgcatgtatcacttgtttctggtaacacaacaacaattgaggcatatgagaaaaaaactactccattctggaagtatgatcttggccggaagaggaattttgctcaggtttttggaaacaacaagtggtattggttcattccatcatactcagaggaggacttaagaataataccagctctgcagggcctggattatcctgtcagatcagattttgatgggcaagggttctaattagatgagtttgatgtgcacagttgccctctgtataacatgtttgatgttacagccatgccttcattaccggacagtgtctcgtgatggtcggtcttgtacaacatccttgacaactaacatcagtatggctgatctacacggtgcgatgaatgtagaggtatatatacgggggcatgtgaactcgtttctgatacttagtaatggaagaactcgctggactcccccctgtagtttgtccacagcagtgatctgttgtacatttgttttatgtatctgaaagaagcttgaaagtttttgtgctaaatgtatcaagtaacagatgtaccaattattcaagttatattctgtgaacaaaaaaaaaaaaaaaaaaaa

SEQ ID NO: 5356 - protein, 305 aa, Panicum virgatum
  misc_feature: Ceres CLONE 1819666
  misc_feature: Great-hit functional homolog of the protein sequence given in SEQ ID NO 9339
  misc_feature (2)..(65): Pfam Name: zf-DHHC Pfam Description: DHHC zinc finger domain
  misc_feature: Useful for making plants with altered Lignin content
  misc_feature: Useful for making plants with altered terpenoid content
MHRSGTAMAWNVFKFCTALRGLGSVMILLVLGIVGVTYYALVLCNYGPALLAATAALDALVALAVLLLFHFLLVMLLWSYFSVVFTDPGGVPPNWRPDVDEERGETAPLSTTELNDTGSSRIRYCRKCNQLKPPRCHHCSVCGRCVLKMDHHCVWVVNCVGALNYKFFLLFLLYTFLETALVTLSLLPHFIAFFSDVEIPGTPGALATTFLTFVLNLAFTLSVLGFMIMHVSLVSGNTTTIEAYEKKTTPFWKYDLGRKRNFAQVFGNNKWYWFIPSYSEEDLRIIPALQGLDYPVRSDFDGQGF

SEQ ID NO: 5357 - DNA, 1734 bp, Panicum virgatum
  misc_feature: Ceres CLONE 1819707
  misc_feature: Encodes the peptide sequence at SEQ ID NO. 5358
aacttgcagccgggacccgcctcgccctccacgcctcgcctttcttgccgcgcaagaaggcgcgcaccgcctttatctaccgccgcctccggcctcccgcccgctcgcagtccagtccgtccaccgcgcgccaccactttcctgttggctccctgcggcttgccttccacgcgtcccggccggcggcaccagaaccacccgttgctcgctcgctcgctcgctccgggcctccgcgagctggaaccggacaccggccggcccgcggctcgatccgtcgagctcgacatggtacgacgctctcctcgcgctgcgccgttctagtagcagttgtcacggtttcgattttgcgttgttcgattcttctactagctagcgcggcatgtgtatctacggtcgggaatcgggatacagcgacccgatacgaagtagtagaccggcgtgtcttctcgccccctgctcttccgatagatgtggtgtgctctgtatttctgtgcttggtccctttcaagtactatactggtacaatggaggtgcttggtccctttcagatgctagtggtagattgggtgtctggtcctaactcctaagtaataggagtactaagggtgtgtttagatccgcgaaaatctggtagaaaagggcacatcggatactgtagcatactgtaacatttttcgtttgtttgtagtgaatattgtcctattataggctaactaggctcaaaagattcgtctcgcaacgtacatcaaaactatgcaattagttttttttatttacctgcatttagtactccatgcatgggtcatttgctatatttaatgttttgatgtgatttcgatgtgatggaaagtttggaaagtttggaggagtttgaaggaagtgaacacagcctaactcaggaatcaggataggcgtggtagattgggccttgtggttggatccaattaattgtgtcggtgaacgcgagaaagatgggatcttgcactgtgctatgctcaaatgtctgttaaccaggaacctgaagatttcacagcttgtttacacttcgcacaaagctgtgcatttgtatgcagagtcagacattgttccgttactttcttctcaagagtctccccaactcgtgtaccttcgttaaaaatcgattcataattgaactctgaactttgtgctgtcatctgaccttttgccgggaaataatctgataccaacaggctactcccctgattgctgggttgtcagtggctgctgctgcgatgagtggaagatacatgattagagcatggcaaaccttccgaacccgggcagcaatgccgcgagtgcgccggttctatcctgggggatttcagggggacatgaacagaagagaagccgcgttgatccttggcgtaagggaacgtgctacaatggacaagatcaaggaggctcacaagagggtcatggtagctaaccaccctgatgctggcgggagccattatgttgcttcgaagataaatgaggcaaaggacatagtaatgggaaaaaggaagtctggtggttctgtcttttagctgttacaattgaaatcatgctcattttttggtgactgagatgaggctgtaacttttttgaagaaatgacagcagcacgttttcaccctttttaacaatgctgcactgattgtaccatagatctgaataactacatgttacagaattaaagtaacttttttgtctggaaaaaaaaaaaaaaaaaaaa

SEQ ID NO: 5358 - protein, 97 aa, Panicum virgatum
  misc_feature: Ceres CLONE 1819707
  misc_feature (1)..(56): Pfam Name: DnaJ Pfam Description: DnaJ domain
MSGRYMIRAWQTFRTRAAMPRVRRFYPGGFQGDMNRREAALILGVRERATMDKIKEAHKRVMVANHPDAGGSHYVASKINEAKDIVMGKRKSGGSVF

SEQ ID NO: 5359 - DNA, 1407 bp, Panicum virgatum
  misc_feature: Ceres CLONE 1819710
  misc_feature: Encodes the peptide sequence at SEQ ID NO. 5360
tttttcccccaccatctcatctcatctcatctcatctcatccaatccaacccaacccaacccaaccctagaagtagtagctgtagtagtaagcgcacgagggaggggattgcggaggtgagatcggattgattctccatcgaatcctacctataccaaaccctagaggaaatccatgtcgtcctcgtcggcggcgcagcgctactactgccaccagtgcgaccgcaccgtctccatctccccgcccgcctccccggacgacgacgtcctctgcccccgctgcggcggcggtttcgtcgaggagcttcacccagatgccagccccgccgcccccgcggccttcttccccccgccgccctccttcgatctccgccaccccggcgacctctccgccttcttcggcccgccctccccggagccgcccgtcccgggcctcttcgacccctccaacttcctccacgaccacttcggcggccttctctccggcggcgccaccatccagatcgtcctcgagggcgggagcgccgcgcccctcctcgccccgggcgtcagcctcgctgactacttcatggccccctcgggcctcgagcagctcatccagcagctcgccgagaacgaccccaaccgctacggcaccccgcccgccgccaagtccgccgtcgccgcgctccccgacgtcgccgtctccgccgacatgatgcaggccgacgggggcgcgcagtgcgccgtctgcatggacgacttccacctgggggccgccgccaagcagctcccctgcaagcacgtcttccacaaggactgcatcctcccgtggctcgacctccacagctcctgccccgtctgccgctacgagctgcccaccgacgacccggactaccagcagcgcgcgtcgtctgcccccgcccctgccccagctcccgctgcctcctcccccagggtggccgagaggaggttcatgatatcgctgccttggcctctcagggccgccttcggtgctgccgcccaggccgagtccagcaatcctaccaatgatgatgtgcctccttctggtgccaacaataatgaccatgatgcaagtggcggtggtcctcaaactcaaagtggatatgatgatctcgactgaggtctcatagtcttctggtaaagagccgttcttcgaaacaaagagggcaaagtaatgatgctcggtaggggacattctctggtgcggtactgtagcctgtttgccgtgacgaagagaaggctttttcttgatttctcattggtacttggatgtaaagaatagaaagatggaattttggtactttggatgttggtgtagggattatttttttcctctttgggtggttaggagcatgactaccttttcgctgccgctgatggaggacaaaaaaaaaaaaaaaaaaaa

SEQ ID NO: 5360 - protein, 315 aa, Panicum virgatum
  misc_feature: Ceres CLONE 1819710
  misc_feature (1)..(41): Pfam Name: zf-C3HC4 Pfam Description: Zinc finger, C3HC4 type (RING finger)
MSSSSAAQRYYCHQCDRTVSISPPASPDDDVLCPRCGGGFVEELHPDASPAAPAAFFPPPPSFDLRHPGDLSAFFGPPSPEPPVPGLFDPSNFLHDHFGGLLSGGATIQIVLEGGSAAPLLAPGVSLADYFMAPSGLEQLIQQLAENDPNRYGTPPAAKSAVAALPDVAVSADMMQADGGAQCAVCMDDFHLGAAAKQLPCKHVFHKDCILPWLDLHSSCPVCRYELPTDDPDYQQRASSAPAPAPAPAASSPRVAERRFMISLPWPLRAAFGAAAQAESSNPTNDDVPPSGANNNDHDASGGGPQTQSGYDDLD

SEQ ID NO: 5361 - DNA, 1766 bp, Panicum virgatum
  misc_feature: Ceres CLONE 1819717
  misc_feature: Encodes the peptide sequence at SEQ ID NO. 5362
ctcgcgccgcttctccagttctcctactcctacctcccctcccaatcctgctcgctcgccacctcccgccctttttaaaccaccacccgctgccaaatttgctttgcctccccaccaccaccgcttcgctgctgcggttctatagctgataaagctagctagttaggccgcgcttaattggcaggcaggcaggcagccgcgcgtctcggaggagggagggaagcgatcgacacgaggccggcggctctagctcggcgggtcggctagctgggcagcaggtgctgcggtggttctggtttaggttcctcggatcgatggggtcgtcggcggaccacggcggcgccggcgggaggggcaagaagcaggggtcgcagctctggaagaaggcgctgctgcattcctgcctctgcttcgtcatgggcttcttcaccggcttcgcgccgtcgtcggtgtccgactggacgtccgcggcggtctcggcgggcggggtgggcagcagccacgtcgtccgggcgctgcagacggccgcgggcggcgccgtcaaccggagcctcctggcgcacggcggcgcgggcctgctcgacgccgcggcggcgaccccgcggccgctgctggtggtcgtcacgacgacggagtcggcgcccgcggcgtccggggagcgcgccgcggcgctgacgcggatggcgcacacgctgcgggtggcggcgccgccgctgctgtgggtggtggtggaggccgccccggacgtgccggccacggcgcggctgctgcgcgccacggggctcatgtaccggcacctgacgtacaaggacaacttcacggccgccgacgccgccgcgggcaaggagcggcaccaccagcggaacgtcgcgctcggccacatcgagcaccaccgcctcgccggcgtcgtcctcttcgccggcctcggcgacgtcttcgacctccgattcttcgaccagctccgccagatcagcgcgttcggcgcgtggccggtggcgacgatggcgcggggcgagcggaaggtcgtggtccggggccccgcgtgcagcgcggccgcggtcaccggctggttctcccgggacttcggcggcaacggcacggcggccgccacgacggcgaggccccccgaggtggacgcccacggcttcgccttcaacagctccgtgctctgggaccccgagcgctggggccgctacccgacctccgagcccgacaagtcccaggactcgatgaagttcgtccagcaagtggttctggaagattttagcaaggtaaagggcattccttccgattgttcagaggtcatggtatggcatgtcgattcgacggccccttcttcctcttcttagcaaccatctctggagaacaacaggagatagaaagggtgattatagaagaggtcaatgaacgagccggagggcggccccagagtggtgtacattgtacatgcatagctacaccatcgaggcgctggttgccttcatgctgcaaagaagggaaattttgggtttctcaccaggggatggatcaacctctgacccccagttctccatcatattgtacaattttccactattcttttttcttaaaaaaattgtgatatatgtataatttcttcttttctcttttttttcaagagggtctaggaatacatacataatacccccttgatgtgtctctcaaggctgtaatgaaatagaaggcaagctaaaaatccacttaacaatgatgatagacattgtactcaaaaaaaaaaaaaaaaaaaa

SEQ ID NO: 5362 - protein, 344 aa, Panicum virgatum
  misc_feature: Ceres CLONE 1819717
  misc_feature (1)..(228): Pfam Name: Glyco_transf_43 Pfam Description: Glycosyltransferase family 43
MGSSADHGGAGGRGKKQGSQLWKKALLHSCLCFVMGFFTGFAPSSVSDWTSAAVSAGGVGSSHVVRALQTAAGGAVNRSLLAHGGAGLLDAAAATPRPLLVVVTTTESAPAASGERAAALTRMAHTLRVAAPPLLWVVVEAAPDVPATARLLRATGLMYRHLTYKDNFTAADAAAGKERHHQRNVALGHIEHHRLAGVVLFAGLGDVFDLRFFDQLRQISAFGAWPVATMARGERKVVVRGPACSAAAVTGWFSRDFGGNGTAAATTARPPEVDAHGFAFNSSVLWDPERWGRYPTSEPDKSQDSMKFVQQVVLEDFSKVKGIPSDCSEVMVWHVDSTAPSSSS

SEQ ID NO: 5363 - DNA, 980 bp, Panicum virgatum
  misc_feature: Ceres CLONE 1819732
  misc_feature: Encodes the peptide sequence at SEQ ID NO. 5364
ccccgagaatccaactcgtgttcaccgtctgaattgctttgaaatcctctagctgccgcagagcgaggggccggcgtcagaactcaaaaccaagatcgcccatggccaccgccacgacggcgcgcacgtacgtcgacttcgtgccgccgaacagcctgcaggaggaacccgacaaggtggccctccgcgtcgacctctccgcggaagggttcaggaaggagcagatcagggtgcagatcgacaaattcgggaggctgcggataaccggcgagcggccgctcggcgccgacggtagaaggtggaggcgcttccacaaggagttccaggtccccgatacctgcgacgccgccgccatccgcgcgaggctcgacaaggacggcatcctcctcatcaccatgccgaagctgtccgcggcggcggccgaggatctgaaagcgccgggtgcggacatgggtggtgacgccgccgctggccagaaccacgaacctgcaggtcacaccagcgcgcagaaagcgggaactgctgctgaagaggagaaaggccaggaggaggaggacgccggggcggccatggaccatccaggccaagacgacgaacagcacccaagcagcgacaacgccgcggctgcacctgcagctcgccgaccggtggcgtacgggttcgccaaggacagtaggaggatgctactggcgatctttgccgtgatgctggctctggttggcgccggcctgttggcgaggtacaggttgacgatggatcaatcggccgagacggcgccgtcaggcaaccacatcgtcagtctctccgacagttgatcgtgctgcagctgtgaacatccttgtgcatctgaataaaatgcaaacgtgatagtttacatacattcgattactgtacactgtacatacatatgactgcctgttgtaacacaaaagaaaagaaaaacagagttttcaactgtggaaaaaaaaaaaaaaaaaaaa

SEQ ID NO: 5364 - protein, 237 aa, Panicum virgatum
  misc_feature: Ceres CLONE 1819732
  misc_feature (2)..(74): Pfam Name: HSP20 Pfam Description: Hsp20/alpha crystallin family
MATATTARTYVDFVPPNSLQEEPDKVALRVDLSAEGFRKEQIRVQIDKFGRLRITGERPLGADGRRWRRFHKEFQVPDTCDAAAIRARLDKDGILLITMPKLSAAAAEDLKAPGADMGGDAAAGQNHEPAGHTSAQKAGTAAEEEKGQEEEDAGAAMDHPGQDDEQHPSSDNAAAAPAARRPVAYGFAKDSRRMLLAIFAVMLALVGAGLLARYRLTMDQSAETAPSGNHIVSLSDS

SEQ ID NO: 5365 - DNA, 1191 bp, Panicum virgatum
  misc_feature: Ceres CLONE 1819737
  misc_feature: Encodes the peptide sequence at SEQ ID NO. 5366
attccggttgtcgcctctctacagtccgtcaccaccagccggcagccaccctccaccccttggcttccccctcgcgttcgcagcggtcagcgcctccgagatggagctccgcctctgcctccgtctccacgcgcccatccctcctgcggcgacgccaccgccaccgcttttcccggcgcccgcggtgctccctgcgtcccgccgccttcggacgggtgggagcttcggggtcgctcttagcgctcctaggcggcacacgaggcgttcgaatccggcaatccgcgctgccatagccgacgggaagcagggtgtggctgtgaaggagaggagcgtctcggtgatcctcttgtccggagggcagggaaagagaatgggggcaagtatgccaaagcagtatctgccactactgggactaccaattgcactgcacagtttaaaaacattctgtcaactgaaggaagtcaaagaagtcgtggtagtgtgtgaaccagactaccgtgatgtatttgaaggttctattgagaacttgcaaatacctcttaaatttgcacgcccaggaaaagagagacaggattctgtttttaacggacttcaggaaattgatggggactcggaacttgtttgtgtccatgattctgcaaggcccttagtttcttctgaagatctaaaaaaggtcttagaagatgctgctgtgcatggagcagctgttcttggtgtgcctgtgaaagctacaataaaggaggccaatagcgattcttttgtcgtaaaaacccttgaccggaagactctctgggaaatgcaaactccacaggttatgaagcccaatttactcaaagatggttttgaacttgttagacgggatggccttgaagtcactgatgatgtatccattgtggaatatctcaaacacccagtctatatcacggaaggctcttacacaaacattaaggtgaccactcctgaagacttgcttctggctgagcgcctgatgaatgagaaatgataggcaaaagtaacagtttgcctggttgtacagacaaatgtgattttgaatttttgtggcacagcattcaccagcactttcctcaattttggaaaccagaaaataattatggagctcgtacacgagatagctaacctctctgtaaacattctttttatatcaatgaaaacatggcaaggttatctgct

SEQ ID NO: 5366 - protein, 300 aa, Panicum virgatum
  misc_feature: Ceres CLONE 1819737
  misc_feature (59)..(299): SWISSPROT Homolog: EC 2.7.7.60 2-C-methyl-D-erythritol 4-phosphate cytidylyltransferase, chloroplast precursor
MELRLCLRLHAPIPPAATPPPPLFPAPAVLPASRRLRTGGSFGVALSAPRRHTRRSNPAIRAAIADGKQGVAVKERSVSVILLSGGQGKRMGASMPKQYLPLLGLPIALHSLKTFCQLKEVKEVVVVCEPDYRDVFEGSIENLQIPLKFARPGKERQDSVFNGLQEIDGDSELVCVHDSARPLVSSEDLKKVLEDAAVHGAAVLGVPVKATIKEANSDSFVVKTLDRKTLWEMQTPQVMKPNLLKDGFELVRRDGLEVTDDVSIVEYLKHPVYITEGSYTNIKVTTPEDLLLAERLMNEK

SEQ ID NO: 5367 - DNA, 1127 bp, Panicum virgatum
  misc_feature: Ceres CLONE 1819751
  misc_feature: Encodes the peptide sequence at SEQ ID NO. 5368
aaaatcagagcctgccctcttacctatcccagcggaacggaaggatgtcgtcgccggcgaccagcgcgagggcggacgaccacaagccgctgatgctcctggcgcagccactgttcccgaacttagccgcggtgctggagggccggtaccgcttggccctggccgcggacgccgacgaggccacggcgggcgaggccagggtgctgctcgtgccggggctcaaggaggtgaccgccgagctcatcggcaggctcccggcgctggagctcgtggtggccacctccgtcgggctggaccacgtcgacctggacgcctgccgccgccgcgggctcgccgtcaccaacgccggggacgccttctccgcggactcggccgactacgccgtgggcctcctcatcgccgtgctgcgcaggatcgccgccgccgaggcgtacctccgccgcggcaggtgggccacggacggcgagtacccgctcgccaccaaggtgagcggcaagcgcgtggggatcgtgggtctcggccgcatcggctcgcaggtggctcggcgcctcgccgccttcgggtgccccgtcgcctaccactcgcggtcgcccaagccgtcgtcaccctacaggttcgtccccacggtgcgcgccctggccgcggacagcgacgtgctggtgctgtcgtgcgcgctgacggaggagacgcggcgcgtggtggggcgggaggtgatggaggcgctgggcaaggacggcgtgctcgtcaacgttggccgcggcgggctggtggacgagccggagctggtgcgctgcctgcgggagggcgtcatcggcggcgccgggctggacgtgttcgacaaggagccggacgtgccggcggagctgctcgccatggacaacgtcgtgctctcggaccacagggccgtgttcacgccggagtccttccgcggggtgctggacgtcgtcgccggaaacctcgaggccttcttcgccgggaggccgctgctcagccccgtcacgctctgagctgtgtgtgaactcggccacacagggcttcagttgcgaggggtttggagttgcttgtacttttttaatcttcttttttctaataataaaagttacggcaaaaaaaaaaaaaaaaaaaaa

SEQ ID NO: 5368 - protein, 320 aa, Panicum virgatum
  misc_feature: Ceres CLONE 1819751
  misc_feature (1)..(302): Pfam Name: 2-Hacid_dh Pfam Description: D-isomer specific 2-hydroxyacid dehydrogenase, catalytic domain
MSSPATSARADDHKPLMLLAQPLFPNLAAVLEGRYRLALAADADEATAGEARVLLVPGLKEVTAELIGRLPALELVVATSVGLDHVDLDACRRRGLAVTNAGDAFSADSADYAVGLLIAVLRRIAAAEAYLRRGRWATDGEYPLATKVSGKRVGIVGLGRIGSQVARRLAAFGCPVAYHSRSPKPSSPYRFVPTVRALAADSDVLVLSCALTEETRRVVGREVMEALGKDGVLVNVGRGGLVDEPELVRCLREGVIGGAGLDVFDKEPDVPAELLAMDNVVLSDHRAVFTPESFRGVLDVVAGNLEAFFAGRPLLSPVTL

SEQ ID NO: 5369 - DNA, 1289 bp, Panicum virgatum
  misc_feature: Ceres CLONE 1819781
  misc_feature: Encodes the peptide sequence at SEQ ID NO. 5370
gtttttctggaggcttcctggggctgcgtggaggcagaggggagaggggggaagaacgaagaagaagaacaggcgccatccgcttgcttccttccccttctctcccccccccccccgccgccggcgcctctctccacgggtgcgcgccgacaggccatcgcgtcgctgtgcccgtgcgtgcgtgcgtgccggaggagtttgacgtctccggcgacaacggcatggatgccggggcagagaagtgccgcgacaccgcggcggctgccggcagcgacctctacgccgtccttgggctcaagaaggagtgctccgacaccgagctgaaggtcgcctaccggaagctcgccatgagatggcacccagacaaatgctcctcctccagcagcgtgaagcacctgcaggaagccaaggagaagttccaagaaatccagagcgcctattccgtcctctccgacgccaacaagcgtttcctctacgacgtgggtgtatacgacaatgaggacgatgaggacagcctgcagggaatgggggacttcattggtgagatggcccagatgatgagccaggcgcgtccgacgaggcaggaaagctttgaggagctgcaacagctgtttgtggacatgttccagtctgatcttgattcaggattctgcaatgggcctaccaagggccatcaggtgcatgggcaagcccaaagtagaacatcctcaacctcaccttcatcatcaccgtctcctccgcctactatagtaacggaggcagaggtgccatcatgtaatggcttcaataagcggggttcatcagcaatggacccggggaaacctccaagactagttgatgctggggtgagtcagagccaggctggcttttgttttgggatgagcgacacaaagcaagctcagaagatgcgaggcccaaacaccagccggaggaggaacggccggaagcagaagttgtcatcgaagcatgatgtttcatccgaagatgacaccgcaggttctcagcatcagcaggacgtagcagtttgacccctggtgtagttattcgttggtccttggccgtgtcaaggaccctagtgcagccagggcacagcatgttgcctttgccagctgccgtgatctgaagaggagtttagctcatcataggccttaccttgagtgagacctccatgtgaaattcgtcgacgcttccgcaattttctttctccgcatgtgttgcctggtgtaccaagacagtgacttccaattgattcagttcttattgacatctaaaaaaaaaaaaaaaaaaaa

SEQ ID NO: 5370 - protein, 268 aa, Panicum virgatum
  misc_feature: Ceres CLONE 1819781
  misc_feature (1)..(66): Pfam Name: DnaJ Pfam Description: DnaJ domain
MDAGAEKCRDTAAAAGSDLYAVLGLKKECSDTELKVAYRKLAMRWHPDKCSSSSSVKHLQEAKEKFQEIQSAYSVLSDANKRFLYDVGVYDNEDDEDSLQGMGDFIGEMAQMMSQARPTRQESFEELQQLFVDMFQSDLDSGFCNGPTKGHQVHGQAQSRTSSTSPSSSPSPPPTIVTEAEVPSCNGFNKRGSSAMDPGKPPRLVDAGVSQSQAGFCFGMSDTKQAQKMRGPNTSRRRNGRKQKLSSKHDVSSEDDTAGSQHQQDVAV

SEQ ID NO: 5371 - DNA, 1697 bp, Panicum virgatum
  misc_feature: Ceres CLONE 1819834
  misc_feature: Encodes the peptide sequence at SEQ ID NO. 5372
agatccccgccgcaacacgctgaacgaaatggcggcgaggcgcttccacctcgacatcgccgcccggacgctggtccgggcctcgcgcccgccgccgggtttccccgccgtcctcgccgtatccaatctcgacctcgtcctgggccacttccccatcttcctcgtctccgtctaccccgcccccgccgccggcctcgacgcggtcctcgccgccgtgcgcggcgccttcccggcgtacctctcgcgcttcttccccttcgccgggcgcgtcgtgcgggacccggagaccaaggtccccgaggtccagtgcaataacgccggcgccgagctcgtcgtcgccgacgccgcggtgccgctcgcggccgttgacttctcggaggtcgaccggtcgctgggtctgatccagatacccttcgacgcgagcctcgccatgtcgctgcagctggtccggttcgcctgcggggggttcgcgctgacgattggcacgacccacctcctcgccgacggcagggcgttcaccgtgctgctgagcgcgctcgccgagatggtccgcgacggcggcctctcccgcgagcccctgttcgaccgctccctcttcaagccgcggtcgccgccgtcgtacagcgcgtcgctggacgccgagttcgcgcggttcaccccggagaccatgatcaaccccctcctggcggcggccatgcggcggcggctgtaccgcgtcgaggcggccgacctcgcggcgctccaggccgcggcgtccccgccgggcggcgggcgccgcgcctcgcggttcgtggcgctgtgcgcgcacgtgtggaagctcctcgcgcgcgccgtcggcgacgccgaccccagctgccggatggcgtggatcgtggacgggcggaagctggtcgagccgtcggacggcgcgctggaccggtacatcgggaacgtggtcacctacacgtcccgcgaagcgggcgtggcggagctgctgcgcgcgccgctccccgacgtggcggcggcggtgcgcgcggccatctcgggggtgatggccgcggcgcggttccaggagctggcggactggatggaggagcgcaaggcggcgttccgggacggcggcaagtggacggaggccgtgaacctggggttcgggagccccgcgctcgtcatctccggcctgctcccgttccccatcgacggggacctcgggttcggcaagcccaggctcgtcgtgccgtggctgcggcacggccggctgggctccgcgtccgtgacggtcgtacccgacccgagcggcgacgggtcgtggttcgtcggcggcacgagggtgtggccgcggctcatggaggtgatcgaatccgaccctttgctgaagccggcagcgaacctgggactggcgacgccggcgggatcccgtctgtgagctcgcactgggaggagctttgctttgtgcatcgcacgttgtggcaaggactacgaaggcgaggaagattctccgtgcttgaattgggaatggcgagaacgtaggggagtagaggagggacgtccgtagaggagagtagctgcaatttcttcgtcactctgttcagctgagagggcagagtgccaaaggcaaaggacactgagagacaacccttttgttcctcttctgctgtgctctgtaaccgtaccgagattcggtgacatgattatggcaaaaaaaaaaaaaaaaaaaa

SEQ ID NO: 5372 - protein, 458 aa, Panicum virgatum
  misc_feature: Ceres CLONE 1819834
  misc_feature (1)..(359): Pfam Name: Transferase Pfam Description: Transferase family
MAARRFHLDIAARTLVRASRPPPGFPAVLAVSNLDLVLGHFPIFLVSVYPAPAAGLDAVLAAVRGAFPAYLSRFFPFAGRVVRDPETKVPEVQCNNAGAELVVADAAVPLAAVDFSEVDRSLGLIQIPFDASLAMSLQLVRFACGGFALTIGTTHLLADGRAFTVLLSALAEMVRDGGLSREPLFDRSLFKPRSPPSYSASLDAEFARFTPETMINPLLAAAMRRRLYRVEAADLAALQAAASPPGGGRRASRFVALCAHVWKLLARAVGDADPSCRMAWIVDGRKLVEPSDGALDRYIGNVVTYTSREAGVAELLRAPLPDVAAAVRAAISGVMAAARFQELADWMEERKAAFRDGGKWTEAVNLGFGSPALVISGLLPFPIDGDLGFGKPRLVVPWLRHGRLGSASVTVVPDPSGDGSWFVGGTRVWPRLMEVIESDPLLKPAANLGLATPAGSRL

SEQ ID NO: 5373 - DNA, 1309 bp, Panicum virgatum
  misc_feature: Ceres CLONE 1819857
  misc_feature: Encodes the peptide sequence at SEQ ID NO. 5374
aagcacacgacacgcactgaccaaacaccaccccgataaaaacagagcgccgcagcgatgctccaggttcgcgcgccccccaccttcctcccctccaccacctcctcctcctcgccatcatcctcgtcgcaggcgccgtcgccctctgcgtccttcgggaggggcagccaccggcgcggcgggctggtccccttcgccgcggcggcgtcaccgcggcgcggcgcggcgaggcgttccgtgatggccgcggcgggggcggctaagctcgaggacgccgacgcgctcatcgactccgtggagaccttcatcttcgactgcgacggtgtgatctggaagggagacaagctgatcgacggcgtgccggagacgctcgacttgctccgatcgaagggcaagaggctggtgttcgtcacaaacaactccaccaagtcgaggaagcagtacggcaagaagttcgagacgctgggactgagtgtcgacgaggaagagatcttcgcttcatccttcgcagctgcagcctacctgcagtccatcgatttccccaaggacaagaaggtgtatgtcatcggagaggaagggattctcaaggagctggagctggctgggtttcagtacctcggcggacccacagatggagacaagaagatagagctgaagcctggtttttacatggagcatgacaaagatgtgggagcagtagttgtcggattcgatcgctactttaactactacaaagttcagtacgggacactttgcatccgtgagaacccaggttgccttttcattgcaacaaacagggacgccgtcactcatcttaccgatgcccaagaatgggcaggtggtgggtcaatggtcggcgcaattcttggttccactaagcaagaaccactcgttgtcgggaagccatccactttcatgatggactacctggcaaagaagttcggaatcacaacatctcagatatgcatggtgggtgaccggttggatacggatatcctgtttggccaaaacggaggctgcaaaactcttcttgttctatcaggtgtgacttccctgcagacacttcagagccccgacaactcgatccagccagatttctacacaaaccagatttctgattttctcaccctcaaagcagcaactgtctgaagggcgagctcaccttacttttgcataggtagcatcggccatgtttcagcaaataagaaaacacaaagggtggttttgcttttcaaattattgtgtaaccctgagacatgttcatatgtagactgaagcacatctcaaaagatggcaagaattactcctc

SEQ ID NO: 5374 - protein, 363 aa, Panicum virgatum
  misc_feature: Ceres CLONE 1819857
  misc_feature (1)..(250): Pfam Name: Hydrolase Pfam Description: haloacid dehalogenase-like hydrolase
MLQVRAPPTFLPSTTSSSSPSSSSQAPSPSASFGRGSHRRGGLVPFAAAASPRRGAARRSVMAAAGAAKLEDADALIDSVETFIFDCDGVIWKGDKLIDGVPETLDLLRSKGKRLVFVTNNSTKSRKQYGKKFETLGLSVDEEEIFASSFAAAAYLQSIDFPKDKKVYVIGEEGILKELELAGFQYLGGPTDGDKKIELKPGFYMEHDKDVGAVVVGFDRYFNYYKVQYGTLCIRENPGCLFIATNRDAVTHLTDAQEWAGGGSMVGAILGSTKQEPLVVGKPSTFMMDYLAKKFGITTSQICMVGDRLDTDILFGQNGGCKTLLVLSGVTSLQTLQSPDNSIQPDFYTNQISDFLTLKAATV

SEQ ID NO: 5375 - DNA, 1288 bp, Panicum virgatum
  misc_feature: Ceres CLONE 1819917
  misc_feature: Encodes the peptide sequence at SEQ ID NO. 5376
gagcagtgcctccgttgctgcccgctgccccgccgtcgccatgtcctccgccgccgcccgagccctcaagttcgtctcccgcgctgccttgtcctggaagccgacgaggcggccgcagcaaacgctggcggcgaccgtgagcaggtctggcgtgggcctccactcgggcgcgcgcgtcactgcaacgttaatcccggcccacgccggcgagggtaggtatttcctcgtggacggcgaggaggaggcgagggtggcggcggaggtggggaacgccgagccgcggtcgcagctctgcacgacccttcggcggggcgaaggcgggggcccgcgggtccgcacggtggagcaccttctctccgcgatggaggcgctaggcgtcgacaattgccgcgttgaggtcagcggcggcgacgagattcctttgcttgatggatcagcacaagagtgggtagaggcaatacgaagtgcaggtttgtgtgcggccgaggatacaagtgggcaaaacttggagaaactggccccacaaattaatgaacctgtttacttgcagagagatgactgcttcatagctgcattccctagttcgcgaatccgcatcagctatggaattgatttcccgaaggtgccagcaattgggtgtcgatggttttctacatacctggatgctaatatatactcaagcaagattgctccggcaagaactttctgtatatttgaagagatcgaaaaaatgcgtggtgctgggctcatcaaaggagggtcactagaaaatgctatggtttgcagcatgtctggtggttggctaaatccaccagtgcggtttgaggatgaaccttgccgtcacaagattttagatcttataggtgacttctcgcttcttgcacagaatggtaaccagggtttcccaatcgctcatatagttgcctataaggctggtcatgcgctgcacactcatttcctgtgccatctgtctggaaagatcactgtggaccaagaagagcttgctggacaatgctgaaatgcacggctcctattcatcgtagtaagttgttggtagtggttagaaagctacagttcagggtaagcacctgatgaccctcatttcaacacttcagcattctatttggagcatttccctcagacttgtagggtgtgtcagccagctgtttggtgttcgcgttgtagaaaaatcatttttgccgagctgtgtacaaattgttgaaagactgcaacttagtactactgtataaggcattcctttttgtaccaaaaaaaaaaaaaaaaaaaa

SEQ ID NO: 5376 - protein, 325 aa, Panicum virgatum
  misc_feature: Ceres CLONE 1819917
  misc_feature: Great-hit functional homolog of the protein sequence encoded by LOCUS At1g24793
  misc_feature: Great-hit functional homolog of the protein sequence encoded by LOCUS At1g24880
  misc_feature: Great-hit functional homolog of the protein sequence encoded by LOCUS At1g25054
  misc_feature (2)..(280): Pfam Name: LpxC Pfam Description: UDP-3-O-acyl N-acetylglycosamine deacetylase
  misc_feature: Useful for making plants with altered cell wall content and/or composition
MSSAAARALKFVSRAALSWKPTRRPQQTLAATVSRSGVGLHSGARVTATLIPAHAGEGRYFLVDGEEEARVAAEVGNAEPRSQLCTTLRRGEGGGPRVRTVEHLLSAMEALGVDNCRVEVSGGDEIPLLDGSAQEWVEAIRSAGLCAAEDTSGQNLEKLAPQINEPVYLQRDDCFIAAFPSSRIRISYGIDFPKVPAIGCRWFSTYLDANIYSSKIAPARTFCIFEEIEKMRGAGLIKGGSLENAMVCSMSGGWLNPPVRFEDEPCRHKILDLIGDFSLLAQNGNQGFPIAHIVAYKAGHALHTHFLCHLSGKITVDQEELAGQC

SEQ ID NO: 5377 - DNA, 1354 bp, Panicum virgatum
  misc_feature: Ceres CLONE 1819919
  misc_feature: Encodes the peptide sequence at SEQ ID NO. 5378
actaacgtgcagcgaaccagggacacttcgaacacacttacacgaactagtagctcaggccagccgaaaggcacaaagcacagaagaccaccgatggcgtcgaggcagaacacccgtgaggcgcgcgccgaggccgaggcgcggcgcgccgtggaggagctggcgcgggcgcgggacgagcacctggtgcaggccgaggtgaacgcccgctcggcggccgacgagatcgcgcgctcccgcgccgaccacggcgtcgccggggccgccggcgccggcagcggtatcctgggcagcgtacaggagggtgccaagtccttggtgagcgccgtgggccgcaccttcggcggcgccaaggacgcggccgtcgacaagacctcgcagacggcgcaggccaccgccgacaaggcccgggaggccagcgacagcgtggcgcgcaagacgagcgagacggcagaggccacccggaacaaggtggaggaggcgcgggagaccaaggacgccgccatggagaaggcacgggagactaaggacgccgtggcgcagaagacgagcgagaccgcggaggccaccaagaacaagctcggggagtacaaggacgcggcggccgggaaggcgcgggagaccatggacaccaccgccgagaaggcgagggaggccaaggacgtcaccaagcagaaggccggcgagtacgccgacgctacccgcgggaccgcgcaggaggcaagggacaggtcctgggccaccgcgcagaccgccgccgacaaggccagggagatggccgccggcgcccacgacggcgacaaggagcaagcaggaccaggtctgctgggcgcgctcgggaacgtgacgggcgcgatcaaggataagctgacgatgggcggccacggagcggcggggcagcacgacgtccggctgggcggcgacgacgagcgcgcggcgaaggagcgtgccgcggagaaggcggcgtcggtgtacttcgaggagaaggaccgggcgctccgggagcgcgcggcggagcgggtggaccggtgcgtggacaagtgcgtggaggggtgcgccggatcgacctgcgcgcaccgccccggcaagatgtgagaaggcgcggacgtggcgcgcgctggccgctacgtgcccccgccaccgccgcggcccctgcatgggcaaataataaactgttgctagtagtagtggcctagcagagcttcgtgtttcagttctcttttggtgctttccatgatgttcaaatttcacactgcctttcagcctttgtaaacctttggtaaacgttcacaaatgagaagctctggaagtaatatatacggaattttgtggccaaaaaaaaaaaaaaaaaaaa

SEQ ID NO: 5378 - protein, 333 aa, Panicum virgatum
  misc_feature: Ceres CLONE 1819919
  misc_feature: Great-hit functional homolog of the protein sequence given in SEQ ID NO 9750
  misc_feature: Useful for making plants with modulated biomass
  misc_feature: The rosette leaves do not appear in the normal fashion, i.e., their phyllotaxy may be abnormal or too many leaves may be emerging in comparison to the control.
MASRQNTREARAEAEARRAVEELARARDEHLVQAEVNARSAADEIARSRADHGVAGAAGAGSGILGSVQEGAKSLVSAVGRTFGGAKDAAVDKTSQTAQATADKAREASDSVARKTSETAEATRNKVEEARETKDAAMEKARETKDAVAQKTSETAEATKNKLGEYKDAAAGKARETMDTTAEKAREAKDVTKQKAGEYADATRGTAQEARDRSWATAQTAADKAREMAAGAHDGDKEQAGPGLLGALGNVTGAIKDKLTMGGHGAAGQHDVRLGGDDERAAKERAAEKAASVYFEEKDRALRERAAERVDRCVDKCVEGCAGSTCAHRPGKM

SEQ ID NO: 5379 - DNA, 1401 bp, Panicum virgatum
  misc_feature: Ceres CLONE 1819938
  misc_feature: Encodes the peptide sequence at SEQ ID NO. 5380
cttttttccaccaaaccttcctctccaggtccagggtcatccaccccataaatcgtcccgtcataccacattagcactccaatccggcaattcctgccctctgcctgcgcgcatcgggaaaaaaagaggcggctaccaggaaagcggagggtaggcggcggccgcaagttgggagcaaaagaagagcggcaaatctaagagagatcagagcctcaagggagagagtcggcagagagcgccgagcatggagagctcgatctcgaggaccgagctgaactgcatcagcctggcggacccggacatccagaaatcggtcgcgctcctcaaacaggcatgcctagattcaggcttcttctatgttgtggatcatgggataagccaagagttcatggatgaagtttttgcccagagcaagaaattctttgaccttccccacagtgagaagatgaagcttctccgagatgagaagaatcgagggtatacacccatgctggatgaaattcttgatccagaaaatcaagtgaatggtgactacaaggaaggatattatataggagttgaggtacctgaagataatccagaagcaaacaaaccattttatggtccaaatcagtggcctaccgaagaagtattgccaaaatggaggaaggtgatggagcaatatcacagggaggcattgagagtagcaaaatcagttgcaaggatcattgctcttgctctggacctagatgtggacttctttgatagacccgaaatgcttgccaagcctatagccactttaaggcttttacactatgaaggtcgagtatcaaatcctgcaaagggtgtctatggagcaggaacgcattcagattatggcctaataactctcctggcaaccgatgatgtagttggacttcaaatatgtaaggacaggaatgctcagcctcaaatatgggaatatgtagcgcctttgaaaggaggattcatcgtcaatcttggtgatatgcttgaaaggtggagtaactgcattttcaggtcaaccttgcatcgagtagtcctagatgggcaagaacgctactcgatagcttactttgtggaaccaagccacgactgcgtagttgagtgcctgccgacctgcaaatctgaaacaaatcctccaaagttccccccaatcacctgctctgcctacctgtcccagcgctacaaggacactcatgcagatctgagctcttacagcgacggcaaggcctgaaggatgccctactcttacccttttttttctgtcactactcactgatgcttcagtttcagccatccaatgtttacgtgtaaccttcaataacacagtagtgtgaaggatggcactgtgtgtgtactaataccattaccagtgtatcagtataagcatagcagttttgt

SEQ ID NO: 5380 - protein, 329 aa, Panicum virgatum
  misc_feature: Ceres CLONE 1819938
  misc_feature (1)..(111): Pfam Name: 2OG-FeII_Oxy Pfam Description: 2OG-Fe(II) oxygenase superfamily
MESSISRTELNCISLADPDIQKSVALLKQACLDSGFFYVVDHGISQEFMDEVFAQSKKFFDLPHSEKMKLLRDEKNRGYTPMLDEILDPENQVNGDYKEGYYIGVEVPEDNPEANKPFYGPNQWPTEEVLPKWRKVMEQYHREALRVAKSVARIIALALDLDVDFFDRPEMLAKPIATLRLLHYEGRVSNPAKGVYGAGTHSDYGLITLLATDDVVGLQICKDRNAQPQIWEYVAPLKGGFIVNLGDMLERWSNCIFRSTLHRVVLDGQERYSIAYFVEPSHDCVVECLPTCKSETNPPKFPPITCSAYLSQRYKDTHADLSSYSDGKA

SEQ ID NO: 5381 - DNA, 1208 bp, Panicum virgatum
  misc_feature: Ceres CLONE 1819941
  misc_feature: Encodes the peptide sequence at SEQ ID NO. 5382
accaccgcgtagagcgtattagagtttattcgcctcgtcgcccccgtcggtcgccgcgccgtcgcgtcgaatctctccgcgtccgtcgcccgctacctcccctcgctcgcagcttaatttattcagactatcaacaagatgtcggccaatgttggtgaatcaacaagtgctggtggcagcggcgacgcagctggggggagttttgagtgcaatatatgctttgaactgcctcaagagccaatagtgaccctttgtggccatctcttctgctggccatgcctttaccggtggttgcacgtccacgcacactcgccagagtgcccggtgtgcaaggcccttgtcgaggaagacaagcttgttcccctttatggacgtggcaaggaccgtgttgacccaagatcaaagaacatgcctgaatctgacattcctcaccgcccaactggccagaggcctgccacagctccacaggctgatgctaacaacaacttccccaatgccaatgcaaacccatggttcatgggcacaggagtccctttggcgaatgcacggtgggggaattatgcattctcagctgcttttggaggcctgttccctatgcttagcttccaagtccatggattccccgatgctgctgcttatgcgcagccagctgggttccactatggctatggccatgggcatggatttcatggcgggcatatgggacatgcccacggtgtccaccgacaagcacctttgggtcaacagcagcaggcagatatctacctgaaggccctgcttctcatggttggagttcttgtgattgcaagcctccttgcattttaaagcaatgcaaggagttcttgtgattgcaagcctccttgcatggttggacctggaggccctgctcatcatggttggaattcttgggggtgcaatgcaagcctcctggcatttctgacgtaatggcagattggcttaagaattgtcttatttcagtggtggttctgtattatagcttggtgctgaatgttgcataagttattcgtgtatttgcataagtgtccatagaatatgtatttatagctctaggcaagtatctgccttttacagcaccttatataatattaggaggaacctggtgcaattattgctgtttagttttgatgatttttggaggtgaacgtgatgtacaattgttgggtagccaaaaaaaaaaaaaaaaaaaa

SEQ ID NO: 5382 - protein, 228 aa, Panicum virgatum
  misc_feature: Ceres CLONE 1819941
  misc_feature (1)..(41): Pfam Name: zf-C3HC4 Pfam Description: Zinc finger, C3HC4 type (RING finger)
MSANVGESTSAGGSGDAAGGSFECNICFELPQEPIVTLCGHLFCWPCLYRWLHVHAHSPECPVCKALVEEDKLVPLYGRGKDRVDPRSKNMPESDIPHRPTGQRPATAPQADANNNFPNANANPWFMGTGVPLANARWGNYAFSAAFGGLFPMLSFQVHGFPDAAAYAQPAGFHYGYGHGHGFHGGHMGHAHGVHRQAPLGQQQQADIYLKALLLMVGVLVIASLLAF

SEQ ID NO: 5383 - DNA, 1731 bp, Panicum virgatum
  misc_feature: Ceres CLONE 1819947
  misc_feature: Encodes the peptide sequence at SEQ ID NO. 5384
accacagcgcgacgacacctcgttggtatctagctcagctagccagctccgatctggcgatctcccaggcacgaggctgagccggcaagcgcgcgggcgatggctggggcggacggcgcggtcgtctcctcccggcagcgggagatgcacgtcgtgatcttcccgtggctcgcgttcgggcacctgctcccgggcctggagctcgcgcagcgcctggcgtcgcgcgggcaccgcgtatcgttggtgtccaccccgcggaacctcgcgcggctcccgccggtgccgcccgcgctggcgccgcgcgtggacctcgtggcgctcccgctcccgcgcctggacggcctccccgacggcgccgagtccaccaacgacctgccgtctgccgccttcgagctccaccggaaggcgttcgacggcctcgccgcgcccttctccgcgttcctcgacgccgcgtgcgcgcagggtcctgggagcaggcccgactgggtcctcctcgacaacttccaccactgggctgccgccgccgccgttgaccgaaaggttccatgcgcgatgctcctgcacttgcccgcgaccatctttgccgcgctcgccgacgccgcccagacacggcccgagctggctggccctggcgatgggcaacaacagcacgaagccaccggagacggacagccggcggcggaggctccgaggttcgaggcggagcagaacaggaacttgtacagcaccgaaggcgcctcggggatctccgtcgggcagcgcttcttcctaaccatgcggtgctgcagcttcgtcggcctgcggacctgcgccgagctggagccggaggccctgtctcgcctccccacgctcttcggcaagccgctcgtccccttcggcctcctcccgccgtcgcccgacggagcccgcgccgccggtaaggacgccggcgacgccatcgtcccgtggctggacgcgcagccggcggaggcggtcgtgtacgtcgcgttggggagcgaagtgcccctgagcatcgagctggtgcacgagctggctctcgggctggagctcaccgggttccccttcctctgggctctgaggaagcccgccggcgccggtgacgcggacatcctcccgccgggcttcgaggagcgcacgcgcggccgtgggttcgtcgccatggggtgggttccgcagatcagcatcctggcgcacggtgccgtcggcgcgttcctgacgcactgcgggtggaactccaccatcgaggggcttctgttcgggcgccctctgatcatgctcccgatccatggcgaccaggggtcgaacgcgcggttgatggaggagcggcagatcggagtgcaagtgccgagggatgaagaggacgggtcattcgaccgccatgccgtcgcgagggcagtccgtgccgtcatgtccaaggatgaaagcagggagacctttgtggccaacgcgaagaagctgcgagagatcgtggcggacaggacgtgccaggagagatgcattgacgaattcgtcgagcgcttgagatcctcctgcattgagtgaagagattggccacggcctaatgggtatatatttgtggattgataaatttaaaacattattagaagtaattttattccgagtaaaaatgcatcataggtccctaaatttgtagcactgtatcagttaggtctctaaacagtaaactctcaaaatgactatttggatcctcaaaaaaaaaaaaaaaaaaaa

SEQ ID NO: 5384 - protein, 480 aa, Panicum virgatum
  misc_feature: Ceres CLONE 1819947
  misc_feature (1)..(133): Pfam Name: UDPGT Pfam Description: UDP-glucoronosyl and UDP-glucosyl transferase
  misc_feature (1)..(127): Pfam Name: Glyco_transf_28 Pfam Description: Glycosyltransferase family 28 N-terminal domain
MAGADGAVVSSRQREMHVVIFPWLAFGHLLPGLELAQRLASRGHRVSLVSTPRNLARLPPVPPALAPRVDLVALPLPRLDGLPDGAESTNDLPSAAFELHRKAFDGLAAPFSAFLDAACAQGPGSRPDWVLLDNFHHWAAAAAVDRKVPCAMLLHLPATIFAALADAAQTRPELAGPGDGQQQHEATGDGQPAAEAPRFEAEQNRNLYSTEGASGISVGQRFFLTMRCCSFVGLRTCAELEPEALSRLPTLFGKPLVPFGLLPPSPDGARAAGKDAGDAIVPWLDAQPAEAVVYVALGSEVPLSIELVHELALGLELTGFPFLWALRKPAGAGDADILPPGFEERTRGRGFVAMGWVPQISILAHGAVGAFLTHCGWNSTIEGLLFGRPLIMLPIHGDQGSNARLMEERQIGVQVPRDEEDGSFDRHAVARAVRAVMSKDESRETFVANAKKLREIVADRTCQERCIDEFVERLRSSCIE

SEQ ID NO: 5385 - DNA, 1818 bp, Panicum virgatum
  misc_feature: Ceres CLONE 1820049
  misc_feature: Encodes the peptide sequence at SEQ ID NO. 5386
acacgccgtatctccccattcccaccggcaaccgggcatcgtcgtcgccgcctgcgccgccgcccgcggccaccatgtggaggggcggcgccatcgccgcctccgccgcgagggctctccgctcgcgcctcatccccgaccccatccaccacccggccacgtcgctcactcctaccgcctcggcgcgtgcctcctcctccgcaccctccgccgccgcagcgaacaacgtcgttgaagaagcggcgacggcggccgtatcagtctcccagcaggcgggatccgtttccaacgcgctacatcactacgggaggtgctactgggagctctccaaagctcgcctcagtgctcttgttgtggcaacttctggggctggctatgtgcttggtagtggcaatgtcgtggacattgctggactttgttgcacttgcgctggtacaatgatggttacggcatctgcaaataccctcaaccaggtgtttgagataaaaaatgatgctaaaatgaaaaggacaatgcggcggcccctgccatcaggtcgcattagtcctgcacatgctgccatgtgggctacgagcgttggagctgcaggaacagctttattggcctggaaggctaatggcttggcagctgggcttgcagcttctaatcttgttctgtacgcatttgtatataccccactgaagcaaatacacccagttaatacatgggtaggagcagttgttggtgctatcccaccacttctgggatgggcagcagcttctactgaattgtcactaaatgctatggttctccctgctgcattgtactattggcaaataccccattttatggcgcttgcatacttatgtcgcgatgattaccttgctggagggtaccgtatgttttcttttgctgacccttctggtaaaaaaactgcgtgggtatcgctcagaaattgcctgtacatgttgcctttgggattgtttgcatacaactggggcctctcatctgagtggttcggtcttgaagcatcactactaacgatgggccttaccattggagctctatcgtttgtgttggaaccaagcccgaaaactgcaaggagaatgttctatggaagcctgctgtatctccctgctttcatggctggacttctattacatcggctgcctaacgaacaaaaggtgcacaatctgactgagaaaagtgaactcgatggagttctttatggggctgatctgcaggatgaccaaagagcgagacagaagtacgaagacaggaaaccttctcgtgggcaatcacgccctccagttgcttatgcttctgtggctccattccctttcttaccagtacccatatacgagtcatgaaaaccttctcccgttcttcctgcaycagtgggtctctgcctgccggagcaatatgttcakgcactttkggtttcatacatgawtttttctscccccagggggaccctgggtctcgtggaaattataggataatttttttttttgggggggggggggggtgagctctttgcggtccatctgaatgtaaaaaagtgctgttgatcctctttctgatgcctcgagcaacacggttgcgctgacgtacaggatgcttcttttgtcaaatttggttgacattaagaacgcgcagtgaagtttcatgcaaactgctggtggccttcatgttcacggcacatattgatggtgtagaactatgcaagtgtcggaaactctcttcgaattttgagtttcacaaggcggcattcctgtcgtcttaggataagtttggtgaggctacatattcttattttataaatgaagtgattctacg

SEQ ID NO: 5386 - protein, 424 aa, Panicum virgatum
  misc_feature: Ceres CLONE 1820049
  misc_feature (1)..(268): Pfam Name: UbiA Pfam Description: UbiA prenyltransferase family
MWRGGAIAASAARALRSRLIPDPIHHPATSLTPTASARASSSAPSAAAANNVVEEAATAAVSVSQQAGSVSNALHHYGRCYWELSKARLSALVVATSGAGYVLGSGNVVDIAGLCCTCAGTMMVTASANTLNQVFEIKNDAKMKRTMRRPLPSGRISPAHAAMWATSVGAAGTALLAWKANGLAAGLAASNLVLYAFVYTPLKQIHPVNTWVGAVVGAIPPLLGWAAASTELSLNAMVLPAALYYWQIPHFMALAYLCRDDYLAGGYRMFSFADPSGKKTAWVSLRNCLYMLPLGLFAYNWGLSSEWFGLEASLLTMGLTIGALSFVLEPSPKTARRMFYGSLLYLPAFMAGLLLHRLPNEQKVHNLTEKSELDGVLYGADLQDDQRARQKYEDRKPSRGQSRPPVAYASVAPFPFLPVPIYES

SEQ ID NO: 5387 - DNA, 1193 bp, Panicum virgatum
  misc_feature: Ceres CLONE 1820061
  misc_feature: Encodes the peptide sequence at SEQ ID NO. 5388
agctcagctcacactcgtcacccgcatcgcgccgctccagctcgcgtcatcagatagctagctagccatggcgtcctccgaggccgctgcgccgcccgcgcggcgcgtggtggacgagtgccggggcgtgctgttcgtgtacaacgacggcaccgtggagcggcgcgcggcgccggggttcgcgacgcccgtgcgcgacgacgggtccgtggagtggaaggacgcggcgttcgacgcggcgcgcgggctggggctccggctctaccggccccgggactgggagcggcgggggcggctgccggtcttcttctactaccacggcggcggcttctgcatcggctcccgcgcctggcccaactgccagaactactgcctccgcctcgccgcggacctcggcgcgctcgtcgtggccccggactaccgcctcgtgccggagcaccgcctccccgccgccatcgacgacggcgcggcggcggtcctgtggctcgcggtgcaggcgcggggcggcggcgacccgtggatcgccgagtccgtggacctcgcccgcgtgttcgtctcgggcgactccgccggcggcaccatcgcgcaccacctcgccgtgcggttcggctccccggccgggcgagcggagctcgcgcccgccgccgtccgcggctacgtccagctcatgcccttcttcggcggcgccgagcgcacgcggtcggaggccgagtgccccgacgacgcgttcctcaaccggcccctcaacgaccggtactggcgcctgtcgctgccggagggcgccacggcggaccaccccgtcgcgaacccgttcgggcccggcgcgccgccgctggaggccgtggagatggcgccgacggtggtcgtcgtcgggggccgcgacatcctccacgaccgcgccgtggactacgcggcgaggctcaaggccatgggcaagcccgtggaggtgcgggacttcgaggggcagcagcacggcttcttcaccatcgacccctggtccgacgcctccgccgagctcatgcgcgtcatcaagcggttcgtcgactcggacggccggttcgacgactgaaccggcggcgcatcctagccgcgtgctcgtaccggttactgcaccattatgattgggtcatctatttcccgggtttataatacaataatttaatttgtattttcaaaaaaaaaaaaaaaaaaaa

SEQ ID NO: 5388 - protein, 333 aa, Panicum virgatum
  misc_feature: Ceres CLONE 1820061
  misc_feature (1)..(228): Pfam Name: Abhydrolase_3 Pfam Description: alpha/beta hydrolase fold
MASSEAAAPPARRVVDECRGVLFVYNDGTVERRAAPGFATPVRDDGSVEWKDAAFDAARGLGLRLYRPRDWERRGRLPVFFYYHGGGFCIGSRAWPNCQNYCLRLAADLGALVVAPDYRLVPEHRLPAAIDDGAAAVLWLAVQARGGGDPWIAESVDLARVFVSGDSAGGTIAHHLAVRFGSPAGRAELAPAAVRGYVQLMPFFGGAERTRSEAECPDDAFLNRPLNDRYWRLSLPEGATADHPVANPFGPGAPPLEAVEMAPTVVVVGGRDILHDRAVDYAARLKAMGKPVEVRDFEGQQHGFFTIDPWSDASAELMRVIKRFVDSDGRFDD

SEQ ID NO: 5389 - DNA, 1347 bp, Panicum virgatum
  misc_feature: Ceres CLONE 1820113
  misc_feature: Encodes the peptide sequence at SEQ ID NO. 5390
caagtttgggcgcagcgtggtggaagggcattagcttctgtttgctgaaatctgggttcgattctcctcctgcctctcccctttgagtttgttttatcctgaatccttgctcgcgacggcggtgagagcgcgggcagcagcaatggcgaccgcggcggcgaccatgaccatggctacgcaccacccccgcgcccgcccacgcctacaagtctgcgccgcctgggacatgaacccgggcgccgccaccgtggccgtgcccaagccctccaaggccaagccgaagccgccggcgaccacgacgaccccggcccgcccgcctcctccgacccacgccgacctcttcgcgcgctccagcgagggtcaagatacaggaggagtaaagaagagctcatatatgggctttgagaaatggtggttgccaccgccaccagaggtgaagaaaccccgatcactctacagtgctgcatcactggcttacttgggagactgcatatatgaactttatgctcggaggcacttcttctttccacctctaagcatcaatgagtacaacaaacgtgtgatggatgttgtaaagtgtgagtcacaggatcttttgttgaacaagcttcttggagaggatttcctaactcaagaagaaagggacatacttcgttgggggaggaatattgttagcagcaaaactcgcaccagaaagcgtgcaggaattgcagtctacaatcgggcatcttcactagaaacactgattggatacctttacctcacaaatttcaagcggttagagcaactgatgtttcaattaggcttcacaagtggcgcctcttcacaacatattgctgatgagctgcgctcaagcatccagaaaacaacccctacttctgcccaagctcagcaacctgccacggagtaaaaatttccgagggctaatgaacctagtatcacttgcgcatggaattctcttgtagtccagcgactgacatgagaatgcatgccttgcggcatattaggatccaatagtaaggctggaatcaaaaggttcggaagtgctgtatattcacgaatggagcaacatgattgacgaggcgcgcacatacactgggcagtctgccgggaacagaagacttgaatgttgggggggatgtggggcttgtgagaaggaaggatagattgctattgcaaagaagctccagtttaggctggtgaaaggcaaatataattaagatccaaattcgtgtaggaaataaaccgcctcatgggaatttgttggcagaaccagtgaaaattccacctgaaaaacatgcatgctggtggcagaagcctgggtaataaaaaaaaaaaaaaaaaaaa

SEQ ID NO: 5390 - protein, 255 aa, Panicum virgatum
  misc_feature: Ceres CLONE 1820113
  misc_feature (1)..(102): Pfam Name: Ribonuclease_3 Pfam Description: RNase3 domain
MATAAATMTMATHHPRARPRLQVCAAWDMNPGAATVAVPKPSKAKPKPPATTTTPARPPPPTHADLFARSSEGQDTGGVKKSSYMGFEKWWLPPPPEVKKPRSLYSAASLAYLGDCIYELYARRHFFFPPLSINEYNKRVMDVVKCESQDLLLNKLLGEDFLTQEERDILRWGRNIVSSKTRTRKRAGIAVYNRASSLETLIGYLYLTNFKRLEQLMFQLGFTSGASSQHIADELRSSIQKTTPTSAQAQQPATE

SEQ ID NO: 5391 - DNA, 1145 bp, Panicum virgatum
  misc_feature: Ceres CLONE 1820118
  misc_feature: Encodes the peptide sequence at SEQ ID NO. 5392
ggaaccatgagccttgacatcctccaccaccgctgtccacaccgatcgccatggccgccaccccaccggcaccacccgctcacggcggccacaatggaagctccccggcgtcacctcccaccgagctcttctccgagttcttcgagtcctggatcgccgagcagtcccgcgacctcgccgagctccgtgccgcggcggccgcggacccggccaccccggaggtcgacctccgctgcctcgtcggccgggtgctgggccactacgagcactactaccgcacaaaggccgccgccgcggcggacgacgtgatccgcatgttctccccgtcctggacctccaccaccgagaacctgtacctctggtgcggcggctggcgccccaccgccgcgctccacctgctctactccaagtccgggatgcagctcgagcaccagctccccaacttcctcaacggcggcagcctcaagggcgacctcggggacctcggcgccgacgagctccaggccgccgaccagctgcagcgccgcaccgtcaacagggaacgcgagatcgaggacgccgccgcgagcgcacaggaggcgctggcgacggcgaagatggtggagctcgcgggcggcggcgggatggacgcggaggcgatggagcgggagatgcaggcgaatgcggacgggatgaagcgcgtgctggagatggcggacgcgctgcggctagagacgatgcgcggggtggtggcgctgctccgccccgcgcaggccgtgcacttcctcctcgccgccgccgagctgcacctcgccgtgcacgacttcgggcgccgcaaggatgggcgcgccggcgccggcgccgcgccgccgcagcagccgtagcgacgcgtggcagctggcctggccgctcgcttgctaactggtcgctcctccacggcccaagcggcggcgcgtggctgctggtttggtcagcacgagctgtcctcccgataaggctctctctgatcatttgtttattttgtgttcgcgcgtgtggtgtgcacttgtgccatgtctgatgtctctgtctctgactctctggagtaccgagttgttttgttgggtagtatgaactgtgatctgcgaagtcgaactgttttgtttcaaaaaaaaaaaaaaaaaaaa

SEQ ID NO: 5392 - protein, 270 aa, Panicum virgatum
  misc_feature: Ceres CLONE 1820118
  misc_feature: The sequence is a functional homolog of  SEQ ID NO 254 in the  10/714,887 US patent application
  misc_feature: The sequence is a functional homolog of  SEQ ID NO 254 in the  11/435,388 US patent application
  misc_feature: The sequence is a functional homolog of  SEQ ID NO 658 in the  10/666,642 US patent application
  misc_feature: Useful for making plants with modulated growth and phenotype characteristics
MAATPPAPPAHGGHNGSSPASPPTELFSEFFESWIAEQSRDLAELRAAAAADPATPEVDLRCLVGRVLGHYEHYYRTKAAAAADDVIRMFSPSWTSTTENLYLWCGGWRPTAALHLLYSKSGMQLEHQLPNFLNGGSLKGDLGDLGADELQAADQLQRRTVNREREIEDAAASAQEALATAKMVELAGGGGMDAEAMEREMQANADGMKRVLEMADALRLETMRGVVALLRPAQAVHFLLAAAELHLAVHDFGRRKDGRAGAGAAPPQQP

SEQ ID NO: 5393 - DNA, 1001 bp, Panicum virgatum
  misc_feature: Ceres CLONE 1820183
  misc_feature: Encodes the peptide sequence at SEQ ID NO. 5394
attttgcatcgcctcctccctcccatcatcccctgtcctgagccggctgcaaggccagctccttcgatcgcgcacaccttgttctcgtgccgtcctcgatccagcgggttcgtttgcgaccgcgaattgtcggcgcgggcaccggcaatggcgtccacgtcgagctcgacgcccgcggcggaggtggaagagaggggccggaagcggaagcgcgcggacgggccggagcccgcggcggggccgcggccgtccaagtggcgtacgcggcgcgagcacgagatctactcgtccaagctcttcgaagcgatccgcctcgtgcgcgccgggccgtccaccgccggcgcggcgggcccgccaagcggcagggccgtgcgcgaggcggccgaccgcgcgctcgccgtcgcggcgcgcgggcgcacgcactggagccgcgccatcctcgcctccagccgccgccgcatccaggccgtgcgccgcgcgcgcctccgcgcccccgcgtccccgtcttcgcgccaccgcgccgccgcctccgccgccgcctccacctcggcgactggggagggcgccagcacgcctcccctggtgaggagcgcgagggtgctggggcgtctggtgcccggcggccggaggctgccgtttccgacgctccttgaggagaccaccgactacatagcggccctcgagatgcagatccgcgccatgacggcgctcgccgaggcgctgtccgccatctcggccaccaactcctcgtcctccgccggcgccggctcttcctcctcctagccggcgtgaccggagctccaagattcgtgcattcgttgtaaattttccctctttttttccccgtcccaacgaatttttcctcgggattagttaacctctagcgttctccctctccccccactagttattgtcgtcttgtttctctcatttgggcgagcggttagtgtgatgatgaagaagatgatgatggcgttccggaaaaaaaaaaaaaaaaaaaa

SEQ ID NO: 5394 - protein, 211 aa, Panicum virgatum
  misc_feature: Ceres CLONE 1820183
  misc_feature: The sequence is a functional homolog of  SEQ ID NO 522 in the  10/666,642 US patent application
  misc_feature: The sequence is a functional homolog of  SEQ ID NO 898 in the  11/435,388 US patent application
  misc_feature: Useful for making plants with modulated growth and phenotype characteristics
MASTSSSTPAAEVEERGRKRKRADGPEPAAGPRPSKWRTRREHEIYSSKLFEAIRLVRAGPSTAGAAGPPSGRAVREAADRALAVAARGRTHWSRAILASSRRRIQAVRRARLRAPASPSSRHRAAASAAASTSATGEGASTPPLVRSARVLGRLVPGGRRLPFPTLLEETTDYIAALEMQIRAMTALAEALSAISATNSSSSAGAGSSSS

SEQ ID NO: 5395 - DNA, 1791 bp, Panicum virgatum
  misc_feature: Ceres CLONE 1820188
  misc_feature: Encodes the peptide sequence at SEQ ID NO. 5396
aaaacgcccaggacagacaactcgcctctccgatcccgcacgccaccacagccgccgccgccgccgcatcgccaccggcacggtagccatgtccaaccccggctcgtccccgacctccgcctccgcccaccacgaccacgcgcacaccccgctctgccgcccctgcggcgcaaccaccacggctccgaccccggccccctggtcggggacctccgactccccgccgcctgcgtaccgcccgatccgcctcccggccatcaacgcgcccaccaacaccgcctccatcgccctctccccagtcccgcagcccctgcccgtgcccccggccgcgccgccccacgccttccagacccccaccaagcggatcgcctcccccgacgacatcgcccgcttccacgcctccctccacggccgccacttcctcggcttcgtcgccgcgctatccgcctccgtccacggccgtaagctctcggacccgctcccggctcccccgtccgccgccgtctccgcgctcctcgacctcatctccgccctcacggcactcgtcgcgtccgccccgccgctcccgcacaactctcgctacgggaacccggcttttcgcctctggcacgagaagctcaccgactccgccagcgacctcatcgcgcggatcacgtccaccgccgcgtcccccgctgacctcgccggcgccgaggtcgagctcgcgccgtaccttctcgactccttcggcaacgccacccgcatcgactacgggacggggcacgagaccaacttcgccgccttcctctactgcctcgccaggctcgggctcatcaccgagcccgactaccctgccgtcgtgctgcgcgtcttcgcagcctacctcagctttatgcgtacgctgcaggacacgtaccagctggagcctgcgggctcccatggcgtgtggggccttgatgatttccactttttgcccttcatatttggggctgcgcagcttatcgatcacaagtacatgaaacccaagtcgattcacaacccggatatattggagaacttctccaaggagtatatgtacctggcatgtgtcgcgtatgtgaagaagataaagaaggggcccttcgcagagcattcaccgatgttggatgatatcagtggtgtgcccaattggaagaaggtaaatagtgggctgctcaagatgtacaaggccgaggtgcttgagaaagtgccgatcatgcagcatttcctctttggttcgctaatcaaatgggaggattaattccatctaaagaagctcaccatgatctgtgagaactcctgtgtgatgcgaggactggttgtacagtaatgctgctcagattgtgtagaagaaagacctatagaggatcattttccgtctagaggaatgagttctctgtatgtttgcagcgtgccatcacactgctattatcgctcttcaatttctgggggcttgccccctcctgctcagcttgcattacttgtagctgctgaataaacaccttgtattgaggcttttgatgtagtcatgtagatgggagagatggctagagcagtgaagcatttttttttttgtataagaatcagtattgcttgtagcctgaaggtgctgccgcttgtagtgggtttgcctgtgacttaccttgaatgctgttgtcttccgtcgaccttgctgaattcctaatccttggcacctccatgatctcatagaggctgttcggctggtagaatgaatagtgttcggctggtacaatgaatagtattatgtgagtggaaaaaaaaaaaaaaaaaaaa

SEQ ID NO: 5396 - protein, 389 aa, Panicum virgatum
  misc_feature: Ceres CLONE 1820188
  misc_feature (2)..(301): Pfam Name: PTPA Pfam Description: Phosphotyrosyl phosphate activator ( PTPA) protein
MSNPGSSPTSASAHHDHAHTPLCRPCGATTTAPTPAPWSGTSDSPPPAYRPIRLPAINAPTNTASIALSPVPQPLPVPPAAPPHAFQTPTKRIASPDDIARFHASLHGRHFLGFVAALSASVHGRKLSDPLPAPPSAAVSALLDLISALTALVASAPPLPHNSRYGNPAFRLWHEKLTDSASDLIARITSTAASPADLAGAEVELAPYLLDSFGNATRIDYGTGHETNFAAFLYCLARLGLITEPDYPAVVLRVFAAYLSFMRTLQDTYQLEPAGSHGVWGLDDFHFLPFIFGAAQLIDHKYMKPKSIHNPDILENFSKEYMYLACVAYVKKIKKGPFAEHSPMLDDISGVPNWKKVNSGLLKMYKAEVLEKVPIMQHFLFGSLIKWED

SEQ ID NO: 5397 - DNA, 1135 bp, Panicum virgatum
  misc_feature: Ceres CLONE 1820193
  misc_feature: Encodes the peptide sequence at SEQ ID NO. 5398
gtccacgattgttcaggttgctccaagttcccagccttccccctcatcgagtacgtggttgttggagaaaaagaaaacgagtccatcgaagaatggtggacggcatcgatgacgaggtggtggtggagctgccctgcggtggaggcgaaggtaaccccgccgcctacgcggctgggctcaaaaggaagctggacttgtactgcgccgctgtcgccaaatccatggaggccaaatcacaagaatcctcgttgggctactccgactcacaggcttcaggcacttcacaattgacttctcaagcttcttctgctgttgaacacacaggtgatggaggtggggcaagcctagttacaaataactcaaatgtcctcggtcgtgatgactatcaaggagacccaattaacagtggtacatctaaggaacagtcagacgcctgtgtcaatcttgaggagaaaggtgaccctgctaatgagaaaaaaatgaggagaatgctgttaaatcgagaatcagctaggcgttcaagaaggaggagggaaagtcacctgtgcgatctcgaatctcaggtttccaggttaacatctgaaaatgcatctttgctaaagcgcatggctgatatgactcagaagtacaaggatgctacccttgacaacagaaatctcataattgctgttgagacaatgaggacaaaggtgaacatagcagaggaagctgttaggagactatcaggaacaacactcctcttatccagcacatctgaactacctccaagcatgagttcgacttcatttgcatctgataatgtggcttctcctgctgtcagcatggaacatagtatggaacattttcttctgtcgacactttacgacgatcagacagcctgccctcccaaatgcagcaattccctttgacaagtggggagctgggcaccttgtcgacctctctgtgatgggttgcatgctaggagagcctgaagaagaggatccatgaagaatcagaaatttctgagattttatatcactaccacagaactcgggaatgcatggaatcgatgtgttgttgtgtagtagtgtatcaacatgtactgtttttttaataataatattatcattttgggcaaaaaaaaaaaaaaaaaaaa

SEQ ID NO: 5398 - protein, 271 aa, Panicum virgatum
  misc_feature: Ceres CLONE 1820193
  misc_feature (1)..(55): Pfam Name: bZIP_2 Pfam Description: Basic region leucine zipper
  misc_feature (1)..(64): Pfam Name: bZIP_1 Pfam Description: bZIP transcription factor
MVDGIDDEVVVELPCGGGEGNPAAYAAGLKRKLDLYCAAVAKSMEAKSQESSLGYSDSQASGTSQLTSQASSAVEHTGDGGGASLVTNNSNVLGRDDYQGDPINSGTSKEQSDACVNLEEKGDPANEKKMRRMLLNRESARRSRRRRESHLCDLESQVSRLTSENASLLKRMADMTQKYKDATLDNRNLIIAVETMRTKVNIAEEAVRRLSGTTLLLSSTSELPPSMSSTSFASDNVASPAVSMEHSMEHFLLSTLYDDQTACPPKCSNSL

SEQ ID NO: 5399 - DNA, 1322 bp, Panicum virgatum
  misc_feature: Ceres CLONE 1820221
  misc_feature: Encodes the peptide sequence at SEQ ID NO. 5400
tttgcaatcagctctatgtatgatttcagatagagcggcatctcttggctagtggagtttagaatccgggcacgctgggttggtgttttttttttgctgtgctttcttggttcgtgctctgcgtagtccgtggaggtctaggctggttggtctgatctaatgattttttcgaggttatatattcagtgggagatcagaagttaatgtgatttgatgcatgttggggcagaacatctgagtgattaagacttagatatgtatgggatgctggcaattgcttcctctcagtaagcatattgtgtttgctgtggtgatgggttcgtacacctgctgattcttgcaggttcaaagatggcagagacggtgttcactccatccttggaagggatgaagcatgtcaaggcagaaaatggagtcattctcaccaagcctttccttgaagtctgcaagcaaatattgcctgtcctggataaatttggagctgctatggcaatcgtaaagagtgacatcggtggcaatatcacaagactggaaaacaagtattcttcagacccatcaaaatatgagcacttgtacagcatggttcaggaagaagttcaaaacaagactgcaaaaggttcctcgagctgcacaaatgggcttctatggctcacaagggccatggatttccttgttgagttattccgtaacctgcttgagcatccagactggactatgagtcaagcttgcactgattcgtacaccaaaactctgaagaaatttcatggctggcttgccagttctagctttacggtggccatgaagcttgctcctaacagagataaatttatggaggtcattagcggaacgggtgacatcaatgcagatattgagaaattttgcacaaccttttcaccatttctcaaggaaaatcacgagtttctggcaagtgttggtcttgatgatatgaaggcttcatagagcaatctccacaacgattacaacaaaataaacttgtcctaagaaaagtgttgctgaggatacagtgttttccatcgtcttcttcccctcccaaaaggggaaaaaacatacagggtaataacaagtttgtcaccatgattgaccatggatgcttacacagtgaatcgacagtgctaaaaagaacttgtctttggaactcgctcccctgttacagaaagtttgcatatggtggtggaactcttgtactctcaaaaattcttattctgtgctgaaacgctatgagaacttcgcaacaatatcatagccaaattcccgtaccaacttaactattatcagctttataaaaaaaaaaaaaaaaaaaa

SEQ ID NO: 5400 - protein, 202 aa, Panicum virgatum
  misc_feature: Ceres CLONE 1820221
  misc_feature: Great-hit functional homolog of the protein sequence given in SEQ ID NO 9468
  misc_feature: Useful for making plants with modulated oxidative stress sensitivity
MAETVFTPSLEGMKHVKAENGVILTKPFLEVCKQILPVLDKFGAAMAIVKSDIGGNITRLENKYSSDPSKYEHLYSMVQEEVQNKTAKGSSSCTNGLLWLTRAMDFLVELFRNLLEHPDWTMSQACTDSYTKTLKKFHGWLASSSFTVAMKLAPNRDKFMEVISGTGDINADIEKFCTTFSPFLKENHEFLASVGLDDMKAS

SEQ ID NO: 5401 - DNA, 1539 bp, Panicum virgatum
  misc_feature: Ceres CLONE 1820229
  misc_feature: Encodes the peptide sequence at SEQ ID NO. 5402
aggacaacgtgccaaggaaccggggactccacctcccgcaaggccgcaccgcgagctcgccaccggcgaggccactagaataaagcgagcgaacccaatgcaggccgccatcaccaccaccgccaccaccgtctgcgcgcacccgcacacgaagccatcgtcggcccccttcctccggctgtcccctccagcttgccgcgtcagcttcagcgcttctccgggcccgaacgtgagggcgaccgccatggcagccacgccgccgcagcaggagcagcagatggtcatcacgcgccccgacgactggcacctccacgttcgcgaaggcggcgtcctcgaggctgtgctgccacatagcgcgaggcattttgggagggctgtcatcatgcccaacttgaagccgccggtgaccacgacggcgcgcgcggtggagtacagggagcagatcatgcgggcgctgccgcccgggagtagcttcgtgccactcatgacgctttacctcacggataatactagcccggaggagatcaaactcgcaagaaagagtggtgtagtctttgctgtgaagctgtatcctgctggagcaactaccaattcccaagatggtgtcactgatattgggaaatgcttgcctgtcctcgaggagatggtcaggcaggaaatgcctttgcttgttcatggtgaagtcacagatcaacatgttgacacctttgaccgtgagaaggtttttattgatagaatattggcaccacttgtacaaaagcttccacagctgaaaatcgtcatggaacatatcacaactatggatgcagtgaacttcatagaatcatgtgaagaaggtcatgttgcggcaacagtgactccccagcatctcctcctcaataggaacgctttatttcagggtggcttgcagccacacaattactgcttgccaatactgaaaagagagattcatagacaagctattgtatctgctgtaacaagtgggagtagacggtactttcttggtactgatagcgctccccatgataaacagaacaaagaatgttcctgtggatgtgcaggaatatacagtgctcctgttgccttgtctctttacgcgaaggtatttgaagaggctggtgccctagataagttagaagcatttacaagcttcaacggccctgatttttatggcctaccaaggaacacatccaagattgtcttgagaaagagtgcctggaaagttccagcaacctataaacacagttcaggggagattgtgcctatgtttactggcagcaccctccattggcttccatctgatcagcctgaagaatagacaatgtgcattattcgacgatgcacttggggggaatcgataagtggagtaattccagttgctttcctccttttctgttagaatcagcataggaaactgtcttcagacataagcttgccttttgcctctacgtattcttgaaggcaagattagcgagaataacatattgaaagcaacggcgaaatgtctgcttgttgagttaaaaaaaaaaaaaaaaaaaa

SEQ ID NO: 5402 - protein, 406 aa, Panicum virgatum
  misc_feature: Ceres CLONE 1820229
  misc_feature (2)..(346): Pfam Name: Amidohydro_1 Pfam Description: Amidohydrolase family
  misc_feature (59)..(398): SWISSPROT Homolog: EC 3.5.2.3 Dihydroorotase
  misc_feature (60)..(400): SWISSPROT Homolog: EC 3.5.2.3 Dihydroorotase, mitochondrial precursor
MQAAITTTATTVCAHPHTKPSSAPFLRLSPPACRVSFSASPGPNVRATAMAATPPQQEQQMVITRPDDWHLHVREGGVLEAVLPHSARHFGRAVIMPNLKPPVTTTARAVEYREQIMRALPPGSSFVPLMTLYLTDNTSPEEIKLARKSGVVFAVKLYPAGATTNSQDGVTDIGKCLPVLEEMVRQEMPLLVHGEVTDQHVDTFDREKVFIDRILAPLVQKLPQLKIVMEHITTMDAVNFIESCEEGHVAATVTPQHLLLNRNALFQGGLQPHNYCLPILKREIHRQAIVSAVTSGSRRYFLGTDSAPHDKQNKECSCGCAGIYSAPVALSLYAKVFEEAGALDKLEAFTSFNGPDFYGLPRNTSKIVLRKSAWKVPATYKHSSGEIVPMFTGSTLHWLPSDQPEE

SEQ ID NO: 5403 - DNA, 1442 bp, Panicum virgatum
  misc_feature: Ceres CLONE 1820252
  misc_feature: Encodes the peptide sequence at SEQ ID NO. 5404
accagccgcgggccgcgccatctcccctactcctctgatcatggatctttatcttcttcttcacagcgtgctgatgcacttctctgcagcgattgtcatcttggtatacatccctctctctgtaccggtgaagctgttcgtgtgggcgttcgtgaagccgctgaggaaggaggacctgagggggaaggtcgtgctcatcaccggcgcttcctccggcatcggagaggagcttgcgtaccagtacgctaagaaaggggcgtgcctttcgctggtggcccgtcggaagcacgcgctggagggcgtcgccgcggccgcccgggaacgcggcgcgccggacgttctcgtcgttccggccgacgtctctgaccccgagcaatcgagacgcgccgtcgaggaaactgtcgcccacttcggcaaattgaaccatctggttgccaatgccggggcctggtccatctccttcttcgacgaaatcaccaacataactgcgttcaccaaaatgatggacgtgaacttctggggctctgtctacccaacctactacgccctgccacacctcaaggccagcaaaggaaagctcatcgtgtcgtcctccatagcggcgacggcgcctacatctaggttgagcttgtacaatgccaccaaggcagcacagctcaggttctacgagacgctgagatccgaacttggctcggaggttggcgtgaccatactgaccgccgggttcgtggagtccgagatgaccaagggcaaggcgatacagagagacggcgaggtcgccgtcgacgaggaggccagagatgtgcagatcggggtgttcccagtagcccgtgtcgacaagctgtgcaaggcagccctgaacggcatccggagaggcggctggtacgtgacatggccgtcgctgtacctgacgctgccgctgatcgcctgcctcgcccccgaggtcttgacctggcagtcctacgcgctgtacaacgccaagaaggggagcccgccgctgagccagaggatgctggacgccaccggagccaaacggttctacccgccgtcgctccggagccatccaggcatcaagacggagaagactggtgatcgcagggaagaagatgatgcagcgtcaaatgtgtagcgagccacacactcttttgtggtgaaggaaagtgccaaggaaaggctgcaaagggccctgttacccaggtttaattatagtatacatataattcaagagtgactgatccagtgaggaatgatgttggcatgaactgctagctgaggtattgttgtgcaaagagggagatcctttaatttaaattggttgcgatagggattattaggaccttggtgcacacctgtcatcatccgaacaattgaggatgccatgacatgctattaataatcaccacttcaatgggtttgggatttaaaaaaaaaaaaaaaaaaaa

SEQ ID NO: 5404 - protein, 362 aa, Panicum virgatum
  misc_feature: Ceres CLONE 1820252
  misc_feature (1)..(169): Pfam Name: adh_short Pfam Description: short chain dehydrogenase
MDLYLLLHSVLMHFSAAIVILVYIPLSVPVKLFVWAFVKPLRKEDLRGKVVLITGASSGIGEELAYQYAKKGACLSLVARRKHALEGVAAAARERGAPDVLVVPADVSDPEQSRRAVEETVAHFGKLNHLVANAGAWSISFFDEITNITAFTKMMDVNFWGSVYPTYYALPHLKASKGKLIVSSSIAATAPTSRLSLYNATKAAQLRFYETLRSELGSEVGVTILTAGFVESEMTKGKAIQRDGEVAVDEEARDVQIGVFPVARVDKLCKAALNGIRRGGWYVTWPSLYLTLPLIACLAPEVLTWQSYALYNAKKGSPPLSQRMLDATGAKRFYPPSLRSHPGIKTEKTGDRREEDDAASNV

SEQ ID NO: 5405 - DNA, 1483 bp, Panicum virgatum
  misc_feature: Ceres CLONE 1820291
  misc_feature: Encodes the peptide sequence at SEQ ID NO. 5406
gtctatgcggtgccattagacatcacatcatatccttcacaggcagcaaagcaaagcaaagcaaagcacagcccagcccagcgcagcacagcacacttgcagctgcagctgcagcgccatcccttcccttctcctcaagcatcaccaaccttgctccctcccacttccacacgcgcactccaccttgcctgccttcctccgatcggggttcggggccatgggcggcggcgtccaggaggaggaggccgccggcgcgccgcatactgccgccatggtggtgccgccggtgctcgtcaaggggaagcgcagcaagaggcagcgcgtgcacgcgccgccggtggtgctgtcgtccgcggcgcccgagtggtcgtcgtccgcggcgtcggccgccacggcgcccgcggaggaggagtccgggacgtcgcggtcggacgaggccgcgtccagcgccgggtgcctcaccgaggaggacgaggacatggcgctctgcctcatgctcctcgcgcgcggcgtcccggcggcggccaaggatgacgagggcgtggtggtcgccgtcgccgccaaggaggccaggttcaggagccgccgcccggccgacggcgccgccgccggcgagtacgtgtaccagtgcaagacgtgcgacaagtgcttcccgtccttccaggcgctcggcggccaccgcaccagccacaagaagccccgcctgcttccgccgccgctggcgctggcatccgaggataccaaggcggccgctgcagccgagccagccgccccgtctccgacgtcgctcccgccgacgcctccacccccggcggaagccaccgccgccgatgcaacagtgctcgcgatcgcggtcacggtccccgtggcgccgaagcaggagcacgacgcgggcgccgtcgccgtcaaggccgccgcggccttcatcgccgcgagcagcagctccaagcaccacccgcgggtgcacgagtgctccctatgcggcgccgagttcgggtcggggcaggcactgggcggccacatgcggcggcaccgcccgctcgtgccggcggcggcgcgggacgacgcgccgaggaaggagaagagcctcctggagctggacctcaacatgcccgcgccctgcgacgaggcggagacgtcgccgcggttcgctttcgccgctgagaggccaccggcggccctcctcttcccggcatccgcggcgtcggccctggtagactgccattactagtaaacacctcaccaagtagctctcatcctctgctgcttccttctcagctgatacatacatacacacatacacaattactactccaatccatacagtacacaccaaattgctactccttgttgtctactaaatactactttttagtttctcttctttatttttgggggtattttcattccattatttgttcaaatgattggaaatttggaatgggagatgtgaattatcggtacagaaatatgtttgatatat

SEQ ID NO: 5406 - protein, 337 aa, Panicum virgatum
  misc_feature: Ceres CLONE 1820291
  misc_feature: Great-hit functional homolog of the protein sequence given in SEQ ID NO 9759
  misc_feature (1)..(23): Pfam Name: zf-C2H2 Pfam Description: Zinc finger, C2H2 type
  misc_feature: Useful for making plants with modulated biomass
  misc_feature: The plant is abnormally small.
MGGGVQEEEAAGAPHTAAMVVPPVLVKGKRSKRQRVHAPPVVLSSAAPEWSSSAASAATAPAEEESGTSRSDEAASSAGCLTEEDEDMALCLMLLARGVPAAAKDDEGVVVAVAAKEARFRSRRPADGAAAGEYVYQCKTCDKCFPSFQALGGHRTSHKKPRLLPPPLALASEDTKAAAAAEPAAPSPTSLPPTPPPPAEATAADATVLAIAVTVPVAPKQEHDAGAVAVKAAAAFIAASSSSKHHPRVHECSLCGAEFGSGQALGGHMRRHRPLVPAAARDDAPRKEKSLLELDLNMPAPCDEAETSPRFAFAAERPPAALLFPASAASALVDCHY

SEQ ID NO: 5407 - DNA, 1287 bp, Panicum virgatum
  misc_feature: Ceres CLONE 1820314
  misc_feature: Encodes the peptide sequence at SEQ ID NO. 5408
gcattttcgcatccaattccaaaaccagcggagaagagagcagccgcggagaagggaagaagccgccatggccaacgggctcccggaccctccctgcggctttctcaccgccgacgccgctcgatccctcgtcaattccgtcgacgccttcctcttcgattgcgatggagttatttggaagggggataagctcattgaaggggtcggggagacgatggagctgctgcggaaaatgggcaagaaaatagtttttgtaacaaacaactctagaaagtcaagaaggcaatactcaaagaaattcagatcacttggacttgaagtcactgaggaagagatttttacatcctcatttgctgcagccatgttcttgaagttaaataattttcccccagaaaagaaggtttatgttgtcggtgaagacggaattttggaagagctcaagttagctggttttgaatgctttggaggtccggaggatggcaagaaaaacataatcttggaggcggacttctactttgaacatgacaaaagtgttggagctgttgttgttggacttgatcagcacttcaattattacaaaatgcagtatgcaagaacatgtattagtgagaatccaggctgccttttcattgcgaccaaccgtgatccaactggacatatgacatctgcccaagaatggccaggagctggaactatggttgctgcagtaagctgctcagtacagaaagagcccattgttgttggaaagccttcgagctttttgatggacttcctcttgaaaagcttcaatctggaaacatcaaggatgtgcatggtggctgatagactggatacagacatactatttggccagaattctggctgcaagaccctcctcgttttgtctggttgtactactttaccagaactgcaggacgcttcgaataacatccagccagatgtctacacaaacagtgtatatgatctcgttgggttattacagaaataatttgtcggccgtggcatcgagtgacagagctgagttctaactagacgaaccaattgggctattgaaacgatattagtatattctttggctaactgtttggtagtaacccaggactgcgtatcaattgtagtcaactcaggtactcccatttcaaattaaaccagtttcacaacctcataaaatgtaccacataatttgttataaagcttcaaattttgcaataatggaactgcgctttccagtcttgaaatgtatttgactgcagtacggaattgcactaaaaaaaaaaaaaaaaaaaa

SEQ ID NO: 5408 - protein, 306 aa, Panicum virgatum
  misc_feature: Ceres CLONE 1820314
  misc_feature (1)..(250): Pfam Name: Hydrolase Pfam Description: haloacid dehalogenase-like hydrolase
MANGLPDPPCGFLTADAARSLVNSVDAFLFDCDGVIWKGDKLIEGVGETMELLRKMGKKIVFVTNNSRKSRRQYSKKFRSLGLEVTEEEIFTSSFAAAMFLKLNNFPPEKKVYVVGEDGILEELKLAGFECFGGPEDGKKNIILEADFYFEHDKSVGAVVVGLDQHFNYYKMQYARTCISENPGCLFIATNRDPTGHMTSAQEWPGAGTMVAAVSCSVQKEPIVVGKPSSFLMDFLLKSFNLETSRMCMVADRLDTDILFGQNSGCKTLLVLSGCTTLPELQDASNNIQPDVYTNSVYDLVGLLQK

SEQ ID NO: 5409 - DNA, 1442 bp, Panicum virgatum
  misc_feature: Ceres CLONE 1820318
  misc_feature: Encodes the peptide sequence at SEQ ID NO. 5410
ccgcaagccccgcaaaccatcagagaccccaaacccaaacccctctctcctccccttcgccttcgccttcgcctttctcttcctccgcccgccgcttccaatcctagggttttacccgcggcgacgccgcaccgcagcgcgatggagcccacctcgtcggcgtcgatcgcgcggcagacgtgggagctggagaacaacatccccgcggcggccaccgacccggacgcgatggacgcgatctaccgctacgacgacgccgcgcaggcgcgggcgcagcaggagaagccctgggccaacgacccgcaccacttccgccgcgccaagatctccgcgctcgcgctcctcaagatggtcgtccacgcccgcgcggggggcaccatcgaagtgatggggctcatgcagggcaagtgcgagggcgactccatcatcgtcatggatgccttcgcgctccccgtcgagggcaccgagaccagggtcaatgcccaggccgacgcctacgagtacatggtcgagtactcaaccatcaacaagcaggctgggagactggagaatgtggttggctggtatcattcacaccctggttatggatgctggctgtcaggcattgacgtgtcaactcagatgcttaatcaacaatttacagagccattcttggctgttgtgatagaccctacaaggactgtttctgctggtaaagtggagattggggcttttaggacctacccaaaagattacaagcctccagatgagcctgtgtccgagtatcagaccattccactcaacaagatagaagattttggcgtccactgcagacagtactattctttggatataacttatttcaagtcatccctggattctcacctccttgatctgctctggaacaagtactgggtcaacacattatcttcgtcaccacttctgggcaacagggattatgttgctgggcagatctttgatttagctgataaactagagcaagctgaaggtcagctggcacacagtcgatttggtggtatgcttatgccagcacaacggaagaaagagcaagaggagtctccactggccaaggtaactcgagatagttccaaaatcacagctgaacaggtccatggtctcatgtcacaggtaataaaagacatcctcttcaactctgtgcacccatcaagcaaggcaagcacaagtgctccggattcatctggacctgagcctatggttgaagcttaagagttgcaagaaaacgtgacactgaaagctgagttctgatcgtgggcagcatagctgtccgattcacaatgcgcaaactattttgtcaaaacagaatcattatgtaattatgagttgccttctgtattcacttggtaggaggattgttatgatgctcacattaatctcggtcaatgaaacctttttttgagtgtgaaaaaaaaaaaaaaaaaaaa

SEQ ID NO: 5410 - protein, 361 aa, Panicum virgatum
  misc_feature: Ceres CLONE 1820318
  misc_feature: Great-hit functional homolog of the protein sequence given in SEQ ID NO 9578
  misc_feature: The sequence is a functional homolog of  SEQ ID NO 122 in the  10/286,264 US patent application
  misc_feature: The sequence is a functional homolog of  SEQ ID NO 1844 in the  10/412,699 US patent application
  misc_feature: The sequence is a functional homolog of  SEQ ID NO 2088 in the  10/374,780 US patent application
  misc_feature: The sequence is a functional homolog of  SEQ ID NO 766 in the  10/412,699 US patent application
  misc_feature: The sequence is a functional homolog of  SEQ ID NO 938 in the  10/225,066 US patent application
  misc_feature: Useful for making plants with altered terpenoid content
  misc_feature: Useful for making plants with modulated low light sensitivity
  misc_feature: Useful for making plants with modulated growth and phenotype characteristics
MEPTSSASIARQTWELENNIPAAATDPDAMDAIYRYDDAAQARAQQEKPWANDPHHFRRAKISALALLKMVVHARAGGTIEVMGLMQGKCEGDSIIVMDAFALPVEGTETRVNAQADAYEYMVEYSTINKQAGRLENVVGWYHSHPGYGCWLSGIDVSTQMLNQQFTEPFLAVVIDPTRTVSAGKVEIGAFRTYPKDYKPPDEPVSEYQTIPLNKIEDFGVHCRQYYSLDITYFKSSLDSHLLDLLWNKYWVNTLSSSPLLGNRDYVAGQIFDLADKLEQAEGQLAHSRFGGMLMPAQRKKEQEESPLAKVTRDSSKITAEQVHGLMSQVIKDILFNSVHPSSKASTSAPDSSGPEPMVEA

SEQ ID NO: 5411 - DNA, 1352 bp, Panicum virgatum
  misc_feature: Ceres CLONE 1820342
  misc_feature: Encodes the peptide sequence at SEQ ID NO. 5412
accgcccgccgccgccgcctctcctccaccggaaacggagcctccttctccagctctgccgcgcctccaccgcgcgccacggccgttgctcttccggcaagctgcttgtttggtgcgtcgtgaccgggcggccgccggcaagatgagcaaggaggcggcggtgaacgtgttcctgagctgcttcatgcacgtcggcctcgcgctggtgctcctcgtctacctcccggcggcctccctctgccgcctcctggcccgcgtcttcgtccgcccgttcgcccggggcgaggacctccaaggcaaggtcgtgctcgtcaccggcgcctcctccggcatcggcgagcacctggtgtacgagtacgcgaggaagggcgcgtgcgtggcgctggtggcgcggacggagatcgcgctgcgcgccgtggccaagacggcgcgcgacctcggcgcgcccgacgtgctggtcgtgccggccgacatcaccaaggtggacgaggccaagcgcgccgtcgaggagaccgtcgcacacttcggcaaactgaaccacctggttgccaacgcggggatctggtccagctgcttttttgaagaaatcaccaatataaccgccttccacaatgtgatcgatctaaacttctggggcgccgtctacccgacctacttcgcgctgccgtacctcaaggcaagccgcgggaacatcgtcgtcacctcctccgtagccggcagggtgcctaccgccaggatgagcttctacaacgccagcaaaggagctgtgattcggttctacgagaccctgagggctgagctggggtcccacgtccgggtcaccatcctcatgccggggtacgtcgtctccaacctcaccaagggcaagggcctccagaaggacggccatgtcggcatcgacgaggaggcccgcgacatcaatgtcgggccgctgccggtgggcaagacggagtccctggcggcggtggtggtggcgagcgtgcggcgcggggaccactacgtgacgtggcccgggtggtactgggcgttccacatggtgatgtgcgcggcgccggagctggtggactggttctcccggacgttctacgtgtccaagtccggggagcaggacggcggcgccgcgctgagcaagaagatcctcgaggccgtcggcgggaagaagttcctctaccccaagaccatccgctccgaggccgccatggcagctaactgactggactcgtcaaggcgataaatttcttatattatatgtataaacatgcatgcatggtctgttgctgtgacttgttctgggtgcatatgatgggtcgacctgcattttttattcgtttgaaaaaaaaaaaaaaaaaaaa

SEQ ID NO: 5412 - protein, 356 aa, Panicum virgatum
  misc_feature: Ceres CLONE 1820342
  misc_feature (1)..(169): Pfam Name: adh_short Pfam Description: short chain dehydrogenase
MSKEAAVNVFLSCFMHVGLALVLLVYLPAASLCRLLARVFVRPFARGEDLQGKVVLVTGASSGIGEHLVYEYARKGACVALVARTEIALRAVAKTARDLGAPDVLVVPADITKVDEAKRAVEETVAHFGKLNHLVANAGIWSSCFFEEITNITAFHNVIDLNFWGAVYPTYFALPYLKASRGNIVVTSSVAGRVPTARMSFYNASKGAVIRFYETLRAELGSHVRVTILMPGYVVSNLTKGKGLQKDGHVGIDEEARDINVGPLPVGKTESLAAVVVASVRRGDHYVTWPGWYWAFHMVMCAAPELVDWFSRTFYVSKSGEQDGGAALSKKILEAVGGKKFLYPKTIRSEAAMAAN

SEQ ID NO: 5413 - DNA, 1463 bp, Panicum virgatum
  misc_feature: Ceres CLONE 1820376
  misc_feature: Encodes the peptide sequence at SEQ ID NO. 5414
attcctttcccctggaacaagcaccttccttctcctcctgatctcccacgggttcccctcgatggcgacgccccgctccccaagcccccgcgccgacgcgcccctcgactcggcgccgcttctgggcggcgggagccggcgccgaggcggcgcgctccggcggccctccctccgcggcgcggcgcggctgctacgccggggcgggcggcgggcgatgcgggagccgtcggtgctggtgcgggaggccgcggcggagcaccttgaggagcggcaggcggactgggcctactcccgccccgtcgtggcgctcgacctgctctggaacctcgccttcatcaccgtcgccgcggtcgtgctggtgctcagccgggacgaggactcgcccatgccgctccggacctgggtcgccggctacgccctccagtgcgtcgtccacatggtctgcgtcgcgatagagtaccggatgcgccacggcccgcgcggtggaggcccagcgcccgccgacgaggaaaggggcagcgatggatcgtcctcgtccagcgacgaggatgacagggagcttgatcgccgtggtcgccgcaccgattacgccagtattgcaaagcacttggagtctgctaatacgatgttctccttcatatggtggataattggattttactggatatctgctggaggtgaagaggttatccgggatgcacctcaactttactggctttgcatagtctttctggcatttgatgtgttctttgttgtattctgcgttgctctggcttgtatcattggtattgctgtttgttgttgcctcccttgcatcatagcaattctctatgcagtatctgatcaggaaggggcatctgaagatgatattcgtcaaatcccaaggtacaaatttcggcggactgatgagcctgaaaagcaagatgttgaccccatggggccttttggtggaataatgacagagtgtggcacaaatcaacctattgagaaagtgcttgcagctgaagatgcagagtgttgtatctgcctttcggcatatgacgacggtgcagagctgcgcgaactcccttgtgggcaccatttccactgcacatgcatcgataagtggctgcacatcaatgcaacatgccccctgtgcaagtacaacattcggaaaagcagcagtagcagtggaagtgaagaagtatgaatgtccgccccttgacaattccaatccgtttcgactttgtgcctgtgccattgctaatgtgactccaggttgtgtccggtgtaaatttttgtatccaaatgtgctgatagagtcaatcaattatgtactaaagttactcaaagtgctgcccatatgttgcataagttaataaatagttgggtgtgcacctgtacttacagtcgggaatatatgttggtaggaccgttacttctatcctatgagtgatcgaggcttcttcctgcttgttagtatc

SEQ ID NO: 5414 - protein, 375 aa, Panicum virgatum
  misc_feature: Ceres CLONE 1820376
  misc_feature (1)..(41): Pfam Name: zf-C3HC4 Pfam Description: Zinc finger, C3HC4 type (RING finger)
MATPRSPSPRADAPLDSAPLLGGGSRRRGGALRRPSLRGAARLLRRGGRRAMREPSVLVREAAAEHLEERQADWAYSRPVVALDLLWNLAFITVAAVVLVLSRDEDSPMPLRTWVAGYALQCVVHMVCVAIEYRMRHGPRGGGPAPADEERGSDGSSSSSDEDDRELDRRGRRTDYASIAKHLESANTMFSFIWWIIGFYWISAGGEEVIRDAPQLYWLCIVFLAFDVFFVVFCVALACIIGIAVCCCLPCIIAILYAVSDQEGASEDDIRQIPRYKFRRTDEPEKQDVDPMGPFGGIMTECGTNQPIEKVLAAEDAECCICLSAYDDGAELRELPCGHHFHCTCIDKWLHINATCPLCKYNIRKSSSSSGSEEV

SEQ ID NO: 5415 - DNA, 1437 bp, Panicum virgatum
  misc_feature: Ceres CLONE 1820378
  misc_feature: Encodes the peptide sequence at SEQ ID NO. 5416
ccgtccacggccgagccaaagcaagcaacctcctgcctcctcaaagagagttcgagatcgcagctgcctccagaccaccagcaaagcaaccgccaccgacgttccaagaagcgtaaccgaccatgatgatgatgggagagggagcgcacgcgccgccgtggcagcagcagcagcagcagccggcggccagcgccggcatggtggacggggacgacgcgtcgccgtacagcctcctggtggcgctgcggcatttcctgccatcgaacgaggccgcggcggcggcgtacgacgaggacgacgaggaggccctggccgcggtggacgcctacgcctgcgacgagttccggatgtacgagttcaaggtgcgccggtgctcgcgcgggcggagccacgactggacggactgcccgtacgcgcacccgggggagaaggcccgccgccgcgaccccaggcggtaccactactccggcaccgcctgcccggactatcgcaagggcggctgcaagcgcggcgacgcctgcgagtttgcgcacggggtgttcgagtgctggctccacccgtcgcgctaccggacgcagccctgcaaggacggcaccgcctgccgccgccgcgtctgcttcttcgcgcacacgccggaccagctccgcgtcctgccgccgcagcagtccagcgccagccccaggggcgccggcgccgcgccgtcgccgctcgccgagtcgtacgacggctcgccgctccgccgccaggccttcgagagctacctcaccaagaccggcatcatgtcctcgtccccgaccagcacgctcgtctcgccgccgaggtcgccgccctccgagtccccgccaatgtcgccggacgccgccgccggcgcgctccgccgcggctcctggccgggtgtcggctcgcccgtcaacgaggtcgtcgcctcgctgcgccagctccgcctcggcggcggcggctcgccgaggtcggcgccgtccggcggctcgttcttggtcggctacccgttcgggtcccccaagtccccggccgcgctgtacagcctcccgtccaccccgaccaggccggccgcggtgacggtgaccaccccctccggcgccaccgtcatgaccgtggagcgcctcaaccttgggctcatcggtgacgaggagccggtgatggagcgggtggagtccgggagagccctccgcgagatggtgttcgagcggctcagcaaagaagccaccgtgcccaacgacgccgccgcctccgccaacgctgagggcgctgccccagccgccgccccggacgtcggctgggtctccgacctcataaactgatgagggagctcgagaagccagcaccatccgtggctcctctgaacattgtccatctatggtaagtgggggaagaacctgagaggcagcactgcacaacaggagaagaaaatccaaaagc

SEQ ID NO: 5416 - protein, 398 aa, Panicum virgatum
  misc_feature: Ceres CLONE 1820378
  misc_feature (1)..(26): Pfam Name: zf-CCCH Pfam Description: Zinc finger C-x8-C-x5-C-x3-H type (and similar)
MMMMGEGAHAPPWQQQQQQPAASAGMVDGDDASPYSLLVALRHFLPSNEAAAAAYDEDDEEALAAVDAYACDEFRMYEFKVRRCSRGRSHDWTDCPYAHPGEKARRRDPRRYHYSGTACPDYRKGGCKRGDACEFAHGVFECWLHPSRYRTQPCKDGTACRRRVCFFAHTPDQLRVLPPQQSSASPRGAGAAPSPLAESYDGSPLRRQAFESYLTKTGIMSSSPTSTLVSPPRSPPSESPPMSPDAAAGALRRGSWPGVGSPVNEVVASLRQLRLGGGGSPRSAPSGGSFLVGYPFGSPKSPAALYSLPSTPTRPAAVTVTTPSGATVMTVERLNLGLIGDEEPVMERVESGRALREMVFERLSKEATVPNDAAASANAEGAAPAAAPDVGWVSDLIN

SEQ ID NO: 5417 - DNA, 1199 bp, Panicum virgatum
  misc_feature: Ceres CLONE 1820408
  misc_feature: Encodes the peptide sequence at SEQ ID NO. 5418
aactacgcggcctcagaagtcaacactcccggtaggttccggaggttcggtggctccggagagacaggcggatagcgagcgtatggccggccacttcgtcctcaacaccggcgccaagatcccggcggtcgggctcggcacctggcaggccgaccccgccgtcgtcggcgacgccgtctacgccgctgtcaaggcaggtcataggcacatcgactgtgctcaagcatacaacaacgaaaaagaggtcggattgggtctcaagaaagcgctcgatgagggcatagtcaagcgtgaggatctcttcatcacctccaagctctggaacaccaaccatgcgccagaggacgttccagttgcgctggacggcacgctgaaagccctgcagacggactacgtggatctttacctcgtccattggccggtgaccatgaagaaaggcgctggttatggcccgcaaagcattatcccgtcagatatcccggcgacctgggcggcgatggagaagctgtacgacgccggcaaggcgcgcgccatcggcgtcagcaacttctcgagcaagaagctggcggacctgctcgccgtggcgcgcgtgcccccggccgtcaaccaggtggagtgccaccccgtgtggcagcagggcaagctccgcgccttctgccagtccaaagggatacacctctcggcctactcgccgttgggctcgccgggcacgacgatcgtgaaggtgagggcgggcgcggtgctggagcacccggtggtcgtgtcggcggcggagaagctggggaagacgccggcgcaggtggcgctgcgctggggcgtccagatggggcacagcgtgctccccaagagcaccaacgaggagaggatcagggagaacatcgacgtctacgactggtccatcccggacgacctgttcgccaggctctccgagatcgagcaggagaggttgattcccgcgagcttcttcgtgcacccggaaggcgtgttcaagtccgtcgaggagctctgggacggcgagatctgaggtcaccgtctggctgcgcaccgaacgaaatttcaaaaaaaaaagacttggtcaggcgtacggattactacaacaataaatttgtctgaactgtgacggaaatgaagcgcacgtgcaatcggcagtccaataaaattcgcttttgctgacgtcggcaaaaaaaaaaaaaaaaaaa

SEQ ID NO: 5418 - protein, 313 aa, Panicum virgatum
  misc_feature: Ceres CLONE 1820408
  misc_feature (1)..(279): Pfam Name: Aldo_ket_red Pfam Description: Aldo/keto reductase family
MAGHFVLNTGAKIPAVGLGTWQADPAVVGDAVYAAVKAGHRHIDCAQAYNNEKEVGLGLKKALDEGIVKREDLFITSKLWNTNHAPEDVPVALDGTLKALQTDYVDLYLVHWPVTMKKGAGYGPQSIIPSDIPATWAAMEKLYDAGKARAIGVSNFSSKKLADLLAVARVPPAVNQVECHPVWQQGKLRAFCQSKGIHLSAYSPLGSPGTTIVKVRAGAVLEHPVVVSAAEKLGKTPAQVALRWGVQMGHSVLPKSTNEERIRENIDVYDWSIPDDLFARLSEIEQERLIPASFFVHPEGVFKSVEELWDGEI

SEQ ID NO: 5419 - DNA, 1775 bp, Panicum virgatum
  misc_feature: Ceres CLONE 1820419
  misc_feature: Encodes the peptide sequence at SEQ ID NO. 5420
agcgagcactactggcgcaggaaacacaaaggaaacagtcgctgagatggcgcatgccgtgcgcgccccggcgccgcacgtcgtcgtgctcacgagccctggcgtggggcacgtcgccccggtggccgagctcgccacgcgcctcgccgcgctccacggcgtcacctccacgatcgtcacctacaccaacctctcctctcccgggggcggctctcccgcgctggcctccctcccgccgggcatatccaccgccgcgctcccggaggtgcccctcgacgacctccccgccgccgcgcacatggtgacccgcatcctcaccgtcgtccggcgcacgctcccgcacctccgcgccctgctccgctccctcctcgacggctccccctccggcggcggcgtcacggccttcctcgccgacatgctctgccccgcggcgctcgccgtcgccagggagctcggcgtgccgcgctacgtcttctacacatcgagcctcatgtcgctggccacgctgctctacaccccggagctcgcgaggaccaccgcctgcgagtgccgcgacctcccggcgccggtggtcctcccggggtgcctgccgctgcacggagccgacctcgtcgagcccctccaggagcgcgccgaccccgtgtttggcctcctcgtcgacttgggcctcgactacctccacagcgacggcttcatcgtcaacaccttcgacgccctggagcacgagaccctggaggcgttcagggagctctccgacaagggcgtctacccaccggcgtacgccgtgggcccgttggtccgctcgtcgccggacgaggcgtcggcggccgagcaccggtgcacggcgtggctcgacgagcagccggacgggtccgtcctgtacgtgtgcttcggcagcggcggcacgctgtcgacgctgcagaccgccgagctggccgccgggctggaggccagcggccagaagttcctgtgggtggtgcggttccccaacgacaaggacagcagcgcgtgctacatcaatggcgggaagacgacggcagaccacggcggcgacgccgacgacccgatgagctacctgccggaggggttcgtggagaggacgagggccgtggggctcgtggtgccggagtgggcgccgcaggtggagatcctgggccaccgcgccgtcgggggcttcctgacgcactgcgggtggaactcggcgctggaggccgtggccgcgggcgtgccggcgctggcgtggccgctgttcgccgagcagcggatgaacgcggtgaagctggcgtcggagcacgtcgggctggcgctgcgggtgcgcgcgagggaggacgacggggtggtgccgcgggaggaggtggccgcggcggccagggagctgatggtgggggacaggggcgccgtggcgcggcagagagcgcgcgagctgcgggcggaggcgcgccgggcgtcggcgccaggcgggcccgcacaccaggcactcgcggccgtcgtcgacatgtggaaatgtgctgcggcaagctcggcggctgccgatgcagcagctggtggtggactgtgcatgaatccgtgatcgtgtcgtgtgtatgcgttactgcggccttatttagttcacgaaaatttttatgttttagtactatagcacttttatttttatttaataattaatattcaattataaactgattagacttaaaagagtcgtctcatcatttacagttaaattgtataataagttattttttaactacatttaataaaaaaaaaaaaaaaaaaaa

SEQ ID NO: 5420 - protein, 507 aa, Panicum virgatum
  misc_feature: Ceres CLONE 1820419
  misc_feature (1)..(150): Pfam Name: UDPGT Pfam Description: UDP-glucoronosyl and UDP-glucosyl transferase
MAHAVRAPAPHVVVLTSPGVGHVAPVAELATRLAALHGVTSTIVTYTNLSSPGGGSPALASLPPGISTAALPEVPLDDLPAAAHMVTRILTVVRRTLPHLRALLRSLLDGSPSGGGVTAFLADMLCPAALAVARELGVPRYVFYTSSLMSLATLLYTPELARTTACECRDLPAPVVLPGCLPLHGADLVEPLQERADPVFGLLVDLGLDYLHSDGFIVNTFDALEHETLEAFRELSDKGVYPPAYAVGPLVRSSPDEASAAEHRCTAWLDEQPDGSVLYVCFGSGGTLSTLQTAELAAGLEASGQKFLWVVRFPNDKDSSACYINGGKTTADHGGDADDPMSYLPEGFVERTRAVGLVVPEWAPQVEILGHRAVGGFLTHCGWNSALEAVAAGVPALAWPLFAEQRMNAVKLASEHVGLALRVRAREDDGVVPREEVAAAARELMVGDRGAVARQRARELRAEARRASAPGGPAHQALAAVVDMWKCAAASSAAADAAAGGGLCMNP

SEQ ID NO: 5421 - DNA, 1948 bp, Panicum virgatum
  misc_feature: Ceres CLONE 1820433
  misc_feature: Encodes the peptide sequence at SEQ ID NO. 5422
attccgacgccggcgaaattccccaattccgagcgccccagccaccgccgcggcggcggcgcgccaccccacgccggcgatggaggccccgacggcggcgatggtgtggttccggaaggggctgcgcgtgcacgacaacccggcgctcgacgcggcccgccgcggcgccgggcggctgtacccggtgttcgtgctcgacccgcggtacctgcgcccggaccccgccgccgcgtccccgggctccgcgcgcgccggggtcgcccgcgtccgcttcctcctcgagagcctcggcgacctcgacgcccgcctccaccgcctagggtcccgcctcctcctactccgcgcccgcgacgacgacgacgccgccggcgccgtctgcgccgccctcaaggactggaacatcggcaggctgtccttcgagtccgacacggagccgtacgcgctggcccgcgacaagaaagtcacggattttgcgatgtcttcggggatcgaggtgttcacgccggttagccataccctcttcgacccggcagacatcataaacaagaacggtggtcggccgcctttgacgtaccaatcattcatcgccatagccgttgaaccgcctgagcctattttggaggaatactctgaactcccaccggttggagacacaggagagtacgagttgttgcccgtgcctacagttgaggagcttgggtatggggatatcagccaggaggagatttcgccattccaaggaggggagacagaagctctgaggagaatgaaagaatcacttcaagataaggaatgggttgccaaatttgagaaacctaagggtgacccatctgccttcctcaaacctgcaaccactgttttgtcaccatatctgaagtttggctgcctgtcctccagatatttttaccactgcattcaggatgtctacaggagtgtcagaaattatacaaaaccacctgtttcattgacaggccagttgctgtggcgagacttcttctacacagtgtcttttgggactcctaattttgatcagatgaaaggaaacaaaatatgcaagcagatcccatggagtgagaatgaggagctatttgttgcatggagagatgggcggacagggtatccatggattgatgctatcatgattcagctaaggaagtggggctggatgcatcaccttgcacgccattcagttgcttgttttcttacgcgtggtgatctgtttatccactgggagaaaggacgtgatgtctttgaaaggctgctgattgattctgattgggccattaacaacggcaattggctgtggctatcttgctcatccttcttctatcagtaccacagaatttactcccctattacatttgggaagaagtatgatcctaatgggaactacatcaggcatttcattccagtgctgaaagacatgccgagggagtacatttacgagccttggactgccccccttagcattcagaagaaagccaaatgtattattggcaaagactacccaaaaccagtggttgatcatgatactgcaaccaaagagtgtagaaagaggatgggagaagcttatgcctcgaatcgccttgattcctactcttccaaagggaaaccttcaaacttgtcgcgcagaaaatggtctcacggtgaccaagatgcctctaactcgtccattgccaggcaactgaagactagtcgatctgactgatgcgcagcccatttcctgcggcagcattacaaaatgaagctgtgacaacggcggcggcctgcaccagccatctgtagtatcctaatgaagtagtttaaccgaaaaggaaatgacttgcgaccctttctgaattgtagcgtctgtatcaacaatgaacgaacagatctctaacatattacatatggtcaggtaacaggtgtatcatgtactggtcatcttcaaaaaaaaaaaaaaaaaaaa

SEQ ID NO: 5422 - protein, 542 aa, Panicum virgatum
  misc_feature: Ceres CLONE 1820433
  misc_feature (1)..(279): Pfam Name: FAD_binding_7 Pfam Description: FAD binding domain of DNA photolyase
  misc_feature (2)..(194): Pfam Name: DNA_photolyase Pfam Description: DNA photolyase
MEAPTAAMVWFRKGLRVHDNPALDAARRGAGRLYPVFVLDPRYLRPDPAAASPGSARAGVARVRFLLESLGDLDARLHRLGSRLLLLRARDDDDAAGAVCAALKDWNIGRLSFESDTEPYALARDKKVTDFAMSSGIEVFTPVSHTLFDPADIINKNGGRPPLTYQSFIAIAVEPPEPILEEYSELPPVGDTGEYELLPVPTVEELGYGDISQEEISPFQGGETEALRRMKESLQDKEWVAKFEKPKGDPSAFLKPATTVLSPYLKFGCLSSRYFYHCIQDVYRSVRNYTKPPVSLTGQLLWRDFFYTVSFGTPNFDQMKGNKICKQIPWSENEELFVAWRDGRTGYPWIDAIMIQLRKWGWMHHLARHSVACFLTRGDLFIHWEKGRDVFERLLIDSDWAINNGNWLWLSCSSFFYQYHRIYSPITFGKKYDPNGNYIRHFIPVLKDMPREYIYEPWTAPLSIQKKAKCIIGKDYPKPVVDHDTATKECRKRMGEAYASNRLDSYSSKGKPSNLSRRKWSHGDQDASNSSIARQLKTSRSD

SEQ ID NO: 5423 - DNA, 1343 bp, Panicum virgatum
  misc_feature: Ceres CLONE 1820459
  misc_feature: Encodes the peptide sequence at SEQ ID NO. 5424
atgagccactcgccggtcgggcttccgtaaccacgccaccaacctctgagtgcgctcttgggccaagccgggagcgcacggcaaggacaccgtcgcttccccacgtttcgagcacctcctcccttccctcgctcgcattccgagttccagccagccaaccaaccaaccaccggctccgtctcccgaagctccgccctccgcccctccgagagcagagctgcagagaagagaaaaagaaaaaaaataatccgacggaagggacaggggcgcggcgagggcggggacggggaggggccccacggcgcgggcgcgggggcggcaggggcgccaagcgcatggcgtcgtcgagggtgatgccgtcgtcctcgccgtcgcacacggcgtcggatctcgcgcgcttcgcgcaggccgccagcaggcccggcggcggcgggggcagcgggctgggctccatgaacgtagaggagctcctccgaggaatctacggcgacatgcccaccccagcaacgcccgcgccggccgccggccgcccgatgccgcaggctccgccgccggcgccggggatcgccgtgcggaagacggcggagcaggtgtggaaggagatcacgacgaggggtggcagtgcggggacagcggctcccgtgccgcaggccgtcgtccccgctggcgcgggaggcggcgccggcgccggcgtcccggagatgacgctggaggacttcctggcgagggagggcgcggtcaaggaggacgaggttaggatttcgggcccctcggcgcaggccgaggggcaggtggccatggggttcctgggcggagcagagggcgtgggtgtggctggggctggcggcggaggcgggaggggaaggaagcggcagttgatggatccagtggatcgcgcggcgatgcagcgacagaaacgaatgataaaaaaccgcgagtctgctgccaggtcacgcgagaggaagcaggcttatatcgctgagctagaatctctagtcacgcagctcgaggaggagaatgccgagctgttgagagaacaggaggagcggcaccagaagcggcttaaagagcttttggaacgagtgacgccagtcgttgtgagaaaaaaaccgtcacaagatcttagaagaacaaactcgatgcagtggtagccttgagccaagctcagctgccaccccgcttacagttatagcatagcgtttgatcctgtatgtcaattttctattctatctgcggcaacttagttgtagcaccttagtaaatagcatgaacagttagccgacacaaagcttaaatgaaatcatggcatgtactagtagtgttaaaaaaaaaaaaaaaaaaaa

SEQ ID NO: 5424 - protein, 271 aa, Panicum virgatum
  misc_feature: Ceres CLONE 1820459
  misc_feature: Great-hit functional homolog of the protein sequence given in SEQ ID NO 9409
  misc_feature (5)..(56): Pfam Name: bZIP_2 Pfam Description: Basic region leucine zipper
  misc_feature (1)..(62): Pfam Name: bZIP_1 Pfam Description: bZIP transcription factor
  misc_feature: Useful for making plants with altered Lignin content
  misc_feature: Useful for making plants with modulated nitrogen use efficiency
MASSRVMPSSSPSHTASDLARFAQAASRPGGGGGSGLGSMNVEELLRGIYGDMPTPATPAPAAGRPMPQAPPPAPGIAVRKTAEQVWKEITTRGGSAGTAAPVPQAVVPAGAGGGAGAGVPEMTLEDFLAREGAVKEDEVRISGPSAQAEGQVAMGFLGGAEGVGVAGAGGGGGRGRKRQLMDPVDRAAMQRQKRMIKNRESAARSRERKQAYIAELESLVTQLEEENAELLREQEERHQKRLKELLERVTPVVVRKKPSQDLRRTNSMQW

SEQ ID NO: 5425 - DNA, 1434 bp, Panicum virgatum
  misc_feature: Ceres CLONE 1820471
  misc_feature: Encodes the peptide sequence at SEQ ID NO. 5426
attcgaacgaggcatccgaggtggccaagcgcaggcgggcaccatgatggcggcggcggcgctgaggccgcacaaggcgccgccggcgcgcgtgcccacgcggtgggtggccgcgctctgcgccgcctgcttcctcctcggcgtctgcgtcgtcaacaggtactggccagtccctgagcatcccggttgcccagacatggcaagctccgaccactccagggccgcgctgaaccaagtgtcacagactcgcgaagtcatcatggctttggataagacgatatcggacattgagatgcgcctggctgctgctagagctgcccaggcgatgagccagggcatgtcaccgagtgattcggagggcgaccagggaagcatgcggcataggatgtcttttgttatgggtgttttcaccacttttgctaaccgcaagcggagagactcgataaggcagacatggatgccacaaggtgatcagctacgaagactggaagagaagggtgctgttatccgttttgtcattggacgcagtgaaaatccaaatcctgacaatgacttggaccgtgcaattgatgcagaagataaagaatacaatgatattttgagacttaatcatgtggaaggctatggagggctacctatgaagattcagatgttcctttcaactgctcttaccacgtgggatgctgatttctatgtaaaagttgatgataatgttcatgtcaacattggtatcaccagattgattttggcacgacacaggatgaaacctcgggtgtacattggctgcatgaaatccggacctgttgttgcgaaaaatgactccaagtattatgagccagatcattggaagtttgggactgagggtaacaactattttaggcatgcaacaaggcagctttatgctgttaccagggatttagctacttacatatcagcaaaccggcatatcttgcacaagtattcaaatgaagatgtatcatttggctcttggttgattgggttggaagtcgagcatgttgatgagagaagcctttgctgtggtactcccccagactgcgaatggaaagcgcaggccggaaacccatgcgcggcgtccttcgactggaactgcacaggcatctgcaacccggtggagaggatggcagaggtgcatcggcgatgctgggaaggccgtggagccgaagggcacgcacagttttgacagccaggggacatcgttgtaccatttcttctgtagggctctgtaattagtcaagaaacattcttggtatgcaatggtccggtttttcagatgtgcagcaatgccatcttttcctggtcacagcatgcggagaatgggagagggtgaaagatgaggacgacgaacctgcaattgaccttaactgacgaaacctcagtgtatgcttgtctagataaaaaaaaaaaaaaaaaaaa

SEQ ID NO: 5426 - protein, 385 aa, Panicum virgatum
  misc_feature: Ceres CLONE 1820471
  misc_feature (1)..(201): Pfam Name: Galactosyl_T Pfam Description: Galactosyltransferase
MMAAAALRPHKAPPARVPTRWVAALCAACFLLGVCVVNRYWPVPEHPGCPDMASSDHSRAALNQVSQTREVIMALDKTISDIEMRLAAARAAQAMSQGMSPSDSEGDQGSMRHRMSFVMGVFTTFANRKRRDSIRQTWMPQGDQLRRLEEKGAVIRFVIGRSENPNPDNDLDRAIDAEDKEYNDILRLNHVEGYGGLPMKIQMFLSTALTTWDADFYVKVDDNVHVNIGITRLILARHRMKPRVYIGCMKSGPVVAKNDSKYYEPDHWKFGTEGNNYFRHATRQLYAVTRDLATYISANRHILHKYSNEDVSFGSWLIGLEVEHVDERSLCCGTPPDCEWKAQAGNPCAASFDWNCTGICNPVERMAEVHRRCWEGRGAEGHAQF

SEQ ID NO: 5427 - DNA, 1151 bp, Panicum virgatum
  misc_feature: Ceres CLONE 1820481
  misc_feature: Encodes the peptide sequence at SEQ ID NO. 5428
actcatcaggcagggcagggcgctgcggcacaccctctcgctcgcctctcccggggagcctctcgcctctcccagccccgagctcacccctgcattcctcgccacaccgacgcaggcgccaaaaataaacgccacgccgcggccactacgtggcgagggggctccgcgggtcgccccacctcctctagctagctatagccatagcctcccccgcgacgtcgatggaggttgccgaggcggccgcgccggcgcccgacgagggcgcgctggacgagcgcggcgcggcgctgcatctccccaggctgctggccggcgtcgtctccggcgccctcaccggcatcttcgctctcgctggagccttgaccggagccgtcaccggcgccgtcgcggggagagcttcggacagcggcgtcctccggggagccgggatgggggcgttcgccggagctgtcctctccatcgaggttcttgaggcttcgcgagcttactggtgctccgaccggctgggctcgcacggtgcatcctccatggctgatttcattgagcagctcattcaggcccggtttgtgcaagagcaattaacatcttcaagatatacatcatctcgctggcaggtcagcatatcagattttggtcatgatgacctgtatgacatctttggagacatttcatctaaagggctctcactagagtcattgaagaaactaccacattatgtggtcactgaccaaatgcgggactccttcggggaaatcttgtcttgccctatctgcctacaggaccttgtagccggtgagacagcgaggaggttgcccacttgctctcacactttccaccagccttgcgtggacaaatggctcatcgatcatggctcatgccccgtgtgcaggcaagagatgtaagataggtaacctgcttagatgaaggaattagctgggtgaactgatgaaatgaaatgttacttcatatagagataatcctgcatacggtgatgtaaattactagtagaattctgcctgttttactaccagtgaaagcttccatgtacatctgacagtctgactctgtttccatgtgaaatgaaataagatcgggggtcaaccaactgccgaaaggccagctggaaccgtttagtacccgccattccacag

SEQ ID NO: 5428 - protein, 226 aa, Panicum virgatum
  misc_feature: Ceres CLONE 1820481
  misc_feature: Great-hit functional homolog of the protein sequence given in SEQ ID NO 9503
  misc_feature (1)..(42): Pfam Name: zf-C3HC4 Pfam Description: Zinc finger, C3HC4 type (RING finger)
  misc_feature: Useful for making plants with altered alkaloid content
MEVAEAAAPAPDEGALDERGAALHLPRLLAGVVSGALTGIFALAGALTGAVTGAVAGRASDSGVLRGAGMGAFAGAVLSIEVLEASRAYWCSDRLGSHGASSMADFIEQLIQARFVQEQLTSSRYTSSRWQVSISDFGHDDLYDIFGDISSKGLSLESLKKLPHYVVTDQMRDSFGEILSCPICLQDLVAGETARRLPTCSHTFHQPCVDKWLIDHGSCPVCRQEM

SEQ ID NO: 5429 - DNA, 1151 bp, Panicum virgatum
  misc_feature: Ceres CLONE 1820508
  misc_feature: Encodes the peptide sequence at SEQ ID NO. 5430
acggcaaaatcgagctggcactaaagcagacacgagcacaagtgacaggcccaatttgccagttgcctgcgtgacaccgcgagggggttcaagccaagccagcaaccaggtagccatggcactcgcaggcgctgggaacacgtcgccgctcccgctcgccggccgcgtcgcgctcgtcaccggcggctcccgcgggatcggccgcgaggtgtcctcccagctcgccgcgctcggcgcgcgcgtcgtgatcaactacgcgtccaactccgcgagggccgacgagctcgtcgcggagctcgcctcccgcggccacggcgccgtggccgtccgcgccgacgtgtcggacccggacgccgtgcgcgtgctcttcgaccgcgccgaggaggcgttcgggtccccgccgcacatcgtggtggcctgcgcgggcctcctcaacgccaagtacccggcgctcgcggacaccgccgtcgaggacttcgacgccatgttcgcggtgaacgtgcgcgggacgttcctcgtctgccgcgaggcagcgagccgcatccccgccaacagcggcggccgcatcgtcacgttctcgtcgtccatcgtgggcacgctcctgccgggctacgcggcgtacacggcgaccaacgccgccgtggaggccatgacgaggatcctggccaaggaggtggcggccaagggggtcaccgcgaacgtggtcgcgccgggccccgtgcgcaccgagctattcctggccgggaaggacgaggcgttcctgcggcgggtggagcagcactccatggggcgcatcgccgagaccacggacgtggcgccggtggtggagttcctggcgagcgacgcagcggcgtgggtgaacggccaggtcatcagggtcaatggcggcttcgtctaagcgagggaggttttcaaattccattaagaggtgacacactgacacctaccgtgtgtcaagagcagtgtaataagttgatttttgttccacttttttaatactatgtaactccatctaaccctttgtttagatgccttcaaaattccaaaactttacaagattctccatcacatcgaatctttaaacgcatgtatgaagtattaaatgtagctaaataaaataactaattacacaaaaaaaaaaaaaaaaaaaa

SEQ ID NO: 5430 - protein, 260 aa, Panicum virgatum
  misc_feature: Ceres CLONE 1820508
  misc_feature (1)..(176): Pfam Name: adh_short Pfam Description: short chain dehydrogenase
MALAGAGNTSPLPLAGRVALVTGGSRGIGREVSSQLAALGARVVINYASNSARADELVAELASRGHGAVAVRADVSDPDAVRVLFDRAEEAFGSPPHIVVACAGLLNAKYPALADTAVEDFDAMFAVNVRGTFLVCREAASRIPANSGGRIVTFSSSIVGTLLPGYAAYTATNAAVEAMTRILAKEVAAKGVTANVVAPGPVRTELFLAGKDEAFLRRVEQHSMGRIAETTDVAPVVEFLASDAAAWVNGQVIRVNGGFV

SEQ ID NO: 5431 - DNA, 1535 bp, Panicum virgatum
  misc_feature: Ceres CLONE 1820559
  misc_feature: Encodes the peptide sequence at SEQ ID NO. 5432
gagcaccacacacggtcctactaccacggtcacacggctgcataattgtgttgtgcccgctcgccggcccccggggacgtgacacatcgcgcgcacgaagcccgcccgcctgcctgccgcttttggctccgcccgccgtgccgcccgtgaggccggcagctttgcatgaggaggcggaggatgggggcactgcacgtcgtcggcgagcctagggtcagcttccagcaccagcagcagcagcccgccgccgccgccgccggcagcaagagcggcggccacggccccgtcgtcgaagagatccacggcctcttacgcgtctacaaggacggccacgtcgagcggcccccggcgatccccgacgtgccctgcacgtggggcgccacggcccccggcgcgccgggcggcgtcgcggcgagggacgtggtggtcgaccgcgccacgggggtgtgggcgcggctctacgcgccggtggcggcaggcgccggggccggtctccccgtcgtggtgtacttccacggcggcgggttctgcgtcggctccgcggcctggagctgctaccacgagttcctcgtgcagctcgccgcgcgcgcgggctgcgccgtcatgtccgtggactaccgcctcgcgcccgagcaccgcctgcccgccgcgttcgacgacgggctcgaggccctgcgctggctgtggcaccaggcggccttgcccaccggcaccggccgcgccaccgcggccgccgacgaggtctcctggtggcgcgcccgctgcggcttcgaccgcgtgttcctcatgggggacagcgcgggcgccaacatcgccttccacgtcgccgcgcggctgggccagggccacctcggcgcgctgtccccgctcgccgtcaggggcgccgtcctggtccagcccttcttcggcggcgaggcccgcaccgcgtcggagaggaccatgccccagccgccgcgctccgcgctgacgctcccaacctccgactgctactggcggctggcgctgccggccggcgccgggcgcgaccacccctggtgcaacccgctgtcccgcgccgcgccgcgcctggaggccctcccgctgccgcccctcctggtgtgcgtctcggaggcggacgtcctgcgcgaccgcaacctggagctgtgccgggccctgcgcagggccggcaagggcgtggagcaggccgtgtacggcggcgttgggcacgcgttccaggtgctgcacaactgccacctgtcccagccgcggacgcaggagatgctcgcgcacatcaaggccttcgtcagcgccaggtagccgccgccgccgtcgctgacactgtctctctcgcccgccgtgcttgttaaaccatccgccttagcccaatcgaagagtagatgccgtgtaagcaacccagcttgtgaactcacaaactttgaactacgtgtactccacctagctaaaagcgtccaatgcccaactcggattgttgcggtgtcggaaagcaaaagccttggcagaaaacaacaccacacacaaaaaaaaaaaaaaaaaaa

SEQ ID NO: 5432 - protein, 376 aa, Panicum virgatum
  misc_feature: Ceres CLONE 1820559
  misc_feature (1)..(225): Pfam Name: Abhydrolase_3 Pfam Description: alpha/beta hydrolase fold
MRRRRMGALHVVGEPRVSFQHQQQQPAAAAAGSKSGGHGPVVEEIHGLLRVYKDGHVERPPAIPDVPCTWGATAPGAPGGVAARDVVVDRATGVWARLYAPVAAGAGAGLPVVVYFHGGGFCVGSAAWSCYHEFLVQLAARAGCAVMSVDYRLAPEHRLPAAFDDGLEALRWLWHQAALPTGTGRATAAADEVSWWRARCGFDRVFLMGDSAGANIAFHVAARLGQGHLGALSPLAVRGAVLVQPFFGGEARTASERTMPQPPRSALTLPTSDCYWRLALPAGAGRDHPWCNPLSRAAPRLEALPLPPLLVCVSEADVLRDRNLELCRALRRAGKGVEQAVYGGVGHAFQVLHNCHLSQPRTQEMLAHIKAFVSAR

SEQ ID NO: 5433 - DNA, 1672 bp, Panicum virgatum
  misc_feature: Ceres CLONE 1820627
  misc_feature: Encodes the peptide sequence at SEQ ID NO. 5434
gggctctcggctctggcctccctcgcccgcccgctccccccacccatccgtctgcctgcacctgcgcgtgccgagccctcccctcccctccccccgcgcccgcccgcccgcccgctgccttccgctctccgcttcctcccgccggcccgcgccccagatctgcggcggcgccgggcgcccggccgacgccgcgcgtgccgtgggggcggcggatcctgctcggctgctgctgatgagcgcctaggcggccgccgcacgaccgcgcgcgccccgctctcgagaaaatggcgatgatggtggatccccccaatggcacgggaaaccaagggaagcattactacaccatgtggcaaaccctatttgagattgacaccaagtacgtgccaatcaagcccataggcagaggagcttatggaatagtctgctcgtctataaatcgcgagaccaatgagaaagttgcgataaaaaagataaataatgtctttgacaatcgtgtggatgcgctaaggacactgcgggagctgatactccttcggcacttgaggcacgagaatgttattgctctgaaggatataatgatgccagtgcatagaaggagcttcaaggatgtgtacttggtttctgagctcatggacactgatctgcatcaaataattaagtcatctcaaccactttccaatgaccactgccagtatttcctttttcagttgctccgaggcctgaaataccttcattcagctgggatactccacagagacctgaagccagggaacctcctagttaatgcaaactgtgatctgaagatatgtgattttggacttgcccgcaccaacaacactaagggtcaatttatgacagaatatgtcgtcacccgttggtacagagcacctgagctgctgctctgctgtgacaactacggaacatcaatagatgtctggtccgtcggatgcatatttgcagagctacttggtcgcaaaccaatttttccaggaactgagtgcctcaatcagcttaagctcatagtcaatgttcttggcaccatgagtgaggctgaccttgagttcattgacaacccgaaggcccgcaagtacatcaagtcccttccatacaccccaggcattcccctgactagcatgtacccgcaagcacatccgcttgccatcgatctgttgcagaagatgctagtctttgatccctccaaaagaatcagtgtcaccgaggctctggagcacccttacatgtctccactgtatgatccgagcgcaaaccctcctgctcaagtgcccatcgatattgacatagatgaaaatcttggcgtagacatgatccgggaaatgatgtggcaggagatgatccactaccaccccgaggttgtcacagggttgagcatgtgacaggcagcaatgaacatgtggcagagatctgctatattaggatagtcacatgttaaccttttgtatgagcttactgcaattacagcacctatcaagttatcactatatgcatcagactgctgtcaggtgacctcttgtgtaaatatgcgctcaataagatgtgtggagttttcttgtttctgtagtacatggactacactgctgtatgagtatgtctgtatgtgaagcggaacttggtatttaagactttgtaattttagactctgatctgctgtatg

SEQ ID NO: 5434 - protein, 369 aa, Panicum virgatum
  misc_feature: Ceres CLONE 1820627
  misc_feature (1)..(368): SWISSPROT Homolog: EC 2.7.11.24 Mitogen-activated protein kinase 3
  misc_feature (1)..(369): SWISSPROT Homolog: EC 2.7.11.24 Mitogen-activated protein kinase 4
MAMMVDPPNGTGNQGKHYYTMWQTLFEIDTKYVPIKPIGRGAYGIVCSSINRETNEKVAIKKINNVFDNRVDALRTLRELILLRHLRHENVIALKDIMMPVHRRSFKDVYLVSELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADLEFIDNPKARKYIKSLPYTPGIPLTSMYPQAHPLAIDLLQKMLVFDPSKRISVTEALEHPYMSPLYDPSANPPAQVPIDIDIDENLGVDMIREMMWQEMIHYHPEVVTGLSM

SEQ ID NO: 5435 - DNA, 1534 bp, Panicum virgatum
  misc_feature: Ceres CLONE 1820640
  misc_feature: Encodes the peptide sequence at SEQ ID NO. 5436
gtgggagggagaggagagggagagcgggcaaggcgggacaggcagcgaccggagacacagcccatccatcccttccctctctcctccctcttgcttgccatccacaccacaccaaagccaagaacccaactcatcgaaggcagagaccacaggcagcagggaaaaggcgacgaggggggaggagaaatcatggagccgatttgctgtggagattcggccgcgtgatccggtcggtcggatcttgctttcctggggggcgacggtgccatggtggtcgcctcctatatcctcctccccctccgcgctgcttcccccgagatgccgcattagccaccaacgcctcccagcgaagagacttcattctttcatcggtgtctagttcctgccgtgcgttccgcggccatgacggtggccgatgccgagttgcggttccacgtcctcgcggtggacgacagcctcatcgacaggaagctcatcgagatgctgctcaagaactcgtcctaccaagtgaccaccgtcgattccgggagcaaggccttggagctgctgggattgagggacgaggctgccgagtcatcatcgccttcctcctcccctgaccaccaggagattgatgtgaacctgatcatcactgactactgcatgccgggcatgacagggtatgatctgctgaggagggtgaagggatcctcctcgttgaaggacattcctgtggtgatcatgtcgtctgagaacgtgcctgcccggatcaacaggtgcttggaagatggcgcagaggagttcttcctgaaacccgtcaagctcgccgacatgaagaagctcaagtctcatctcctgaagaagaagcagcccaagaagtgtcagccgcagatacagacagagcccgaggacgaggagcggctggaggcaccgccacagccggcgcacaagccggaggcgcccgtggcacaagtgaccgctgacgcaacaacggcagccatcagcgactgcagcggcagcaacaagaggaaggcggcggccatggagcagcaggaggggctgacgtcgccggagagcaccaagccaaggatgtccaatagcagcctggcagtggagacctgaaaaggcaaccagaaacccctaccctactaagaaatttcttcttttgctgtttttttttgtggtggctaatcatgggatggatgagtcattagctccttggggggagggtggttttagctcgaagtgaaaaacaattacggcatacttatatagtagctgcttcggcctgcaaattttgttgtgctcaggaacaccctttgtgtgttcgttagaaagacgaaggggatgggggaaaaaggaagttgtagataaaggcagcgcctttgggttgctcttgtttaggctaattttaatttgatgatggcttattatgccactgactggctcaaaggctgtgtggcctgtgatgtgttttgcacaggtcgatggatcgagcaatcggttaatgtggctcatgtcttccttttactgacaaaaaaaaaaaaaaaaaaaa

SEQ ID NO: 5436 - protein, 232 aa, Panicum virgatum
  misc_feature: Ceres CLONE 1820640
  misc_feature: The sequence is a functional homolog of  SEQ ID NO 932 in the  10/666,642 US patent application
  misc_feature: Useful for making plants with modulated growth and phenotype characteristics
MTVADAELRFHVLAVDDSLIDRKLIEMLLKNSSYQVTTVDSGSKALELLGLRDEAAESSSPSSSPDHQEIDVNLIITDYCMPGMTGYDLLRRVKGSSSLKDIPVVIMSSENVPARINRCLEDGAEEFFLKPVKLADMKKLKSHLLKKKQPKKCQPQIQTEPEDEERLEAPPQPAHKPEAPVAQVTADATTAAISDCSGSNKRKAAAMEQQEGLTSPESTKPRMSNSSLAVET

SEQ ID NO: 5437 - DNA, 1341 bp, Panicum virgatum
  misc_feature: Ceres CLONE 1820645
  misc_feature: Encodes the peptide sequence at SEQ ID NO. 5438
acctcttcgttccctgcgcaccactcgagtcgagagccacctgatccttcgttccccgtcttcctctctcccggcacgttgctccttcgttaacgctcgagagcgggaggggttaggtgggcaagcggcggggatggggcgcgggccggtgcagctgcggcggatcgagaacaagattaaccgccaggtgaccttctccaagcgccggaacgggctgctgaagaaggcgcacgagatctccgtgctctgcgacgccgaggtcgcgcttatcgtcttctccaccaaggggaggctctacgagtactccagccatgaaagcatggaaggcatccttgagcgttaccaacgatactcgtttgaagaaagagcagtacttgatccaagtattgcagaccaggcaaactggggagatgaatatggcaggttaaaagccaaacttgatgcgctacagaagagtcagaggcaattgttaggagaacaactggattcactgaccattaaagaactccagcaactggagcaacaactggacagctctgtgaagcatataagatcaagaaagaatcagctcatgttttattcaatttctgagcttcagaaaaaggaggaatctcttacagatcaaaatggtgtcctgcaaaagctcatggaggcagagaaagagaaaaacaatgcattaatgaatgcacacctccgggagcagcaaaacggagcttcaacaagcttgccatcaccgccgctatcaacagttccggattccttgccaactctaaatattgggccgtgtcaacctagaggaggaacagtaggggagtctgaacctgaaccgtctcctgctcaagtaaacagcggcaagctgccaccatggatgctacgtagtgtcagtaacagatgagctgttcctgatacggttctgcggctgaactcaaaggcaacacaccgtcaccaacacccttcgatgacccaggcatccataccagcgtgatccatctcgatccagtgaataccagcatagtcactaataagaacaggtatcatcaaatgctttacagggttaataaagtctgaagctcctctgcaccatcatattgcgttttgttctcgcgtctactttctaccttttttattctccgatcgacaagctggtgtacatctaaaaaagaagcacggtgttagcatgtggttggaggtcctaccgctatgcttgtttcccctgcctgtgtatgctttaacggagatgtatgttgtcatgttttccgtgttttacactttaaacagaaggctcttctcccggtaagggtagaatcctggtcaaagtgccaaaaaaaaaaaaaaaaaaaa

SEQ ID NO: 5438 - protein, 253 aa, Panicum virgatum
  misc_feature: Ceres CLONE 1820645
  misc_feature: Great-hit functional homolog of the protein sequence given in SEQ ID NO 9300
  misc_feature: Great-hit functional homolog of the protein sequence given in SEQ ID NO 9694
  misc_feature: The sequence is a functional homolog of  SEQ ID NO 730 in the  10/666,642 US patent application
  misc_feature: Useful for making plants with altered alkaloid content
  misc_feature: Useful for making plants with modulated biomass
  misc_feature: Useful for making plants with modulated flowering time
  misc_feature: The plant flowers significantly earllier than wild-type.
  misc_feature: The rosette leaves do not appear in the normal fashion, i.e., their phyllotaxy may be abnormal or too many leaves may be emerging in comparison to the control.
  misc_feature: Useful for making plants with modulated growth and phenotype characteristics
MGRGPVQLRRIENKINRQVTFSKRRNGLLKKAHEISVLCDAEVALIVFSTKGRLYEYSSHESMEGILERYQRYSFEERAVLDPSIADQANWGDEYGRLKAKLDALQKSQRQLLGEQLDSLTIKELQQLEQQLDSSVKHIRSRKNQLMFYSISELQKKEESLTDQNGVLQKLMEAEKEKNNALMNAHLREQQNGASTSLPSPPLSTVPDSLPTLNIGPCQPRGGTVGESEPEPSPAQVNSGKLPPWMLRSVSNR

SEQ ID NO: 5439 - DNA, 1043 bp, Panicum virgatum
  misc_feature: Ceres CLONE 1820666
  misc_feature: Encodes the peptide sequence at SEQ ID NO. 5440
acacacgatctctctgtcccaaattaaaaaccccgcgagttgcctcttcttccattgcagctagcgatccatatgggggctgccaataagtggagcgacactgccatgctcgtcatcgacatgcagaaggagttcgtagacccggcaatgagcaacctggcgttcctggccggcggggaggccatcctcccggccgttacccaggccgtcgaacttgcgcgggagcgcggtatcttcgttgtctgggttgtgagagagcatgaccctgatggtagggacgttgagctctttcgccggcgcttctactccgggggaaagggccccgcgatgaaaggttcccaaggcgcagagatggctgatgggcttgtcatcaaagaagaggactacaagctggtgaaaacaaggttcagctctttctttgccacaaacctggattctgtcctcaaaacttcagggatcaagaacctggttgttgttggggttcaaacaccaaattgtgtccggcagactgtctttgatgctgtcgcacttgactatgagaaagttacggttattgtggatgcaacagctgctgctagcccagaaatccaaatggcaaacgtcagagacatgaagaacattggggtggagacaccaaccttggaagactggagtcgtcaggcttgattgtgcttcatgctcagcaccaacgagacatcgatcagactcgacgtgtggttcttcagaaaagaagaatatggttggttttacttcgatatgagtgtgtgtaattatattttactgtcatgtgccacatgttatatgcatgtgcagaaacttgtaataatccctcatgcacagagttcggatcagttcactgtaccatggtgatgctctgtctgaaacagagcaaatcaaatcgtgtgccgctaatcaaattgtagtagagtgcagatcctgatgcagattggagccgttattaagaagtgtgtttggcaaacaaaaaagataaataaaatgaaaaaccatatgtcgcctcaggaagtatggtaaatgttgttttc

SEQ ID NO: 5440 - protein, 197 aa, Panicum virgatum
  misc_feature: Ceres CLONE 1820666
  misc_feature (1)..(188): Pfam Name: Isochorismatase Pfam Description: Isochorismatase family
MGAANKWSDTAMLVIDMQKEFVDPAMSNLAFLAGGEAILPAVTQAVELARERGIFVVWVVREHDPDGRDVELFRRRFYSGGKGPAMKGSQGAEMADGLVIKEEDYKLVKTRFSSFFATNLDSVLKTSGIKNLVVVGVQTPNCVRQTVFDAVALDYEKVTVIVDATAAASPEIQMANVRDMKNIGVETPTLEDWSRQA

SEQ ID NO: 5441 - DNA, 1173 bp, Panicum virgatum
  misc_feature: Ceres CLONE 1820678
  misc_feature: Encodes the peptide sequence at SEQ ID NO. 5442
agccagtgtcgccgccgcacccacaccaccggtgctcgccccttctccaccgctcgagcgcgatggcgtcgacgagggatctagccatagcctctatctcagctgcggccggcgccgttgctgccgccgcagctctgcgcttcctgtcttgctgcaggacatcctccgtcaggccccagaacatgtccctcgccgccaacgggtccgcccccgagcgaccgctgggccagtcccccttcgatcccgccaagagggaagggtatatctcctgggacgactacttcatggcgatcgccttcctttcggctgagcggtccaaggatcctaacaggcaggttggagcatgcttggttagccaagagggaataatcctaggaattggctacaacggcttccctagaggttgttcggatgacaaacttccttgggcaaagaaatctgcaaatggagatccactagagacaaaatttccctatgttgttcatgctgaagttaatgcaattctaaatacaaaccatgcttcagcggctggacagaaattatatgtcaccatgttcccatgcaatgaatgcgccaagattatcattcagtcaggcgtatccgaggtcatctattttgtcgagaaaaggatcaacaattcagctcatgtttatgtcgcctctcacaagttgttatcgatggctggtgtcaaggtcaggaagcatcagccccagatgacgcaaataccgatcaagttccaggagccgtgaagctggtactcgtgaacgaataaatggtgcaagatctctgttgatcgtgtcacaggtgacaagtgaccctgccagcctcagcattctcagctggcatgcagggtcagaccacttccttgcccttcagggatgagctgttgtaacttgtaaaatcataagcttgaaatcgtaccggtaatgtataggcatttcaaatttcctttctgataccagacactcctgtcatgtcgtgtggccgttgtgttgccctattgtttgaaagaagatcctcttcatcaattctaggtgtcccacggcgacacatgacaagtcaccgcagatgtgtaggggtgcttttgctctgcagtttgcattgtaaaaaacacaaatttttaggacagaaatcatgattgtttgacttttttaaaaaaaaaaaaaaaaaaaa

SEQ ID NO: 5442 - protein, 228 aa, Panicum virgatum
  misc_feature: Ceres CLONE 1820678
  misc_feature (1)..(119): Pfam Name: dCMP_cyt_deam_1 Pfam Description: Cytidine and deoxycytidylate deaminase zinc- binding region
  misc_feature (63)..(225): SWISSPROT Homolog: EC 3.5.4.12 Deoxycytidylate deaminase
MASTRDLAIASISAAAGAVAAAAALRFLSCCRTSSVRPQNMSLAANGSAPERPLGQSPFDPAKREGYISWDDYFMAIAFLSAERSKDPNRQVGACLVSQEGIILGIGYNGFPRGCSDDKLPWAKKSANGDPLETKFPYVVHAEVNAILNTNHASAAGQKLYVTMFPCNECAKIIIQSGVSEVIYFVEKRINNSAHVYVASHKLLSMAGVKVRKHQPQMTQIPIKFQEP

SEQ ID NO: 5443 - DNA, 1216 bp, Panicum virgatum
  misc_feature: Ceres CLONE 1820682
  misc_feature: Encodes the peptide sequence at SEQ ID NO. 5444
cctggccacctttaacagccgggaagccgcgctcgcttgcttttgtccttgcgagctcgttcctgcccccgtcgtcgccttccttcctctcccccggctaacctgcccgtcctccgtgcgcgtccgtctccacagctcccgtgtcttggcggccggttagggtcggcctataagtacgggatccggctctgcccgtttccatcactaccccatctgccacctgctgatagcaatctctgctggtagctagcatcgtccagtgccgagttacgacgatcaaccggccatggcgaggatccacctctacgtcgccgcggcctgcgccgtcgtgctcgcgctcgccgccccgaccctcgccggcgaccccgacttgctccaggacgtctgcgtcgcggacctcgcgtccccgatcaagatcaatgggttcccgtgcaaggcgaatgtgacggcggacgacttcttcttcacggggctgaggaaccccggcaacaccaacaacccggcgggctccgtggtgacggcggccaacgtggagaagttccccggcgtcaacaccctgggcgtctccatcgcgcgcatcgactacgccccgggcggccagaacccgccgcacacgcacccgcgcgccaccgagatcatcttcgtcctcgagggcacgctcgaggtcggcttcatcaccaccgccaacaagctcttcaccaagatcgtcaacaagggggacgtcttcgtcttccccagggggctcgtccacttccagcagaacagggggcacggccccgccgccgtcgtcgccgccttcaacagccagctccagggcacgcaggccatcgccatgacgctcttcggcgccacgccgccggtgtcctccgacatcctggccaaggccttccggattgacaacggggaggtcgacgccatcaaggccaagttcgcgcccaagtagaggccttccacgactgtctgcacccgttgatttctgaataaatcgcgcatgctctgtgcaggatatctatagtgagtgctagtgattgcaacgacgtgcagttcaattagttcatctttcgtttgtattcctagctagttggtgtgtggcacaaataagatcagcagtttcatggtttctgttatagtaaattggtttttcaaccaaagtatgatcacaaatagtgcttaatttgcttgccaattcatcgagcaaaaaaaaaaaaaaaaaaaa

SEQ ID NO: 5444 - protein, 218 aa, Panicum virgatum
  misc_feature: Ceres CLONE 1820682
  misc_feature (24)..(217): SWISSPROT Homolog: EC 1.15.1.1 Nectarin-1 precursor
MARIHLYVAAACAVVLALAAPTLAGDPDLLQDVCVADLASPIKINGFPCKANVTADDFFFTGLRNPGNTNNPAGSVVTAANVEKFPGVNTLGVSIARIDYAPGGQNPPHTHPRATEIIFVLEGTLEVGFITTANKLFTKIVNKGDVFVFPRGLVHFQQNRGHGPAAVVAAFNSQLQGTQAIAMTLFGATPPVSSDILAKAFRIDNGEVDAIKAKFAPK

SEQ ID NO: 5445 - DNA, 1579 bp, Panicum virgatum
  misc_feature: Ceres CLONE 1820700
  misc_feature: Encodes the peptide sequence at SEQ ID NO. 5446
accgccaagcaatcgagaaagctcccccctcccccggcacgccggggagaagcaaagcaaagcgagccccgcctttgagagagatcgagtgataagtgcaagagcagaggcaccgcgcgcgcgcggcgatggagagggacgtcgtggtctccgacaccgcggccaccgggtcctcgtcttcgccgtccgccgcctccttcgccgctaccagggtcatctgccgcgtgtgccagaagcagttcgcgcagtacacctgcccccgctgcaactcccggtactgctcgctcccgtgctacaaggggcatagccttcaatgcactgaatccttcatgcgtgagaatgttatggatgagcttaagcagatgcaacctgaagatgaatcaaagaaaaagatgatagatatccttaagcggctccacttggaagaagagatggactcggatggtgaagatgagtcaatgttatcggaggagcttattcaaaaagtcatgtctggggaagaaataaagatcgaagacctctctgatgatgaagtcaaacgatttcgacgagctctggcctcaggtgaactcagcaagatgattgagccatggacaccatggtggaaaaagccatctgctagattgataacccttagtcctgatggaagccagcttatcagacaagtgagggaagaagacactgccacatcaggtccaatgactgaccaagagccagtcaccatcaatgaaatcccagaagggccagaatctcctctcccagcgctgaaacagctaacaagggcggagccatcgcctctgcttgccgttcacttggttgacattctgtacagttactgcttcacgcttcggctctacaacggtgattggcactctgatcctttgggtgcttccactgttgccctatctatgtctaaagtcatgggggaggatgctaagcctgagacagtacctgaagcactgacggcttgcatagaggagacatgctcacctgcttacaggcacacaggtggtttcaggtttgctatcgggcttctggatgatatcatctccattctgtccttgggacacaacgtgcttgtctgcgcgctaagtgacttccatcgactcattgaagctggtaagagcatgctcaaggtggagaaagtgggcaagacggagagcgcgcagagctcttcgaagcttcgtggtgcagctaggaagctattcttcatgacttgttgggtccatgagcagccggaagaggcttggccgcctttagctcgcattgtcgaagtacaaaaagcatctctcgaggagttggacactgggaatcggaagacggatataaagagcaagcaaatccaaggttcttatcgaggagctgtaagcgtgtggatttactgctagattgcaactctgtgtacccttcctatctcgcaggctgaatccatccaacgagttcaccttgtaatgcagtggtttgtgcatacactctaattttgttgaagaaatttgtatacatatctgaaatcctgtttaaagtgatcctaaccgatgcatcaagtttgcttttgttcgaaaaaaaaaaaaaaaaaaaa

SEQ ID NO: 5446 - protein, 419 aa, Panicum virgatum
  misc_feature: Ceres CLONE 1820700
  misc_feature (1)..(31): Pfam Name: zf-HIT Pfam Description: HIT zinc finger
MERDVVVSDTAATGSSSSPSAASFAATRVICRVCQKQFAQYTCPRCNSRYCSLPCYKGHSLQCTESFMRENVMDELKQMQPEDESKKKMIDILKRLHLEEEMDSDGEDESMLSEELIQKVMSGEEIKIEDLSDDEVKRFRRALASGELSKMIEPWTPWWKKPSARLITLSPDGSQLIRQVREEDTATSGPMTDQEPVTINEIPEGPESPLPALKQLTRAEPSPLLAVHLVDILYSYCFTLRLYNGDWHSDPLGASTVALSMSKVMGEDAKPETVPEALTACIEETCSPAYRHTGGFRFAIGLLDDIISILSLGHNVLVCALSDFHRLIEAGKSMLKVEKVGKTESAQSSSKLRGAARKLFFMTCWVHEQPEEAWPPLARIVEVQKASLEELDTGNRKTDIKSKQIQGSYRGAVSVWIYC

SEQ ID NO: 5447 - DNA, 1119 bp, Panicum virgatum
  misc_feature: Ceres CLONE 1820701
  misc_feature: Encodes the peptide sequence at SEQ ID NO. 5448
attgcatccaagcccgactaggccacgataagcaagatggcgacaaagacgcgcggcgccttcaaccacgtcgtcctgctcctcgcggcgacgtccctcctcgccaccgccgccagcaaggaccgctgccactccggcgacaaggccgcgctgctggccgtcaaggcggcgctcggcaacccctttccgtcctggacgcccgactccccgtgctgcgactggtacgacgtcgactgcgactactccaccggccgcgtcgtcggcctctccgtgttccaggacgccaacctcaccggcgccatccccgacgccgtcgccggcctcgcccacctccagagcctcatgtggcaccacctccccgcgctctccggccccatcccgccggccatcgccaagctctccaacctctcgcagctcatcatctcctggaccgccgtctccgggcccgtgccgtccttcctgggcgcgctcaccaagctcacgctgctcgacctctccttcaactccctcacgggcgccgtcccggcgtcgctcgccgccctccccaacctctccggcatcaacctcagccgcaaccgcctcaccggcgccatccctccgctgctcctcagcaagtcccccgaccaggcctacctcttgctgtcgcacaacaacatgtccggcgccatccccgccggcttcgccgccgtcaacttcgcgcacctcgacctgtcgcgcaacgccttcgcgggcgacgcgtcggggctcttcggccggggcaaggagcttcagtacctggacctgtcgcgcaacgccttcagcttcaacctctccggcgtggggctgccggagcagctctacttcgtggacgtgagccacaacgccatctccggcggcatcccggcggaggtggccaacctcaccaacctgcagttcttcaacgtcagctacaaccggctctgcggcgcggtgcccaccggcggccacatggagagatttgacctcttcagcttccagcataacaagtgcctctgtggaactccgcttgctaacccctgcaactgacgacagaccaacagatgaaataaaatcactgacaatatcataaattcagtgatacttatggattaaattttattt

SEQ ID NO: 5448 - protein, 335 aa, Panicum virgatum
  misc_feature: Ceres CLONE 1820701
  misc_feature: Great-hit functional homolog of the protein sequence given in SEQ ID NO 9264
  misc_feature: Useful for making plants with altered oil content
MATKTRGAFNHVVLLLAATSLLATAASKDRCHSGDKAALLAVKAALGNPFPSWTPDSPCCDWYDVDCDYSTGRVVGLSVFQDANLTGAIPDAVAGLAHLQSLMWHHLPALSGPIPPAIAKLSNLSQLIISWTAVSGPVPSFLGALTKLTLLDLSFNSLTGAVPASLAALPNLSGINLSRNRLTGAIPPLLLSKSPDQAYLLLSHNNMSGAIPAGFAAVNFAHLDLSRNAFAGDASGLFGRGKELQYLDLSRNAFSFNLSGVGLPEQLYFVDVSHNAISGGIPAEVANLTNLQFFNVSYNRLCGAVPTGGHMERFDLFSFQHNKCLCGTPLANPCN

SEQ ID NO: 5449 - DNA, 1701 bp, Panicum virgatum
  misc_feature: Ceres CLONE 1820723
  misc_feature: Encodes the peptide sequence at SEQ ID NO. 5450
aagctaagccaagccttatcgatcgttcgcctactagctagtgctgtagtgcatatattcttacgaggttggcaccaacccaggcccaaaaataccccaactgctacttcaggtcactccaaattaagaggctgcaaccaaggtcagatcagttcaccatgggcagcaacggcacgaccgccgccgcgcacgcaccggcgctggccccgccgccgtcgcaggggaggctgatcacggtgctgagcatcgacggcggcggcatccgcggcctcatcccggccaccatcatcgcctgcctcgaggccaagctccaggagctggacgggccagaggccaggatcgccgactacttcgacgtgatcgccggaacgagcaccggcgcgctgatcatggcgatgctggcggcgccggacgagaagaagcggccgctcttcgccgccagggacatcagccagttctacctcgagaacggtccaaagatcttcccacagagaaagaggatggggttcctgaagccggtggcgaacctggtgagcctgatgaggggccccaagtacgacggcgccttcctgcacgacaagatcaagagcctgacgcacgacgtgaggatcgcggacacggtgaccaacgtcgtggtgccggcgttcgacgtcaagtgcctgcagccggtcatcttctcgacgtacgaggcggcgcacgagcccctcaagaacgcgcacctctccgacatctgcatcagcacggcggcggcgccgacctacttcccggcgcacttcttccggaccgagggcgccgccgccgacggggagaagcccggccaccgggagttccacctcgtcgacgggggcgtcgcggccaacaaccccaccatggtcgccatgtccatgctcaccaaggaggtggtccgccacaacccggacttcaggcccgtggagtacggcaacttcctcatcgtctccatcggcaccgggtcgcccaagcaggcagagaagtacaccgcgcccaagtgcgccaagtggggcctgctccggtggctctacgacgggggcttcaccccgctcatcgacatcttctcccatgccagcgccgacatggtcgacatccacgcccaagtgctcttcgaggcccttcggtgcgagaagaactacctccgcatccaggatgattcgctagtaggacacacgtcgtcagtggacatcgcgacgaaggagaacatggaggccttgatcgggatcggaagggagctcctcaagaagccggtggcgagggtgaacatcgacacgggggtttacgagcctgtctccggcgggggcaccaacgagcaggctctcgcgcgcttcgctaggaagctctccgacgagctcaagctacgcaagaaaaacctcaactcctactagcttagcttgattgcttgccggccagagtgggcctcgaaattaaagcggcaaaatatgtgaatatcaataaacaattttgcttgctttttaatcagaaacctgacatgacaatgagtatgtggagtgtaattttacctgtgcttgttattgggctgaaaaatgcttttgtgtcatgtttcgatcttaaaagattgtgcccgtgccatgcaacctcggtctcagctacaggctcagccatgagtggaaggagtgtacatactgtgccttgttcacggtagagtcattgtggattcttgttcgtttc

SEQ ID NO: 5450 - protein, 412 aa, Panicum virgatum
  misc_feature: Ceres CLONE 1820723
  misc_feature (1)..(209): Pfam Name: Patatin Pfam Description: Patatin-like phospholipase
MGSNGTTAAAHAPALAPPPSQGRLITVLSIDGGGIRGLIPATIIACLEAKLQELDGPEARIADYFDVIAGTSTGALIMAMLAAPDEKKRPLFAARDISQFYLENGPKIFPQRKRMGFLKPVANLVSLMRGPKYDGAFLHDKIKSLTHDVRIADTVTNVVVPAFDVKCLQPVIFSTYEAAHEPLKNAHLSDICISTAAAPTYFPAHFFRTEGAAADGEKPGHREFHLVDGGVAANNPTMVAMSMLTKEVVRHNPDFRPVEYGNFLIVSIGTGSPKQAEKYTAPKCAKWGLLRWLYDGGFTPLIDIFSHASADMVDIHAQVLFEALRCEKNYLRIQDDSLVGHTSSVDIATKENMEALIGIGRELLKKPVARVNIDTGVYEPVSGGGTNEQALARFARKLSDELKLRKKNLNSY

SEQ ID NO: 5451 - DNA, 908 bp, Panicum virgatum
  misc_feature: Ceres CLONE 1820757
  misc_feature: Encodes the peptide sequence at SEQ ID NO. 5452
atcctcgccaccaaccccccgaaacgcggctccagatccggcggccggtggcgtcctccccgcgcgaccacccatcacaaccaacggcgctgatctcctccgccatctccgtccatctccgtttccatcgccaggagggttccggcatgtcggaagccgagagcgcaccggagaccggcggcggcagctacggagggaaggagcaggatcggtacctgccgatcgccaacattggccgcatcatgcgccgcgcggtgccggacaacggcaagatcgccaaggacgccaaggagtctgtccaggagtgcgtctccgagttcatcagcttcatcaccagcgaagcgagtgacaagtgcatgaaggagaagcgcaagaccatcaatggcgatgacctgatctggtccctggggacgctcggcttcgaggaatacgtcgagcccctcaagcactacctcaagctctaccgggagacggagggtgacacaaagggttcgaaatcttctgatcatacaggaaagaaagagattgtactcattggtgaacctggatcatcgttggacggcgtgtaggatggagggtgatagttagtgactcgtcaccggagagttatttggtcgagcatgtgtcatagttgctagatggcacccaggatggtgctcaccatcgctgactgccctctgtgaggatggcgcttcgaagcctgttatttttggatgtccggtccttatagaattattatctttgttagttgggatgtacaaactttccttcctagatcatagactcatagttcagtcgtagcgtgctctatgaaatgatgaatctgtccagtgatgttgaccgtttgacactgcactgcatgaacgaaatcggagataacttgcagataaaaaaaaaaaaaaaaaaaa

SEQ ID NO: 5452 - protein, 140 aa, Panicum virgatum
  misc_feature: Ceres CLONE 1820757
  misc_feature (1)..(66): Pfam Name: CBFD_NFYB_HMF Pfam Description: Histone-like transcription factor (CBF/ NF-Y) and archaeal histone
  misc_feature: The sequence is a functional homolog of  SEQ ID NO 1165 in the  10/412,699 US patent application
  misc_feature: The sequence is a functional homolog of  SEQ ID NO 2139 in the  10/666,642 US patent application
  misc_feature: The sequence is a functional homolog of  SEQ ID NO 30 in the  10/675,852 US patent application
  misc_feature: The sequence is a functional homolog of  SEQ ID NO 334 in the  11/435,388 US patent application
  misc_feature: The sequence is a functional homolog of  SEQ ID NO 336 in the  10/714,887 US patent application
  misc_feature: The sequence is a functional homolog of  SEQ ID NO 781 in the  10/374,780 US patent application
  misc_feature: The sequence is a functional homolog of  SEQ ID NO 793 in the  10/374,780 US patent application
  misc_feature: The sequence is a functional homolog of  SEQ ID NO 808 in the  10/666,642 US patent application
  misc_feature: The sequence is a functional homolog of  SEQ ID NO 90 in the  10/675,852 US patent application
  misc_feature: Useful for making plants with modulated growth and phenotype characteristics
MSEAESAPETGGGSYGGKEQDRYLPIANIGRIMRRAVPDNGKIAKDAKESVQECVSEFISFITSEASDKCMKEKRKTINGDDLIWSLGTLGFEEYVEPLKHYLKLYRETEGDTKGSKSSDHTGKKEIVLIGEPGSSLDGV

SEQ ID NO: 5453 - DNA, 1845 bp, Panicum virgatum
  misc_feature: Ceres CLONE 1820764
  misc_feature: Encodes the peptide sequence at SEQ ID NO. 5454
ggcctcctccaactgccatgtctcgccgcgccgcaatggcatcatccgccgccacccgcgcgcgcctttcgccgccggcgccagccgttcgccccccgcggaagcggcgccggtcgccgcccgcccaaggaagcatatcttcgtggcgcgcatgcgcatccaccgagaacgccgcgccccgcgaccaacgcagccgctggcaagccccggagcgtgcccctggtcgcgtctggcggcagttccgcccgccgcagcctgccttgccctcctcgcggcggtgggtttcatcggaagacgcctctacctcctcttccggagacacctgcacaatcatgtcatacaacatcttggctgattacaatgcaaggaaccatcctgacctttattgggatgtcccttgggatgcaatgaggtgggattcaaggaggcggcttattatccgtgaaattaggcactgggaccctgacctagtgtgtctccaagaggtggataggtttcaggacattgctgcaggaatgaggagcagtgggtatgaaggtatatttcagaggcgaactggagatactagagatggatgtgccatgttttggaagtcaaaacggttacatctgcttgaggaagatagtattgactttagtgaattcgatctccgaaataatgttgctcaaatatgtgtttttgagcttaatggagcacacaaattagttcttgggaatattcatgttttgtttaatccaaagaggggtgatgtaaaattaggccagattcgattgctacttgagaaggcaaatgctcttgctgaaaaatgggataaaattcctattgtgcttgctggtgatttcaacagcacacctgatagtgctatctacaagttcttgacgacaatgaagctgaacatttctttgcatgatagaagacagttatctggacttgatagctctgaatttgatctatacgagcttttcagttcactgaaataccaatggagtgatgaagaagtgagaaatgcgactgggtattcaaatgttatggtcgctgaacatccattgaagctcagtagttcatatgctaatttaaagggaaattcaaacaataggggtcttcatggtgaacctctagcaacctcctttcacaagaaatttcttggcacggtggattacctgtggtacactcatggacttgaatgctccaaggttttggacactttccctataggtgttttgaggagaacaaggggtcttccaaccagggaaattggcagtgatcatttgcccattatggctgaattcgccttcacagaattacttgaagatgattttgagggacaagatgagtctgagcaagatgatgagtctgagcaagaagtgaccacagcgcaacacatatatctctcctcagatggcgagtcccattgaagtgaccaagtgatccagttggtcaaataggtctaaggtacattattggagaactgggagcatggtgcgcgcgatactacactgcgtctgccaaggtccttaaaacagaagttctccatcagtatggaaggaatttcgccggtacctttgccgatgtagtttctgtaggggaggcaaattctgctccccattgtcccaagcggagcagaatcaggtatgtgacgagaagaaccatatagtcagcaattcagctgctggatttattctgcatcagatgtgtcaacgatagtgttgaccagtatgatccaacacgataattctatgcatgctgtaccgatagaggttaactggcaccttcatttgtaatcgtacacctctactgacagtacatgttgtacttctggttctgcaaaaaaaaaaaaaaaaaaaa

SEQ ID NO: 5454 - protein, 465 aa, Panicum virgatum
  misc_feature: Ceres CLONE 1820764
  misc_feature (2)..(331): Pfam Name: Exo_endo_phos Pfam Description: Endonuclease/Exonuclease/phosphatase family
MSRRAAMASSAATRARLSPPAPAVRPPRKRRRSPPAQGSISSWRACASTENAAPRDQRSRWQAPERAPGRVWRQFRPPQPALPSSRRWVSSEDASTSSSGDTCTIMSYNILADYNARNHPDLYWDVPWDAMRWDSRRRLIIREIRHWDPDLVCLQEVDRFQDIAAGMRSSGYEGIFQRRTGDTRDGCAMFWKSKRLHLLEEDSIDFSEFDLRNNVAQICVFELNGAHKLVLGNIHVLFNPKRGDVKLGQIRLLLEKANALAEKWDKIPIVLAGDFNSTPDSAIYKFLTTMKLNISLHDRRQLSGLDSSEFDLYELFSSLKYQWSDEEVRNATGYSNVMVAEHPLKLSSSYANLKGNSNNRGLHGEPLATSFHKKFLGTVDYLWYTHGLECSKVLDTFPIGVLRRTRGLPTREIGSDHLPIMAEFAFTELLEDDFEGQDESEQDDESEQEVTTAQHIYLSSDGESH

SEQ ID NO: 5455 - DNA, 1201 bp, Panicum virgatum
  misc_feature: Ceres CLONE 1820804
  misc_feature: Encodes the peptide sequence at SEQ ID NO. 5456
accccgcagcttcaaacccacccacccatccacccgcctgtcgatcgatccatccagccgcccgctcgagatcgcggccgctgtgccagtgccagtgcacacgggcgctgttgcgacttgccctcgcggccgacaatccctcgatcacctcaacgtcccctgctgcgcactctgcccgcgcgctacgatccaatcctcatcccgatatataccacgccggtcgccaccgcgggcaggagctaagcccccggcccggccgcgctgtagtattgcagtagcctgtagtggtggtagcttgtagccgtgctgcgtctgcgcaggatgctgcaggagctggcgccgtgcgcgtgcggggggttctacgccgggggctgcggcggccggtgcgcgggcgccgccgcctcggccttctcgatgctgttccccgcgggggcggagcagtgctactactacaaggaggaggaggacgggccgccctacggcggcgggccggtcgactgcacgctgtcgctcggcacgccgtccacgcgccgggcggaggcgggcggccacgcgcgcgcagcaggcggcgccgccccctgcaaggagtcgtccggccgcggctcgccggcgcggcggtgcgccaactgcgacaccacgtccacgccgctctggcggaacgggccgcggggacccaagtcgctgtgcaacgcctgcgggatccggtacaagaaggaagagcggcgcgctgcggcggccgtcgcgccggcgccggcgccgcaggagtacgcgtgcggcggctacgcgaggcagcagccgccgcagccgcagtggggatgctacggcgcggccgcggccaagtcggcgtcattcgggatgtacggcggcgacgtcgtcgacgccgcggcggacgggccctgcctgtcgtggatgctcaacgtgatgccctcctcgccggcgttcgcagtccgggagaggcccaccctgttccagtactactagcgctaggctactgacgacaatagtagtaacttttttttattaccagcttaatcagtttagcgatgagatcacaaccacaaacaccctgttcggctgctgggcggctgctgctggcggctgcggcgtgagtgcagaaccagccagcaccagccggccgggcaccagccaaagttgcattgtactactagtgctagacgaccaacatgcaagtttggaagcg

SEQ ID NO: 5456 - protein, 219 aa, Panicum virgatum
  misc_feature: Ceres CLONE 1820804
  misc_feature (1)..(36): Pfam Name: GATA Pfam Description: GATA zinc finger
MLQELAPCACGGFYAGGCGGRCAGAAASAFSMLFPAGAEQCYYYKEEEDGPPYGGGPVDCTLSLGTPSTRRAEAGGHARAAGGAAPCKESSGRGSPARRCANCDTTSTPLWRNGPRGPKSLCNACGIRYKKEERRAAAAVAPAPAPQEYACGGYARQQPPQPQWGCYGAAAAKSASFGMYGGDVVDAAADGPCLSWMLNVMPSSPAFAVRERPTLFQYY

SEQ ID NO: 5457 - DNA, 1568 bp, Panicum virgatum
  misc_feature: Ceres CLONE 1820812
  misc_feature: Encodes the peptide sequence at SEQ ID NO. 5458
acacagccaagcacaagtctctcttggactgcatcttggcagcacaccaccaaagcacgaaagagtgagaggtcgagttacaggcgagcggatggcgaagcaatcggctgccatgtgcagcctccttgtgctcctgttgctcggcttgggatcccagctggtccaatcccaggtcctcttccaggggttcaactgggagtcgtggaagaagcagggcgggtggtacaactacctccggggccgggtggacgacatcgccgcgacgggggccacgcacgtctggctcccgccgccgtcgcactcggtggcgccgcaggggtacatgcccggccgcctctacgacctggacgcgtccaagtacggcacccacgctgagctcaagtcgctcatcgccgccttccacgccaagggcgtccagtgcgtcgccgacatcgtcatcaaccaccgctgcgccgactacaaggacagccgcggcatctactgcatcttcgagggcggcacgcccgacagccgcctcgactggggtccggacatgatctgcagcgacgacacccagtactccaacggccgcggccaccgcgacaccggggcggacttcggcgctgcgcctgacatcgatcacctcaacacgcgtgtccaggaggagctctccgactggctcaactggctcaagtccgacctcgacttcgacggctggcgcctcgacttcgccaaaggctactccgctgccgtagccaaggtgtacgttgacaacaccgcgcccaccttcgtcgtcgccgagatatggagttcgctgcagtacgacggcaatggcgaaccatccagcaaccaggacagagaccggcaggagctggtgaactgggcgcaggccgtgggcggccctgccgcggcgttcgacttcaccaccaagggggtgctgcagtcggccatccagggcgagctgtggcggctcaaggatggcaacggcaaagcccccggcatgatcggttggctgccggagaaagcggtcaccttcgtcgacaaccacgacaccggctccacccagaactcatggcctttcccctccgacaaggtcatgcaaggctacgcctacatcctcacgcacccaggaactccctgcatcttctacgaccacgttttcgattggaacctgaagcaagagatcagcgctctttctacagtgaggtcaagaaacgggatccaccccgggagcaagctggacatccttgccgctgatggggatctctacgtcgccaagatcgacgacaaggttatcgtgaagatcggatcgcggtacgatgtcgggaacatgatcccctcagacttccatcccgttgcccatggcaacaactactgcgtttgggagaagtctggtttgagggttccggccgggcgacaccactagacccgaccgaacttctaaatatattctttctcaggtctatttgaacctgaagaaatttgaatcggattgagtaaaataacccgaatttgattgtactaagcttctttcagcaattattgaaagaagatcatggtgtttggatgaaaaaaaaaaaaaaaaaaaa

SEQ ID NO: 5458 - protein, 437 aa, Panicum virgatum
  misc_feature: Ceres CLONE 1820812
  misc_feature (1)..(318): Pfam Name: Alpha-amylase Pfam Description: Alpha amylase, catalytic domain
  misc_feature (1)..(437): SWISSPROT Homolog: EC 3.2.1.1 Alpha-amylase isozyme 3B precursor
  misc_feature (1)..(437): SWISSPROT Homolog: EC 3.2.1.1 Alpha-amylase isozyme 3C precursor
MAKQSAAMCSLLVLLLLGLGSQLVQSQVLFQGFNWESWKKQGGWYNYLRGRVDDIAATGATHVWLPPPSHSVAPQGYMPGRLYDLDASKYGTHAELKSLIAAFHAKGVQCVADIVINHRCADYKDSRGIYCIFEGGTPDSRLDWGPDMICSDDTQYSNGRGHRDTGADFGAAPDIDHLNTRVQEELSDWLNWLKSDLDFDGWRLDFAKGYSAAVAKVYVDNTAPTFVVAEIWSSLQYDGNGEPSSNQDRDRQELVNWAQAVGGPAAAFDFTTKGVLQSAIQGELWRLKDGNGKAPGMIGWLPEKAVTFVDNHDTGSTQNSWPFPSDKVMQGYAYILTHPGTPCIFYDHVFDWNLKQEISALSTVRSRNGIHPGSKLDILAADGDLYVAKIDDKVIVKIGSRYDVGNMIPSDFHPVAHGNNYCVWEKSGLRVPAGRHH

SEQ ID NO: 5459 - DNA, 2027 bp, Panicum virgatum
  misc_feature: Ceres CLONE 1820813
  misc_feature: Encodes the peptide sequence at SEQ ID NO. 5460
actcccctcccctccctggctctccccctagctaccggcctcgcctccacgcctccgccgccgagccgcgaaactccctctccgccgccgccgtcgactcctgctccggcgggcaggatccggctcgccggctctcccctgcggtgaggtacaagatggagggagttggaagagatgccaaccctttgagcggctaccgaattggcaaaaccctggggattggatcgttcggcaaggtaaagatcgccgaacatatattgacaggccataaggtggccatcaagatcctcaatcgccggaagatcagaagcatggaaatggaagagaaagtgaagagagaaatcaagatactcagactatttatgcatcctcatatcatacgcctttatgaggtgatagatacacctgctgatatctatgttgttatggagtatgttaaatctggagagttgtttgattacattgttgagaagggaagactacacgaagaagaagctcgccgtttttttcagcagatcatatctggtgttgaatattgccatagaaacatggtagttcaccgtgatctaaagccagagaaccttcttttagattcaaaatggaatgttaagattgctgattttggcttaagtaatgttatgcgtgatggtcactttctaaagacgagttgtggtagcccgaattatgcagcacctgaggtcatatctggtaaactatatgctggtcccgaagttgatgtctggagctgtggtgttattctttatgctcttctttgtggtactcttccatttgatgatgagaatattccaaatctttttaagaaaataaagggtggaatatatacccttcctagtcatttgtcaccttccgcgagggacttgattccccgaatgctggttgttgatccaatgaaaaggattaccatccgtgaaatccgtgaacatgtgtggttcaagattcggcttccacggtatttggctgtgccgcctccagacactgcacagcaagttaaaaagcttgatgaggaaactcttaatgatgttatcaagatggggttcgacaagaatctgctaattgaatcactgcaaaacaggttgcagaatgaggcaacagttgcctattatttactcttggacaataggcttcgtacaaccagtggttatcttggagctgagtttcaagaatctatggactcttctttttctcaagtaattgctgaaacgccaacttcggcaactgaacttcggcaacatgggtttacagaatctccaggttctggcttgaggcagcattttgctgctgaaaggaaatgggcccttggtcttcagtctcgagcccatccacgagagataattactgaagtgcttaaagctctgcaagaattgaatgtttactggaaaaagattggacactacaacatgaaatgcagatggagtcctggttgtcttgagagtatgatgcataacagtgatggctttagtgcggagtctgctataattgaaacagatgatctcatccagaaatcaacccctacagtgaagtttgagattcagctttacaaaacgagggatgagaagtaccttctcgacttgcaaagggtcagtggaccacagctcctctttctggatctgtgttctgcctttctaacgcagctgagagttctctgatcctgacatgattagctcccgaagcacaatccttgatacagccagtggagtttcaatttatatttgagatgtacataatgaccatatatccttcaatagattatatttctggaacatgtagacattagagggttttgttgtttgcccagacggttgtctctgaagatcctaaacaaggtttgcaggcaagcctcaaacctcttcaattagatgtgaaaattttaggcctttctttagtccttggagaagctatcccattaaggtgattgtactagcatgatacccagactgagaaatatctcattaaaattgaaatgaaagctggccctttttacataccaaaaaaaaaaaaaaaaaaaa

SEQ ID NO: 5460 - protein, 503 aa, Panicum virgatum
  misc_feature: Ceres CLONE 1820813
  misc_feature (11)..(503): SWISSPROT Homolog: EC 2.7.11.1 SNF1-related protein kinase catalytic subunit alpha KIN10
  misc_feature (11)..(503): SWISSPROT Homolog: EC 2.7.11.1 SNF1-related protein kinase catalytic subunit alpha KIN11
MEGVGRDANPLSGYRIGKTLGIGSFGKVKIAEHILTGHKVAIKILNRRKIRSMEMEEKVKREIKILRLFMHPHIIRLYEVIDTPADIYVVMEYVKSGELFDYIVEKGRLHEEEARRFFQQIISGVEYCHRNMVVHRDLKPENLLLDSKWNVKIADFGLSNVMRDGHFLKTSCGSPNYAAPEVISGKLYAGPEVDVWSCGVILYALLCGTLPFDDENIPNLFKKIKGGIYTLPSHLSPSARDLIPRMLVVDPMKRITIREIREHVWFKIRLPRYLAVPPPDTAQQVKKLDEETLNDVIKMGFDKNLLIESLQNRLQNEATVAYYLLLDNRLRTTSGYLGAEFQESMDSSFSQVIAETPTSATELRQHGFTESPGSGLRQHFAAERKWALGLQSRAHPREIITEVLKALQELNVYWKKIGHYNMKCRWSPGCLESMMHNSDGFSAESAIIETDDLIQKSTPTVKFEIQLYKTRDEKYLLDLQRVSGPQLLFLDLCSAFLTQLRVL

SEQ ID NO: 5461 - DNA, 1629 bp, Panicum virgatum
  misc_feature: Ceres CLONE 1820874
  misc_feature: Encodes the peptide sequence at SEQ ID NO. 5462
aatcattgttgaattgcgatttgcgagcgagctcgtgccatgatctacgagaacgagagatcgtgaaggaagtaaaggcgggcggcgccgaatccgccgatgaggggaggaggagcagcgatggcgaggctggcggtggccgcgagggccttctcctccgcctcggcctccgccggcggcggcgtggccatggtgcagggcgcgtcccgggggatcggcctcgagttcgtgcggcagctgctgcggaggagcgaccagggccgcgtcgtcgccacgtgccgcgcgccgggatccgccgccgagctccagaagctcaaggaggagcacgcgccggggcgcctcaccgtgctgccgctcgacgtcaccgacgagaccaccatagaggccgctgcggcctcgattcaagagacacatggttctcttgacctgctgatcaactccaccggcatcctttctatcccaaacgtgatacaaccagagactacactgagcaaagttcagaagtcgtccctgctgctggcgtatgaagtgaatgcagtcggcccaatcttagtgatcaagcacatgtggccactgctgaagattggtggtcgctccgatactgggagaggattctcattggttgcaaacatgagtgctagagtcagttcgataggagacaatggtctgggaggctggcattcatacagagcttctaaaacggcactgaaccagttgacgaagactgtgtcagtagagtttggcaggaaggacaacatcacctgcatcctgctacatccaggaaccgtggacagtgacctctcacggccctttcagagaaacgtccccaaggataagctcttcacaagagaattctccgtgcagaagctcctctccatcattgacagcgtcaagaaaagcgacaatggcaagttcttcgcatgggatggccaagaaatcccttggtgactcgtgatcactgtttcagccagcagcatacaggtcaacaatgagaacagattttctttttgcaaagtgttgccctgttatcgaccgttccacgttatcgctccggatcttccacaagtgcatgcgaccacattcagaagtcagctgttgtagaacaagaagaaccacaagcaaaacatggcgatcggttttccattcactttccggctgcttaggaaaagatgtgaatgtttgctgatgagtgatgacgcaaattttgttcaattttatttgagtccttcaattctgggagtttttgtcattcatgatgatgatgatccatcaagctactcttgacatgtgaaggcctcgagagaagtcaatagtattatttggatattactacccacctaatgcgcgtttgacccagaaggaactggagaagagagaacacgttcgagccacagccaccaacgaagactggtcatgctgtgcgcagccttctcagccgccggtgcaatggtcagaatgaaactttgataaataattactctgttaacattctattcgtcgttgtatcttcataaggatgtgtttttggattcaaatctaatggcaccaactttgtgaactaatactatgtattgataaagtagtaaattgcttgttaaagacttgcattagcgataagccgtgcaagtt

SEQ ID NO: 5462 - protein, 282 aa, Panicum virgatum
  misc_feature: Ceres CLONE 1820874
  misc_feature (1)..(187): Pfam Name: adh_short Pfam Description: short chain dehydrogenase
MRGGGAAMARLAVAARAFSSASASAGGGVAMVQGASRGIGLEFVRQLLRRSDQGRVVATCRAPGSAAELQKLKEEHAPGRLTVLPLDVTDETTIEAAAASIQETHGSLDLLINSTGILSIPNVIQPETTLSKVQKSSLLLAYEVNAVGPILVIKHMWPLLKIGGRSDTGRGFSLVANMSARVSSIGDNGLGGWHSYRASKTALNQLTKTVSVEFGRKDNITCILLHPGTVDSDLSRPFQRNVPKDKLFTREFSVQKLLSIIDSVKKSDNGKFFAWDGQEIPW

SEQ ID NO: 5463 - DNA, 1193 bp, Panicum virgatum
  misc_feature: Ceres CLONE 1820946
  misc_feature: Encodes the peptide sequence at SEQ ID NO. 5464
gctatccccatggacctcgacctcttcggggagcccgccggagtctccgacctcatcgtaccgtccccgcctccgccggcgccggcgcgcgatgcggaggcggggtcgccggagtcggtgacctcccgggcaagcccgcccgggggggaggcgctgatggagatcgagaggttcctgatgcaggagggggaggcggagctgggcggggaggcagagggcatcaacgtggaggagttcttcgacgcgctctacgacggcggggaggggaaggagggcgaggcgggtggaagcacggatgaggattccggaagggatgaggtggtggaggttgtaacgccggaggtggacggcgatgatcccgtcagcaagaagaagatgaggcaaatgaggaacagagattccgccatgaaatcgagggagaggaagaagtcgtacataaaggacttggagacgaagagcaagtatttggaggcagagtgccgccggctcagctatgcactccagtgctatgcaactgagaacatggtactgcgccagagcttgttgaaggataggcctgttggtgctcccacagccatgcaggagtctgccgtactcacggaaaccctgccgttggtttccctgctttggctagtgagcatcgtgtgcctgttcctgatgcccggtctgcccaaccgaagtccagctgctccaagcagcgccggaagaggtctcgggatggtagccggaaagacaagcagtgaaaacccagagatattggaactcatcctccatggaaggcgctgcaagagcacaagggcaaaaatcaagctagatacagtaccatttcatgcagtagctgcttgctagcctttccataggcctattttgcaagcatccagtatgtagtgtacttgccaaccttagcatgcctgctaatatatgtgtcatgcagcagccagttgatatccatggaatatcttttcttttctatttggattttttcttttgttcttttttggagattccgtagtaattcttaaatatgggcttttgtgttcgtatattagcatcttgttcctggatctgaagttcctgtgatcgtgaatctttggaagtgttagtgcagtatgatatgatgtaataaaattatcaagaccagggaagctcgttgaggtctatggtttagttgacaaaaaaaaaaaaaaaaaaaa

SEQ ID NO: 5464 - protein, 279 aa, Panicum virgatum
  misc_feature: Ceres CLONE 1820946
  misc_feature: Great-hit functional homolog of the protein sequence encoded by LOCUS At1g42990
  misc_feature (1)..(55): Pfam Name: bZIP_2 Pfam Description: Basic region leucine zipper
  misc_feature (1)..(65): Pfam Name: bZIP_1 Pfam Description: bZIP transcription factor
  misc_feature: Useful for making plants with modulated nitrogen use efficiency
MDLDLFGEPAGVSDLIVPSPPPPAPARDAEAGSPESVTSRASPPGGEALMEIERFLMQEGEAELGGEAEGINVEEFFDALYDGGEGKEGEAGGSTDEDSGRDEVVEVVTPEVDGDDPVSKKKMRQMRNRDSAMKSRERKKSYIKDLETKSKYLEAECRRLSYALQCYATENMVLRQSLLKDRPVGAPTAMQESAVLTETLPLVSLLWLVSIVCLFLMPGLPNRSPAAPSSAGRGLGMVAGKTSSENPEILELILHGRRCKSTRAKIKLDTVPFHAVAAC

SEQ ID NO: 5465 - DNA, 1317 bp, Panicum virgatum
  misc_feature: Ceres CLONE 1820959
  misc_feature: Encodes the peptide sequence at SEQ ID NO. 5466
acttcagcagctgtttcagtaaatctatctgctgtctaccggctacaggcactcttcccgtacctagccctgcacgtagccgcacggagataagcagcagagacgatccaagatggcgaagcagcagggtgtcgtcgcttccatggttgcactggcattgctgctcggaacatttgcagccatccctacaggggtgcaatccatcggcgtgtgctacggcgtgaacggcggcggcctgccctcggccggcgacgtcgtgcggctctaccagtccaacggcatcaacctcatgcgcatctacttcccggacgccgacgcgctgcgggcgctgagcggcaccaacatcggcctcatcatggacgtgcccaacgagaacctcggctccatcgcctccgaccccaacgccgccgccgcctgggtccgggacaacgtccaggccttcccggccgtctccttccgctacatcgccgtggggaacgaggtggccggcggggacaccgccagcatcctccccgccatgcgcaacatcgacgccgccctcgccgacgccggcctcggcgccgtcaaggtgtccacggcggtgcagagcggcgtcacgcaggggttcccgccgtcggccggcagcttctcgcagggccacatgggccccatcgcgcagtacctgcagagcaccggcgcgccgctcctcgcaaacgtctacccctacttctcctacatcggcaacaaggcccagatcgacatcaactacgcgctcttcacctcccccggcaccgtcgtgcaggacggcggcaacgcctaccagaacctcttcgacgcgctcgtcgacaccttctactccgcgctcgagaacgccggcgcggggaacgtcggcatcgtcgtgtcggagagcggctggccgtcggcggggggcgacgcggccaccgcagccaacgcgcagacctacaaccagaacctcatcaaccatgtcgggcagggcacgcccaagcgccccgggcccatcgagatctacatattcgccatgttcaacgaggaccggaagcccggagcagagacggagaagcacttcggattgttcaacccggaccaatcgccggcataccccatcagtttctgagccaacggatatcatacaagaacaagacatacatacagatatacatacacacagaaataacgagatagtacttcaaatttgatgaataagctatttatcagatgcctgtaaaatgcaaactgcattcatgtaacgcaagcacttcaattgtttcctaaagatgaataagaggcatcacgttgcaaaaaaaaaaaaaaaaaaaa

SEQ ID NO: 5466 - protein, 333 aa, Panicum virgatum
  misc_feature: Ceres CLONE 1820959
  misc_feature (1)..(302): Pfam Name: Glyco_hydro_17 Pfam Description: Glycosyl hydrolases family 17
  misc_feature (1)..(333): SWISSPROT Homolog: EC 3.2.1.39 Glucan endo-1,3-beta-glucosidase GII precursor
  misc_feature (1)..(333): SWISSPROT Homolog: EC 3.2.1.39 Glucan endo-1,3-beta-glucosidase, acidic isoform precursor
MAKQQGVVASMVALALLLGTFAAIPTGVQSIGVCYGVNGGGLPSAGDVVRLYQSNGINLMRIYFPDADALRALSGTNIGLIMDVPNENLGSIASDPNAAAAWVRDNVQAFPAVSFRYIAVGNEVAGGDTASILPAMRNIDAALADAGLGAVKVSTAVQSGVTQGFPPSAGSFSQGHMGPIAQYLQSTGAPLLANVYPYFSYIGNKAQIDINYALFTSPGTVVQDGGNAYQNLFDALVDTFYSALENAGAGNVGIVVSESGWPSAGGDAATAANAQTYNQNLINHVGQGTPKRPGPIEIYIFAMFNEDRKPGAETEKHFGLFNPDQSPAYPISF

SEQ ID NO: 5467 - DNA, 1377 bp, Panicum virgatum
  misc_feature: Ceres CLONE 1820983
  misc_feature: Encodes the peptide sequence at SEQ ID NO. 5468
aatccaacagtgctttcgtgtctgtccatggtcatagcagcctgcctccgcgagctctgctcctgcggccgctgcccccgcgacgacgaatccgagcccgtcagccaagcgacgccgtcgacgatggccgccaccgccgtcggcgacggccagatcaacaccgccaccaccatcacgcaccgcacggtggaggtgggcaccggcgggcgcctgcacgtggcggaggccggcccggcggcggcggcgggcgcgccgacggtgctgctgctccacggcttcccggagctgtggtacacctggcgccaccagatgcgcgcgctggccgcggcgggctaccgcgccgtggcgcccgacctgcgcggctacggcggctccgacgcgcccgcggcgcccggcggcgacaccgccgggcagtacacggcgctgcacgtggttggcgacctggtggcgctcctcgacgccctcggcgaggagcgcgtgttcgtggccgcgcacgactggggcgcgctcacggcgtggagcctctgcctgttccgccccgacagggtgcgcgcgctcgtcgcgctcagcgtcgcctacgcgccccggagcgccgcgcggaggcccgtcgacggcctcagggcgctcttcggcgacgactactacgtctgccggatccaggatcctggagcaattgaagctgaattcaaacgccttggcacggagctggtgctcaggaagttcttaagctaccgcagccccggaccgctgttcatcccgaagagcgggtggggctccccagatgatgagctgccattgcctagctgggtaaccgaggaggacctcaagtactacactagcgagtttgagaggaccggtttcactgggggactcaactactaccgtgccctgaataagacatgggagctcacatcaccctggactggagctaagataaatgttccagtcaagttcatcattggagacttggatttgacatatcatagtcctggcatacaagatttcattcacaagggtggcttcaagaagttcgttccacttcttgacgatgttgtcgtcatgaaagatgttgggcacttcatcaatgaagaaaaacccaaggaagtcagcgagcacataataagtttcataaagaaattcaattgatgctaatttcttaatgatgttggtaattagcaatttggaatttatgtgatttttagtttgttgtgacgttgatctaatgccatgtaaaatgcttgtcaaaattgccctgtgtttttcttagtggttggatctgtataaatttatgatgtttgtttgagaaccttggggtgaagttaaattattatgatatgaataaagctttgtcttctccaaaaaaaaaaaaaaaaaaaa

SEQ ID NO: 5468 - protein, 372 aa, Panicum virgatum
  misc_feature: Ceres CLONE 1820983
  misc_feature (1)..(257): Pfam Name: Abhydrolase_1 Pfam Description: alpha/beta hydrolase fold
MVIAACLRELCSCGRCPRDDESEPVSQATPSTMAATAVGDGQINTATTITHRTVEVGTGGRLHVAEAGPAAAAGAPTVLLLHGFPELWYTWRHQMRALAAAGYRAVAPDLRGYGGSDAPAAPGGDTAGQYTALHVVGDLVALLDALGEERVFVAAHDWGALTAWSLCLFRPDRVRALVALSVAYAPRSAARRPVDGLRALFGDDYYVCRIQDPGAIEAEFKRLGTELVLRKFLSYRSPGPLFIPKSGWGSPDDELPLPSWVTEEDLKYYTSEFERTGFTGGLNYYRALNKTWELTSPWTGAKINVPVKFIIGDLDLTYHSPGIQDFIHKGGFKKFVPLLDDVVVMKDVGHFINEEKPKEVSEHIISFIKKFN

SEQ ID NO: 5469 - DNA, 1367 bp, Panicum virgatum
  misc_feature: Ceres CLONE 1820998
  misc_feature: Encodes the peptide sequence at SEQ ID NO. 5470
ggctttcgcctgcctgggtgtgcggtgtctccttccttattccttccaccacctgttcgtttcgtcctcacctcgccgcagcctagctgcacacccgtcacattgcccccaagccgatctccctgcgaattcactccctcctgctgggcggtgctcactgctctggtcagtcaggcatgcgcgcctcccgcccctgccggctggcgctcctcctcctcgccgtggcggcggcggcgggcggccacgacttccggcgggacttcgacgtggtgtggggggagggcaatgcgcggttccgcgacggcgggcgggaggtggagctgtcgctggacgagcgcacgggcgcgcggctgcagtccaagcagcgctacctcttcggccgcttcgacctcgagatcaagctcgtcgccggcgagtccgcggggaccatcacctccttctacatctgcagcggcggcgcgcgtcacgacgaggtggacttcgagttcctgggcaacgcgagcggcgagccgtacctcctgcacaccaacatcttcagcgacggcaggggcgagcgggagcagcagttcgtgctgtggttcgaccccaccgcgggcttccacacctactccatcctctggaacccgcacaacgtcatcctctacatcgacggcgtccccatccgggtgttccgggacaacgccgcccgcggggtgccgttcccggcgcgccagccggcgcacgtcttcgccagcatctgggacgccgaggactgggccacgcagggcggccgcgtcaagacggactgggccagcgcgcccttcgtcgccgcctaccgccgctacaacgtctccaccaccgcctgcgtctgggacgaagggggagggcgcgcgcgatgcccgccggcggcgtcgtggatggcgcggaggatggactggtggagctggatgacgctcagctgggtgcgcatgaactacatggtctacgactactgcgacgaccgcaggaggttcccgcacggagccccgcccgagtgcgacatccccatcggcaggtcgtgacctgcttgctgatcgagctccaacctccaatccggcagtcgtgtcgtgtcgtgtgcagggagaatgaagaagtcttcttctgcttctgcaagctagctagagaacgttctgtctcgccacgtgacggcactgtaataatcgggcttgcttttttgttgatctcttgaagaccgatgcagttgccgggttgtttagcctgtgtatccgcaaaaagtggtaaaaagtgtgacattggattctgtcgcacacggtagcatttttcgtttgtttgtgttaaatattgttctatcatagactaactagactcaaaaaaaaaaaaaaaaaaaa

SEQ ID NO: 5470 - protein, 287 aa, Panicum virgatum
  misc_feature: Ceres CLONE 1820998
  misc_feature (1)..(181): Pfam Name: Glyco_hydro_16 Pfam Description: Glycosyl hydrolases family 16
MRASRPCRLALLLLAVAAAAGGHDFRRDFDVVWGEGNARFRDGGREVELSLDERTGARLQSKQRYLFGRFDLEIKLVAGESAGTITSFYICSGGARHDEVDFEFLGNASGEPYLLHTNIFSDGRGEREQQFVLWFDPTAGFHTYSILWNPHNVILYIDGVPIRVFRDNAARGVPFPARQPAHVFASIWDAEDWATQGGRVKTDWASAPFVAAYRRYNVSTTACVWDEGGGRARCPPAASWMARRMDWWSWMTLSWVRMNYMVYDYCDDRRRFPHGAPPECDIPIGRS

SEQ ID NO: 5471 - DNA, 1243 bp, Panicum virgatum
  misc_feature: Ceres CLONE 1821027
  misc_feature: Encodes the peptide sequence at SEQ ID NO. 5472
ccggggcctgccttgtcggagcggctgctgtatctctccgcctcctcccagctgaaatcggcagccaggcgagcaagcgaatggctcccctcttcgccgccgcgtcccacgcgtccgccctccccctcttctccccggaccccgccgccgcccgccgggctggcggcaccctcaggtcccgcacctcggccctccgcctccgccggccccccggggccgccgggcgcgggcgcgggaacgtccccggcgagtggggcgagcgctccccgccgggggcccccgcgcagcccgacccgcccgtggacgacgacgagtggggccgcgacgacgacgacggcaactcgcgccccatcgtcgccgacgagtggggcgagccgggggagcccgagcccgagccgccctccgccgcggatccgcctagcccagccgccgacgacgagtggggggaggatcccgcggcggcgccgccgccgccgcccgcggaggaggaggtggacgagcaggcggagaggagggaggagctcaagcggtgcctggtggacacggtgtacggctccgagttcgggttccgggcgtccacggagaccaggggggaggtcgtcgagctcgtcacgcagctcgaggctaacaaccccacgcccgcacccgtcgaggcgccggatctcctcaacggcaactggatcctcatatatacagcctattctgagctgctgcctattctagctgctggggcaacaccttttgtgaaagtaaagcagatatcccaagaaattgactctaaaagcatgacgattgtcaatggttcaacccttacgactccattcgcatcgttttcattcagtgcagctgcctcttttgaggttcaaagtccatcgaggatagaggtccaatttaaggaggggagctttcagccacctgcgatatcatcatcagtggatctacctgaacaggttgatatatttgggcagaagatcagcctgggcccagtccagcaggcactgaatccgttgcagcaagcatttgctagcattgctggctccatttctgggcagccacccctcaaggtatctattcctggcaacgatagaggccggtcatggctgctgacaacctacctggacaaagacttcaggatctcaagaggcgatggaggcttgttcattcttgcaaaagaggggagcccgttgctagatcaattgtaattctttaataggtcacgttggaaaaaaaaaaaaaaaaaaaa

SEQ ID NO: 5472 - protein, 373 aa, Panicum virgatum
  misc_feature: Ceres CLONE 1821027
  misc_feature: Great-hit functional homolog of the protein sequence given in SEQ ID NO 9544
  misc_feature: Useful for making plants with modulated nitrogen use efficiency
MAPLFAAASHASALPLFSPDPAAARRAGGTLRSRTSALRLRRPPGAAGRGRGNVPGEWGERSPPGAPAQPDPPVDDDEWGRDDDDGNSRPIVADEWGEPGEPEPEPPSAADPPSPAADDEWGEDPAAAPPPPPAEEEVDEQAERREELKRCLVDTVYGSEFGFRASTETRGEVVELVTQLEANNPTPAPVEAPDLLNGNWILIYTAYSELLPILAAGATPFVKVKQISQEIDSKSMTIVNGSTLTTPFASFSFSAAASFEVQSPSRIEVQFKEGSFQPPAISSSVDLPEQVDIFGQKISLGPVQQALNPLQQAFASIAGSISGQPPLKVSIPGNDRGRSWLLTTYLDKDFRISRGDGGLFILAKEGSPLLDQL

SEQ ID NO: 5473 - DNA, 1492 bp, Panicum virgatum
  misc_feature: Ceres CLONE 1821030
  misc_feature: Encodes the peptide sequence at SEQ ID NO. 5474
cataatctcagccgcaactgcgtgcaactacgtcttggggatcagatcagatgtcgtcgacctcgcaagtggcgccgctcgccgtgctcgtcttcctggtctgcgcgacgctcgcctccggcgccgccagcgtccgcgtcgggctcacgcgcatccacgccgaccccggcattcccgcgtcccagctcgtgcgcgacgcgctgcgccgcgacatgcaccggtccgccggccgcgcgctcggggcctccgacgacggcgctgctgccaccacggtgtcggcgcgcacccgcaaggacctgcccaacggcggggagtacctgatgacgctggccatcggcacgccgccggtggcgtacccggccatcgcggacaccggcagcgacctcatctggacgcagtgcgcgccctgcggcggtcagtgcttcaagcagccggcgccgctctacaacccggcgagctccaccaccttcggcgtgctcccgtgcaacagctcgctgagcatgtgcgtgggggcgctggccggtgccgcgccgccgccggggtgcgcgtgcatgtacaaccagacgtacggcaccgggtggacggcgggcgtccagggctccgagacctttaccttcggggcggcggccgccgaccaggcccgcgtccccgggatcgccttcgggtgcagcaacgccagcagcgacgactggaccggctcggcggggctcgtcggcctgggcaggggcgccctgtcgctcgtctcgcagctcggcgccggcaggttctcctactgcctcacgccgttccaggacgccaacagcaccagcacgctcctcctcggcccgtcggcggcgctcaacggcaccaccggcgttcgttccacgccattcgtcgccagcccggccaaggcgcccatgagtacctactactacctcaacctcaccggcatatccctcggcacgacggcgctatccatctctcccgacgccttctccctgaacgccgacggcaccggcgggctcatcatcgactccggcacgaccatcacgtcgctggtcgacgccgcgtaccagcaggtccgcgccgccgtgaagtccctggtgacgctgcccgcgatcgacggctcggactcgacggggctcgacctgtgcttcgcgctgccgtccccgacgtcggcgccgccggccatgccgagcatgacgctccacttcgacggcgcggacatggtgctcccggcggagagctacatgatctcgggctccggcgtgtggtgcctggtgatgcggagccagatggacggcgcgatgagcacgctcggcaactaccagcagcagaacatgcacatcctctatgacgtccggaaggagacgctgtcgtttgctccggccaaatgcagcacgctctgaccagatttgtacagatacatatacgtgtgcataggactcatgatttttgtacagatacatatacattctagattgttataactaaacattctaattcaattatt

SEQ ID NO: 5474 - protein, 445 aa, Panicum virgatum
  misc_feature: Ceres CLONE 1821030
  misc_feature (1)..(358): Pfam Name: Asp Pfam Description: Eukaryotic aspartyl protease
MSSTSQVAPLAVLVFLVCATLASGAASVRVGLTRIHADPGIPASQLVRDALRRDMHRSAGRALGASDDGAAATTVSARTRKDLPNGGEYLMTLAIGTPPVAYPAIADTGSDLIWTQCAPCGGQCFKQPAPLYNPASSTTFGVLPCNSSLSMCVGALAGAAPPPGCACMYNQTYGTGWTAGVQGSETFTFGAAAADQARVPGIAFGCSNASSDDWTGSAGLVGLGRGALSLVSQLGAGRFSYCLTPFQDANSTSTLLLGPSAALNGTTGVRSTPFVASPAKAPMSTYYYLNLTGISLGTTALSISPDAFSLNADGTGGLIIDSGTTITSLVDAAYQQVRAAVKSLVTLPAIDGSDSTGLDLCFALPSPTSAPPAMPSMTLHFDGADMVLPAESYMISGSGVWCLVMRSQMDGAMSTLGNYQQQNMHILYDVRKETLSFAPAKCSTL

SEQ ID NO: 5475 - DNA, 1361 bp, Panicum virgatum
  misc_feature: Ceres CLONE 1821048
  misc_feature: Encodes the peptide sequence at SEQ ID NO. 5476
gccagtagccagtgcaggaggagcaggagaccaagccttctgcttcccggccgagatcgatgggagaagaagcgcatcgcagcgtgcaggagctggcggcgtcgctgggcgcgctgccgccggagttcgtgcgcccggagcacgagcagccggcggccaccacgttcccgggcggcgccgcgctggacgtgccggtgatcgacctgtcggagcccgggtacggcgcgcgcgtggcggccgcggcgcgggattgggggctgttccaggtggtgaaccacggcgtgccctccccggtggtggccgagctgcagcgcgtcgggcgggaattcttcgcgctcccgcgggaggagaaggagcgctacgccatggacccggcctccgggcggatcgagggctacggcaccaagctgcagaaggacctcgagggcaagaagacgtggaacgacttcttcttccacgtcgtggcgccgccggccaaggtcgaccacggcgtgtggccccggagcccccccgggtacagggaggccaacgaggcctactgccgccacatgcagcgggtggcgcgcgagctgctcggccacctctcgctggggctcggcctcgaggagggcgccatggcggaggcgttcggcggcggcgacctggtgttcctccagaagatcaacctgtacccgccgtgcccgcagccggagctcacgctcggcgtcgcgccgcacaccgacatgagcacgctcaccatcctcgtgcccaacgaggtgccggggctccaggtcttcaaggacggccactggtacgacgccaagtacgtgcccgacgcgctcatcatccacatcggcgaccagatcgagatcttcagcaacggggcctacaaggcggtgctgcaccgtacgacggtgagcaaggacaagacgcggatgtcgtggccggtgttcgtggagccgccgggggagcaagtcgtcgggccgcacccacagctggtcaccgccgagagccccgccaagtacaaggcgaggaagttcaaggagtaccagcactgcaagatcaacaagctgcccctgtaactgcccggccacgacatgcgcgttgcaaggagcacgcggtgcacgtttctctgtcgtgttgaatacagtagctgcctgtgactctgttgttctgtccgtcgtttcgatcacacatccgcatggccacgcgcaattatcctctcttttttttttgctttggactgggccaccgactgtgggcagtgggccggttatcatctattcttgtttgtaataaaataagtatagtgaccaggccttgttcggcttcggtaactgtaataaaatgggcctctttatcaaaaaaaaaaaaaaaaaaaa

SEQ ID NO: 5476 - protein, 333 aa, Panicum virgatum
  misc_feature: Ceres CLONE 1821048
  misc_feature (1)..(100): Pfam Name: 2OG-FeII_Oxy Pfam Description: 2OG-Fe(II) oxygenase superfamily
  misc_feature (1)..(332): SWISSPROT Homolog: EC 1.14.11.23 Flavonol synthase/flavanone 3-hydroxylase
MGEEAHRSVQELAASLGALPPEFVRPEHEQPAATTFPGGAALDVPVIDLSEPGYGARVAAAARDWGLFQVVNHGVPSPVVAELQRVGREFFALPREEKERYAMDPASGRIEGYGTKLQKDLEGKKTWNDFFFHVVAPPAKVDHGVWPRSPPGYREANEAYCRHMQRVARELLGHLSLGLGLEEGAMAEAFGGGDLVFLQKINLYPPCPQPELTLGVAPHTDMSTLTILVPNEVPGLQVFKDGHWYDAKYVPDALIIHIGDQIEIFSNGAYKAVLHRTTVSKDKTRMSWPVFVEPPGEQVVGPHPQLVTAESPAKYKARKFKEYQHCKINKLPL

SEQ ID NO: 5477 - DNA, 1587 bp, Panicum virgatum
  misc_feature: Ceres CLONE 1821051
  misc_feature: Encodes the peptide sequence at SEQ ID NO. 5478
agtcgcccatcctagctccatcctattctctgttctgctctgctcagccaccatcgtgtgcggccgtttcaattcagacagtctcgattggtgggcgggcacggtcgtgcggctgctggtgttcttccgcgtcatcctgtgctttgggttcaattcaactagaggtcgctgccgttatgacaagtggcaccgtcgcgtgccactacggattaatgcaaacttgccaggtcagcgccgccttgtcgccaacgacgcatcggtagctcaggccgaatacttccgccagcttctgaagcccgtgacgtagattcagccatcagttccttcctcattctgcttccagaaaacctcaaactcaaaccaaactaaccaaaacaattttgaattcaaccacaagaaaaagctagctcccaagtccagttaacaaaatgccgtcgaattcatgttcaatttcattccaaccaagagcctaaaatcttcccagatttccgacacaaacacttccggcggcccgatgcagggagatcccgggtacggctacggctacgggtacggcgcaggcgccggcggctatgactacgacatggccggctacggaggtggaggcggcgcgtactacacggcgaacgaccggtatcccgtcgcgccggctgccaatgaggacccggtcgccggtacgaggcagcacgacttcccggctccactgacggggctggagttccagccgtcggacacctgccccaagaactacgtcatcttcgatcagacatacgaccggagccggatgatgttccacccctccctggtccccaacaacttgggctcctccgtaggcgggtacgactacgactacgaccaccgctgctacggctacgatcagaactacgccggcaagagcgcgtattatggctgcggcgacgacggcggcgctgcctcgattcggcaggaggacacggacgagatcaacgcgctgatgagcacggaggacggcgaggacgaggacgacgtgcgcagcacggggcgcaccccggggtgccgcgccgggggatccccggactccacttgctcgtccgccgggtgcagcgccggccggaagcacgaggccggcggcgagaagaagaaggagcggatgaagaagatggtgcggacgctcaaggggatcgtcccgggcggcgaccggatggacacgccggcggtcctcgacgaggccgtcaggtacctcaagtccctcaaggtggaggtcaagaagctcggcgcgcgcgggtcaagcggttagccagtcaccagctgacatcggcatccggcggtcgatgatggcaaggacgacaggctttcgtcatggcatccgatgccgcgaaccatgagttggtgcgtgccctgtttgcacgggcaggttcagaacgcgatggcatgggatgggagagctcagttgccgcgcgctttattttgtcagcgttccttgtgtgcctctgcctggctcaagcgtccgggcgggggcgtgcacggtgcacagattgcttcttttgtttgttagatatatagaagttgttgccttttcctctttcggaaaaaaaaaaaaaaaaaaaa

SEQ ID NO: 5478 - protein, 277 aa, Panicum virgatum
  misc_feature: Ceres CLONE 1821051
  misc_feature: Great-hit functional homolog of the protein sequence encoded by LOCUS At1g29950
  misc_feature (1)..(40): Pfam Name: HLH Pfam Description: Helix-loop-helix DNA-binding domain
  misc_feature: Useful for making plants with altered cell wall content and/or composition
MFNFIPTKSLKSSQISDTNTSGGPMQGDPGYGYGYGYGAGAGGYDYDMAGYGGGGGAYYTANDRYPVAPAANEDPVAGTRQHDFPAPLTGLEFQPSDTCPKNYVIFDQTYDRSRMMFHPSLVPNNLGSSVGGYDYDYDHRCYGYDQNYAGKSAYYGCGDDGGAASIRQEDTDEINALMSTEDGEDEDDVRSTGRTPGCRAGGSPDSTCSSAGCSAGRKHEAGGEKKKERMKKMVRTLKGIVPGGDRMDTPAVLDEAVRYLKSLKVEVKKLGARGSSG

SEQ ID NO: 5479 - DNA, 1395 bp, Panicum virgatum
  misc_feature: Ceres CLONE 1821067
  misc_feature: Encodes the peptide sequence at SEQ ID NO. 5480
agaggagcgaggaggagagctcggccgggcatggagctcgacgaggagacgttcttggacgagctcatgtcgctgcggggggaggcggcgccgtggcagggctaccccggcggcgtcatgatgagcgacctcctcttctacggcgccgacgcgagaagcggcggcggcatggacctgccgccgttccaggagctggtgcccatgccgcccgcggcgcccccgcacgaggagttcaacttcgactgcctgagcgaggtgtgcaacccttacaggagctccggcgtcgccgccccgggggaggcagcgcccggccagacgctcgacgctccccttcacgacgccatggtggacgaggagccgagcggtgataaggggcagtgctacggaggcgggggcagctccccgacgttcgtgttcggaggaggcgccggcgagagctcggagatggcgcccatcaggggtgtcggcggcccccaccacaagaccaagctccacggcgcgccgtcaaagaatctcatggctgagaggcgccggaggaagcggctcaacgaccgactctccatgctccgctccattgttccaaagatcagcaagatggacaggacatccattcttggggacaccattgactatgtgaaggagctgacagagcggatcaaagcccttgaggaggagatcggcgcctcgccggaggacctgaaccttctgaataccttgaaagattattcgtccaacagtaacaatgagatgatggtgaggaactccaccaagttcgacgtcgagaagcgggacaacgggagcacgaagatcgagatctgctgccccacaaaccccggggtgctgctgtccacggtgaacgcgctggaggtgctggggctggagatcgagcagtgcgtggtgagctgcttcagcgactttggcatgcaggcctcttgcttacaagaggacgggaagcggcaagtgataagcaccgacgagataaagcaggcattgtttaggagtgccgggtatggagggagatgtctctagcaggtcgaagtttcatccaacgcatggaattgaatataaatccggtcgattattggtcgttcttgttcttgatgccttccgtcccgtggctttgctccatgaattaatatagagctatatatatagtagtgttcatctatgagtgtagctagtatgagccatctgaatcccagcaaattaaagatttgctcaggtattgtaagttgatcatttcttgtggtttgtataattttggatcatggcttgtatgcagtactcctgcttgtatgtgggattattgataccatgtatcacgcgacatggtttgggttaaatgccaagaacctggattgtttcttatgtaagtttagctgtggacttttgttc

SEQ ID NO: 5480 - protein, 332 aa, Panicum virgatum
  misc_feature: Ceres CLONE 1821067
  misc_feature (2)..(50): Pfam Name: HLH Pfam Description: Helix-loop-helix DNA-binding domain
MELDEETFLDELMSLRGEAAPWQGYPGGVMMSDLLFYGADARSGGGMDLPPFQELVPMPPAAPPHEEFNFDCLSEVCNPYRSSGVAAPGEAAPGQTLDAPLHDAMVDEEPSGDKGQCYGGGGSSPTFVFGGGAGESSEMAPIRGVGGPHHKTKLHGAPSKNLMAERRRRKRLNDRLSMLRSIVPKISKMDRTSILGDTIDYVKELTERIKALEEEIGASPEDLNLLNTLKDYSSNSNNEMMVRNSTKFDVEKRDNGSTKIEICCPTNPGVLLSTVNALEVLGLEIEQCVVSCFSDFGMQASCLQEDGKRQVISTDEIKQALFRSAGYGGRCL

SEQ ID NO: 5481 - DNA, 1380 bp, Panicum virgatum
  misc_feature: Ceres CLONE 1821101
  misc_feature: Encodes the peptide sequence at SEQ ID NO. 5482
cttgctagcctaggagtcggtcacttgattctccgatccgtgtagcgcgccccggaaggtttctcagagtggaaacgaacaggaaagccgcggggagaagtgcattcattccagagaagagataggcatagatagccacgcgcggcggagagcgagctagctagcaacgcacaggctgcctgcttcgattcctggttgccgcctcgcgtcgtcgatcgcgcggtgtttctcacggctaccaagatagtagggctggcaaaccggtggccggccgccggcgcggcggccgaggagatggggagcctcgacggccacgcgctgcagggccgccaccacggctacgcccactcccatgtcggcgccgacagcggcggcggcggcggcggcggcaacaacaacaacgacgaggacgacgcgtcgccgccgccggcgtcgtcgggtggaggagcgggggcgggcccgcgccggccgcgcgggcggccccccgggtccaagaacaagcccaagccgcccgtggtggtgacgcgggagagccccaacgcgatgcgctcccacgtgctggagatcgccagcggcgccgacatcgtcgacgccatcgcgggcttctcccgccgccgccagcgcggcgtctccgtcctcagcgggaccggcgccgtcaccaacgtcacgctgcggcagcccgcgggggccggggccgccgccgtcgcgctgcgcggccgcttcgagatactctccctgtcgggcgccttcctcccggcgccggcgccgccgggggccacggggctcgccgtgtacctggcgggaggccaggggcaggtggtgggcgggagcgtcatgggcgagctcatcgcgtcgggccccgtcatggtgatcgccgccacgttcggcaacgccacctacgagaggctgccgctggaccaggacgccgacgagggcgccgtgctgtccgggtcgtccgagggcgccgccaccgcgcagcagatggagcagccgcagcagcagagcagcgggggcaacgtcgtgccgccgtccatgtacgccgtcccgcagacgccgccacacgacatgttcggtcagtgggggcaccccgctgtgacgcggccgccgccgacgtcgttctagcaagcaagcgcttgctgcgccgcccggccggcgattacctttatttgctaggtagatctctacttcttccgtagctgcaggctagttgtttgagtagctcgactaccttgttaattaatatgctatgtcatgctgcatatgtgtggatcgtcttttcatttcttctcttctacttggaagcctgttgaattaatgtacgattcctgctagtacttaagtgtgtatcagcaattcagctaaaaaaaaaaaaaaaaaaaa

SEQ ID NO: 5482 - protein, 275 aa, Panicum virgatum
  misc_feature: Ceres CLONE 1821101
  misc_feature: The sequence is a functional homolog of  SEQ ID NO 1409 in the  10/374,780 US patent application
  misc_feature: The sequence is a functional homolog of  SEQ ID NO 1412 in the  10/374,780 US patent application
  misc_feature: The sequence is a functional homolog of  SEQ ID NO 1418 in the  10/374,780 US patent application
  misc_feature: The sequence is a functional homolog of  SEQ ID NO 40 in the  10/669,824 US patent application
  misc_feature: The sequence is a functional homolog of  SEQ ID NO 40 in the  10/870,198 US patent application
  misc_feature: The sequence is a functional homolog of  SEQ ID NO 412 in the  11/435,388 US patent application
  misc_feature: The sequence is a functional homolog of  SEQ ID NO 414 in the  10/714,887 US patent application
  misc_feature: Useful for making plants with modulated growth and phenotype characteristics
MGSLDGHALQGRHHGYAHSHVGADSGGGGGGGNNNNDEDDASPPPASSGGGAGAGPRRPRGRPPGSKNKPKPPVVVTRESPNAMRSHVLEIASGADIVDAIAGFSRRRQRGVSVLSGTGAVTNVTLRQPAGAGAAAVALRGRFEILSLSGAFLPAPAPPGATGLAVYLAGGQGQVVGGSVMGELIASGPVMVIAATFGNATYERLPLDQDADEGAVLSGSSEGAATAQQMEQPQQQSSGGNVVPPSMYAVPQTPPHDMFGQWGHPAVTRPPPTSF

SEQ ID NO: 5483 - DNA, 1159 bp, Panicum virgatum
  misc_feature: Ceres CLONE 1821102
  misc_feature: Encodes the peptide sequence at SEQ ID NO. 5484
aacccggaaaatccccccactcccctgctcctaatctcacaatcgcacagccggagccggccctcccggcagccaagaactcggcggagcagagagtagcagccaagaaagctggggaagagggtccttcttgggagcaggaagaggaggccgaggagaaagggggatctggaggcggcgccccgatggcggtgacggggacctcggcggcggcggcggccacgatgctggcggcggcggcggccatcttcatcaccttcgtcctctgcttctacctcttcctctgcgccaagcgctaccgcggcgccgccccgacgatcgggggcgccggcgccggcgcgggcaggggccgcgcgcggttcgtcttcgcgggcgcgggctgccacggcggcggcggcggcatggatgaggccgccatcgccgcgctgccgcggagggaggcggccgcgggggacccgcccgcggactgcgccgtctgcatcgccgaggtcgccgcgggggaggccgcccgcgtgctgccccggtgcggccacgcgttccacgtcgagtgcgtcgacatgtggctgcgctcccactccacctgcccgctctgccgctgcgcggtcgtcgacgaggaggcggccgtgccggcggcggcggcggcccccgaggccgacccggagtcgcccaacttccccaccaacgtcctcttcgtcggctcccaggacgccgtcagcacccgcggcgcgccggcggagcctccccaggcggcgcgccagccgccggcggtgcccgcgcaggcgccgcatctgattccagggcccatcgccggagtcgcggccgtcgtggaggcggcaagggtagccgccctacgccggctgctgggctgcggcggcgcgacgccgtctccaccgacgccacctcagcagcaagaccgcgacttggaggccgggctcggcggcggcgagagcagcgggtccccgccgccggcgaagccgcagtaagcttctggtttgatgctcgcttgttgcgttcctcatgttcctcgtcttctcggactatttgaggcatcagaagaaggaagcaagtgtgcagaggatctgttgatctgtaatcaacagctacatatagtgctagaaatctacaagcaaaattcacggaaaaaaaaaaaaaaaaaaaa

SEQ ID NO: 5484 - protein, 265 aa, Panicum virgatum
  misc_feature: Ceres CLONE 1821102
  misc_feature (1)..(42): Pfam Name: zf-C3HC4 Pfam Description: Zinc finger, C3HC4 type (RING finger)
MAVTGTSAAAAATMLAAAAAIFITFVLCFYLFLCAKRYRGAAPTIGGAGAGAGRGRARFVFAGAGCHGGGGGMDEAAIAALPRREAAAGDPPADCAVCIAEVAAGEAARVLPRCGHAFHVECVDMWLRSHSTCPLCRCAVVDEEAAVPAAAAAPEADPESPNFPTNVLFVGSQDAVSTRGAPAEPPQAARQPPAVPAQAPHLIPGPIAGVAAVVEAARVAALRRLLGCGGATPSPPTPPQQQDRDLEAGLGGGESSGSPPPAKPQ

SEQ ID NO: 5485 - DNA, 1335 bp, Panicum virgatum
  misc_feature: Ceres CLONE 1821131
  misc_feature: Encodes the peptide sequence at SEQ ID NO. 5486
atcgccgagcaagcaacagccacgaaccgagaccccatcgcccgccaccgagatcaattcgagctagacaagatcacaagatcgacatggagtacgacgagcaggagtcgccggaggccgccgccggggaggagtacgccacggtcatgtccgcgccgcccaagcgccccgcggggcggaccaagttccgggagacccgccacccggtgtaccgcggcgtgcggcggcgcggccccgcggggcgctgggtctgcgaggtccgggagcccaacaagaagtcccgcatctggctcggcaccttcgccaccgccgaggccgccgcgcgcgcgcacgacgtcgccgcgctcgcgctccggggccgcgcggcctgcctcaacttcgccgactcggcgcgcctgctccgcgtcgacccggccacgctcgccacccccgaggacatccgccgcgccgccatcgagctcgccgagggctccgcgcagcaggacgccgcggtggcggtcgcctcctcgtcgtccggggccgacgcggcggcaccgatggcgatggcgatgcaccaccagcaggacgccgcgccgtacgactacgcggcaatgtacggcaacatggacttcgatcagccgtactactacgacgggattggcggcgccgccgccatcggaggcaacgactggcaggccggctggcatgtggacgcggacgacgacggtgcagccgccgcgggctgcggcagcgacatgacgctgtggagctactacgactgagtggcattggatggagcagcttcaagccggataaattcagctgctactctagagtctcaagcataggagattggaagaggagaagctgagttgataggtttttttttttccggagggatgttggatttaaattcaaagtttgtaagcgagaggagcggcaaagggcatgcaaaaaatgcacttttgccgttcttcttttgcgggaaggaataaagaaaaccaactctgcctagagttagtatttttggttttcaaaggaaggagaaaacaaatagacttattagtgcttaactcaaattttcagctagtagagttaatttttttgaaagaaaagagaaaacaaatagatctagctcatgtttcttcgtcttcttatttatttatttgatgaaggagaggaaacatatagatttagttatgcttcttttcctacgtattatttttttttccattctcgtctttgtattctcaaatagcagtagcagtgtaaacttcatgggagctgtgaaaaggaattaactacatatgtgaatgcaattcagcaatttttttttaaaaaaaaaaaaaaaaaaaa

SEQ ID NO: 5486 - protein, 224 aa, Panicum virgatum
  misc_feature: Ceres CLONE 1821131
  misc_feature (1)..(66): Pfam Name: AP2 Pfam Description: AP2 domain
  misc_feature: The sequence is a functional homolog of  SEQ ID NO 1224 in the  10/374,780 US patent application
  misc_feature: The sequence is a functional homolog of  SEQ ID NO 1229 in the  10/374,780 US patent application
  misc_feature: The sequence is a functional homolog of  SEQ ID NO 1245 in the  10/374,780 US patent application
  misc_feature: The sequence is a functional homolog of  SEQ ID NO 1413 in the  10/412,699 US patent application
  misc_feature: The sequence is a functional homolog of  SEQ ID NO 710 in the  11/435,388 US patent application
  misc_feature: The sequence is a functional homolog of  SEQ ID NO 750 in the  11/435,388 US patent application
  misc_feature: Useful for making plants with modulated growth and phenotype characteristics
MEYDEQESPEAAAGEEYATVMSAPPKRPAGRTKFRETRHPVYRGVRRRGPAGRWVCEVREPNKKSRIWLGTFATAEAAARAHDVAALALRGRAACLNFADSARLLRVDPATLATPEDIRRAAIELAEGSAQQDAAVAVASSSSGADAAAPMAMAMHHQQDAAPYDYAAMYGNMDFDQPYYYDGIGGAAAIGGNDWQAGWHVDADDDGAAAAGCGSDMTLWSYYD

SEQ ID NO: 5487 - DNA, 1078 bp, Panicum virgatum
  misc_feature: Ceres CLONE 1821143
  misc_feature: Encodes the peptide sequence at SEQ ID NO. 5488
attccccatcacctctccaacgtttgcccgagcgcgacgtgagacgacgagcggcgtcgagagcgacccgagccagcagctgccgccgccttccagttcgtgccgggatccggagatgagccaggagaacggagccaccaacgggcacctcgccgaggagcagcaggacgtcgtgatggaggtggagccgaagcgccgggcgccgcggctcaacgagcggatcctctcctcgctgtcgcggaggtccgtcgccgcgcacccctggcacgacctcgagatcggtcccgaagctccggcggtcttcaacgtggtcgtggagatcaccaaggggagcaaggtcaagtacgagctggacaagaagacggggctcatcaaggtggaccgggtcctctactcctccgtcgtgtacccgcacaactacggcttcatcccccgctcgctctgcgaggacaacgaccccatggacgtcctcgtcctcatgcaggaaccagtccttcccggcgccttcctccgggccagggcgatcggcctcatgcctatgatagatcagggcgagaaggacgacaagatcatagccgtctgcgccgacgatcccgagtaccgccactacaacgacatcagcgagctatcccctcaccgcctccaggagattcggcgcttcttcgaagactacaaaaagaacgagaacaaggaggtcgccgtcaacgagttcctccccgctgaagctgcccgcgaagccatccagtactccatggatctgtacgggcagtacattatgcagaccttgaggcggtagagcgtgaccgctttttccctctccctaccgaatcttatgcgagctgaagcaaaagcaccataacatcggaacatttggaatctgatgagcagccaagtcacatgagttgtcgtgcttgttggtcatcttttttccagagatattttagtctgtatcttgctctttattaattttctggaacttgtccacagtgtggtttgatctatgtactcctcttctacatttctcacagaacgagtaaataaaattaatagtgtatcagaaaaaaaaaaaaaaaaaaaa

SEQ ID NO: 5488 - protein, 226 aa, Panicum virgatum
  misc_feature: Ceres CLONE 1821143
  misc_feature: Great-hit functional homolog of the protein sequence given in SEQ ID NO 9627
  misc_feature (1)..(155): Pfam Name: Pyrophosphatase Pfam Description: Inorganic pyrophosphatase
  misc_feature (12)..(226): SWISSPROT Homolog: EC 3.6.1.1 Soluble inorganic pyrophosphatase
  misc_feature: Useful for making plants with modulated nitrogen use efficiency
MSQENGATNGHLAEEQQDVVMEVEPKRRAPRLNERILSSLSRRSVAAHPWHDLEIGPEAPAVFNVVVEITKGSKVKYELDKKTGLIKVDRVLYSSVVYPHNYGFIPRSLCEDNDPMDVLVLMQEPVLPGAFLRARAIGLMPMIDQGEKDDKIIAVCADDPEYRHYNDISELSPHRLQEIRRFFEDYKKNENKEVAVNEFLPAEAAREAIQYSMDLYGQYIMQTLRR

SEQ ID NO: 5489 - DNA, 1302 bp, Panicum virgatum
  misc_feature: Ceres CLONE 1821162
  misc_feature: Encodes the peptide sequence at SEQ ID NO. 5490
ggcaacaacgtggctgtcgtcttggctaggcaccgtaccaatggaggagggcgccgcggggagggcgaggccgccggcggtgtgcgtgaccggcgcggggggattcgtgggctcctggctcgtccagcgcctcctcgccgccggccggtacactgtccacggcaccgtccgcgatcccggcgacgccaagaacgcgcacctggcggcgctgggcgccgccgccggggagcggctgcggctgttcagggccgacgtgctggactacggcgccgtggcggcggccgtcgccggctgcgacggcgtcttccacgtcgcctccccagtccccgtccacgccatcactgaccccgaggtcgagctgctcgctcccgccgtgacgggcaccgcgaacgtgctcagggcgtgctccgaggcccaggtcaggagggtcgtcgtggtgtcgtctctctcggccgtgatggtgaaccctgcctggccgcagagccaggccatggacgaagcctgctggtctgacgtcgagctctgcagatccactcagaactggtattgcctctccaagaccctggcagagctcgaggcattcgaccacgccaagagcaccgggctggacgtggtgtcgctctgcccgtccctggtgatcgggcccctgctgcagtccacactgaacgcgagcagctccgtcatcgccgactgcctgaaaggggatcgcgaggtgaagcttaagctgaggaacttcgtggacgtccgcgacgtcgccgacgcgctgctcctggtgtacgaggcgccggaggcgtcggggaggtacatctgcgatgcgcacgcgaagcaggtgtccgacgtcgtggagctgctgaggagctggtacccggcttgcaagaatgccagcagcaagtttgtgcaggtgagcgatgagccttttttcagctccaagaagctggaggcgctggggtggaaattcaggccgtttgaggagaccctcagggacagcgtcgaatccttcagggaggcaggtgtcctggattgaacaagcagcgcactatcgtggatcaaagtagttttgtgctacatcaaagcagcagcgtcgaaacctttggcttgagaattggaatgggcagtgtgaaaaatcataagggacaaagtttgtcggtgtaatatggcgatatagttacttgcaatgctctagtttcagaattcataatccttaatacttttgaagctgatgaaaatgttgtgacaccttatctaatttggatggaccaacaggctcaagattgttgcgtgcaaaaaaaaaaaaaaaaaaaa

SEQ ID NO: 5490 - protein, 327 aa, Panicum virgatum
  misc_feature: Ceres CLONE 1821162
  misc_feature: Great-hit functional homolog of the protein sequence encoded by LOCUS At2g33600
  misc_feature: Great-hit functional homolog of the protein sequence given in SEQ ID NO 9628
  misc_feature (1)..(242): Pfam Name: Epimerase Pfam Description: NAD dependent epimerase/dehydratase family
  misc_feature: Useful for making plants with altered Lignin content
  misc_feature: Useful for making plants with altered cell wall content and/or composition
MEEGAAGRARPPAVCVTGAGGFVGSWLVQRLLAAGRYTVHGTVRDPGDAKNAHLAALGAAAGERLRLFRADVLDYGAVAAAVAGCDGVFHVASPVPVHAITDPEVELLAPAVTGTANVLRACSEAQVRRVVVVSSLSAVMVNPAWPQSQAMDEACWSDVELCRSTQNWYCLSKTLAELEAFDHAKSTGLDVVSLCPSLVIGPLLQSTLNASSSVIADCLKGDREVKLKLRNFVDVRDVADALLLVYEAPEASGRYICDAHAKQVSDVVELLRSWYPACKNASSKFVQVSDEPFFSSKKLEALGWKFRPFEETLRDSVESFREAGVLD

SEQ ID NO: 5491 - DNA, 1511 bp, Panicum virgatum
  misc_feature: Ceres CLONE 1821191
  misc_feature: Encodes the peptide sequence at SEQ ID NO. 5492
acaccaatcatcgccggcctcgattctctccggtcactgcctggtcagggttcttgtttccttgcgtagatcgatcacgatcaggacgtgagttccgagcgatggcgaagccgagcgtgggcgtctcggaagtgggggtctcggcggcggcggcgcaggcggcgtgcccctgccccgggacgctgttcccgtacccgccgccgcgcggcgccgggatcgccgcctccgtgcggcgcaagtgcctgcaggtggagctcggcggcggggcggcggggctgctgggcggcgcctggggcgtcgagtcgatgcgcgcgtcgtcgcccacgcacgccaaggccgtggcggccctcgccggcggcgtggacgacgagcgcgcggcgtggatggtgcggcacccgtcggcgctgggcaagttcgagcagatcgtggcggcgtccgagggcaagcgcatcgtgatgttcctggactacgacggcaccctgtcgcccatcgtggacgaccccgacgccgccttcatgagcgagacgatgaggatggccgtgcgcagcgtcgccaagcacttcccgacggcgatcgtgagcggccggtgccgcgacaaggtgttcgagttcgtgaagctggcggagctctactacgcggggagccacggcatggacatcaagggcccggccaaggcctcttcccggcacgcaaaggccaaggcgaagggcggaggagtcctgttccaaccggcgagcgagttcctgccgatgatccaggaggtgcacgagcgcctggccgagacgacgcgctgcatcccgggggccaaggtggagaacaacaagttctgcgtctccgtccacttcagatgcgtcgacgaaaagatgtggggcgagctgtcggaggcggtgaagggcgtgctgcgggggtacccgaggctgcggctgacgcaggggcggatggtgctggaggtgcggcccaccatgaagtgggacaagggccgggcgctcgagtttctgctcgagtcgctgggcttcgccgactgcgccaacgtcctgcccgtctacatcggcgacgaccgcaccgacgaggacgccttcaaggccctgcggcggcgggggcagggcgtgggcatcctcgtctccaagcaccccaaggagacgaccgccaactactcgctccgggagcccgccgaggtcatggagttcctgctgcgcctcgtcgagtggaagcgactctccaggaccagcctcaggctcaggctgcaatgacgacgactcttcttgcactataccctgcaggacgtacaatgcggcgcggatcgatgcaactcaaagctgattaattgcgtgattggaattggatctaacactgattgttgcacttgtaccatctcgatctcgtggagtgcgagagctctgttttcctctccattcttcttttttccccagggccggaacgggtgtatgtacattctgtagttgatgatattatacctacaagaggaattatacgtgtcccgttaccattcc

SEQ ID NO: 5492 - protein, 382 aa, Panicum virgatum
  misc_feature: Ceres CLONE 1821191
  misc_feature (1)..(236): Pfam Name: Trehalose_PPase Pfam Description: Trehalose-phosphatase
MAKPSVGVSEVGVSAAAAQAACPCPGTLFPYPPPRGAGIAASVRRKCLQVELGGGAAGLLGGAWGVESMRASSPTHAKAVAALAGGVDDERAAWMVRHPSALGKFEQIVAASEGKRIVMFLDYDGTLSPIVDDPDAAFMSETMRMAVRSVAKHFPTAIVSGRCRDKVFEFVKLAELYYAGSHGMDIKGPAKASSRHAKAKAKGGGVLFQPASEFLPMIQEVHERLAETTRCIPGAKVENNKFCVSVHFRCVDEKMWGELSEAVKGVLRGYPRLRLTQGRMVLEVRPTMKWDKGRALEFLLESLGFADCANVLPVYIGDDRTDEDAFKALRRRGQGVGILVSKHPKETTANYSLREPAEVMEFLLRLVEWKRLSRTSLRLRLQ

SEQ ID NO: 5493 - DNA, 1295 bp, Panicum virgatum
  misc_feature: Ceres CLONE 1821199
  misc_feature: Encodes the peptide sequence at SEQ ID NO. 5494
agaacgggagcggcgaggtcgagctcctactgaggctgcgtgaggccgagagcccgcccgagatcaatttcggcaataattgcagctcgagcaggcaaatcatatacagcttgggtgagaggtgagaagagagaagcgagggtgagatcgaccggccgatcgggagggcaggccatggggcgcgggaaggtgctgctgcagcggatcgagaacaagatcagccggcaggtgacgttcgccaagcgccggaacggcctgctcaagaaggcctacgagctctccatcctctgcgacgccgaggtcgcgctcgtcctcttctcccacgctggccgcctctaccagttctcatcctcctccaatctgcttaaaactttggagaggtaccagaggtacatctatgcttctgctgatgctgcagcgccgtctagtgatgagatgcagaataactatcaagaatatatgaagttgaagacaagagttgaggctttacaacgctcgcaaaggaatcttctgggtgaagacctggctccacttaccaccagtgaacttgaccagcttgagagtcaagtagacaagaccttgaagcaaatcagatcaagaaagactcaagtgctacttgatgaactctgcgacttgaagagaaaggaacatatgctccaagatgccaacatggtcctgaaaagaaagctggacgaggtcgaggcagaggcgcctcctcgcccacagccacagctgccgtggcagggcggcagcggtgatggcaccatggtgtcggacggccctccacagccagagcacttctttcaggccctggagagcaacccatctctgcagccaacgttccataccatggacatgaaccagcagccggtgccagcgccgggcggctcctactctcctgcgtggtcggcgtggatggcatagccagtgctttattgttgcattggccggagaagtgattgtgtcctccagagattcctacgagttccgtttctgcttttgctccccaatttgctcggcttccagcgcttgccgaaatgtaagtgacaacttaaaatagccctgtatagattgctgtccttatctaagttggtctctgctcagctgcttcattaagaggtgtgacgatgcatgataagagaaaaatggttgaacttcctatgttttggattctacattgcttgacaataagcactgtcatgttggactgctagactgcccatcgtttgacaatatttgtctttttttttcaaaatataatgcgtttggactgccaaaaaaaaaaaaaaaaaaaa

SEQ ID NO: 5494 - protein, 249 aa, Panicum virgatum
  misc_feature: Ceres CLONE 1821199
  misc_feature: Great-hit functional homolog of the protein sequence given in SEQ ID NO 9754
  misc_feature: Useful for making plants with modulated biomass
  misc_feature: Useful for making plants with modulated flowering time
  misc_feature: The plant flowers significantly earllier than wild-type.
  misc_feature: The plant is abnormally small.
MGRGKVLLQRIENKISRQVTFAKRRNGLLKKAYELSILCDAEVALVLFSHAGRLYQFSSSSNLLKTLERYQRYIYASADAAAPSSDEMQNNYQEYMKLKTRVEALQRSQRNLLGEDLAPLTTSELDQLESQVDKTLKQIRSRKTQVLLDELCDLKRKEHMLQDANMVLKRKLDEVEAEAPPRPQPQLPWQGGSGDGTMVSDGPPQPEHFFQALESNPSLQPTFHTMDMNQQPVPAPGGSYSPAWSAWMA

SEQ ID NO: 5495 - DNA, 1147 bp, Panicum virgatum
  misc_feature: Ceres CLONE 1821253
  misc_feature: Encodes the peptide sequence at SEQ ID NO. 5496
accgaagcactccagctagtccggcgcagggtctccctctgttccgccgctgttgttcgaccaggccaccggcggcggcgcgcccatagtatccggcaatgtcggcgcaggcggggacagggacgtactccccggcggctgccgcgggggacaagcggcgggagaagagggaggagctgcggcgccacctcgccgaggatgccaactggccccgcgccgacggacgctccttccacgactgccggccagcgtttatgcaaacagggccaactacggctgcatcagggtctgcttatgcggaatttgggaagacaaaggtcattgtatcagtgtttgggccaagagaaagtaagaaagcaatgctgtacagtgatgtcggtaggctcaattgcaacatgggctatacaacatttgccactccagtgcgtggacagggagcagacaacaaagagtactcatcaatgcttcataaagctttggaaggcgcagtaatgctacacacttttccaaagaccactgttgatgtttttgccttggttcttgagtctggtggcagtgatctacccatcattatatcatgtgctagtcttgcactggcagatgctggaatcatgatgtatgaccttgttacatctgtatccgtgtcttgttttggaaagaacatcatcatcgatccaacctcagatgaggaagcatggcaagatggaagcctcgtggtagctttcatgccagcccgcaaggagatcacccaactcacactcactggagagtggagtgatggcaaaatcaccaatgcggtagagctctgcatggatgcttgcagtaagcttggtgacatactgcgcgaccgcttgaaggatactgccactttgacaagcgaatgacattgttgaggcaacacttgcaccaacatccttagctgtacaaaaaaattgtaggcaagggaggttgatagtccagatgcttgagtgagcatacatggttatggtgattggctgattatttccatcatggcaaaagagtgaactttcaaaccgggaagaagttgcagggcggtgttatcatgtaatgtactcctgacctctatcgaaccttttggttttcatgaatcgcctgcatttttcctcaaaaaaaaaaaaaaaaaaaa

SEQ ID NO: 5496 - protein, 261 aa, Panicum virgatum
  misc_feature: Ceres CLONE 1821253
  misc_feature (1)..(126): Pfam Name: RNase_PH Pfam Description: 3' exoribonuclease family, domain 1
MSAQAGTGTYSPAAAAGDKRREKREELRRHLAEDANWPRADGRSFHDCRPAFMQTGPTTAASGSAYAEFGKTKVIVSVFGPRESKKAMLYSDVGRLNCNMGYTTFATPVRGQGADNKEYSSMLHKALEGAVMLHTFPKTTVDVFALVLESGGSDLPIIISCASLALADAGIMMYDLVTSVSVSCFGKNIIIDPTSDEEAWQDGSLVVAFMPARKEITQLTLTGEWSDGKITNAVELCMDACSKLGDILRDRLKDTATLTSE

SEQ ID NO: 5497 - DNA, 1355 bp, Panicum virgatum
  misc_feature: Ceres CLONE 1821311
  misc_feature: Encodes the peptide sequence at SEQ ID NO. 5498
gcggagaacccccggtacctgtccgaatttcagccgccgcccgcccgccttcgcgcacgcccacgggctctcttctctccccacctcgccccgcgcctcgtcacctctccgatctctctcttctctctccatctcgtttcccccgcctgcgcagccagcaaaccctagcccgcaagcgcccacctgcgaaccccgaatccccgaggttccccgggagcggagattggagctgccgcgcaaggatcggaagagcgggagcagcggcgccttacgtggatcgtggttgctcggcggcggcggcgcggagatggaccggaagcgcatcaaggacgcgctcgggaagcacctcgagaagtcgtcgccgtcgacctccaggggcgtcgcggccaaggtgagggagcgcctcgttcccgggaagctgccggcgttgctcggcaaggccgggaagttttccgatgttgaggaatccgaatctgacagtgaagattctgatgtcagtggttctgagggcgaggacacatcttggatcgcatggttctgtagcttgcgaggcaatgaattcttctgcgagattgatgatgattacatacaggatgatttcaacctgtgtggtctgagtaatcaagtgccatattatgattatgcacttgatctcatcttagacattgagtcttctaatggcgacgtgttcactgaggagcaaaatgaattgatcgagtcatctgcagagatgctgtatggattaattcatgcacgatacatcttaacaagcaagggtctagctgcaatgttggaaaagttcaagaactatgacttcggtagatgccccagagtgtactgctgtggtcagccctgccttccagcaggacagacagatattcctagatcgagcacagtgaaaatatattgtccgaaatgtgaagaacttcactatccaagatccaagcaccaaggcaacatagatggagcgtacttcgggactacattccctcatcttttcctgatgacatacccacacttgaagccgcagaagccgtcacagcaatacaccccaagagtcttcggcttcaaacttcacaagaagtcatgacagagctgtacatccagcagaagcacccttttacctaggttttagggagagcactgtggcccccaaatgttgtggccttttcatgtaccaattcgcgagcttgggtcttgctgtaaactgatgtggaattgtacctgcttcctgatattactattctgtaaccttaggttctctctctctctcgctcgctcacttgatcacagtatgtctttatgcatggtttcaggtaattttacacgaagtagaaaaaaaaaaaaaaaaaaaa

SEQ ID NO: 5498 - protein, 260 aa, Panicum virgatum
  misc_feature: Ceres CLONE 1821311
  misc_feature (1)..(175): Pfam Name: CK_II_beta Pfam Description: Casein kinase II regulatory subunit
MDRKRIKDALGKHLEKSSPSTSRGVAAKVRERLVPGKLPALLGKAGKFSDVEESESDSEDSDVSGSEGEDTSWIAWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQTDIPRSSTVKIYCPKCEELHYPRSKHQGNIDGAYFGTTFPHLFLMTYPHLKPQKPSQQYTPRVFGFKLHKKS

SEQ ID NO: 5499 - DNA, 1034 bp, Panicum virgatum
  misc_feature: Ceres CLONE 1821350
  misc_feature: Encodes the peptide sequence at SEQ ID NO. 5500
gtccctcctctcctctctcaccgtcgcggcagccagcgccgcctgtctccgttctccccctcccaccgaccgcgaggaagatgagcggtggctcgaggagggtcctggaggcgtggaggctcggggtggtcaggtacggcgacgcgctcaggctccaggagcgtctcgtcgcggaccgcaaggccggccgcgtcggcgacctcgtgctgtcgctgcagcacccgccgacctacaccctcggcaagcggcgcgacaaggccgagcgcaacctgctcgccacggaggccgagctgagcgccctgggcgccgagctccaccgcacggagcggggcggcgacgtcaccttccacgggccgcggcaggccgtgctgtacccgatcctctcgctccgccccctggggctcggcgcgcggaggtacgtcgaggggctcgaggccacgatgatccaggcggcggcgctccacgccgtggccgcgcggcggggggaccccggggagaccggcgtgtgggtcggggaccgcaagatcggcgccatcggggtcaggatctcgtccgggttcacgtggcacgggctggccttcaacatcgaccccgatctcgggtacttcgagcacatcgtgccgtgcggcatcgccggcaaaggggtcacatcgctgcggcgggaggtgccggacagagtggagcttccagccgacgaggccatccatgacgagcttgtccggtgcctggggagaactttgggcttcaccgatgtggaattcaaggacgattctgagtgtggaggcatgactggtgcagctcaagatgcagcagcttcacaatcctgacgcactctgcaatcggcatccttcagaatgtcttcggatcaatttttggaatatttttcatgcgattgtgctcaaggtattcctagtgtatgtacgatagatggtagcaagctttagtttactgcaaatctgcagctagacagcttgtacattgcttaatggaattaggcacaaatctgtttgtattaaaaaaaaaaaaaaaaaaaa

SEQ ID NO: 5500 - protein, 248 aa, Panicum virgatum
  misc_feature: Ceres CLONE 1821350
  misc_feature (1)..(91): Pfam Name: BPL_LipA_LipB Pfam Description: Biotin/lipoate A/B protein ligase family
MSGGSRRVLEAWRLGVVRYGDALRLQERLVADRKAGRVGDLVLSLQHPPTYTLGKRRDKAERNLLATEAELSALGAELHRTERGGDVTFHGPRQAVLYPILSLRPLGLGARRYVEGLEATMIQAAALHAVAARRGDPGETGVWVGDRKIGAIGVRISSGFTWHGLAFNIDPDLGYFEHIVPCGIAGKGVTSLRREVPDRVELPADEAIHDELVRCLGRTLGFTDVEFKDDSECGGMTGAAQDAAASQS

SEQ ID NO: 5501 - DNA, 1246 bp, Panicum virgatum
  misc_feature: Ceres CLONE 1821386
  misc_feature: Encodes the peptide sequence at SEQ ID NO. 5502
ggcttctcgcgtcgcggaatcgaagaagcaaacggcggagcagagcagagccctcgaatccagccgcgtcgcatcgtatcgtttgggcctgtcccgtcctgggctcgattcgaggtagtttttgggagggaaggtcatcggatcaagcctcttgatcaccatggtgcctagagatagggcgcatggcgccgccggcccccctacggaaaacctcgttcaagggcctatcttgaacaacaagtgtgaaaagaaggctccaaagaaagtgcataaatctgagagggagaaacgaaagcgagataaacagaatgatctgtttggtgagcttggaaacatgctagaacctgataggcagaacaacgggaaggcatgcatattgagtgacactacacgtatgcttaaagatctactttcacaagtagaatctcttcgacaggagaatggcgcactgaagaatgaatctcgttatgttgcattggagagaaatgaactactggatgaaaacaacatgatccgcaatgaagtctcagaactgcaaaatgagctgaggatgcggatggaaggcaaccctatctggagtcatgatgcgactagatcaaatcttacagcgcctcatcccgccaccacagtatttgcactgcagcattcaccacatccaccagtcattgcaacgatggcaccccctctgcaacaactagcagtccttgagcaatcttatactgccccacggcgcgagctacagctcttccctgaagctgcatccactgaagataccgaaccaccacaggaccaggggatctccaatcatgtggcgcggccgcaggcaaggtacccaacaagaatggccactttgcctgcacatgtatatccaatccttccaagaatggaagatgagcaatgtagcagtggcactactggtagtggagatgaaagtggcataggcaaccattaacagttcgaatacagaatgaaacatgtggttacaacctgaaaagtttcttagttgtatcttgctagtgtaggtagtgtctaaagaaacctgtgcgtccgtgtgcctgcgtccgtgtgcctgcgcgtgtaaatatcgttccattctgtatcagctgaacttaatcttcaactagttactttgatgggagagaaaccgatctttttagtttgttgtgtcatacctaacaggcagaagtccaaagagtaaacgctcaataatagaaaacatgttaatcaaaaaaaaaaaaaaaaaaaa

SEQ ID NO: 5502 - protein, 263 aa, Panicum virgatum
  misc_feature: Ceres CLONE 1821386
  misc_feature (1)..(51): Pfam Name: HLH Pfam Description: Helix-loop-helix DNA-binding domain
  misc_feature: The sequence is a functional homolog of  SEQ ID NO 1185 in the  11/479,226 US patent application
  misc_feature: The sequence is a functional homolog of  SEQ ID NO 532 in the  10/412,699 US patent application
  misc_feature: Useful for making plants with modulated growth and phenotype characteristics
MVPRDRAHGAAGPPTENLVQGPILNNKCEKKAPKKVHKSEREKRKRDKQNDLFGELGNMLEPDRQNNGKACILSDTTRMLKDLLSQVESLRQENGALKNESRYVALERNELLDENNMIRNEVSELQNELRMRMEGNPIWSHDATRSNLTAPHPATTVFALQHSPHPPVIATMAPPLQQLAVLEQSYTAPRRELQLFPEAASTEDTEPPQDQGISNHVARPQARYPTRMATLPAHVYPILPRMEDEQCSSGTTGSGDESGIGNH

SEQ ID NO: 5503 - DNA, 1271 bp, Panicum virgatum
  misc_feature: Ceres CLONE 1821402
  misc_feature: Encodes the peptide sequence at SEQ ID NO. 5504
atcggccgcatcgcggaattcgaattcgaactcgattcctcccctctcgctctccgcccgcaccccaaccccacggcggctaccgggtgctcggagatgcagcagaggccggaggacgccatggaggaggtcgagcccgaggcggcggcggcgccggagctagggttctggctcgcggcgcggcggcggctcgcccccgacgaccccttcttcgccgccggggacctcgagcgcgagctcctcgccaagcacgtggccttggatctctcggaagatgaccggagccagcttgagaagatggaagtagccagcacgtgtactgtgttttgcccaattgctggttgcggtgcccatctagattgtttggaggactttgaggaccactatgtcactcgacatactgcttcatgctctgtatgttcaagagtatatccaacttcaaggttgctaagcattcatgtgtctgaggcacatgactcatatttccaagcaaaagttgcccgtggttttccaatgtacgagtgtttggtggagggttgtggggtgaagttgaagagttacaaaagtcggcagcagcacctcattgataagcatcaattccccaagtcattcgagttcttcaaaaaggcacggccctcccagaggcaacggcagaaatcccagaggaggcaaactgctcacaagggagaagagacaagggataactcgatggatgtagatgggaaaggcacgaggcaaactaactggaggtatcggccaaagcagcatgaccacaaagagttgaaagagaatgagtctcagcataaggaggctaaggaaaacgaaatggaggtcgaacagaagatcgacgagctgacttcagccgtgtcaaaactgagcacagcagattccacccctgcaaacatcacttttggccaccgtcgctctcgtggtcttacatttgttccgaggtcaatcaggcagaacaagccggcggcctcccagccagaagggaaatgacaaatacgccatttggtctttcgatggttccagaatggcagaatccgggtaattttgtatgggtgtttgatcttggatttgtattgttgcgtggactggtttccactaattatacatggatcacgaggcggcaatcgttttcttcccttgtatccagaactcagaaaatgtgttatgctgaaaaaaaaactcgagaatgtgaatggccattgccgacctgcagtgacccccaaaatgggtaggctgggctttaaaaaaaaaaaaaaaaaaaa

SEQ ID NO: 5504 - protein, 300 aa, Panicum virgatum
  misc_feature: Ceres CLONE 1821402
  misc_feature: Great-hit functional homolog of the protein sequence given in SEQ ID NO 9698
  misc_feature: Useful for making plants with altered alkaloid content
MQQRPEDAMEEVEPEAAAAPELGFWLAARRRLAPDDPFFAAGDLERELLAKHVALDLSEDDRSQLEKMEVASTCTVFCPIAGCGAHLDCLEDFEDHYVTRHTASCSVCSRVYPTSRLLSIHVSEAHDSYFQAKVARGFPMYECLVEGCGVKLKSYKSRQQHLIDKHQFPKSFEFFKKARPSQRQRQKSQRRQTAHKGEETRDNSMDVDGKGTRQTNWRYRPKQHDHKELKENESQHKEAKENEMEVEQKIDELTSAVSKLSTADSTPANITFGHRRSRGLTFVPRSIRQNKPAASQPEGK

SEQ ID NO: 5505 - DNA, 1581 bp, Panicum virgatum
  misc_feature: Ceres CLONE 1821482
  misc_feature: Encodes the peptide sequence at SEQ ID NO. 5506
gatgcgcttgcgcggccgtccaaaaacgtgacgacccgtcgcgcgcggcgcgcctaggatatgctcgtgagggaatgacccgcgaccacacggggcccggggattggcgggcgccgcgcccagatctccccggatggggcgtgtgcggctgccggggccgcatcgtgtgctcgccaaattctcccgtctccgttctccccctcgacgccagcagctaccagcctacgcagctgctgctaccttatcccccccgctggcctcatctcggcagctactacttacccctcctgctgtgctgccccgggcgctcctctgctcgactgctcccgttggcttcttcttccccacctcgcttccactcgcttgccgctccctccgatcaccggctgccccgtgctgagctcttctactacgcaggtcagcctctcgtgccatggcgtattcgcgtttcactgttcgaattcttctcgtaagccatatgcttttttggtttgctcttgtgcttgctacgatcaataatagttctgcgttctgcagataggtcaattagtttttttcgcagctcgatcactgctgcaagtgagcgaatccggccgattggcctcgcgtaaccttcgtgcgcaattgcaagttgctatacgtttgagttggtccaggcttgcgcagatgcttggatacgtctggttcgacgcagtttactgatgttggaatgcgttcgtgcagagcgatgaacatcttgaaccagcccatcaaccccggcggccacccggtgttcccggcggccaaggaggccggccacctcacgccggcgtcggtgcgcttcgacggcgtgccggcgcagcccagcacggtagccgcggggcgctccagcgcgcagtacccgagatggcaggcgcagacgctgcgccgggccagcagctacgtcggcgccgaccacgacggggccaccgcggccgcgggcccggagcccgccccgttcaagccgccgacgctcgacttcctgcggtcgctcctggacaggagtagctgcagcgtgagctccgccttggcgggcggcgaggccagcgccccgccgccgcagctgctcgcgctgcgggtggtcgtgtcctccgcggtggagctggacgcgcgccagaccgagctcatcgcgcgcaagatgcgccggctcaccgggttcgtgaacctcacggtcgagaacgtcgtggacccgtccctgatcgccggcttcgtcatctgctacggcaccgacgactcccacgtcatcgacctcagcgtcaagggccagctcgccgcgctcaagaaccgcgtcgactccatcgaccagaccgcccacgggcacccgcacccctgtatccctgatcaaccgaactacaccgtgctacaagcctatagcagcactactatccccgtgatcatgacactatttatacaaccgaacgccatgctaacaacagttttccgatctaatgttgttgtaaatcgcgagaaacttagctactccctccctgctgagcctatatacatgtttgtatgctacacgaagtgttactgtatatgaagaatgccgaaacagcggcttct

SEQ ID NO: 5506 - protein, 282 aa, Panicum virgatum
  misc_feature: Ceres CLONE 1821482
  misc_feature (1)..(73): Pfam Name: OSCP Pfam Description: ATP synthase delta (OSCP) subunit
MRSCRAMNILNQPINPGGHPVFPAAKEAGHLTPASVRFDGVPAQPSTVAAGRSSAQYPRWQAQTLRRASSYVGADHDGATAAAGPEPAPFKPPTLDFLRSLLDRSSCSVSSALAGGEASAPPPQLLALRVVVSSAVELDARQTELIARKMRRLTGFVNLTVENVVDPSLIAGFVICYGTDDSHVIDLSVKGQLAALKNRVDSIDQTAHGHPHPCIPDQPNYTVLQAYSSTTIPVIMTLFIQPNAMLTTVFRSNVVVNREKLSYSLPAEPIYMFVCYTKCYCI

SEQ ID NO: 5507 - DNA, 1471 bp, Panicum virgatum
  misc_feature: Ceres CLONE 1821523
  misc_feature: Encodes the peptide sequence at SEQ ID NO. 5508
atttttctcacccgcttccttccctttccccgctgcctgccgataagaagctccctcgccgtctcctctccctctttctccgtcctcgcaaaatcctccccgtattgagagccaagaaagtaaacgagccgaggcataaaggccgggagctggcgagggaagcgagaaaatttttcttcccggggaggaaatcgggacggccacgggtcaaaatcgtctcctcctcgcaagcaagcctcggctccggttggtggtggtggtgcactgctggtgctgctgtccgagacgagagcgggtagaggagaccacgagctcgagaggagggaaagggggaaggagcttggcagaaggcaccagacgcgtgaagaagctccgagcgaggaatcgaatcgagccatggactcggagcactggatctcgcgcctcgccgccgccaagcggtactacgcagcccagctcggccacatcgacgatatgccggggatgggggtggaggaggtggagatggagatggaggacgacggggacgtggagatggagctggagctcggggacgcgacgtggccggaggtcgcctgcccttactgctacgaggaccacgacgtcgcctccctttgcgtccatctcgaggaggaccacccgtacgagccccacgccgcgccctgccccatttgctcccaaaggattacaagagatatgcttaaccatatcaccatgcaacatggttacttgttcaagaacggtcacaggtctcgcagatatattattcctgagagccatggaatctctttattgagccgagatctacgtggtactcatttacaggctcttctagggggtggtcatagccacagatcaagtagcacagcgaccacaaacatttccagtgatcctcttctatcatcatttggccttagcttctcaacatcagatgcaccagaaccatcaaaatcaacagcttctatcccagatggtgcctcagcacgaaaggagacaccagctcagccttgggaatcaagtattgactcatctctcacgagcgaagaaagggaacaaaagcggaaacaggccaccgacagagcaacctttgtgcaaggcctggtgctctcaactctattcggagactgagtgttcaaacagccataggttggttgctagatgggcgcttactcctgcctggtccgcatagtctgatagtactccaccagggttggtgggtctaactctgatggcaggagaatgcacctggaaactctagccgcgttcttctttgtttcagtagagtgcggagttgattcgttcatgatacagcttactttaagctagctgttgtacctttcttttatcaatttaccagccagcaatcccataactgtaactcattggtacattgtgtctgtaccgacatataacagctgtaacatttactctatacaatgcaaatgatggcacttgtatgagagcagttgcc

SEQ ID NO: 5508 - protein, 243 aa, Panicum virgatum
  misc_feature: Ceres CLONE 1821523
  misc_feature (1)..(205): Pfam Name: Di19 Pfam Description: Drought induced 19 protein (Di19)
MDSEHWISRLAAAKRYYAAQLGHIDDMPGMGVEEVEMEMEDDGDVEMELELGDATWPEVACPYCYEDHDVASLCVHLEEDHPYEPHAAPCPICSQRITRDMLNHITMQHGYLFKNGHRSRRYIIPESHGISLLSRDLRGTHLQALLGGGHSHRSSSTATTNISSDPLLSSFGLSFSTSDAPEPSKSTASIPDGASARKETPAQPWESSIDSSLTSEEREQKRKQATDRATFVQGLVLSTLFGD

SEQ ID NO: 5509 - DNA, 1467 bp, Panicum virgatum
  misc_feature: Ceres CLONE 1821529
  misc_feature: Encodes the peptide sequence at SEQ ID NO. 5510
aaaccacctagctcaacggccacaaaattaaatcttgtcaaggaacagcatggatgttgttctagctcggtgccacctccgccatgccgtcggggcgctcctcgccgccgagttcctgctctccgccgccgtcagggcgcaggatgaaacaggccaatatacttgagctcgatcgatcgaaagcatgctggcgtcaataatgtcttcttcaatcagtcgtggtcccacaccatgcgtgctcgtgctcgtgcacctatccatatccactatgcatgcatagtagtacttcctctatttcaaatgattaattttggattttctgttcaaattattagttttcgattttctagatacatattttttctatgcatatatataatgtttagatgcatagtaaaattaatatatctagaaaagttaaaatgattaataatttagaaaagttaaattaatatataatgtttggtggttaattgcagacaacgagcgcgagttcagctacaaccggagcgcgccgaacgggccggatcgctggggcgagatcaagccgtcgtgggccaactgcagccgcggccggatgcagtcgcccatcgacctctccaacgccaggccggagcgctccctcggcttcctcaactactcctaccgccccgcccaggccaccatcgtcaaccgcggccacgacatcgcggtgatgttcaagggcgacgccgggagcctggtgatcaacggcacggcgtaccacctgcggcagctgcactggcacacgcccagcgagcacaccgtcggcggccgccgctacgacatggagctgcacctggtgcacgagtccgcggcgaacaaggccgccgtgatcggcgtcctctacaaggtcggccaccccgaccggttcctgcagacgctggagcccgccatcaggctcatcaaggagacgcgggacatggaggtgcccatcggggtggtcgacccaagcggcgcccgcgccaccggcagcgtgtactaccgctacatgggctccctcaccacgccgccctgcaccgagggggtcgtctggaccgtcttccagaaggctcgccacgtggccaagtaccagctggagcttctcagggatgcggtggatgacggagaacgcgaggccacttcaggatgtgaacggcagagacatcagcgtcttccggccgaagccctgtgtactgggtaaacagtactactagatggtgatgcatgggctgatcgatcgacagggataccacagtagtgtgtggtagcttgttatgcatcttggtagacggcgaacatgtcttgtgcttctctctacttatgtgtcttggctgtagcaggactaaataaaacacggggtcatttatgttctcaatttctcattgattgacctcgcatgcatgctcagaagaaaataataatttacgtgtccatcatgttgacgcggaaaaaaaaaaaaaaaaaaaa

SEQ ID NO: 5510 - protein, 207 aa, Panicum virgatum
  misc_feature: Ceres CLONE 1821529
  misc_feature (25)..(208): Pfam Name: Carb_anhydrase Pfam Description: Eukaryotic-type carbonic anhydrase
MQSPIDLSNARPERSLGFLNYSYRPAQATIVNRGHDIAVMFKGDAGSLVINGTAYHLRQLHWHTPSEHTVGGRRYDMELHLVHESAANKAAVIGVLYKVGHPDRFLQTLEPAIRLIKETRDMEVPIGVVDPSGARATGSVYYRYMGSLTTPPCTEGVVWTVFQKARHVAKYQLELLRDAVDDGEREATSGCERQRHQRLPAEALCTG

SEQ ID NO: 5511 - DNA, 1840 bp, Panicum virgatum
  misc_feature: Ceres CLONE 1821559
  misc_feature: Encodes the peptide sequence at SEQ ID NO. 5512
agccagccagtcccaccacaccactggcacccacccagcaccaaattagctacgtagtagggatgaccaccaggcctgcagcagaggggggcgccgccgccgccgccgccgctgccgacaataagcagctcgtccccacctccaacggcaccgtccgcaaggccccctccaaggaccgccacagcaaggtcgacggccggggccgccgcatccgcatgcccatcatctgcgccgctcgcgtcttccagctcacccgcgagctcggccacaagtctgacggccagaccatcgagtggctgctccgccaggccgagccctccatcatcgccgccaccggcaccggcaccaccccggcctccttctccacctcctcgccatcctccctccgctcctcctcccagaccacgccaaccgccgccgcgcccttcatcctcggcaagcgcgcccgcgacgacgccggcgccgacgccgagcccacggtcgccgcccccgccccgggattctgggcgctgccggggcgggcagacttgggccagctctggagcttcgccgcagcgccggagatgatggtggccgcggccgccacgccggccatggcgggggaggcgtccgcagcccgggtcgggaactacctacccatggcgcagggcaacctcaacctgctcgcctacttctccggcgggccagctccaacggccacagccggacgggcggaggaggagagcgcacgctgaacgttgccttgtttcataggctccgccatcggctcaccacatctatctagggttttccaccttttatttatcaggtttttcttccttgagacttgttgctcctcctccccctcggtttgctttccttcattccttccttggcgtcgctgctcatctctcattccttgtgtgtgtgtgtgtgtgcaagtgtcactcggctcagctcatttctggtttcctctctggagtaccaggagctcacttctggtttcctctctagagtaccaggaggctgcagaattgggtggccttgagcaagagcacctgcaaaattgctccacctacctcactcgagtcctcagctcacccaccccatgacctggttttattcgtgtaggaagaaggtatagccgcttgctcagtgccgtaggtcgtctcttgttttgtgtcactacacccctggttgcagtgcagcatccacagctcagggtgatcgggagcaggcaaatgttgtcctgggagattgggaggtgtgcgcgtgggataaaattctagtcagtcagtgtgctgttgctgtcaaaactcctttcctggggggtgggctgttccaacaagaagaaaagaaaacttcctctctgttctgttggacaagcaagggaaatggcgtcaaattgtcgtccatctctgcagcaggcagcaggcagcaggcagcaggtgtatcwgctcagctcagctccctccctcccatgtgcctcacaaagcagagaggggaagaagaggaaggaaggaaaaagaccttttcttaccacaaacaaacaaacaaacaaacaaaggaggcttgggcctggctgtaagttgtccacttggtctgctgatctgctctgtctgcttgcttgctgtcattttgattgttgccttttgtgctcttatctggattcgattagtagtcataatactgcttctgcacctgcttgctggggatattgagagcaataactagtctgctagtcctcaattgttggtagctcagttcagctcttatgtatatatatgtatgcatgtatatgtatctatgtacggattgtttgttgatcaggtcaagaattaatggacgaaaataaggacgg

SEQ ID NO: 5512 - protein, 223 aa, Panicum virgatum
  misc_feature: Ceres CLONE 1821559
  misc_feature: The sequence is a functional homolog of  SEQ ID NO 2782 in the  10/374,780 US patent application
  misc_feature: The sequence is a functional homolog of  SEQ ID NO 680 in the  10/225,066 US patent application
  misc_feature: Useful for making plants with modulated growth and phenotype characteristics
MTTRPAAEGGAAAAAAAADNKQLVPTSNGTVRKAPSKDRHSKVDGRGRRIRMPIICAARVFQLTRELGHKSDGQTIEWLLRQAEPSIIAATGTGTTPASFSTSSPSSLRSSSQTTPTAAAPFILGKRARDDAGADAEPTVAAPAPGFWALPGRADLGQLWSFAAAPEMMVAAAATPAMAGEASAARVGNYLPMAQGNLNLLAYFSGGPAPTATAGRAEEESAR

SEQ ID NO: 5513 - DNA, 1719 bp, Panicum virgatum
  misc_feature: Ceres CLONE 1821572
  misc_feature: Encodes the peptide sequence at SEQ ID NO. 5514
gtgagcttatcggagacaattgaagcttgggcgatcaaccatgggcgccacgctaccaggcttgctctctgcgcttgtgctgcttctcctcccggcttccctcctccgtgtccgagaccaccacctcagccggccagaggcggagggcggcctgcacccggtcgtgctgatccccggcctgtcctgccccgacctggaggcgcggctaaccgacgcctaccggccctccatgccggccggctgcagccgggaggaggggcggtggttcgggctgctgacgaaccgcacctgggagctggaccccgagcacgccgcctgcttcgtcgaccagatgcgcctcgtctacgaccccatcttcagcgacttccgtaaccttcccggcgtcgagacgcgcgtccccggctttggctccgcccgcggcttcggctccaagattccaacacacccgtaaagctagttttaatgggaattttataatattaaacatcattaattttactgacatgacaaaaaaagaaatacgagattttatgggatgtgaggatatgaaacaaatctgacataattatctaattttcagtttaaataattgtgtcaatggaactctcacggagagtgcacgcaaagtagctagctaattattacatcatttggttgcagggagttttgtttggaagcactgaggtctgcactggaaagcagcagacttggctaccgcgagggagaaaccctcttcggagctccctacgacccgcggtacgctcccccgatgcccggccaggcgtcccaagtctactcccgctacttccgccggctggcgacgctcatcgaggacgtgagtaggaggaacaacggcaggcccgctatcgtcctcggccacagcttcggcggtgcggtggcgctcgagttcgtcaggaacgccccgctccaatggcggggcaccttcgtcaagcgcctcgtcacggtggcaccagcgtggtccgggggctacgtcctccccctgatggccttcgcctcgggcccggtagggtttctcttcgtcccggcagctccgcagctggccatgcgatccatgtggaggaccttcgagactgccctggcgaacctgccgtccccggcggtgttcgggcgccggccactggtgataaccaggatccggaattactcggcccacgacatcgccgacctgatcgttgcggccgccggttccgccgacggcgtccgcccgttcagagaccgcgagctcccgaagatggactacttggaggcgcccatggtgccgtggaccagtatcgttggggtgggtatcccgacgccggagcagctgatttactgggacggcgacttcgataggcagcctcaagtggtgcacggcgacggcgacggtatcatcaatctcgctagcatgctggcgttggaggacaaggtgggtaagcagcccggtcaaaaggagcgcttcaaatccatcaagtttcctggggttccacactctgcattagtcacggatgaacgggcgctcagcgtactcatggatgaaattgtacaggcaaatcatcgctaggctcaaaattaaaggactattattatctcattttttcgcgaaattattatctcgtactgtatatattaattatgattgttacatggtgtgcatgcactgtgcagtttgttcaataataaagaagctttaattttatataaaaaaaaaaaaaaaaaaaa

SEQ ID NO: 5514 - protein, 263 aa, Panicum virgatum
  misc_feature: Ceres CLONE 1821572
  misc_feature (22)..(266): Pfam Name: LACT Pfam Description: Lecithin:cholesterol acyltransferase
MPGQASQVYSRYFRRLATLIEDVSRRNNGRPAIVLGHSFGGAVALEFVRNAPLQWRGTFVKRLVTVAPAWSGGYVLPLMAFASGPVGFLFVPAAPQLAMRSMWRTFETALANLPSPAVFGRRPLVITRIRNYSAHDIADLIVAAAGSADGVRPFRDRELPKMDYLEAPMVPWTSIVGVGIPTPEQLIYWDGDFDRQPQVVHGDGDGIINLASMLALEDKVGKQPGQKERFKSIKFPGVPHSALVTDERALSVLMDEIVQANHR

SEQ ID NO: 5515 - DNA, 1293 bp, Panicum virgatum
  misc_feature: Ceres CLONE 1821585
  misc_feature: Encodes the peptide sequence at SEQ ID NO. 5516
gagggcgggaggggaggcaacctgacgcagacacgctgccgatacgcggaacggtgggagagtagaaacggagagtgaccgcatgccatgccgcgaatccttctcctctgcctctttctcctcgcccactcggcggcggatggggaggctcggttcggaggtggagtgctgcttccgctgcgggtgcaggcggcgtcgcttgcgccgcaggcgccggcgaacaagctccggttccgccacgacgtgagcctgaccgtgtcggtggccgtgggcacgccgccgcagaacgtcacgatggtgctcgacaccggcagcgagctctcctggctgctctgcaacgggaccggcgcgccgcggcccgcggcggcgttcgacgcgcccgcttcgtccacgtacgccgcggtccactgccggtcgccggagtgccagtggcgcgggcgcgacctccccgtcccgccgttctgcgccgcgccgccgtccgactcctgccgcgtctcgctcgcctacgcggacgcctcgtccgccgacggcgtcctggccgccgacgcgttcctcctcggcggcgcgccgcccgtggccgcgctcttcggctgcatcacctcctactactccgccacgggcggcggtagcaacggcaccgactcctcggacgccgcgacgggcctcctcggcatgaaccgcggcagcctgtccttcgtgacgcagacggacacccgccgcttcgcctactgcatcgccccgggcgacgggcccggcctcctcgtcctcggcggcgacggcctcgccctggcgccgccgctgaactacacgccgctcgtcgagatcccgcagccgctgccgtacttcgaccgcgtggcctactccgtgcagctggagggcatccgcgtgggcgccgcgctgctgcccatcccgaaatccgtgctcacgccggaccacacgggcgcggggcagaccatggtggactcgggcacccagttcacgttcctcctcggcgacgcctacgcggcgctcaaggccgagttcgcgaaccggacgcgcgcgctcctggccccgctcggcgagccgggcttcgtgttccagggcgcgttcgacgcgtgcttccgcgcgccggaggcccgggtggccgcggcgctcccgcggctcccggaggtgggcctcgtcctgcgcggcgcggaggtggcggtcgccggggagaggctcctgtacagggtgccctgtgaagcgcccctacccgaagatcaaggctaaaccatgtattaactaccgaataaagtctccggcataatacatatt

SEQ ID NO: 5516 - protein, 386 aa, Panicum virgatum
  misc_feature: Ceres CLONE 1821585
  misc_feature (2)..(325): Pfam Name: Asp Pfam Description: Eukaryotic aspartyl protease
MPRILLLCLFLLAHSAADGEARFGGGVLLPLRVQAASLAPQAPANKLRFRHDVSLTVSVAVGTPPQNVTMVLDTGSELSWLLCNGTGAPRPAAAFDAPASSTYAAVHCRSPECQWRGRDLPVPPFCAAPPSDSCRVSLAYADASSADGVLAADAFLLGGAPPVAALFGCITSYYSATGGGSNGTDSSDAATGLLGMNRGSLSFVTQTDTRRFAYCIAPGDGPGLLVLGGDGLALAPPLNYTPLVEIPQPLPYFDRVAYSVQLEGIRVGAALLPIPKSVLTPDHTGAGQTMVDSGTQFTFLLGDAYAALKAEFANRTRALLAPLGEPGFVFQGAFDACFRAPEARVAAALPRLPEVGLVLRGAEVAVAGERLLYRVPCEAPLPEDQG

SEQ ID NO: 5517 - DNA, 1880 bp, Panicum virgatum
  misc_feature: Ceres CLONE 1821594
  misc_feature: Encodes the peptide sequence at SEQ ID NO. 5518
atgatgcgtatctcgctataaaagggcccttgttcaatcaaccagcaggaaccggcactgattgaagaaccacacgcggagaaaggggggagaccaagaacaagcaagccatggagctcaatcaagcagacgaggttctatcttctccgcttgctccaaatgcaaaggacaatctcagcatgatgcactcaaagtttatctgctgcaagctctacatttctgaaagctgcaatcccacagctattgccgcaattgatcttgcagcaaagactgatcctcaggttgcggtgctaagcaagttcgaagatagcctctacaaccgcgtacgctacacacttgtctcctatattatcgatgacagctcaaccggtgaagtgatatatagtccaatcaggaaggtattgttggcgatgatggaggctgcattttcagccataaaccttgaattgcactccggtgctcatcctagaatgggtgtcaatgatgacctgtccttccaccccctgggtcaagccacaatggaggatgcagcttccttggctaagcagctggcttctgacattggcaatgattttcaagtgccagtgttcctctatgcagcagcccatcccacaggcaagtctgtaggtgcaatacggcgtgagctcggctactaccggccaaatcacatgggcaaccagtggtcaggggccacaacagttggcgcgacaccttttcttgagggatacaatgtgccagtgctctcaaaggatgttgcaactgtgaggcggattactcgaagattaagcggacgcggtggagggcttccgactgtgcaagctcttgcgcttctccatggtgatgattgcacagagatcgcatgcttgttggatccagatcatgtcagtgcctatcaagttcagaccgtggttgagcagattgcagcagagcaagggctcgaagttgagaaggggtacttcactgacttgactaaggacaggatgcttgacaagtacttgaagataactgctgattgatatgaatgtaatagaactttgtgtgactgactaacccagatgaatcatgcatgtttgtaattgcaagcatgctgctcgttaaaaaaaaggagatcactcacaagcttaaacacttcctcctcattgcttcggccctcttgcagcagctgctccgtgcccagtttcaagcagcagcatccgatttgcctggatgtgccaaggttacacagcagcaagaagaagcgcatcctgaggtgttcctccagccttgctgatggtccatccaccgttggttcttcagtaagatgggttcttgaccctgcaggcgacggcgattggcgccacatcggctacaaagttgcacgccccggcgcgttcgagatagcctccgatgcggtgaccgttggtcgggtcgctgacaaagctgacatcgtcctccccattgccacagtttctggcacgcacgctcggctggagaagaaagacgggaggctgctggtgacggacctgggcagcaccaacggaacctacatcaacgagcggcgccttaaccctggcttcgcaattcccattgaccccggcagcctactcatctttggtgacatccacctggcgatgtttcgtgtgaggaagatgatagttgaggtgcccagcgagacggataaaacccaacaagaaaccaagaccgaggtagtatcagctgcagttgaagatactacaagctagcaagctctgatgtgttcctagtgccccactagctactagtagaatgttcggaataaaaacctacacggtcatggactcattgtggccgcgttatgacggtttcagcaagaaccaggaattatgaagtaacaaaggcaccaaaaaaaaaaaaaaaaaaaa

SEQ ID NO: 5518 - protein, 301 aa, Panicum virgatum
  misc_feature: Ceres CLONE 1821594
  misc_feature (1)..(166): Pfam Name: FTCD_N Pfam Description: Formiminotransferase domain, N-terminal subdomain
MELNQADEVLSSPLAPNAKDNLSMMHSKFICCKLYISESCNPTAIAAIDLAAKTDPQVAVLSKFEDSLYNRVRYTLVSYIIDDSSTGEVIYSPIRKVLLAMMEAAFSAINLELHSGAHPRMGVNDDLSFHPLGQATMEDAASLAKQLASDIGNDFQVPVFLYAAAHPTGKSVGAIRRELGYYRPNHMGNQWSGATTVGATPFLEGYNVPVLSKDVATVRRITRRLSGRGGGLPTVQALALLHGDDCTEIACLLDPDHVSAYQVQTVVEQIAAEQGLEVEKGYFTDLTKDRMLDKYLKITAD

SEQ ID NO: 5519 - DNA, 1378 bp, Panicum virgatum
  misc_feature: Ceres CLONE 1821628
  misc_feature: Encodes the peptide sequence at SEQ ID NO. 5520
gtcaacggaggttgcgcaacggataacccgccgggccgccccttaaacccatgccgctcctcgccgccgccgcctcggcggtcgcgccgcctccatccctacgagtgggtcccctcatatccctccgcactcccaggaccggagccctagccctgactgtcgcccgctgcgctccctccccttcggccccggcagccgcggaggcgcctgcgccgccgcaggaggccaagccgaagccgcggcggtacccgaggcagtaccccggcgaggcggtgggcgtcgccgaggagatgcggttcgtcgcgatgcggctccgcaaccccaagcgcaccaccatcaaggacgagccgcgggcggagacggaggcctcggatgcgtcggaggacgacgacgacgatgacgatggcggcgtgaaggaggagcacgagaaggaggaggagggcgagctccaggaaggggagtggatgccgagcatggaggggttcgtgcggtacctggtggacagcaagcttgtcttcgacaccatcgagcgggtcgtcgccgagtccaccgatgtcgcctatgtttacttcaggaaaagtggtttggagcgttcagcccgcatttcaaaagatttggagtggttcaacgaacaagggattgcaattccagagccgagtactttaggaacaacttatgcaacttatctgactgaactggctgagagcaacgcccctggattcctctcacattattacaatatctattttgcacatataactggaggtgtggcagtaggcaaaaagatcagcaagaaaattctggacggaagggtgttggagttttacaaatgggacactgatgctgagcttctgctgaaagatgctagggataagcttaatgaacttagcaagcactggactcggaaggatagaaacttgtgcttaaaagaagctgctaaatgcttccagtacctgggaaagatggtccggttaatcatctcatgagccattatggctggtagacaagcctagttaatctaatctcactgcatgcattagcagatgtattctagaagtctggaaaagctagagatcttagtatcagtggaggcttatatagcgcacttctgagaaggcatgcaaggcaacatccttaccagctaaataacatgtcagaagtctgaagggtcctttggtgctagagatggaagctggtcagtgagcactacatgatggacgtccaaaatccaaatggcaggccaccccggtttctttttttggcgtttagtttccaaaaacgaaaaattttgggtgtcccatcaatgtttgaccagatgtcgggaaggcttttcgaacactaattaaaaaactaatttcaaaaaaaaaaaaaaaaaaaa

SEQ ID NO: 5520 - protein, 311 aa, Panicum virgatum
  misc_feature: Ceres CLONE 1821628
  misc_feature (1)..(180): Pfam Name: Heme_oxygenase Pfam Description: Heme oxygenase
MPLLAAAASAVAPPPSLRVGPLISLRTPRTGALALTVARCAPSPSAPAAAEAPAPPQEAKPKPRRYPRQYPGEAVGVAEEMRFVAMRLRNPKRTTIKDEPRAETEASDASEDDDDDDDGGVKEEHEKEEEGELQEGEWMPSMEGFVRYLVDSKLVFDTIERVVAESTDVAYVYFRKSGLERSARISKDLEWFNEQGIAIPEPSTLGTTYATYLTELAESNAPGFLSHYYNIYFAHITGGVAVGKKISKKILDGRVLEFYKWDTDAELLLKDARDKLNELSKHWTRKDRNLCLKEAAKCFQYLGKMVRLIIS

SEQ ID NO: 5521 - DNA, 1712 bp, Panicum virgatum
  misc_feature: Ceres CLONE 1821646
  misc_feature: Encodes the peptide sequence at SEQ ID NO. 5522
gccactgacatttagcagaagaccggcccagggccagcatcaatctcggcggcggcggcggcggcggaatggcgaaggtcagcgagtccgcggcgaagtctgcgtccaccgcggcccctcctccccctcccgcttccgcgccgccttcgaggccgaaggcgaagcaccggctggaggttgaggggtaccccgtggagggcgtctccatcggcggccaggagacctgcgtcatcttccccacgctgagcctcgccttcgacatcggccggtgcccgcagcgcgccgtttcgcaggagttcctcttcgtctcccacgggcacctcgaccacatcgggggcctccccatgtacgtggccacacgggggctcttcaggctgcgcccgcccaccatcttcgtcccggcgtgcctccgggacctcgtggagcggctcttcgaggtgcaccgcgccatagaccagtccgagctcaagcacaacctggtccccctcgaggtcggggaggagtacgagttcaggagggacctcaaggtcagggctttcaggacctaccacgtcatacccagccaggggtatgtgatatactcggtgaagcagaagctcaagcaggagttcattggcctcccggggagcgagatcaagcggctcaagttatcaggtgtggagatcacgaatacagtgtcgacccctgaaattgctttcacgggagatacaacatcagatttcattcttgatccagataatgcagacgtgctggcagcaaaaattcttgttgtggagagtacttttctagatgactccattcctgttgagcatgcaagagaatatgggcacacacacttatttgagatagcaagccagtctgacaagcttggaaacaaagctattctactcattcacttttctgctcgttatactacagaggaaattgatgcagcaataaacagattgccaccgtcattccgaagcagagtttatgcgttgaaggaaggcttctaaagaaacatgaacggacaaatccgcaatgacattttctggatgtcattgcggatgctactgcagcaatcatctgggcatctggcaaatgagtatggagaccgagggcactgcatccaaccacaccggactagaaatggcatgactatcatagcttggcttgcaaatgagcttcctcatgaaacagaaccaatatgcatgaatcgaagacatgtgcaacagaatcagcaacgttaacgaatggcatggatcacagaaccagtcacagatttgtcttcacaatgctactttacctctgaggtgacttctaagcagtctgaagttgtctaagaattactgatgtccaaactcttagcgattctgatgcgcacagctcggccagccagatcttcgttgtgtgttgccaacttttgaggaagagtcgtctgtatggagtcttgacaggttgcctgtaaagttgaagaggatcatgcatgaagccatcaagtggaaacaggattagttccactgaagcctcaggtagaaaaatgagcttaggtttgtacatacttcaattacattttcagtctagacactgaacttagaaagctgtcatacagtgatgctagcgatcctgaaatgtggggataaggtcgatcgataagccgtagtccgtggatctccgtataaagcttacccagtaatggtgccatttatgccgaaaaaaaaaaaaaaaaaaaa

SEQ ID NO: 5522 - protein, 308 aa, Panicum virgatum
  misc_feature: Ceres CLONE 1821646
  misc_feature: Great-hit functional homolog of the protein sequence given in SEQ ID NO 9726
  misc_feature (32)..(308): SWISSPROT Homolog: EC 3.1.26.11 Nuclear ribonuclease Z
  misc_feature (35)..(308): SWISSPROT Homolog: EC 3.1.26.11 Ribonuclease Z, chloroplast precursor
  misc_feature: Useful for biocontainment applications
  misc_feature: Useful for making plants with modulated time to senescence
  misc_feature: The plant produces a reduced number of seeds.
  misc_feature: The plant senesces significantly earlier than wild-type.
MAKVSESAAKSASTAAPPPPPASAPPSRPKAKHRLEVEGYPVEGVSIGGQETCVIFPTLSLAFDIGRCPQRAVSQEFLFVSHGHLDHIGGLPMYVATRGLFRLRPPTIFVPACLRDLVERLFEVHRAIDQSELKHNLVPLEVGEEYEFRRDLKVRAFRTYHVIPSQGYVIYSVKQKLKQEFIGLPGSEIKRLKLSGVEITNTVSTPEIAFTGDTTSDFILDPDNADVLAAKILVVESTFLDDSIPVEHAREYGHTHLFEIASQSDKLGNKAILLIHFSARYTTEEIDAAINRLPPSFRSRVYALKEGF

SEQ ID NO: 5523 - DNA, 1056 bp, Panicum virgatum
  misc_feature: Ceres CLONE 1821650
  misc_feature: Encodes the peptide sequence at SEQ ID NO. 5524
aactccatccccaacccaaagtcagcggctgacgcggacgccggcgagccgcgccgccggaggacccccgcctcctgcccagcacaccgccggccgccgcagccatgtgctccgtccacttcttccccgccgcctcccagacccgggtcccggcccgcctcctcaagccctctgcaaagccaccgttcccgtccccccgcgtcgtgtccaccgccgccttccaccacggcggcggcggcggcaatgcacatgcgtggcgccgcccgcacctctggctgcggcgggtggtacgcgcccccgcggctcccgccgaagcgccgcccgtgggccccgacggcgggagcgggggcggcggcgcggggggaggcggcggcggggaggacgaggaggaggagggggagaggaaggagaagggcctgctgcccgagtggatgaacgtgaccacggaggacgccaagacggtgctggccgcggtggccatctcgctcgccttccgctccttcgtcgccgagccgcgcttcatcccctcgctctccatgttccccaccttcgacatcggcgaccgcatcgtcgccgagaaggttacttactacttcagaaaaccatgtgtaaatgacatagtaattttcaaaagcccgccagtgctacaggaggttggatatactgataatgatgttttcatcaaaagagtagttgcgaaggggggcgatgttgttgaggttcatgaaggaaaacttgttgtgaatggtgaggctagaaaggaagaatttattcttgagccaccttcttatgacatgaatccagtggtaatttttttagatgctaatcaatgacacttgaactcaatgcatacattttgtatgtttttcccagtcagatttatgcatgtaatataaatggcacaccaatgttttgttggactacggaccccctgcagttgctgtgtatctgctgctgtttgttacaagaatttatgtcataagaccctagttgacaatatatcttgacaaattctataaaagattagcattttgtcaaaaaaaaaaaaaaaaaaaa

SEQ ID NO: 5524 - protein, 242 aa, Panicum virgatum
  misc_feature: Ceres CLONE 1821650
  misc_feature (1)..(78): Pfam Name: Peptidase_S24 Pfam Description: Peptidase S24-like
MCSVHFFPAASQTRVPARLLKPSAKPPFPSPRVVSTAAFHHGGGGGNAHAWRRPHLWLRRVVRAPAAPAEAPPVGPDGGSGGGGAGGGGGGEDEEEEGERKEKGLLPEWMNVTTEDAKTVLAAVAISLAFRSFVAEPRFIPSLSMFPTFDIGDRIVAEKVTYYFRKPCVNDIVIFKSPPVLQEVGYTDNDVFIKRVVAKGGDVVEVHEGKLVVNGEARKEEFILEPPSYDMNPVVIFLDANQ

SEQ ID NO: 5525 - DNA, 1569 bp, Panicum virgatum
  misc_feature: Ceres CLONE 1821654
  misc_feature: Encodes the peptide sequence at SEQ ID NO. 5526
gcccaaacatgtcattcctccccctcttgcggagcgagcgcccccgcaacgcctcctccggccgtcccgtccccggaggtaaacgcccgcctcctcctccggccgtctccgtgggcggccgtaccccgccacgatgaacggcatcaagtcggctctcctctccggccaacgccgtcaccccctcgtcgcggcggcggcggccccgcatcagcagctgggaggcgccgcgtcgttccactccacccccgtcctgcagcggaagcgcaagacgcagtggcacaacagattcaactattacacaaaacgtcggaggaatagagaaaataaaagatcgatggtacggaatatgtcggagtatgcagagtacctcttccagagttggcgggatgaagaggagagaactgatgcatctagtggaccttcatggtttagaggacatcgttgggttagaaattcaaataacaatggtttctgtacacatgatttctattacggaaatttcaaaagcagaggaggatttgagttttgctcgagtgatgaggatgaaccagagattctgtttcgtaatgcttttagagaccagcacacatattattggtctttttcctctgataattttcagtggaggaactccagacgtgctcactcagaaaaattcagaaactggagttctgaaacggatgatgaggatgaagtatccactccatcagaggtatctttggcacggcaagctcttggattgagcacctctggtccactaaaacttgaagatgttaaaagcgcataccgagcttgtgcacttagatggcacccagatcgccacaatggatcatctaaggtaagttgttcgacaggcaaagttatcttttacttgctttacaaaattatgtgcgacttctctttttctccgaacaacgtggtggacctggttgtctatggcacatgtcctgagcacatatgaggtgccactttcgggtaggattgaactgaacatcaaatagtatggctatatcagttaatgatcagacactccccccgcctgcgcgcgcgttctttatccaattagtttagggaattttgggctgcatgtccatcgttgatcatgataaggcactgtatcatctatatataactatatagcaaatacatcttcactatgtttgatcaatatggatcggtcagcagcacacctatctttacaacaaacgtggctacagcggaggagaaattcaagcattgcagtgcagcataccagaccttatgcgatagtttgactgctgcatagataattataaatgaagatcggtgctgcatgagtccctttcaaacttgtagctgcaaattctgaagagttgccatgtgcttgtggtagcccgtaccatcccaaccccaaaagtagcattgctcttggctcttggggcaattgagtcaacccaaaattgaccaaataatacgagcactgtaccatgtaaaatcatttattacagttcattgttgtatttttttagtgataggaagacattgtttataccaatcattattttatcttaaaaaaaaaaaaaaaaaaaa

SEQ ID NO: 5526 - protein, 275 aa, Panicum virgatum
  misc_feature: Ceres CLONE 1821654
  misc_feature (3)..(58): Pfam Name: DnaJ Pfam Description: DnaJ domain
MNGIKSALLSGQRRHPLVAAAAAPHQQLGGAASFHSTPVLQRKRKTQWHNRFNYYTKRRRNRENKRSMVRNMSEYAEYLFQSWRDEEERTDASSGPSWFRGHRWVRNSNNNGFCTHDFYYGNFKSRGGFEFCSSDEDEPEILFRNAFRDQHTYYWSFSSDNFQWRNSRRAHSEKFRNWSSETDDEDEVSTPSEVSLARQALGLSTSGPLKLEDVKSAYRACALRWHPDRHNGSSKVSCSTGKVIFYLLYKIMCDFSFSPNNVVDLVVYGTCPEHI

SEQ ID NO: 5527 - DNA, 1340 bp, Panicum virgatum
  misc_feature: Ceres CLONE 1821751
  misc_feature: Encodes the peptide sequence at SEQ ID NO. 5528
cggcccaccactcactctcctcgtctcctccatagcaggggggaaggaaggcgccggcgaacggaagcgggagctgctcggcggcgcgaaccccgggaattgcggacaggtggtgcgaaagggttgggggcatctttcgagtctctcccatcggctcgccggagatgctgccctacgcgacggcggcggaggcggaggcggcgctgggccgggccatgacgcccgccgaggcgctgtggttccggtacaccgcgggggtatccgactaccacctctactgcttgaacatcctcttcctcttcgtcgtcttcacgctggccccgctccccgtcgcgctcctagagctccggtcccccgccgccgtcgcgccgtacaagctgcagccccgggtgcggctctccagggcggagtttgtccgctgctacaaggacgtcctccgcatcttcttcgtcgtcatcggcccgcttcagctcgtctcctacccggccgtcaagatggtgggaattcacacgcagcttccattgccgtccctgggagagatggcggcgcagcttctggtatacttccttgttgaggactacctcaattactggatccacaggctcctccacggggagtgggggtaccagaaaatccaccgcgtccaccatgagttcacggcgcccatcggcttcgcagctccatacgcacactgggctgaggttctgatacttggtatcccctcctttgtcgggccagcaatcgctccaggccacacgatcacgttctggctctggattgtactccgccaggtggaggctatcgatacacacagcggctttgatttcccattcactctgacgaagtatattccattctatggcggagcagaataccatgactatcatcattatgtaggaggccagagccaaagcaattttgcttctgttttcacatactgtgattatctgtatgggactgatagaggttacagattccacaaggcgtacctagcaaagctgaaggatcttgggcaaaatgatggtgagaaaggagatggcaatggattcagctatacaaactcggactagattgcttgatacagtgcctccttagtgtctccatgatcgattgagttcactatggcatcacgaaatgggagatcagcctgagttgggcatcgagttcacttggcttcacgaaatgggagatcagcctgagttgggctgtgcatgtgtggtgtggtgttctgatttctgaaactggcatgccgctttcagctgcgttgccctgtgtttcccagtgtttgtgaacttctatggaacttgtatgctgaccaataaaaaaaaaaaaaaaaaaaa

SEQ ID NO: 5528 - protein, 301 aa, Panicum virgatum
  misc_feature: Ceres CLONE 1821751
  misc_feature (4)..(208): Pfam Name: Sterol_desat Pfam Description: Sterol desaturase
MLPYATAAEAEAALGRAMTPAEALWFRYTAGVSDYHLYCLNILFLFVVFTLAPLPVALLELRSPAAVAPYKLQPRVRLSRAEFVRCYKDVLRIFFVVIGPLQLVSYPAVKMVGIHTQLPLPSLGEMAAQLLVYFLVEDYLNYWIHRLLHGEWGYQKIHRVHHEFTAPIGFAAPYAHWAEVLILGIPSFVGPAIAPGHTITFWLWIVLRQVEAIDTHSGFDFPFTLTKYIPFYGGAEYHDYHHYVGGQSQSNFASVFTYCDYLYGTDRGYRFHKAYLAKLKDLGQNDGEKGDGNGFSYTNSD

SEQ ID NO: 5529 - DNA, 1344 bp, Panicum virgatum
  misc_feature: Ceres CLONE 1821767
  misc_feature: Encodes the peptide sequence at SEQ ID NO. 5530
ggcccatccagatccgtgtccatccatttttccgccacaacaagcgcttcctcctcctctcttcctgctgttgctttggtgagaatccttacctcgcctagttgcttcaacggattgccttgatgttcgtcgctgcgagccccccaatccaatttccatctgcggattgcggagtactacagtactagtggcttcaactcgactgctagtcgcaatgatggatgacggggacctcgatttctcaaacccagacacattcttgtgcccggcaattggcaacgatccgcccaccagctgctccatggacagctacttcgatgacatcttgaaggatacagagcaccacgcttgcacccacacccacacctgcaacccgccggtccacgaccattcgcacacccacacctgtgtccatgtccacaccaagattgttgcggcttcaccggatgccgctgagaccgcggaatcgccatctgagaacaacaccaccaagaagcgcccgtctggtaaccgagcagcggtgaggaagtaccgagagaagaagaaggctcacacagcgtcgttggaggatgaggtggtccacttgagggctttgaaccagcagctcatgaagaagctccagaatcacgccgcgcttgaggcggaggtagccaggcttcgctgcctgcttgttgatatcagagggaggattgagggggagattggtgctttcccttatcagaggccagccaagaacatcggtttggtgtctagtgttgaccagggaagcttccttggtggtgcccaggttaccaactcctgtgatttcagatgcaatgatcagatgtattgcaatcctggaatgcaggaggctatgagtgcgcaggtgttgggacaaggtgcctgtgatatagctaatatccaatgcatgggaagtgcaaagtctggatacacaaagctacctgtctgtgggggtgtggacccagtacctactgggtgcttgccaaatgttgaaaagaagtgaaggatggagtggtatggtctctcctttcagagactactgggtctcggcgttctgcatccaagaaacgctgtataaacttctagcttctatagtagggacgcatcttgttaaacctgtgatgtgtgagttggttgccgatgatgcttctatggtgcctgaggcaattcaagtttgttagctctgaagctgacaggacatcgtcgtttttttctttagttgccagatgctctctgatgaagttcagaactgaaccagatctgaaggagttgaactagctaaaatccgccatctgtgcttgaactcaagtttgatatgaatctatgcgaaatcagctgtctact

SEQ ID NO: 5530 - protein, 262 aa, Panicum virgatum
  misc_feature: Ceres CLONE 1821767
  misc_feature (1)..(58): Pfam Name: bZIP_2 Pfam Description: Basic region leucine zipper
  misc_feature: The sequence is a functional homolog of  SEQ ID NO 1707 in the  11/479,226 US patent application
  misc_feature: The sequence is a functional homolog of  SEQ ID NO 208 in the  10/225,068 US patent application
  misc_feature: The sequence is a functional homolog of  SEQ ID NO 2360 in the  10/374,780 US patent application
  misc_feature: The sequence is a functional homolog of  SEQ ID NO 372 in the  10/412,699 US patent application
  misc_feature: The sequence is a functional homolog of  SEQ ID NO 863 in the  11/479,226 US patent application
  misc_feature: Useful for making plants with modulated growth and phenotype characteristics
MMDDGDLDFSNPDTFLCPAIGNDPPTSCSMDSYFDDILKDTEHHACTHTHTCNPPVHDHSHTHTCVHVHTKIVAASPDAAETAESPSENNTTKKRPSGNRAAVRKYREKKKAHTASLEDEVVHLRALNQQLMKKLQNHAALEAEVARLRCLLVDIRGRIEGEIGAFPYQRPAKNIGLVSSVDQGSFLGGAQVTNSCDFRCNDQMYCNPGMQEAMSAQVLGQGACDIANIQCMGSAKSGYTKLPVCGGVDPVPTGCLPNVEKK

SEQ ID NO: 5531 - DNA, 1736 bp, Panicum virgatum
  misc_feature: Ceres CLONE 1821822
  misc_feature: Encodes the peptide sequence at SEQ ID NO. 5532
aagctagtccaaccgccaagcagccaagctccgagctccacctcctcttccactcttctctgagttcgcaacaactaaatcaaccgagcgattgctgcggcgcagcgccagattgatcagaaatggccgtacacctaccaatgtctcgaccttctcccgggctctgcgccaagccgccgcaccagcagcgcggcagcgcatcgaccgccgcggcggccgtggcagcggtgaccgcgccgccctccacgttcgctccgcagaccacgcggctgtccgcgccatccatcgcggtgaacgtcaggcacaccaagccggtcacgcaggtcgtcggcgtcttgcccgagagggcggcgaagaagaagagcgacgagactttggcgaacatgtggcgggagatccagggaggccgcgactgggccgggctcgtggagccgctgcacccgctcctccgcgccgagatcgttcggtacggcgagctcgtggcggccacgtacaaggcgttcgacctcgacgccggctccaagcggtacctcaactgcaagtacggcaagacccggatgctcgaggcggttggcatggctggcactggctacgccgtcacgaggtacatctacgcggcgccggacatcgccctccccggagcggcggggccgtgcccgagccggtggatcggctacgtggcggtcgcgtccgacgacgcggcgcggcggctcggacgccgcgacatcgtcgtgtcgttccggggcaccgtcaccgggtcggagtgggtggccaacatgatgagctccctcgagccggcgaggtttgacccggcggacgcccgcccggacgtcaaggtcgagtcggggttcctctccgtctacacctctgacgatgccacctgcaggttcacatgcgggagctgccggaaccagctcctctcggaggtgacacggctcatcaacaaatacaagcacgaggagatcagcatcacgctggccggccacagcatgggcagctcccttgccctcctgctcggctacgatctcgccgagctcgggctcaaccgtgacggcaacggcaacaccgtgccgaccacagtctactccttcgctggcccgagggtcggcaacacggggttcaagaaccggtgcgacgagctcggcgtgaaggtgctaagggtggtgaacgtcaatgatcctatcaccaagttgcccggcattttcttgaacgagaactctagggttttgggagggaggttggagctcccatggagctgtgcgtgctacactcatgttggcgtcgagcttgccctggatttcttcaaagcaagagatcctgcttgtgtgcatgatctggaggcctacttagggttgctcaagtaccctaagattgcaaaggtgaaaaaggacggggaggatcttataagcaaggccaagaagtttgtgcttcaacaaaattttgatacttggaggtggcaaatggccgcaatccaagttggtgagttggtacaagccatgggcatgtaggttgatacagggttcgttttcattcccatgattttttagggatatgaaacttagatgcccttggaaattcattctttttgtcagaaaatgagatagggtagagaggaaattagacaaaagaccggttattgtaaatgaaagataaagattccaagtgatactgatattagctaatatataaactctgtcacaaatactattttgttacaaaaaaaaaaaaaaaaaaaa

SEQ ID NO: 5532 - protein, 461 aa, Panicum virgatum
  misc_feature: Ceres CLONE 1821822
  misc_feature (1)..(160): Pfam Name: Lipase_3 Pfam Description: Lipase (class 3)
MAVHLPMSRPSPGLCAKPPHQQRGSASTAAAAVAAVTAPPSTFAPQTTRLSAPSIAVNVRHTKPVTQVVGVLPERAAKKKSDETLANMWREIQGGRDWAGLVEPLHPLLRAEIVRYGELVAATYKAFDLDAGSKRYLNCKYGKTRMLEAVGMAGTGYAVTRYIYAAPDIALPGAAGPCPSRWIGYVAVASDDAARRLGRRDIVVSFRGTVTGSEWVANMMSSLEPARFDPADARPDVKVESGFLSVYTSDDATCRFTCGSCRNQLLSEVTRLINKYKHEEISITLAGHSMGSSLALLLGYDLAELGLNRDGNGNTVPTTVYSFAGPRVGNTGFKNRCDELGVKVLRVVNVNDPITKLPGIFLNENSRVLGGRLELPWSCACYTHVGVELALDFFKARDPACVHDLEAYLGLLKYPKIAKVKKDGEDLISKAKKFVLQQNFDTWRWQMAAIQVGELVQAMGM

SEQ ID NO: 5533 - DNA, 1219 bp, Panicum virgatum
  misc_feature: Ceres CLONE 1821835
  misc_feature: Encodes the peptide sequence at SEQ ID NO. 5534
atatcgtcgggtttcagaaaacaggagctcgatcagcagtttcaagaacaaggggacgagggagaaaacatctgccgaggatgacagaaccggcaccggcggcgtggttcgtcttcttcttcctgattttcgtcggcggcgtttccgccgcggcgttctcgttccgcctcctcgcctacctcgcgctctgcctgagccggccaaaggacctgcgccgccggtacggcgcgtgggccgtggtcaccggcccgacgtccggcatcggccggtccgtggcgctggagctcgcgggccgcggcctcaacctcgtcctcctcgacctcgacgccgccaacctccaggagacctccgacgtgatcaagtctcgccacggcgtgaagaccaggaccgtggtgttcgacctctcgctcgtcggcacccctcaaggtgacgagtcgatgcggcggctccgggcggcgatcgagggcctggacgtcggcgtgctggtgaacaacgccggtgtggggaggccggcgttggcgtacctgcacgaggccgacgtggaggcgtgggtgaggatggtacgggtgaacctgtgggcgctgacggaggtcacggccgccgtcctgccggggatggtggagcgcggccggggcgccgtactgaacatgggctcggcgtcgtcggaggccatcccctccttcccactcaacaccatctacgccgccactaaacggtacgtttctaagttctcgaggagcctttacgtcgagtatagaagcaaagggattgatgtgcagtgccaggccccgttcttcgtggcgaccaggctggtgcccagcgccgtgctggacaactggctctcgccgttcatccccacgccggacgcctacgcccgcgcggcggttcgctggatcgggcacggcccgctctgcacccccgccgtcggccaccagctcctgtggtgcctcgccggcgtcctgccggacgccgcgcacgactggctccgcctgcgcgagcacctgcggttcagagcgctgttccagagagagagggcggcgatggcgtcggcagctgatcggggagagaaaacgacgcacgccaaaaaatgagtttttttttttagtttggctaataatgtgcttgcttggcctgccggaactgatgtggttcctacggttcaccccaaactgtgtgcatcatgaagctgtacgtggttcaaaaaaaaaaaaaaaaaaaa

SEQ ID NO: 5534 - protein, 336 aa, Panicum virgatum
  misc_feature: Ceres CLONE 1821835
  misc_feature (1)..(179): Pfam Name: adh_short Pfam Description: short chain dehydrogenase
MTEPAPAAWFVFFFLIFVGGVSAAAFSFRLLAYLALCLSRPKDLRRRYGAWAVVTGPTSGIGRSVALELAGRGLNLVLLDLDAANLQETSDVIKSRHGVKTRTVVFDLSLVGTPQGDESMRRLRAAIEGLDVGVLVNNAGVGRPALAYLHEADVEAWVRMVRVNLWALTEVTAAVLPGMVERGRGAVLNMGSASSEAIPSFPLNTIYAATKRYVSKFSRSLYVEYRSKGIDVQCQAPFFVATRLVPSAVLDNWLSPFIPTPDAYARAAVRWIGHGPLCTPAVGHQLLWCLAGVLPDAAHDWLRLREHLRFRALFQRERAAMASAADRGEKTTHAKK

SEQ ID NO: 5535 - DNA, 1101 bp, Panicum virgatum
  misc_feature: Ceres CLONE 1821840
  misc_feature: Encodes the peptide sequence at SEQ ID NO. 5536
accgaccgcccccgaccccgtatccccccaattccggacgcgacagtggaaccctagccgcctccggccatcccccgccggccccggcgatccccccgctatggcctccccggagggcaccacgtgggtcttcgactgccccctcatggacgatctcgccgtcgccgccgacttcgccgcggcccccgcggggggattcttctggtcggcgccgccgcccatgcagccgctgggagcgcaggcgccgatgcaggccgtcgcggccgcgccggctcctagtccctgtgtggaaatcagtggctctgtagactgtgatcagggaaaagaacagacaacaaataaacgtcctaggtcagaaagtacagcacaaccaagcactaaagcatgcagggagaagattagaagggacaagctgaacgagagattcctagaattgggtgccatcttggagccagggaagactcctaaaatggacaaatcagctatattgaatgatgctattcgtgtagtaggagaactgcgtagtgaagcaaaaaagctgaaggattcaaatgagagtctccaagagaagatcaaagagttgaaggccgagaagaatgagctgcgggacgagaaacaaaggctgaaggccgagaaagagagcctggagcagcagatcaagttcctgaactcccgcccaagcctggtaccgcaccctcctgtgatcccagcctctgccttcgccgctccccaagggccggcagctgctagtcacaagctgatgatgcctgtgattggctaccctgggttcccgatgtggcagttcatgccagcttctgatgttgacacctcaaatgaccccaagtcttgccctcctgtcgcataagcaagctaaaggtggaaagaggcgatgccgccctccattgattcaagtctagctcggtctgcagtgttattggtgtagttgactccagaacttggaaggttatatgtgtgtctgtcagctcgtgacatgggtggtctgatggcaccgttgtatattatatggtaaataaataaattccgtcacttaaatcaaatgagaattctatgccgtagaactaaaaaaaaaaaaaaaaaaaa

SEQ ID NO: 5536 - protein, 254 aa, Panicum virgatum
  misc_feature: Ceres CLONE 1821840
  misc_feature (1)..(52): Pfam Name: HLH Pfam Description: Helix-loop-helix DNA-binding domain
  misc_feature: The sequence is a functional homolog of  SEQ ID NO 1203 in the  11/479,226 US patent application
  misc_feature: The sequence is a functional homolog of  SEQ ID NO 2422 in the  10/374,780 US patent application
  misc_feature: The sequence is a functional homolog of  SEQ ID NO 542 in the  10/412,699 US patent application
  misc_feature: The sequence is a functional homolog of  SEQ ID NO 814 in the  10/225,066 US patent application
  misc_feature: Useful for making plants with modulated growth and phenotype characteristics
MASPEGTTWVFDCPLMDDLAVAADFAAAPAGGFFWSAPPPMQPLGAQAPMQAVAAAPAPSPCVEISGSVDCDQGKEQTTNKRPRSESTAQPSTKACREKIRRDKLNERFLELGAILEPGKTPKMDKSAILNDAIRVVGELRSEAKKLKDSNESLQEKIKELKAEKNELRDEKQRLKAEKESLEQQIKFLNSRPSLVPHPPVIPASAFAAPQGPAAASHKLMMPVIGYPGFPMWQFMPASDVDTSNDPKSCPPVA

SEQ ID NO: 5537 - DNA, 1152 bp, Panicum virgatum
  misc_feature: Ceres CLONE 1821897
  misc_feature: Encodes the peptide sequence at SEQ ID NO. 5538
aaaaaaaccctagccccaccccgccgttcgccgccgccgccgccctgccgcgcgctcacgccacctccggcgaggccgcccccgggccccggcgcagagcactcccgcccccccgtcggcgccgcgatggacatggacacgtacgagcggctgacagccgagaccaggcgccgcgggatgcgattcgatgcgctgatcgggctggacgaggtggaggggagcgacgacgaggaggagcaggaggagcggccggcgcgggccgggatggcggacgagctgccctgcccgttctgcggcgaggagctggacgccgtggggctgctgtgccacatggacgacgagcaccacgccgaggccaatgccggggtgtgcccaatttgcacagacaaggttgatgtgaacttggttagccacatgagctcacagcatcgaagtttcctgaaggataagaggagaaaccgacaaggtttatctgggtcacattatgcaacacttgcatttttgaaggaagatccacatgagaggagaagtggatcttcacgtgctgctccagtcagcacagtgcctgatcctctactgtcctcttttgttggtaacttctatgaagtagatttgccaagggatactaaggtagagtcctttgatgagacagaggtgggaagagataacttggagctgaaagcagcagagagcgttgatgagcctttgctccctgaggtcaaggaggagcggaccaggaggagccaattcgtgcaggggctcgtcttgtcgctgatatttgacgacatcttatgaagagcaacccataagccgttggagaaggcagctcttgctaccagcaaacaagccttacaccgagcacaagttgctgccgcagctgctgtaacaacttgctgatctgcaattagaagatggcgccgttgctccgggataattgggagatgaattgtggatatggatgttccttagtatatgcatcatcattgcatggacaatagagtatatgtatgtatagttcggtagcatcatttgaccagatttgttggggggccttgtatgtatattgggaggccaaattatcgccgaactggatcctatctatcataaatcagccatttgatcatgttttcgcaaaaaaaaaaaaaaaaaaaa

SEQ ID NO: 5538 - protein, 222 aa, Panicum virgatum
  misc_feature: Ceres CLONE 1821897
  misc_feature (1)..(228): Pfam Name: Di19 Pfam Description: Drought induced 19 protein (Di19)
MDMDTYERLTAETRRRGMRFDALIGLDEVEGSDDEEEQEERPARAGMADELPCPFCGEELDAVGLLCHMDDEHHAEANAGVCPICTDKVDVNLVSHMSSQHRSFLKDKRRNRQGLSGSHYATLAFLKEDPHERRSGSSRAAPVSTVPDPLLSSFVGNFYEVDLPRDTKVESFDETEVGRDNLELKAAESVDEPLLPEVKEERTRRSQFVQGLVLSLIFDDIL

SEQ ID NO: 5539 - DNA, 1052 bp, Panicum virgatum
  misc_feature: Ceres CLONE 1821916
  misc_feature: Encodes the peptide sequence at SEQ ID NO. 5540
aagctagctagctagccagcagccgaccactaccatgtccgcgccggcggttgccacggcggccgagggcgctacgcgcatcatcctggtgcacggcacgggccacggcgggtggtgctggtaccgcgtggccacgctgctccgcgcggcgggccaccgcgtggccgcgccggacctcgcggcctcgggcgccgacgcgcgccgcctccgcgacgcgcccaccttcgaggactacacgcgcccgctgctggacgcgctccgcgggctccccggcggcgagcgcgccgtcctggtcggccacagcttcggcggcatgagcgtcgcgctcgccgccgagaccttcccggagaaggtcgccgccgccgtgttcgtcaccgccttcctgccggactgcgccaacccgcgctcccacgtcatcgagaagcttgccctggcggactggatggacagcgtcacggacgcggagcacgtcccggcgtcggtgttcctggggcccgagttccggcggcgcaagctctaccagctcagcccgccggaggactacacgctgtcgcagagcctggcccgggcgagctcctactacgtggccgacctgcggtgccagccgccgttcagcgaggcgcgctacggcgcggcgcgcaaggtgtacgtggtctgcggacaggaccgggccttggtcgagccctaccagcgggcgatggtcgccggctgcccggtggcggaggtgagggagatcgccggggcggaccacatggccatgttctccgcgccggcggagctcgcggggcacatcgccgacgtcgccaacacgtacgcctgatgccgcgccgatgcccgtcgttcgaccacattgctgccagtgcttcacagtggcaattctggtactcgaggacatgagaaaaatatcaacgccatctcaaattttcaatttatagcagtcaacataggcaactaaacttcaagattacgcgagaataatatagatctaccaaaaataatggatgagggaatgtagctcctgtttggcgtgacaaaaaaaaaaaaaaaaaaaa

SEQ ID NO: 5540 - protein, 261 aa, Panicum virgatum
  misc_feature: Ceres CLONE 1821916
  misc_feature (1)..(217): Pfam Name: Abhydrolase_1 Pfam Description: alpha/beta hydrolase fold
MSAPAVATAAEGATRIILVHGTGHGGWCWYRVATLLRAAGHRVAAPDLAASGADARRLRDAPTFEDYTRPLLDALRGLPGGERAVLVGHSFGGMSVALAAETFPEKVAAAVFVTAFLPDCANPRSHVIEKLALADWMDSVTDAEHVPASVFLGPEFRRRKLYQLSPPEDYTLSQSLARASSYYVADLRCQPPFSEARYGAARKVYVVCGQDRALVEPYQRAMVAGCPVAEVREIAGADHMAMFSAPAELAGHIADVANTYA

SEQ ID NO: 5541 - DNA, 1883 bp, Panicum virgatum
  misc_feature: Ceres CLONE 1822059
  misc_feature: Encodes the peptide sequence at SEQ ID NO. 5542
ccgtcgacaccgagatccgtgtccacactgttcacgatcacatcgatcgagttcgagctccaagaacatggcaggatccaagagagacgaagcttctcccctgcacgtagtggtgttcccatggctcgccttcggccacatgatccccttcctcgagctctcggagcagctcgccaagcgcggccacttcgtcaccttcgtctcagccccgaggaacctcgccaggctgaggcccgtcgtcccggaggtcaggccacgcatccgcctcgcgccactgcccctgccgcgcgtcgaggccctcccggacggcgccgagtcgacggccgacgtgccaccggagaaggtcgagctcctcaaggtcgccttcgacggcctcgccgcccccttcgccgccttcctcgccggggcctgcgccggtgggaagtccggagccggagaagggcacggcaggaagccggactggatcgtccacgacttcgcgcaccactggctcccgcccatcgccgacgagcacggggtgccgtgcgcggcgttcttcatcattccggcggcctacgtcgcgttcatcggccccaaggagctcaacgacgcgcacccgaggtccgcggcggcggacttcaccgtcgcgccgccgtggatcccttcctcattgtcccatgtcgcgtaccgcggccacgaggccgagtgggtcgtcggggcgtgggggcccaacgcctcgggcgtctccgacacagcccgcatctgggagacgatggagcgctgcccgctcctcgtgtgccgctgcagccgcgaggtcgacggcccgctctgcgacctcctcggcgagatctatggcaagcccgtcctcccctccggcctcctcgcgccacacgacgctgccacccgcgcttcctcggctgccggggacgacgaccacgacgacgacgaggagaccgcgggcctcatgcgctggctcgacgcccagccggggaggtccgtgctctacgtggcgttcgggagcgaggcgccgctggcgccggagcacgtccgcgcgctcgcgctcgggctggagctcgccggcgtgcgcttcctctgggcgctccggaggccgctcggcgaggcgcggccggagctcccggacgggttcgaggcccgcgcgcgcgccgccggccgcggggtggtgcgcgtcggctgggtgccgcaggtgcgggtgctcgcgcacgccgccgtgggcgccttcctgacgcacgccgggtggagctccctcatggagagctttctgttcgggcacccgctggtgatgctgccgctgttcgccgaccagggcctcacggcgcggctgatggcggcgcggcgcgtcggcctggaggtgccgtggaacggccgcgcgttcgccgccgaggacgtcgcggcgactgtgcggcgggtgatggtgggggaggaagggaaggagctcgcgcgcaacgccggtgagctgcgggaggttctctgggacactgcgaggcaggggaggtacatcgacgagctcgtcgagcacctgcagcagcgccgccgcggagcgtaggctgcaacgtgcacgagcacgacgcagtgctccgtgttagttgataagctagatgttttatttccttcctagttttcctttctgttaggcagttaggcgggcgcgcatcagtaggatcgcgttgcccggttcaggcgcacacccgcgctgcgtcgtgagggtgtgcaccgcggtgctctccgccaagaccggatcaaggactgcgtgggatggcacgcacgttcctgatcgtggaggtttgttagccagtagttacgttgtttaacttcctacttatatggaataaagcacaacagaaaagctgctctctgcggcacaataaaaaaaaaaaaaaaaaaaa

SEQ ID NO: 5542 - protein, 491 aa, Panicum virgatum
  misc_feature: Ceres CLONE 1822059
  misc_feature (1)..(164): Pfam Name: UDPGT Pfam Description: UDP-glucoronosyl and UDP-glucosyl transferase
  misc_feature (1)..(126): Pfam Name: Glyco_transf_28 Pfam Description: Glycosyltransferase family 28 N-terminal domain
MAGSKRDEASPLHVVVFPWLAFGHMIPFLELSEQLAKRGHFVTFVSAPRNLARLRPVVPEVRPRIRLAPLPLPRVEALPDGAESTADVPPEKVELLKVAFDGLAAPFAAFLAGACAGGKSGAGEGHGRKPDWIVHDFAHHWLPPIADEHGVPCAAFFIIPAAYVAFIGPKELNDAHPRSAAADFTVAPPWIPSSLSHVAYRGHEAEWVVGAWGPNASGVSDTARIWETMERCPLLVCRCSREVDGPLCDLLGEIYGKPVLPSGLLAPHDAATRASSAAGDDDHDDDEETAGLMRWLDAQPGRSVLYVAFGSEAPLAPEHVRALALGLELAGVRFLWALRRPLGEARPELPDGFEARARAAGRGVVRVGWVPQVRVLAHAAVGAFLTHAGWSSLMESFLFGHPLVMLPLFADQGLTARLMAARRVGLEVPWNGRAFAAEDVAATVRRVMVGEEGKELARNAGELREVLWDTARQGRYIDELVEHLQQRRRGA

SEQ ID NO: 5543 - DNA, 1546 bp, Panicum virgatum
  misc_feature: Ceres CLONE 1822070
  misc_feature: Encodes the peptide sequence at SEQ ID NO. 5544
aaagaaaactgagaaggaaaagaaaaaaaaggagagaggagacacgctgccctgaagaaaggaaagcacaaacgcggtgactggaattcttgcttagcgcttaagattccaccgtggccggacactccatcgaaattccgattcagaacaccgtctgtctaatctgcgaagcaaggcacaaattcctcgaggagctagagacacgacgttcattccgattcgcgcaggtgaggttgagcagaccgcgagtcgttcgcttcagctccttccccctctcatcttctgctgccgcgaactgccctgaaacatctccaaggggaggagcccaggcgagatcgagatcgaagcaccacccgccttcgcctccggagccggggaaaagggcggcggctatgtgggtggagatcctgtgcggcctggtggcctacaaggtcatccgccacttcttcttcgacggcggcgacgacgcttcctaccttgccgacctcgactcctcccactccgacctctgcttcgccgtcgccgccaggctcgagaagctctacgccggccgatgcttcgtcggcctccgcatccctgaccccgacgccggcgagcgccagcacatcgatgtcgtcctcgtcaccaagagggaggtgatggtggtggcaattaagaacttctctggcttcgttgaggccgacaaggatggaaattggtcttgcccaactgacaagaagcgtaagcaagagataattccaaacccggtactagaagtcagcagacaagctactactcttcaatcatacttggagcaaaggggagcaaagctacctgacgggcatataattggaagagttgttctgccaaatcccaactgcaggccttcatataatataactattcaaccagatgttatgttgtatgatcaatggaaagatcttaaggcagactcaaagggtggactctcaacatggtttaaaggtgcatttactggaagcaaaagtgacatgcaagattcagtactccagaacctacattttattcttagcacatcacctatgtgggacaggttggaactcaaaggagacaaaaatgttcttggtgagttcatcgagttcaaagggaggcatgaggacattcaacttctcaaaaaacttaagaggtcaaaagtcggtcgattcatcatccagaagtcaactctttttggtggttttggtaggtcacgggttcaaatattgtattctcctcgtgattatcgggctgaggggacttcatcttcagaatggaaagagatttctgtgaagcaatacacagagattgttttccagccattgcactccaaaaaagttcggaaattcaagttctcaagtgttgtttcagtcacacttagtgcctagcaagcagaaatcttaagctgccgcttttctggtatacttcgtacttccttttcggtgtaactcactgaaattatgcttctctgtttccacttgtaattatgtgtgataatgtggaggatagtgacttggagcgacgcctcactgaataaaaaaaaaaaaaaaaaaaa

SEQ ID NO: 5544 - protein, 328 aa, Panicum virgatum
  misc_feature: Ceres CLONE 1822070
  misc_feature (1)..(69): Pfam Name: NERD Pfam Description: Nuclease-related domain
MWVEILCGLVAYKVIRHFFFDGGDDASYLADLDSSHSDLCFAVAARLEKLYAGRCFVGLRIPDPDAGERQHIDVVLVTKREVMVVAIKNFSGFVEADKDGNWSCPTDKKRKQEIIPNPVLEVSRQATTLQSYLEQRGAKLPDGHIIGRVVLPNPNCRPSYNITIQPDVMLYDQWKDLKADSKGGLSTWFKGAFTGSKSDMQDSVLQNLHFILSTSPMWDRLELKGDKNVLGEFIEFKGRHEDIQLLKKLKRSKVGRFIIQKSTLFGGFGRSRVQILYSPRDYRAEGTSSSEWKEISVKQYTEIVFQPLHSKKVRKFKFSSVVSVTLSA

SEQ ID NO: 5545 - DNA, 1249 bp, Panicum virgatum
  misc_feature: Ceres CLONE 1822072
  misc_feature: Encodes the peptide sequence at SEQ ID NO. 5546
atccaatccagccactagcccagtgtgccactgggagtagagtaacctggtctgaagtcaagccagagagagggcccgcgggagacgatggcggccgcgcggtggctgctggtggccgcggtggcggtggcggcgctggcggcgaagcgcgcggcggcggcggcgccgcggaagccggtggacgtgccgttccagcggaactacgtgccgacgtgggcggcggaccacatccgctacgtggacggcgggcgggaggtgcagctctacctcgacaagtccaccgggacgggcttccagacgcggggctcctacctcttcggccacttcagcatgcacatgaagctcgtcggcggcgactccgccggcatcgtcaccgccttctacctgtcgtcgcagaactcggagcacgacgagatcgacttcgagttcctgggcaaccggacggggcagccctacatcctgcagaccaacgtgttcaccggcggcaagggcgaccgcgagcagaggatctacctctggttcgaccccaccaaggagtaccactcctactccgtcctctggaacctctacatgatcgcgttcttcgtggacgacgtaccgatccggatgttcaggaacagcagcggcgacctcggcgtccggtacccgttcagccagccgatgaagctctactcgagcctgtggaacgccgacgactgggcgacgcgcggcgggcgggagaagacggactggtccaacgcgcccttcgtcgcctcctaccggggcttccacgtcgacggctgcgaggcctccgccgaggcccgcttctgcgccacccagggcgcgcggtggtgggaccagcccgaattccgggacctcgacgccgcccagtaccgcaagctccgcgaggtccgccagcgctacaccatctacaactactgcaccgaccgcgaccgctacgccgccatgccgcccgagtgcgcgcgcgaccgcgacgtctgagacttctgagagggagccggcgccggcaggccggccggtggtctgccgccgccgcctccgccggcggcggggtgtgtgtgtgtgtggtattggactattggttggtatttgtgtttgcgtgggcttcagactttcagagaggccagggcacgcgtgtgtatgtgtgtgtctgtgcacatacatgatgtgctgtactgtactgttgttgtatcatcccagatcaaaaatcaattgatagtgccatttgcaaaaaaaaaaaaaaaaaaaa

SEQ ID NO: 5546 - protein, 297 aa, Panicum virgatum
  misc_feature: Ceres CLONE 1822072
  misc_feature: Great-hit functional homolog of the protein sequence encoded by LOCUS At5g13870
  misc_feature (1)..(181): Pfam Name: Glyco_hydro_16 Pfam Description: Glycosyl hydrolases family 16
  misc_feature (1)..(297): SWISSPROT Homolog: EC 2.4.1.207 Xyloglucan endotransglucosylase/hydrolase protein A precursor
  misc_feature (10)..(297): SWISSPROT Homolog: EC 2.4.1.207 Xyloglucan endotransglucosylase/hydrolase precursor
  misc_feature: Useful for making plants with altered cell wall content and/or composition
MAAARWLLVAAVAVAALAAKRAAAAAPRKPVDVPFQRNYVPTWAADHIRYVDGGREVQLYLDKSTGTGFQTRGSYLFGHFSMHMKLVGGDSAGIVTAFYLSSQNSEHDEIDFEFLGNRTGQPYILQTNVFTGGKGDREQRIYLWFDPTKEYHSYSVLWNLYMIAFFVDDVPIRMFRNSSGDLGVRYPFSQPMKLYSSLWNADDWATRGGREKTDWSNAPFVASYRGFHVDGCEASAEARFCATQGARWWDQPEFRDLDAAQYRKLREVRQRYTIYNYCTDRDRYAAMPPECARDRDV

SEQ ID NO: 5547 - DNA, 973 bp, Panicum virgatum
  misc_feature: Ceres CLONE 1822117
  misc_feature: Encodes the peptide sequence at SEQ ID NO. 5548
aggtgatcaccaatccatcgtcatcattcatccggtgctcgacacagccgttgcgcgcggaggtcttgggcggcgacgaagagaccggagagaggaagcagcaggaagagacggacaaagatcagggaatgggcggcgccggcacggcggggaagcgcggcgcgcggtgcgagctctgcgggggcgcggcggcggtgcactgcgccgcggactcggcgttcctctgcctgcgctgcgacgccaaggtgcacggcgccaacttcctggcgtccaggcacctgaggcgccgcctgcgcccgggcgcgcccgccggctcggcgtcctcggcgtcgtccgcgtcgagcggctcctacgtgtccaccacggccgactctgcggggtcggcggccgccgcgcccgcgccggcgcggaatcggcgggcgcgcgcggaggcggtgctggaagggtgggccgggcggatgggcttcgcggcggggcccgcgcgccggcgcgcggccggggctgcgggcgcgctccgggcgctgggccgcggcgtagccgccgcccgcgtcccgctccgcgtcgcgatggccgcggcgctctgggccgagatcacgtccgcccccgccgcgtgcaagggagcggaggccgcgctgctccggcggctggaggccgcggcgcacgtgccggcgaggctggtgctcaccgtggcgtcgtggatggcgcgcgcggcgagccaccgtgcgccgccgccgccgcccgccgaggccgacgatgtggagggctgggccgagtgctcctgaccaaccgggcctccccaccgctcatccgctgctgctgttgctgcactgtacgagctgccgcgctgagccagcgagcgcccagagatgggctggggcgtagcagcaagcatcgtgtgggcaacgttcgtttgttcttttcctcccctaattaactaccagtatttgatttgcaaaaaaaaaaaaaaaaaaaa

SEQ ID NO: 5548 - protein, 217 aa, Panicum virgatum
  misc_feature: Ceres CLONE 1822117
  misc_feature (3)..(47): Pfam Name: zf-B_box Pfam Description: B-box zinc finger
  misc_feature: The sequence is a functional homolog of  SEQ ID NO 328 in the  10/666,642 US patent application
  misc_feature: Useful for making plants with modulated growth and phenotype characteristics
MGGAGTAGKRGARCELCGGAAAVHCAADSAFLCLRCDAKVHGANFLASRHLRRRLRPGAPAGSASSASSASSGSYVSTTADSAGSAAAAPAPARNRRARAEAVLEGWAGRMGFAAGPARRRAAGAAGALRALGRGVAAARVPLRVAMAAALWAEITSAPAACKGAEAALLRRLEAAAHVPARLVLTVASWMARAASHRAPPPPPAEADDVEGWAECS

SEQ ID NO: 5549 - DNA, 1731 bp, Panicum virgatum
  misc_feature: Ceres CLONE 1822141
  misc_feature: Encodes the peptide sequence at SEQ ID NO. 5550
ccccgtggatcgagaacacgaaacacgcgggacacggacccgcgctgctcgtcacgttctccttccgcgtccacagtccgcaccagccgcgcgacgctacgcagttctaatccggccgctcagctcgtggctgcagcgccgcgctcatcagacccaatggctccggtgagaatcgtcgacgtcgcctacgttcccgcgccgccgccggcggcgccgtccgggcctatcaagctcaacgccatggaggtgcagtgggtcgtggccccggtgctgcagcacctcctgctcttcgagggcgaccagctgccgcccttcgacgacgtcgtccggtccctaaaatcctccctcgcggcgacgctggccgcccacgccccgctcgccggcaagctccatcacctcgcggagaccggcgaggtcgccatccgctgctccgccgccgccgacggcgtcaggttcgtggtcgcggagaccgacgccgacgcccgcagcctcgcgtgcgacgaggaccacgacgtggtcacgttcgaggggctcgttccggaggtcgacatgtaccggcagccggcgccgctgctggccgtgcaggccacgcgcctcgggggaggaggcggggtggccctcgggctcacgctgcaccacgccgtcgctgacgggcggtcgatgtggaggttcgtggaggcctgggcggcggcgtgccgcggcgacgcgccgcccgagccgcccccgtgcttcgaccgctcgcgtgtcgcgctgcccggcggcgaggagctggcccggagcgtcgtgcggaactacatgccagacctgccagtggtgcctatgcccgcgattttgaagcaagaccggctgcggttcacccgccggacgttcaccctggacgcggcgcgcatcgcgcggctgaagcagcgaatcgtccgcctcggcgaggcccacggcgcgccgctgcggcgcacaccgtccagcttcgtcgccgtcgtctcgctagcatggacctgcgccgtccgctgccggtccttcccggcggacgacgacgtgttcctcttcttcctggccgacgcccgcgaccgcctcgaccctcccgccggcgcggagtacttcggcgcgtgcctgacctgctgcctggtgaagctgccggcgcgggagctcctcgccgagcgcgcgctggcggcggcggcggcggcggtgcaggaggcgatccgggagatggcggaggacccgctgggttcgtcgcccgggtgggacttcctcaagctggcccgcgaccggaggatccccatcgaccgggtggtgaacgtgtccgggtcggcgggcttcagggcgtacgacgtcgccgacttcgggtgggggaggccgcggcggacggagaacgtgaggatgaaccacgacgggcaggtggcgctggtccgcgccagggacggcggcggggtgcaggtggcggtgtccttgctccagcgggcgcacgtcgacgcgttcaagtcggagctcctcaagctgctcgggtcggatgagtagtttttccttctgtcagctgtttttcgagtcgtgggttacctactgtttcattttttgtctgtaatgtctcaactcttcccctcgaggctctgcctgctcaagtggttgttctgtcctcctagttctcccttcctctttactcttgtagaaaatagtcgtatttccgttttaattaatggaaatggtggatggctttattaaaaaaaaaaaaaaaaaaaa

SEQ ID NO: 5550 - protein, 451 aa, Panicum virgatum
  misc_feature: Ceres CLONE 1822141
  misc_feature (25)..(459): Pfam Name: Transferase Pfam Description: Transferase family
MAPVRIVDVAYVPAPPPAAPSGPIKLNAMEVQWVVAPVLQHLLLFEGDQLPPFDDVVRSLKSSLAATLAAHAPLAGKLHHLAETGEVAIRCSAAADGVRFVVAETDADARSLACDEDHDVVTFEGLVPEVDMYRQPAPLLAVQATRLGGGGGVALGLTLHHAVADGRSMWRFVEAWAAACRGDAPPEPPPCFDRSRVALPGGEELARSVVRNYMPDLPVVPMPAILKQDRLRFTRRTFTLDAARIARLKQRIVRLGEAHGAPLRRTPSSFVAVVSLAWTCAVRCRSFPADDDVFLFFLADARDRLDPPAGAEYFGACLTCCLVKLPARELLAERALAAAAAAVQEAIREMAEDPLGSSPGWDFLKLARDRRIPIDRVVNVSGSAGFRAYDVADFGWGRPRRTENVRMNHDGQVALVRARDGGGVQVAVSLLQRAHVDAFKSELLKLLGSDE

SEQ ID NO: 5551 - DNA, 1325 bp, Panicum virgatum
  misc_feature: Ceres CLONE 1822193
  misc_feature: Encodes the peptide sequence at SEQ ID NO. 5552
actccagctccagtccgtccatccgatgcctccgactacgatggcttccacctcgctcttcctccccaccaccgccggcgcggccaccgctcgccgccaccccttctccagcctccgcaccacccactatcaggtgcccagcacacgcctccaccgcgcaccccggctcgtcgtcgtctccgctgcggcctcaccggcctcgcccgcgtcgtcgctcgacgcgctcatcttcgactgcgacggcgtcatactggagtccgagaacctccaccggcaggcctacaacgacgcgttcgcgcacttcggggtgcgctgcccgccggcctccgccgacccgctgtactgggacgaggccttctacgacgagctacagaaccgcatcggcggcgggaagcccaagatgcggtggtactttggggaaaatgggtggccttcttcaaagatttttgagacgccaccttcaactgactctgataaggagaagttggtcgacataattcaggactggaaaacagagagatacaaagaaacaataaagtctggaactgtggagcctagacctggtgttttgcggctgatggatgaagtaaagggtgcgggtatcaagcttgctgtttgctctgcagcaactaaaagttctgtgataatgtgccttgaaaaccttattgggcttgagagatttaatggcctggattgcttcctcgctggcgatgatgttaaactaaagaagcctgatccaacaatatatattacagcagcagagaaattaggtgtagaaagcaagaactgccttgtggtggaggacagtgttattggattactagcggcaaaaggagcagggatgtcatgtataataacatatacaccttcaactgctagccaagatttcacggatgcaattgctacctatcctgacctgagtaacgtgaggcttgaggaactcaagctgttactccagaaaactcttgttactggatagtaaaacgttttgttttcctcaagagatacattgacatttttttttatgcacgatgtcattccctggtggaacagcaggtgaatccaagcaggcatcttgttgaatagttggtgttggatgtaggaacccatgcttggttcctcagatatgtcatctgatacttcaaaccctgtccgtccgcgtttgctggttgcgtgcataggatgattaatgtaatcagcaagccgtcaaatagtgagttgcaattgttgaaacttttgttgtcgaatgaaataaaattgtcaaaatatatcgttgtattgaaaaagataaaatgtttcccgcacaaaaaaaaaaaaaaaaaaaa

SEQ ID NO: 5552 - protein, 317 aa, Panicum virgatum
  misc_feature: Ceres CLONE 1822193
  misc_feature (1)..(222): Pfam Name: Hydrolase Pfam Description: haloacid dehalogenase-like hydrolase
MPPTTMASTSLFLPTTAGAATARRHPFSSLRTTHYQVPSTRLHRAPRLVVVSAAASPASPASSLDALIFDCDGVILESENLHRQAYNDAFAHFGVRCPPASADPLYWDEAFYDELQNRIGGGKPKMRWYFGENGWPSSKIFETPPSTDSDKEKLVDIIQDWKTERYKETIKSGTVEPRPGVLRLMDEVKGAGIKLAVCSAATKSSVIMCLENLIGLERFNGLDCFLAGDDVKLKKPDPTIYITAAEKLGVESKNCLVVEDSVIGLLAAKGAGMSCIITYTPSTASQDFTDAIATYPDLSNVRLEELKLLLQKTLVTG

SEQ ID NO: 5553 - DNA, 1831 bp, Panicum virgatum
  misc_feature: Ceres CLONE 1822215
  misc_feature: Encodes the peptide sequence at SEQ ID NO. 5554
gacggagagaccgaggccatcgccaatcgccacccacccactcggttgctcccgtcccggctccgcgcctccgcctgatccgacaaacgcaagagacgagcaccatccgctgatctcttcagtacagtagtagcagcaggctacccacgcctccgatccgccgctccctcgccgtccggagatggcttccgccgccttggccctcgcctcgccggcggcctccgccgtcgccgcccggtccaaggtgcttggagggggaaataatcaggggagaaatggctgccgcgtgggaatcacgaggaagagctttggccatgttatgatggcccttgcagtggatgtttctcgttttgagggagtgccaatggctcctccagacccaattcttggggtttcagaggcctttaaagcagataaaaatgacctgaagctcaatcttggtgttggtgcctatagaacagaagagttgcagccctatgtcctcaatgtagtcaagaaggctgaaaatcttatgttggagaaaggagaaaacaaagagtatcttcctattgaaggcttagcagcatttaacaaagcaactgcagagctactgcttggagctgacaaccccgtcatcaagcaaggactggttgctacacttcaatctctctcaggcactggatcgctacgacttgctgcagcatttatacaaagatacttccctgaagccaaagtacttatatcatcacccacgtgggggaaccacaagaacatcttcaatgatgctagggtaccttggtcagagtaccggtactatgaccccaagactgttgggttagatttcgagggaatgatagctgacattgaggctgctcctgaaggatcttttgttctgctacatggttgcgctcacaacccaactggaatagacccaactcctgagcaatgggagaaaattgcagatgttattcaagagaaaaagcatatgcctttctttgatgttgcatatcagggttttgccagtggaagccttgatgaagatgcattttcagttaggctttttgttaagcgtggcatggaagtatttgttgcacaatcttacagcaagaaccttggtctatatgcagaaagggttggggcaataaatgttgtttgctcagcaccagaagttgcagatagggtaaagagccagctgaaacgtctggctcgtcccatgtattcgaacccccctattcatggtgctaggatagttgccaatgttgttggtgacccaactatgtttggtgaatggaagcaggagatggaacaaatggcagggcggatcaagaatgtaaggcagaagctctatgatagtttgtctgcaaaggacaagagtggcaaggactggtctttcattctgaggcagattggtatgttctcctacactggcctgaacaaagcacagagtgataacatgacagataaatggcatgtttatatgaccaaggatgggcggatttcgttagctggactttccctggctaagtgcgattatcttgccgacgccatcatcgattccttccacaatgtcagctagatagaggcctaaagaattgaggtgaagctattccggttgagtccttggacgcttggctgggatttttgggtccttccagctatagttttcaggtgtattacacccagtgtaatttggacaaataattttttgtcatcacagcacaactcaagtgcctggctacatgtaacagtagcaatttacaggatcgtaaaacttaattgaataatggcattggcagtgttacttgcgcctgcccataacattcacgttttgcaaaaaaaaaaaaaaaaaaaa

SEQ ID NO: 5554 - protein, 457 aa, Panicum virgatum
  misc_feature: Ceres CLONE 1822215
  misc_feature: Great-hit functional homolog of the protein sequence encoded by LOCUS At4g31990
  misc_feature (1)..(369): Pfam Name: Aminotran_1_2 Pfam Description: Aminotransferase class I and II
  misc_feature (41)..(457): SWISSPROT Homolog: EC 2.6.1.1 Aspartate aminotransferase, chloroplast precursor
  misc_feature (55)..(449): SWISSPROT Homolog: EC 2.6.1.1 Aspartate aminotransferase, cytoplasmic
  misc_feature: Useful for making plants with modulated nitrogen use efficiency
MASAALALASPAASAVAARSKVLGGGNNQGRNGCRVGITRKSFGHVMMALAVDVSRFEGVPMAPPDPILGVSEAFKADKNDLKLNLGVGAYRTEELQPYVLNVVKKAENLMLEKGENKEYLPIEGLAAFNKATAELLLGADNPVIKQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYAERVGAINVVCSAPEVADRVKSQLKRLARPMYSNPPIHGARIVANVVGDPTMFGEWKQEMEQMAGRIKNVRQKLYDSLSAKDKSGKDWSFILRQIGMFSYTGLNKAQSDNMTDKWHVYMTKDGRISLAGLSLAKCDYLADAIIDSFHNVS

SEQ ID NO: 5555 - DNA, 1329 bp, Panicum virgatum
  misc_feature: Ceres CLONE 1822242
  misc_feature: Encodes the peptide sequence at SEQ ID NO. 5556
ccaaatctcactcgcacctgaccacaccaaacgtccgaaccaaaccccgcccgcgaacggcgaatctctccccgccgagccgcgaatccacgccacccacgggaggggaagggcgcgcggcggcgggggcatggagttcctgcaggggcagaggctggagaccacggtggccgtcgcggtcgccgtcgtcgccgtggccgccggcgccgcctacctcgtcctccgcagcaggaagcccaggggttgcttggaccccgaaaacttcagggagtttaaacttgtagagaagaggcaactcagtcataatgtcgctaagttcaagtttgcgctcccaacacctacttctgtattgggtcttccaatcggacaacatataagctgcaggggacaggacgctgccggcgaggaagtaatcaagccttatactcccactacactggactctgaccttggacattttgagcttgttattaagatgtacccccaaggaagaatgtctcatcattttcgtgagatgaaagttggcgactatatgtctgtaaagggacccaagggccgtttcaagtaccgacctggacaagtgagagcatttggaatgatagctggaggatcaggcattaccccaatgttccaagttacaagggcaattcttgagaacccagaagacaatacaaaagtttacctaatctatgcaaatgtcacatatgatgatattcttcttaaggaagaactggacagtatggccaaaaactatcctgatcgtttcaagatctactatgtcctgaatcagcctcctgataactgggatggcggtgttgggttcgtgtcgaaggaaatgatccaagctcattgcccagcacctgctaccgacattcaggtgttgagatgcgggcctccccccatgaacaaagccatggctgcgcacctggacgagcttggctacacgaaggagatgcagttccagttctaatcaaaccccgcctctgccgaaggataccaaaaataatacagcgacgggacatgttttcgctccccgttgagttgagtcacgtagcaccaacagacgtagttcacaaagcaatgcatcgtatctctcgatgacatcacgagtacctaatctgtatcggtgttgcgacatcgaaccattgccattcttgtgacatcgctactccaacctccaaaccagacatcgagagacatccactgccttgcattattaggctttggatcactctagcatcctagcgctcatatttctcgaaaaaagaatttcatatgtatggagtattaaatgaagtctatttgcaaaaaaaatttaaggatgggtgt

SEQ ID NO: 5556 - protein, 279 aa, Panicum virgatum
  misc_feature: Ceres CLONE 1822242
  misc_feature (1)..(100): Pfam Name: FAD_binding_6 Pfam Description: Oxidoreductase FAD-binding domain
  misc_feature (1)..(110): Pfam Name: NAD_binding_1 Pfam Description: Oxidoreductase NAD-binding domain
MEFLQGQRLETTVAVAVAVVAVAAGAAYLVLRSRKPRGCLDPENFREFKLVEKRQLSHNVAKFKFALPTPTSVLGLPIGQHISCRGQDAAGEEVIKPYTPTTLDSDLGHFELVIKMYPQGRMSHHFREMKVGDYMSVKGPKGRFKYRPGQVRAFGMIAGGSGITPMFQVTRAILENPEDNTKVYLIYANVTYDDILLKEELDSMAKNYPDRFKIYYVLNQPPDNWDGGVGFVSKEMIQAHCPAPATDIQVLRCGPPPMNKAMAAHLDELGYTKEMQFQF

SEQ ID NO: 5557 - DNA, 1249 bp, Panicum virgatum
  misc_feature: Ceres CLONE 1822256
  misc_feature: Encodes the peptide sequence at SEQ ID NO. 5558
aacgaacaaaaagaggccccgcttcgcttcccgccctgctgccgcgctgcgcctctctcccccacccggccttcctcggctcgacctctcaaaccgccccgactccgtccgatccgatgccgccgccgctcgaggcgcgcgactacatcggcctgggcgccgccgcgtcccccgcctcctcgtcctgctccggcgcccgcggcgagggggctccgggcccgcacctcgcgctgcggctcgggctgccggggtcggagtcccccggccgcggggcgggggcggagcacgtcgacgccgcgctcacgctgggacccgcgcctcccaggggcggcgccaagcgcgggttcgccgactccctcgaccggcccgcgaagcgggatgcggatgccggcgacgctgctggggccgtgagcggggaggagaacaagggtgtggctgctgcagccgccggagctccgcgggctgccaaggcacaggttgttggttggccacctgttcgtagacagagttaccgaaagaatatactagctgcgagtgccacaaagacaaaggggggagatgaaagtaggagtgaggcaggatgctgttatgttaaaatcagcatggatggagccccatacctaaggaaggtggacctcaagacctattcaagctatgaggatctctcgcttggtctcgagaaaatgttcagttgcttcatcactggtaaaagcagttcaggcaagccatcaagggacatgcttacggatggttctagggctgatgcccttctggaccaagaatatgtccttacttatgaagacaaagatgctgactggatgcttgttggtgatctgccctgggacttgttcaccacaacttgtcggaaacttagaatcatgagaggttctgatgctgcaggcatggctccaagatcactggaacaggttggtcggaacaaataaggtgccttgccctacacgtgaatcacgaatgtaatggtcagtttgcgatggcgctgaagggagcaatgttttatctgaagtgctatgtctttttccacatgtgcagtgagatttgtggcctactgtaagacgcccattttgcccacgaggttgtctgtaccattgttgatggttgcttttgtctgtgaaaggtcgaacactgcctctgtgatactttcaccagtttgcttatatattcagcagtttgtatttcataccgtagaagtaagaacaaatgttcatgtcaaaaaaaaaaaaaaaaaaaa

SEQ ID NO: 5558 - protein, 275 aa, Panicum virgatum
  misc_feature: Ceres CLONE 1822256
  misc_feature (1)..(234): Pfam Name: AUX_IAA Pfam Description: AUX/IAA family
MPPPLEARDYIGLGAAASPASSSCSGARGEGAPGPHLALRLGLPGSESPGRGAGAEHVDAALTLGPAPPRGGAKRGFADSLDRPAKRDADAGDAAGAVSGEENKGVAAAAAGAPRAAKAQVVGWPPVRRQSYRKNILAASATKTKGGDESRSEAGCCYVKISMDGAPYLRKVDLKTYSSYEDLSLGLEKMFSCFITGKSSSGKPSRDMLTDGSRADALLDQEYVLTYEDKDADWMLVGDLPWDLFTTTCRKLRIMRGSDAAGMAPRSLEQVGRNK

SEQ ID NO: 5559 - DNA, 1366 bp, Panicum virgatum
  misc_feature: Ceres CLONE 1822272
  misc_feature: Encodes the peptide sequence at SEQ ID NO. 5560
actaatcccccacctcacactctcctctccttctctctctaccacctttccccatccggccatccatccctcccccgctctctctctccgaatcgagccaagagcaccgtcatctctcgccgccgccgcctttactctctctatctcccttatctttccgccatgggcgcgccgctccgccgccgcctcctcctgctcctcgccgccgccgcctgcgcggcgtcggcggcggccgcggcgcccaggctgtcgcccaactactaccgccgcagctgcccgcgcgtggagcggatcgtgtcggacgtcgtcgcggccaagcagcgcgcgaacccatccacggcggcgggcacgctgcggctcttcttccacgactgcttcgtcaacggctgcgacgcctcggtgctcatctccccgctctcctccgacgcgtccccggagcgcgccgcggagatcaacctctccctccctggggacgccttcgacgccgtgggccgcgccaaggcggcgctcgaggccgcctgccccggcgtggtctcctgcgccgacgtcctggccctcgcggcgcgggacctcgtgggcatcctcggcggtccccggttccccgtcgcgctcgggcggcgcgacgcccgccgctccgacgcccgcgacgtcgaggggaacctgccccgcaccaacatgtcggcgcgcgccatggcgcggctgttcgcgggcaagggcctcacgcccagggagatggtggcgctggccggcgcccacaccgtgggcttctcccactgcggcgagttcgcgcaccgcatctacggctaccgcggcgccggcgggcacgacccgcggctcaacccggagttcgcgcgcgcgctgcagcgctcctgcgcggggtaccggagcgaccccaccgtctccatcttcaacgacgtcgtcacgccccgggacttcgacgaggcctactacaagaacctgccccgcgggctggggctgctcgcctccgacgccgcgctgtgggagtacccgcccacccgggtgttcgccgagcgctacgccgccaaccgcaccgccttcttcgaggacttcgccgccgcgatgcagaggctcggcgccgtcggcgtcaagacagggcgccagggcgtcgtcaggcgccgctgcgacgcgctcgactgagagctagtagcggacttgttgcgcgttccgtcggtgatttcgaattcgataggttaggattcgattgggggaggagctctgctctctgaacatgaaaattgtgatgaacattgtggggcgttcgagttcttgacagggtgatgaactgaaggcaaagctaattctgaacttcatacagattgtgtttcaaaaaaaaaaaaaaaaaaaa

SEQ ID NO: 5560 - protein, 331 aa, Panicum virgatum
  misc_feature: Ceres CLONE 1822272
  misc_feature: Great-hit functional homolog of the protein sequence encoded by LOCUS At5g47000
  misc_feature (1)..(251): Pfam Name: peroxidase Pfam Description: Peroxidase
  misc_feature (23)..(328): SWISSPROT Homolog: EC 1.11.1.7 Peroxidase 41 precursor
  misc_feature (9)..(328): SWISSPROT Homolog: EC 1.11.1.7 Peroxidase 65 precursor
  misc_feature: Useful for making plants with altered cell wall content and/or composition
MGAPLRRRLLLLLAAAACAASAAAAAPRLSPNYYRRSCPRVERIVSDVVAAKQRANPSTAAGTLRLFFHDCFVNGCDASVLISPLSSDASPERAAEINLSLPGDAFDAVGRAKAALEAACPGVVSCADVLALAARDLVGILGGPRFPVALGRRDARRSDARDVEGNLPRTNMSARAMARLFAGKGLTPREMVALAGAHTVGFSHCGEFAHRIYGYRGAGGHDPRLNPEFARALQRSCAGYRSDPTVSIFNDVVTPRDFDEAYYKNLPRGLGLLASDAALWEYPPTRVFAERYAANRTAFFEDFAAAMQRLGAVGVKTGRQGVVRRRCDALD

SEQ ID NO: 5561 - DNA, 1452 bp, Panicum virgatum
  misc_feature: Ceres CLONE 1822299
  misc_feature: Encodes the peptide sequence at SEQ ID NO. 5562
agccgtgccgacagaaacagcatctccggccggcagcgcaccaccgtacccaacgccatggccgccccgatactcggcttcctctcagcgctactcctgcttctcctcccggctcccctccgagaccacttctcgtcagtccaccggcagacggccggcggcggcacggccggcggcctccacccgatcgtcctggtccccggcgtgacctgccccgacctggaggctcggctcaccgaggcctacgagccctcaacgccacgctgcggccggatgagagggaaggggtggttcgggctgtggacgaaccgcacctgggcactggacgccgagaccgctgcgtgcttggaggagcagatgcgcctcgtctacgaccccgccctcggggacttccggaacctgcccggcgtggccacgcgcgtccccaacttcggctccgctcgcgggttcagctccaagtacgcaccacacccggaatattgctttggagcactgaggtctaccctagagagattcgggtaccgcgacggagagaccctcttcggggctccctatgacttccggtacgcccctccggtccccggccagacatctcgagtttactcccggtactttagccgggtaacgaggctcatcgaggacgctaccaagaagaatcaaagcagggccgccatcgtcttcggacacagctacggggccatggttgccctcgagttcgtcaggaactccccgtcgccgtggcggaacaagttcatcaagcacctctttatggtagcaccgacatggtcgggaggctacgttcgcgcgataagaagcgttgtctcggggccgccggcagacatggtttacgttccgtccgcctctgctgtgtcggtgcggtcgatgtggaggaccttcgagactgccatcgtgaacctaccatgcccagcggtctttgggcgcaggccactcgtggtgaccaggagcaagaattactcggcgtatgatatcgccgatctgcttcttgccatcagttgcgccaacggcgacaagccattcagagagcgtgagctcgcaaagatgggctacttcaaggcgcccatggttccaatgactcatatgtatggagtgggtgtcccaacggaggagcaactggtgtactgggaaggtgacttcgacatgccgcctgaaatggtgtacggcgatggtgacggcaccatcaacgtgattgccatgttggcgttccaggagaaggtggggaaacagccgggacaaaaggagctcttcaagtccatcagagttgctaaggttccgcactctgaattaattatcaatcaacgggctgtcaagaagataatgaatgagatcgtagagttaaatcgcttggttgaaatgcatttctcttattaatatttctacaaaattcaatataatattcaatctttcttttcggaaaaaaaaaaaaaaaaaaaa

SEQ ID NO: 5562 - protein, 443 aa, Panicum virgatum
  misc_feature: Ceres CLONE 1822299
  misc_feature (1)..(344): Pfam Name: LACT Pfam Description: Lecithin:cholesterol acyltransferase
MAAPILGFLSALLLLLLPAPLRDHFSSVHRQTAGGGTAGGLHPIVLVPGVTCPDLEARLTEAYEPSTPRCGRMRGKGWFGLWTNRTWALDAETAACLEEQMRLVYDPALGDFRNLPGVATRVPNFGSARGFSSKYAPHPEYCFGALRSTLERFGYRDGETLFGAPYDFRYAPPVPGQTSRVYSRYFSRVTRLIEDATKKNQSRAAIVFGHSYGAMVALEFVRNSPSPWRNKFIKHLFMVAPTWSGGYVRAIRSVVSGPPADMVYVPSASAVSVRSMWRTFETAIVNLPCPAVFGRRPLVVTRSKNYSAYDIADLLLAISCANGDKPFRERELAKMGYFKAPMVPMTHMYGVGVPTEEQLVYWEGDFDMPPEMVYGDGDGTINVIAMLAFQEKVGKQPGQKELFKSIRVAKVPHSELIINQRAVKKIMNEIVELNRLVEMHFSY

SEQ ID NO: 5563 - DNA, 1329 bp, Panicum virgatum
  misc_feature: Ceres CLONE 1822310
  misc_feature: Encodes the peptide sequence at SEQ ID NO. 5564
cttgctccgcccgcccgcatttccttccctcccgtcgcctcgccgcctccgcacgcgcaccgcaacgcgacgcagcgggaaccgccgcgacctccgcccaccccaccctgctcgcccgccttcttcttcctcctctcgagaagaagggtcttcttggaggcagcgaggaggcgtctcggggaagggaggggatggcgatcgaccacgagtccccgttcaaggagctccgcctcaagaaccgcaggatcatgggaggcggcggccccgagccggaggaggaggccgcctcggcggcgtaccgggaccagtggccgcgctggctgcagccgctgctctccgcgcgcttcttcgcgcattgcaagacgcacagcgactcgcaccgcagcggcgagtgcaacatgttctgcctcgactgctccgccgccgcgggcgcgggcgccggcgcgctctgctccctctgcctcgcgcacgcccaccgcgaccaccacaccatccagatccgtcgctcctcctaccacgacgtcatccgggtctccgacatccagcgcttcatggacatcgccggcgtgcagacctacgtcatcaacagcgcccgcgtcgtcttcctcaacgagcggccccagcagcagaagcccggctgcggcggcaaggccgcctccgcctccgccaacctctgcgaggtctgcgcccgcagcctcctcgacaacttccgcttctgctccctcgggtgcaaggtcgtcggctgcgcccccgacgccgcaaaggccaggaactggctcctccggcccgccgccgcccccgatggcaacgcctcctcctccgccctgcggaatgccgacaggaagcagagcttcacgcctcccacgccgccgagcatgccagcgaagcggcgcaagggcatcccgcaccgcgcgccgttcggcagcctcatcgtcgagtactagccctcggcggcggcggcggcggcattggccttacacgcgcgcggtaaagtaaaagtactcctcaacccaacggaatcgcacagtgagtcactgaatccgtgcatgaatcagagtccgccattacggcaatgggatggccaccacttcggtggcccgccttcctttgccatggcactttggggttggtggtgcttctcgaggtggatgccatttgctcgctagctttgctttccacaaagggagaagaaaggagggtgcttgctgctagacatctgctgctgcaacaatgtcaatcaaaaactagctttttcgttaagagttgattactgttgttaggacagaagatatatatttctgatagaaatatatgtacatgttttagtcc

SEQ ID NO: 5564 - protein, 250 aa, Panicum virgatum
  misc_feature: Ceres CLONE 1822310
  misc_feature (1)..(121): Pfam Name: PLATZ Pfam Description: PLATZ transcription factor
MAIDHESPFKELRLKNRRIMGGGGPEPEEEAASAAYRDQWPRWLQPLLSARFFAHCKTHSDSHRSGECNMFCLDCSAAAGAGAGALCSLCLAHAHRDHHTIQIRRSSYHDVIRVSDIQRFMDIAGVQTYVINSARVVFLNERPQQQKPGCGGKAASASANLCEVCARSLLDNFRFCSLGCKVVGCAPDAAKARNWLLRPAAAPDGNASSSALRNADRKQSFTPPTPPSMPAKRRKGIPHRAPFGSLIVEY

SEQ ID NO: 5565 - DNA, 1061 bp, Panicum virgatum
  misc_feature: Ceres CLONE 1822440
  misc_feature: Encodes the peptide sequence at SEQ ID NO. 5566
gcaaaacaccttgctttttgtactcttccgtctttgccctcgcgctctcgcctcgcccccgttcgctcggccggcgcgtgtacgtgcgtacagcgagcggagaagggaagagagagagagagagagatagagagagaaaaaaaagaaaagagtcttgcggctcttgccttgccttgggttgagctcattcgctgttcgttcatggagagctcctcctcctcctcccacaagcgggcgcgggaggcggccgacctcgccgccgccggcgacggcgcgctgccggagaagaggctgcggcccgaggacctgctcgacctgctcgacgatgacgccgacgcggccgccgccggcgacctggcgtccgtcatgcggagcctcgaggaggagttagggagcttcgacgaggccggggcccccgacgccgccgccgcgccgccggcgcaccagccggagctggggttcctgctcgaggcctcggacgacgagctgggactgccgccggcgggcgcctcgtcgtcggaggaggccggcgccgccggggcgccggacgtggccgccgggctcgacggccagatctgggggttcgaggacgagatcgacggcggcttcggcggctactcgccggaggcggccgccgccgccgccgccgcggcggcgtgggacgacgacggcttcgacgccgggctgttcgcgttcggggacgacgcctgcggggcctcggatctcgcggccctgcgccacgagaccatgccggccgtctgatgacaggccccggccggccagccagtggattagcgttccttttctttttcttgctttttttttacctttggctaaccttagctggaactaccctctttttttaaccttggtgtaaagcttttagaagggtaaaaacagaggcgtggaaacctggggaaggttccgaccggggaaaagaatctgaaaatggtttccctttttgcccttgggaattattttctcgcttattataaatgaaaaaaggaagaagaaataagctagcataagctagcgagtagtaaaaaaaaaaaaaaaaaaaa

SEQ ID NO: 5566 - protein, 186 aa, Panicum virgatum
  misc_feature: Ceres CLONE 1822440
  misc_feature: Great-hit functional homolog of the protein sequence given in SEQ ID NO 9355
  misc_feature: Useful for making plants with modulated low light sensitivity
MESSSSSSHKRAREAADLAAAGDGALPEKRLRPEDLLDLLDDDADAAAAGDLASVMRSLEEELGSFDEAGAPDAAAAPPAHQPELGFLLEASDDELGLPPAGASSSEEAGAAGAPDVAAGLDGQIWGFEDEIDGGFGGYSPEAAAAAAAAAAWDDDGFDAGLFAFGDDACGASDLAALRHETMPAV

SEQ ID NO: 5567 - DNA, 1411 bp, Panicum virgatum
  misc_feature: Ceres CLONE 1822465
  misc_feature: Encodes the peptide sequence at SEQ ID NO. 5568
acaagcacacagctcagttcttcttgtctaataggctagctagttcctcccctccgtctctccctctctcctattcatgttctctctcacctcgcagcttgagagagacttgtgcaacaaaaattagagagagagagagagagagagagcatacacgagagatcgatcatgtcgatgagcttcttgagcatggtggaggcggagctgccaccggggttccggttccacccgagggacgacgagctcatctgcgactacctcgcgcccaagctcggcggcaaggtcgggttctccggccgccgcccgcccatggtcgacgtcgatctcaacaaggttgagccatgggatctccccgctgcggcgtcagtgggtcctagggagtggtacttctttagcctcaaggacaggaaatatgcgacggggcagcggacgaacagggccacggtgtcgggttactggaaggctaccgggaaggatcgggcagtggcgcggcgaggggcattggtggggatgaggaagacgctggtgttctaccaggggagggctcccaaggggaggaagacggagtgggtgatgcatgagtacaggatggagggtgcacttgagcaatcctccaagttctcctccaaggatgaagattgggtcctctgccgagtcatctgcaagaagaaattaccaggaggcgccgccagctccaaggcatcaagaggccttgccaccaatggtggccatgacacggtaccaaccagctcgccgccgctgccacccctcatggacaccaccctagcacagctccaggccgccatgaacaccgccgccggcgccgcctgctccggtgcagtcgagcaggtgccctgcttctccagcttcaacaacatcgccagcaacaacaacactgctgctgctgctgttgctgcagctcagccatgctacctgcccatggtcacaggcagccatggcatgagcttcctggaccatggcctgcctgaactgggtggctgctttgatcctctgaactgcgacaagaagttgctcaaggccgttctgagccagttcggcggtgaggtggtgccaagcctgccgcatgagatggctgctggtactgcgacctccacatggatgaatcacttctagggaaattgattgagcaagaacaagtgattggtgattccatatgaactatatttacttattgtgtggtaaatcatttatgtgcgagtagtagagcaagcaacattttttttctaccgatttcgataaggcaagcgaaaattaggagtggtactatgtaatggctgttggtgtgtatattcagatgtaggggtttgagtgatcaagagaattccagattggttattttgcagtgcctgagccctgaatcctaatttctcaaaaaaaaaaaaaaaaaaaa

SEQ ID NO: 5568 - protein, 321 aa, Panicum virgatum
  misc_feature: Ceres CLONE 1822465
  misc_feature: Great-hit functional homolog of the protein sequence given in SEQ ID NO 9354
  misc_feature: Useful for making plants with altered Lignin content
MSMSFLSMVEAELPPGFRFHPRDDELICDYLAPKLGGKVGFSGRRPPMVDVDLNKVEPWDLPAAASVGPREWYFFSLKDRKYATGQRTNRATVSGYWKATGKDRAVARRGALVGMRKTLVFYQGRAPKGRKTEWVMHEYRMEGALEQSSKFSSKDEDWVLCRVICKKKLPGGAASSKASRGLATNGGHDTVPTSSPPLPPLMDTTLAQLQAAMNTAAGAACSGAVEQVPCFSSFNNIASNNNTAAAAVAAAQPCYLPMVTGSHGMSFLDHGLPELGGCFDPLNCDKKLLKAVLSQFGGEVVPSLPHEMAAGTATSTWMNHF

SEQ ID NO: 5569 - DNA, 1246 bp, Panicum virgatum
  misc_feature: Ceres CLONE 1822511
  misc_feature: Encodes the peptide sequence at SEQ ID NO. 5570
atcaaccaccaggaagccaaggaaggagagaaccagatcaagatcaaccaatggcgcacccaaaaacaggtgggtttctgccggtgcctaacgtgcaggcactcgcgcagacttggaacagctccggcgagctggtgcctgaccggtacgtcaggacggaggaggccgtcgccgaggaggtcgtcgccggatgcgcgcttccagtcgtggacctcggcaggctcctcgatccccggtcgtcggcagaggagctcgcgaacctcggctctgcctgtcagcactggggttacttccagctcgtcaaccatggcgtgccggaagaggtgatccgggacgtgaggagagacatagccgagttcttcaagctcctgctcgaagccaagaaggcgtgcgcgcagctgccggacgacatccagggctacggccagggcttcgtcttctccgaggcgcagaagctggactgggccgacatgatctacctcaagcttcgccccatggagtcgcggagcatgaggttctggcccgcccagcctccgtccttcaggaactccgtggattggttctcgacggaggtggcgaaggtgacgtcgtccttgctgcggttgatggcggtggacatgggcgtggagccggagcgcctcctggagaagttcgggggccagccgcagaccatgaaggtgacctactacccgcagtgcaggcaggccggcgatgtgctcagcctgtcgccgcacacggacgcctgcgccgtgacgctgctgctccacgtcaacgatgtgcagggcctgcaaattagaagggacgatggcaagtggcacgccgttgaacctctcgagggtgcattcatcgtcaacgtcggtgacacactcgagatgttaagcaacggcaagtacaaaagcgttgagcatagggtcacggtgcacccagacaaagagcgcatctccgcggcgatgttccaccagctattcccgaacgcgacggttggccctcttccggagctcgtgaaaggcagcagcggggcgcgatacagatcggtggattacacggatttcatgaagcacttcttctcggcgaagcatgataatggagcgagccaccttgaccactacaggatttaatttgctcgaagaagatgatggataccttgttatcaggttaatgatgtatcatttgatggatgaactctgaaaaataaaagcacttgtgatgcatgataaatataacggaaaaaaaaaaaaaaaaaaaa

SEQ ID NO: 5570 - protein, 355 aa, Panicum virgatum
  misc_feature: Ceres CLONE 1822511
  misc_feature (1)..(100): Pfam Name: 2OG-FeII_Oxy Pfam Description: 2OG-Fe(II) oxygenase superfamily
MAHPKTGGFLPVPNVQALAQTWNSSGELVPDRYVRTEEAVAEEVVAGCALPVVDLGRLLDPRSSAEELANLGSACQHWGYFQLVNHGVPEEVIRDVRRDIAEFFKLLLEAKKACAQLPDDIQGYGQGFVFSEAQKLDWADMIYLKLRPMESRSMRFWPAQPPSFRNSVDWFSTEVAKVTSSLLRLMAVDMGVEPERLLEKFGGQPQTMKVTYYPQCRQAGDVLSLSPHTDACAVTLLLHVNDVQGLQIRRDDGKWHAVEPLEGAFIVNVGDTLEMLSNGKYKSVEHRVTVHPDKERISAAMFHQLFPNATVGPLPELVKGSSGARYRSVDYTDFMKHFFSAKHDNGASHLDHYRI

SEQ ID NO: 5571 - DNA, 1430 bp, Panicum virgatum
  misc_feature: Ceres CLONE 1822551
  misc_feature: Encodes the peptide sequence at SEQ ID NO. 5572
gaattggcacagggaggagagagacaggcacacagggtagagagagaaagagggaggcccattaccaatgccaagaacaagaaatcagagaggacagtcgcgaatccaatccgaatcccctccaaaaacccaccaaacatcctcccctatctgcaagaacaagaacaagagagcatcctaggaaaaaaagaagaccaggaagaccaagaaaaaagtcttgagaagtttcgagaagagtggtgggaaggtacttcagctcggagaaggaaggagatggatccggccttgctggatgacatcatacggcggctgctggaggtaaagaatctgaagccggggaagaacgcgcagctgtcagagtcggagattaagcagctctgcgctgccgccaaggagatcttcctgcagcagcctaaccttctggagctcgaggcccccatcaaaatctgtggtgatgtccatggccagtattctgatctactgaggctatttgattatggtggctacccacctcaggccaactaccttttcttgggtgattatgtggaccgcggaaagcaaagcctggaaacaatatgtcttcttttggcttacaaggtcaagtacccagagaactttttccttctaaggggcaaccatgaatgcgcgtctgtaaatcgcatctatggtttttatgatgagtgcaagcggagattcagtgtgaaactctggaaaacattcacagactgttttaactgcttgccagtgtcagcactgatagatgagaagatactttgtatgcatggtggtctttcccccgagttgaacaagctggatcaaatactcaatctgaatcgtcccacggatgtgcctgatactggattgctctgtgatcttctttggtctgatccttccaatgaagcacaaggctgggccatgaatgatcgaggtgtttcatatacatttgggcctgataaagtcactgaattccttgagaagcatgatttggacctcatctgcagagcccatcaggttgtcgaagatggatatgagtttttcgctaaccgccaacttgtaacaatattctcggcccctaactactgtggagaattcgataatgctggtgccatgatgagtgtagatgagacattgatgtgctccttccaaatactgaagcctgcaaggaagatgttggctggttcaaccaataacaaatctggcttcaagtcattaagaggatggtgacaatggtccaatggtgagcaagctgcgatgaacaggggcggatcttacagcggctgcaattgacaggcattttcaccgaaacctcagggcctgaaagagcatagcagatgtgtacaactctcctcgcaaaggaactgtacatcttccatgttggattaacactcttgtaatgtattattggcttttaaaaaaaaaaaaaaaaaaaa

SEQ ID NO: 5572 - protein, 316 aa, Panicum virgatum
  misc_feature: Ceres CLONE 1822551
  misc_feature (1)..(196): Pfam Name: Metallophos Pfam Description: Calcineurin-like phosphoesterase
  misc_feature (1)..(307): SWISSPROT Homolog: EC 3.1.3.16 Serine/threonine-protein phosphatase PP1
  misc_feature (1)..(316): SWISSPROT Homolog: EC 3.1.3.16 Serine/threonine-protein phosphatase PP1
MDPALLDDIIRRLLEVKNLKPGKNAQLSESEIKQLCAAAKEIFLQQPNLLELEAPIKICGDVHGQYSDLLRLFDYGGYPPQANYLFLGDYVDRGKQSLETICLLLAYKVKYPENFFLLRGNHECASVNRIYGFYDECKRRFSVKLWKTFTDCFNCLPVSALIDEKILCMHGGLSPELNKLDQILNLNRPTDVPDTGLLCDLLWSDPSNEAQGWAMNDRGVSYTFGPDKVTEFLEKHDLDLICRAHQVVEDGYEFFANRQLVTIFSAPNYCGEFDNAGAMMSVDETLMCSFQILKPARKMLAGSTNNKSGFKSLRGW

SEQ ID NO: 5573 - DNA, 1244 bp, Panicum virgatum
  misc_feature: Ceres CLONE 1822583
  misc_feature: Encodes the peptide sequence at SEQ ID NO. 5574
acgcctcacacggcgacggggacggccgcaccaccatcccccatccatccgttcccctccccgccgccgcctcccatggcggacttcggcgacgagctcttcctcgacgtcggcgacgacgggttcggcgacctttcctacgtcaccttctcccagtccatcgaggaggatctcgcctgcccacgcagcctcctctccccgggcttcgacctgggaaccctaagccccaccccgggctcccccttctccttcgactccgaccccgacctccgcgccctctcccccacgcggctccgctccccgcccttctgggactgcctcgaggacgagctcgccgaccacggcttcgagtgggaggagatcgccgacgctgccccgggcgtcggcggcagggctgcagccgccgatgctggtggtggtggaggcggagggcggggactaggacccgatgtcgacgccgacgtgttcgggttcctcgacgagcgggagttgctgggcgcgatgcaggggatcgacagcggggacggcgactcgatcttctcccacgagccgccgttcgacttcggcgacggcgacgcggagctcgacggcatcttccggagcggcgttggctgggagctgctcccggtgccgctggacgaggacgacttcgaggtgctgccggggcacctcgcggatgcggcggcgggtggggccccgccggcggcgcgcgcggcggtggagcggctccaggtggtagccgtccggggggaggaggccgcgcaggggtgcgccgtgtgcaaggacgggatggcgcagggggagctcgccacgcggctgccctgcgggcatttctaccacggggcttgcattgggccgtggctcgccatacggaactcgtgcccggtgtgccggtacgagctgcccactgacgaccctgagtatgagcggcgaagggcgaggcgccgttccaccggtggctcgacggcgcagttgggtgccccgatgcaaatttgaactagggcgacttggtggtatgtgttggatgcaattccattatttcactgaagtgagaaacctcactaattgggtgcatgccagtagaacagtacttctatggtcttcaattttttttcaggatttagttgttgtgcttgggagttggtaagaacaattgttgtaacatttgtacatatgtcttgttgcttcaataatatagcaaactctttctcattgttgtttcggaaaaaaaaaaaaaaaaaaaa

SEQ ID NO: 5574 - protein, 306 aa, Panicum virgatum
  misc_feature: Ceres CLONE 1822583
  misc_feature (1)..(41): Pfam Name: zf-C3HC4 Pfam Description: Zinc finger, C3HC4 type (RING finger)
MADFGDELFLDVGDDGFGDLSYVTFSQSIEEDLACPRSLLSPGFDLGTLSPTPGSPFSFDSDPDLRALSPTRLRSPPFWDCLEDELADHGFEWEEIADAAPGVGGRAAAADAGGGGGGGRGLGPDVDADVFGFLDERELLGAMQGIDSGDGDSIFSHEPPFDFGDGDAELDGIFRSGVGWELLPVPLDEDDFEVLPGHLADAAAGGAPPAARAAVERLQVVAVRGEEAAQGCAVCKDGMAQGELATRLPCGHFYHGACIGPWLAIRNSCPVCRYELPTDDPEYERRRARRRSTGGSTAQLGAPMQI

SEQ ID NO: 5575 - DNA, 1388 bp, Panicum virgatum
  misc_feature: Ceres CLONE 1822658
  misc_feature: Encodes the peptide sequence at SEQ ID NO. 5576
aagtgtgtgtgtgtagctagtcaactcttctcgatctcctctctggcctgttctctgcctgctgctgctttaatttagagtatttgttttccaatcaatccctggcagttagttgaataatcgtcttggtcgtcgatcgcaaattgggccaattcaactccattatatccaactccgccgccgcgccggtggtcttgttccattattcctgccccagaacagagtactgaagagatgagcagcggcaacggcggcggcggcgaggacgacgacgtcctagaccacgagtaccaagaagagtatgtgaggaactcgcgggggatgagcctgttcgcatgcagatggctgcctgggaagaggtggacgacgaagcagggtcctcccaaggcgctcatcttcctctgccatggttacgctgtggagtgcggcgttaccatgcgcggcaccggcgagcgtctggcccgtgccggctacgccgtgtacggcctcgactacgagggccacggccgctccgacggcctgcagggctacgtgccagacttccaggccctcgtccaggactgcgacgactacttcgcctccgtcgtccgccgctcccacgtccgcagattcttccttctcggcgagtccatgggcggcgccgtcgctctcctcctccaccgcgctcgccccgacttctgggccggcgccgtgctggtggcgcccatgtgcaagatcgccgacgacatgcggcctcacccggtggtcgtcaacatcctgagggccatcacctccatcatccccacctggaagatcgtgcccaccgccgacgtcatcgacgccgcctacaggatgcaggagaagagggacgagatccggggcaacccctactgctacaaggacaagccgcgactcaagaccgccttcgagctgctcaaggtcagcttggacgtcgaggccaacctcctgcacaaggtgtcgttgccgttcctgatcgtacacggcggtgcggacaaggtgacggacccttcggtgagcgagctgttataccaatcggcggcgagccaggacaagacgctcaagctctacccaggcatgtggcacgccctcacctctggtgagtcgcccaacaacatccgcactgttttccaagatatcatcgcttggctggaccacagatccatctcgatggaggacctgccagcagaggtggagcagaaggccaggcatgacgaccaccaccaccatgcagcaggcaacaccaagtagctagctgcatattgtctctcaatgtatacacacacatgaatgcatgtagctaggatccaatataatggagcaatagttcaattattgtgatatacacacagaaccattatatatttgagtaaagtccgttttacatccct

SEQ ID NO: 5576 - protein, 337 aa, Panicum virgatum
  misc_feature: Ceres CLONE 1822658
  misc_feature (1)..(225): Pfam Name: Abhydrolase_1 Pfam Description: alpha/beta hydrolase fold
MSSGNGGGGEDDDVLDHEYQEEYVRNSRGMSLFACRWLPGKRWTTKQGPPKALIFLCHGYAVECGVTMRGTGERLARAGYAVYGLDYEGHGRSDGLQGYVPDFQALVQDCDDYFASVVRRSHVRRFFLLGESMGGAVALLLHRARPDFWAGAVLVAPMCKIADDMRPHPVVVNILRAITSIIPTWKIVPTADVIDAAYRMQEKRDEIRGNPYCYKDKPRLKTAFELLKVSLDVEANLLHKVSLPFLIVHGGADKVTDPSVSELLYQSAASQDKTLKLYPGMWHALTSGESPNNIRTVFQDIIAWLDHRSISMEDLPAEVEQKARHDDHHHHAAGNTK

SEQ ID NO: 5577 - DNA, 1082 bp, Panicum virgatum
  misc_feature: Ceres CLONE 1822691
  misc_feature: Encodes the peptide sequence at SEQ ID NO. 5578
gcgccgagacgtggctgcaggcgcacgagaggtgatcgagcattcgagccgacgcgcgcgcagcaagcagcaccgtacccgagtttctcgccatgggcggcagcaagcacatcgtgctcgtccacggcgcgtgcctcggcggctggtcctggttcaaggtggccacccggctccgcgccgcggggtaccgcgtggacgcgccggacctggcggcgtcgggcgtggacccgcggccgctccgcgaggtgcccacgttccgggactacacggcgccgctgctggacctcctcgcggcgctcccggccggggaccgcgtggtgctcgtcggccacagcctcggcggcctgagcgtcgccctggccgccgagctgttcccggacaaggtcgccgccgccgtgttcctctgcgccttcatgcccgactgcgccgcgcggccgtcgcacgtgctcgagaagttcgtggaggggaagtggctggactggatggacacggagatgaagccgcaggacgcggagggcaagctccccacgtccatgatgttcgggccccggatcctgcgggagaagttctaccagctctgctcgcccgaggacatcaccctggcgtcgtccctgatgcgggtgagctcgatgttcgtggaggacctggccgcccagcagccgttcaccgcgggcgggtacggctcggtgcgcagggtgtacgtggtgtgctcggaggactacggcatcgtggaggggttccagagctggatggtggagaacaacccggtggaggaggtgagggagatcgccgccgaccacctggtgatgctctccaggcccgacgagctggcgcggtgcctcgccgacatcgccgacaagtacgcgtgatgaatgatgatgatgaggaagatcgatgctcgatagatctgccgctgcgtggatgcatggtgttctgttgtgatcagctttcttttctttcttaatcaaaaaagaaaccttggagaactcgagcctgttgtttcgaaatgagattgaagttcacggtgtggcgagcaattgaccaatcgtggatgtttattagaaaaaaaaaaaaaaaaaaaa

SEQ ID NO: 5578 - protein, 258 aa, Panicum virgatum
  misc_feature: Ceres CLONE 1822691
  misc_feature: Great-hit functional homolog of the protein sequence given in SEQ ID NO 9347
  misc_feature (1)..(222): Pfam Name: Abhydrolase_1 Pfam Description: alpha/beta hydrolase fold
  misc_feature: Useful for making plants with modulated drought sensitivity
MGGSKHIVLVHGACLGGWSWFKVATRLRAAGYRVDAPDLAASGVDPRPLREVPTFRDYTAPLLDLLAALPAGDRVVLVGHSLGGLSVALAAELFPDKVAAAVFLCAFMPDCAARPSHVLEKFVEGKWLDWMDTEMKPQDAEGKLPTSMMFGPRILREKFYQLCSPEDITLASSLMRVSSMFVEDLAAQQPFTAGGYGSVRRVYVVCSEDYGIVEGFQSWMVENNPVEEVREIAADHLVMLSRPDELARCLADIADKYA

SEQ ID NO: 5579 - DNA, 1320 bp, Panicum virgatum
  misc_feature: Ceres CLONE 1822719
  misc_feature: Encodes the peptide sequence at SEQ ID NO. 5580
ccaaatcaatcttgaaggggagcgattcacatcacaggagcgatgccgctctgcagcttctacgcctccacctccctccccgtcgccaagccgcagcagtccgtcgcgtcctctaataagcctcactccaccgccgcggcctccgtggcgaccaccgcgccgacgcgcagcgcgacggcgactgtgtccacggccacggcggcgctgtcgctgcacctccccgagctgccgtcgcaggtgaaggacaagatcctgagcctggagctgatgggcgtggactacgggcgcgcgctggagctgaaccctgcgctccgcgacgcggcgccggagtccatccacgcggtggtgtccttcctccagtcccgcgggctccacttcaaggacctcggccgcgtcttcggcatgtgcccgtccgtgctcaccgccagcgtccgcgccgacctccgccccgtcttcgccttcctctccgaggacctcggcgtcccggagtccgcgcaccgccgcgtcgtcgtcaagtgcccgcgcgtgctcgcctgcagcgtccgcgaccagctccgccccgcgctcatctacctctgccgcctgggcttccgggacacccgcgcgctggcgctgcaggaccccatcctcctcgtctccagcgtggagcgcaccctggcgcccaagctccagttcctggccgggctcggcatgtcccgggacgacgccgtcgccatggtgctgcggtgcccggcgctcttcaccttcagcatcgagcgcaactacaggcccaagttcgagtacctggtggaggccatgggcggcggcgtggaggacatcaaggcgttcccgcagttcttcgccttcagcctcgagaagcggatcgcgccgcgccaccgcgcagtggaagaggccggcgtcacgatgccgctgccggacatgctcaaggccaccgacgaggagttcacggagatgctcgagaaggagcggaggctgcaggagcaggccgcagcgacagactgagcgcgccgccataccctgcacgacggggtacgcttcgtgtgcttttactggcgcggcggttcgcgcatgatcctaggaattcagccgccgtttccatggcgagtgtcctggccatgccggtagccaagtagccatttgatttgaagaactagcagcctgtacatatgcattgatattatttggtggtcacggcacgtagctatgagagagatggcattcctttctgcaatttgtaagtactgagcagcaggtcgtgtcttatgtacatatgctatgtatcaagtattcaagttcatcaaaaaaaaaaaaaaaaaaaaa

SEQ ID NO: 5580 - protein, 319 aa, Panicum virgatum
  misc_feature: Ceres CLONE 1822719
  misc_feature: Great-hit functional homolog of the protein sequence given in SEQ ID NO 9704
  misc_feature: Useful for making plants with altered terpenoid content
MPLCSFYASTSLPVAKPQQSVASSNKPHSTAAASVATTAPTRSATATVSTATAALSLHLPELPSQVKDKILSLELMGVDYGRALELNPALRDAAPESIHAVVSFLQSRGLHFKDLGRVFGMCPSVLTASVRADLRPVFAFLSEDLGVPESAHRRVVVKCPRVLACSVRDQLRPALIYLCRLGFRDTRALALQDPILLVSSVERTLAPKLQFLAGLGMSRDDAVAMVLRCPALFTFSIERNYRPKFEYLVEAMGGGVEDIKAFPQFFAFSLEKRIAPRHRAVEEAGVTMPLPDMLKATDEEFTEMLEKERRLQEQAAATD

SEQ ID NO: 5581 - DNA, 1597 bp, Panicum virgatum
  misc_feature: Ceres CLONE 1822750
  misc_feature: Encodes the peptide sequence at SEQ ID NO. 5582
ctgcgagcctgcaacacacacagcttccgatcctccgaggcgacgcggaggcgcctcgctcacgccgccggcaccgagacgcccccagaactccctccgtcgctagggcttgctcccgcgtcccccacttggcgcggcgatggatgacggcggcgagggtcccgctgctcctgctgctgaggcggccgtagcggtgaggaaccctcggtgctacctcgacgtcagcatcggcggggagctggaggggcggatcgtggtggagctctacgcctccgtggcgctgcgcacggcggagaacttccgcgccctctgcaccggcgagaagggcgtcggcgccgacaacggcgtgcccctccactacaagcgctcatgtttccatcgcatagtcaaaggttttatggtacaaggtggagatataactgctggtgatggaactggtggacaatcaatatatggattgaattttgaggatgagaattttgtcttgaagcatgagaggaaagggatgttatcaatggcaaatgctggacccaacacaaatggatctcagtttttcatcactaccacccgaacacctcacctcgatggaaaacatgttgtttttggaagggctataaaaggaatgggggtggttcgtgcaatggagcatattcctgttgatgaagctgaacgcccgactgatgacgttgttattgttgattgtggagagataccagaaggtgccagtgatggagttgttaactttttcaatgatggtgacacgtatcctgattggccaaatgatcttgatgaaaagcctgcagaagtttcttggtggattgatgctgtggagtctgcaaaagctttgggaaatgaaagtttcaagaaacaggattacaagatggctctcagaaaatacagaaaagccatgcggtacttagatctttgctgggagaaagaagacattgatgaagagaggagcacaacgctgcgaaaaacaaagtcaattatattcacaaatagctctgcttgcaaactgaagttgggagatttggagggtgctttgttagatgcagattttgcactgcgtgaaagggaggacaatgcaaaagcttttttccgacaaggacaggtatgcatggcgctaaaccttatcgatgctgcagtggagagcttcaagcaggcactggaattagaaccaaatgatggaggaattaagcgtgaacttgctgctgcaaagaagaagatttctgacaaacaagatcaggagaggaaggcgttttcgaggttgttccaaccttcaggaggatcagagaagagtgacaacgagaatagttgatcctgctagcttaaccattcatagttattctgttgttgcaagtcaaatgttcaggagggagctcgcacgacaggaaaaactctcatcagacaacccgaaatagtgcagtgacagtgacgctagagccttttgtttccagcatggaaggaaccatggatctatattgtcgtagaaatgtaatccctggcgttgacttagcaggcagattctcaggaacgcctgctaatagactgattcggtcaatgaaccaccattaacgaaaaaaaaaaaaaaaaaaaa

SEQ ID NO: 5582 - protein, 392 aa, Panicum virgatum
  misc_feature: Ceres CLONE 1822750
  misc_feature (1)..(169): Pfam Name: Pro_isomerase Pfam Description: Cyclophilin type peptidyl- prolyl cis-trans isomerase/CLD
  misc_feature (23)..(378): SWISSPROT Homolog: EC 5.2.1.8 Peptidyl-prolyl cis-trans isomerase CYP40
MDDGGEGPAAPAAEAAVAVRNPRCYLDVSIGGELEGRIVVELYASVALRTAENFRALCTGEKGVGADNGVPLHYKRSCFHRIVKGFMVQGGDITAGDGTGGQSIYGLNFEDENFVLKHERKGMLSMANAGPNTNGSQFFITTTRTPHLDGKHVVFGRAIKGMGVVRAMEHIPVDEAERPTDDVVIVDCGEIPEGASDGVVNFFNDGDTYPDWPNDLDEKPAEVSWWIDAVESAKALGNESFKKQDYKMALRKYRKAMRYLDLCWEKEDIDEERSTTLRKTKSIIFTNSSACKLKLGDLEGALLDADFALREREDNAKAFFRQGQVCMALNLIDAAVESFKQALELEPNDGGIKRELAAAKKKISDKQDQERKAFSRLFQPSGGSEKSDNENS

SEQ ID NO: 5583 - DNA, 1122 bp, Panicum virgatum
  misc_feature: Ceres CLONE 1822771
  misc_feature: Encodes the peptide sequence at SEQ ID NO. 5584
atgcacaccggcagctcgccgaccctccgagttcgggccgctactgctataaatacgaagctcccgcggcggcggtccggccggtcatggcggcagtcggcgcgcgcccagtgctgtaccaccacccggcgccggcgggcgacgccgcctccatgtcctcgtacttctcccacggaggcagctccacctccagcttctccgccgcgctcgccgccgcggccgcgccgcccccgccgccgcttgccgaccagttcgacatctccgagttcctcttcgacgacggcgcgggggcggcggccgcgccaggcgtgttcgctgcggcggccgaccgcggcgcgccgccccccgtcgcgcccgctgctggcwgcrcgatcagtgcgcccgcacatgccgccaggagcgcggcggaggcggtgccggagcggccgcggacagagcggatcgcgttccggacgaggtcggaggtcgagatcctggacgacgggtacaagtggaggaagtacggcaagaagtccgtcaagaacagccccaacccaaggaactactacaggtgctcgacggaagggtgcaacgtgaagaagcgggtggagcgggacaaggacgaccccagctacgtggtgaccacgtacgagggcacgcacaaccrcgtgagccccagcacggtgtactacgccagccaggacgccgcctccggccgcttcttcgtcgccggcacgcagccgccgccgggctccctcaactagccccggccggcgcggccgatcratccaactaagccgatcgtacstccargaaagccggcggccagatagctagaagtcsatcggtatagtatactagtatagtaggataggtgatcacgatctgggtcggtttctggaggtggatcgtttgggatctagcgctcgtcctcttttcccccgaccttttctgcggccgctggctgctggtgcgatcgaatgaatgaatagtgtgcggctgctgctgctgctgatgctggctcaggaggttttcccccacatcacttgttcccacgagctgatcagctaaaacagtctgggaaatgttagcatttatatactgctgccttgaccgtgcactaagatgtacagaggttttgtc

SEQ ID NO: 5584 - protein, 218 aa, Panicum virgatum
  misc_feature: Ceres CLONE 1822771
  misc_feature: The sequence is a functional homolog of  SEQ ID NO 132 in the  10/714,887 US patent application
  misc_feature: The sequence is a functional homolog of  SEQ ID NO 132 in the  11/435,388 US patent application
  misc_feature: The sequence is a functional homolog of  SEQ ID NO 138 in the  10/714,887 US patent application
  misc_feature: The sequence is a functional homolog of  SEQ ID NO 138 in the  11/435,388 US patent application
  misc_feature: The sequence is a functional homolog of  SEQ ID NO 140 in the  10/714,887 US patent application
  misc_feature: The sequence is a functional homolog of  SEQ ID NO 140 in the  11/435,388 US patent application
  misc_feature: The sequence is a functional homolog of  SEQ ID NO 144 in the  10/714,887 US patent application
  misc_feature: The sequence is a functional homolog of  SEQ ID NO 144 in the  11/435,388 US patent application
  misc_feature: The sequence is a functional homolog of  SEQ ID NO 154 in the  10/714,887 US patent application
  misc_feature: The sequence is a functional homolog of  SEQ ID NO 154 in the  11/435,388 US patent application
  misc_feature: The sequence is a functional homolog of  SEQ ID NO 156 in the  10/714,887 US patent application
  misc_feature: The sequence is a functional homolog of  SEQ ID NO 156 in the  11/435,388 US patent application
  misc_feature: The sequence is a functional homolog of  SEQ ID NO 158 in the  10/714,887 US patent application
  misc_feature: The sequence is a functional homolog of  SEQ ID NO 158 in the  11/435,388 US patent application
  misc_feature: The sequence is a functional homolog of  SEQ ID NO 1611 in the  10/412,699 US patent application
  misc_feature: The sequence is a functional homolog of  SEQ ID NO 208 in the  10/714,887 US patent application
  misc_feature: The sequence is a functional homolog of  SEQ ID NO 208 in the  11/435,388 US patent application
  misc_feature: The sequence is a functional homolog of  SEQ ID NO 971 in the  10/666,642 US patent application
  misc_feature: Useful for making plants with modulated growth and phenotype characteristics
  misc_feature (94)..(94): Xaa is any aa, unknown, or other
  misc_feature (95)..(95): Xaa is any aa, unknown, or other
  misc_feature (187)..(187): Xaa is any aa, unknown, or other
MAAVGARPVLYHHPAPAGDAASMSSYFSHGGSSTSSFSAALAAAAAPPPPPLADQFDISEFLFDDGAGAAAAPGVFAAAADRGAPPPVAPAAGXXISAPAHAARSAAEAVPERPRTERIAFRTRSEVEILDDGYKWRKYGKKSVKNSPNPRNYYRCSTEGCNVKKRVERDKDDPSYVVTTYEGTHNXVSPSTVYYASQDAASGRFFVAGTQPPPGSLN

SEQ ID NO: 5585 - DNA, 1224 bp, Panicum virgatum
  misc_feature: Ceres CLONE 1822783
  misc_feature: Encodes the peptide sequence at SEQ ID NO. 5586
gaccggcgccgtgcccccggccggatggaggaggcatcagcagcaggagccgtcaccaccgccgccgcgcggagcagcccggccgccgtgcaggccaccaacgacgacgccgcggccagcaagctgtcttgtgttaacaaaggatacatgaaggatgattacgtgcgcttttttgtcaggcgcgcgacaaggagggcgccaataatcaatcgtggatactatgcacgttggtctgttcttaggaagcttctgcgtcagttccttaatgcggggaaagatagtaatgaccagaagccgaagcaaatattatctcttggcgcaggctttgacacgacattcttccagttgcaagatgaagggattgctccaaacctttacgtagagctggatttcaaggaggtaaccagcaaaaaagccgccatcattaaccactataatgaaatgaaggaaaaattaggttcggaagcttcaatttcgatagaaaaaggtgaagtgataagtacacactacaagctattttctgctgatattcgtgacgtaccaaaactggattcagttattcgcatggctgaaatggatcctagcttgccgacctttatcattgcagagtgtgtacttatttacttggacccaactgccacgggtaccattgttagttgggcttctgaaaagttctccactgctgtctttttcttatatgagcagattcatcctgatgatgcatttggggagcaaatgattagaaatcttgagagtagaggatgccccctgctaagtataaatgctacaccaaccttgagtcacaaagagaagcttttccttgacaatggatggcagagagctgttgcatgggatatgctgaagatctataatgacttcattgacagtcaagaaaggcgcaggattgaacgactagaattgtttgatgaatttgaagagtggcatatgatgcaggaacactattgtgtggcttatggaatcaatgatgcagagggcatatttcacaattttgggttcgacaaggaatagcatcttttttattttgctgtggtgtttgatcttgagagtccagtgctcccaaagcttgcgataataatgcctgtaatatacagtactatattttgcatgtttaaccaattttgtaatttgcaagattgtgtgatcccactggcttaatctttgatttctttttgtttgttcgaataaaaaaaaaaaaaaaaaaaa

SEQ ID NO: 5586 - protein, 334 aa, Panicum virgatum
  misc_feature: Ceres CLONE 1822783
  misc_feature (1)..(301): Pfam Name: LCM Pfam Description: Leucine carboxyl methyltransferase
MEEASAAGAVTTAAARSSPAAVQATNDDAAASKLSCVNKGYMKDDYVRFFVRRATRRAPIINRGYYARWSVLRKLLRQFLNAGKDSNDQKPKQILSLGAGFDTTFFQLQDEGIAPNLYVELDFKEVTSKKAAIINHYNEMKEKLGSEASISIEKGEVISTHYKLFSADIRDVPKLDSVIRMAEMDPSLPTFIIAECVLIYLDPTATGTIVSWASEKFSTAVFFLYEQIHPDDAFGEQMIRNLESRGCPLLSINATPTLSHKEKLFLDNGWQRAVAWDMLKIYNDFIDSQERRRIERLELFDEFEEWHMMQEHYCVAYGINDAEGIFHNFGFDKE

SEQ ID NO: 5587 - DNA, 1400 bp, Panicum virgatum
  misc_feature: Ceres CLONE 1822856
  misc_feature: Encodes the peptide sequence at SEQ ID NO. 5588
taccagccgccgcacccaatttcatcccgctcgatcgcggcaccgccgccgcacccaatttcttcccgcctgagcccgccgccgcacgcaatttcttcccgctcgagcgcgccgccgccgtatcccttccctcacgcgcaatgctttgaccactccatcccatcccgctaggagcacgcggtcgaccaatccctcttcccgctcgagcgcgcatgtaccccaatcccttcctgctcgagctcccccagccaaatccatccacgagcgctcctccaacccaatcccatcctacccaacgctgcttgcctctcttcccctgcctaatccaatctgtcgctgcctccatcccaaatcatctcgttgctagctctgtccccaaatcctgttgcccgctccatgcattatctgctgctgagaaccatggagagttaggggggcgtgtcctggaaggaggagggcaaggagttgtgttcctggaggagggaggcaaggagttgcattgatctgggaggaggaactgggtctgtgctgaagctgtgcaaggaaggttcacgggaaaggagagaatgaaggagaaagcaagaaagagaaaggagagaaggaaggagaaagcaagaaagagatctgtgtgcgtccgaaggtgagatgcaaatatcctctctccctccgatcagcagcagcacagccagagccagcgccagcacagcggcgagcggtccaccatccacagcttcaattcaaatcgcacggccatggcgtcgcagcagcagcagcggcaggcggcggcggcggcacccgtggggttcgaggactacctgccggtgatggcggagcggctgggcgaggaggggctgatgcgggagctggcgagcgggttccggctgctcatggacccggcccgcgggctcatcaccttcgacagcctccgccgcagcgcgccgctgctgggcctgggcgccatgtccgacgacgacctccgcgggatgctcgcggagggcgacttcgacggcgacggcgcgctcagcgagatggagttctgcgtgctcatgctccgcctcagccccgagctcatggacgggccccgcaggtggctcgacgacgccgtctcgcaggcctcgcacttcctcttcaccagctaggcgggcctaggactgggctgccggagacggccgcgcgcgtagcgtaggaattgttggttgagcttctctttcttttcgttgttcatagctggattaggaattcgttcaaaaaaaaatagctggattaggaagggactggtgcctgattggtcgatagatggattccatgccttgtgtactcgatcgcctgttcctccccaactggaatctgaattgatcaaacatgcttcttcctcctttcaaaaaaaaaaaaaaaaaaaa

SEQ ID NO: 5588 - protein, 128 aa, Panicum virgatum
  misc_feature: Ceres CLONE 1822856
  misc_feature: Great-hit functional homolog of the protein sequence given in SEQ ID NO 9669
  misc_feature: Useful for making plants with altered glycerol content
MASQQQQRQAAAAAPVGFEDYLPVMAERLGEEGLMRELASGFRLLMDPARGLITFDSLRRSAPLLGLGAMSDDDLRGMLAEGDFDGDGALSEMEFCVLMLRLSPELMDGPRRWLDDAVSQASHFLFTS

SEQ ID NO: 5589 - DNA, 1442 bp, Panicum virgatum
  misc_feature: Ceres CLONE 1822867
  misc_feature: Encodes the peptide sequence at SEQ ID NO. 5590
ggtcacctcgccgcgaacaaacagcccattaatccgctgtcgctcagctgatctactcggctccaagtcacagtcactccaccgcgctggccatggctctgcaggccgctctcctcccttccactctctccgtccccaagaagggcaacctcgccgccgtggtgaaggacacggctttcctcaccgttccccagaagctgcgggttccgtcgctttcggtgcgggcgcaggccgcggcgacggcgcccgtggccaccccgggggccagcacgtcgaccaaggacgccaagaagacgctgcgccagggggtggtggtgatcaccggcgcgtcgtcggggctcggcctggccgcggccaaggcgctggcggagacgggcaagtggcacgtcgtgatggcgtgccgcgacttcctcaaggcggccaaggcggccaagggcgccggcatggcggagggcagctacaccatcatgcacctggacctggcctccctcgacagcgtccggcagttcgtggacaacttccgccgcgccggcatgccgctcgactcgctcgtctgcaacgccgccatctaccggcccacggcgcggacgccgacgttcacggcggacgggtacgagatgagcgtgggcgtcaaccacctgggccacttcctcctggcgcgcctgctcctggacgacctccgcaagtccgactacccgtcgcggcgcctcatcatcctcggctccatcaccggcaacaccaacacgctggccgggaacatcccgcccaaggccgggctgggcgacctccgcggcctcgccggcgggctgcgcggccagaacgggtccgccatgatcgacggcgccgagagcttcgacggcgccaaggcgtacaaggacagcaagatctgcaacatgctcaccatgcaggagctgcaccggcggtaccacgaggagacgggcatcaccttcgcgtcgctctaccccggctgcatcgccaccacggggctgttccgcgagcacatcccgctgttccggctgctcttcccgccgttccagaagttcatcaccaagggcttcgtgtcggaggcggagtccggcaagaggctggcgcaggtggtcagcgaccccagcctcaccaagtcgggggtctactggagctggaacaaggactcggcgtccttcgagaaccagctctcgcaggaggccagcgacccggagaaggcaaggaagctctgggagatcagcgagaagctcgtcggcctggcctgagcagaggagcttttatttgcttcgttgtttcatgtgtaccattagcaaccattttgttttattgtttaggagctggtgatgatggcagtcagagaagcctgtaagtgatcgatcatgcactatgcacaattttttttcacacaaagtatggaataaaacaacaggctttaataaaaaaaaaaaaaaaaaaaa

SEQ ID NO: 5590 - protein, 385 aa, Panicum virgatum
  misc_feature: Ceres CLONE 1822867
  misc_feature (1)..(129): Pfam Name: adh_short Pfam Description: short chain dehydrogenase
  misc_feature (1)..(385): SWISSPROT Homolog: EC 1.3.1.33 Protochlorophyllide reductase A, chloroplast precursor
MALQAALLPSTLSVPKKGNLAAVVKDTAFLTVPQKLRVPSLSVRAQAAATAPVATPGASTSTKDAKKTLRQGVVVITGASSGLGLAAAKALAETGKWHVVMACRDFLKAAKAAKGAGMAEGSYTIMHLDLASLDSVRQFVDNFRRAGMPLDSLVCNAAIYRPTARTPTFTADGYEMSVGVNHLGHFLLARLLLDDLRKSDYPSRRLIILGSITGNTNTLAGNIPPKAGLGDLRGLAGGLRGQNGSAMIDGAESFDGAKAYKDSKICNMLTMQELHRRYHEETGITFASLYPGCIATTGLFREHIPLFRLLFPPFQKFITKGFVSEAESGKRLAQVVSDPSLTKSGVYWSWNKDSASFENQLSQEASDPEKARKLWEISEKLVGLA

SEQ ID NO: 5591 - DNA, 1074 bp, Panicum virgatum
  misc_feature: Ceres CLONE 1822875
  misc_feature: Encodes the peptide sequence at SEQ ID NO. 5592
cgatcgatcgtcgatggcggtgacggccacgacggtcgctgcggcgaccacgatgctggcggccgtcgcggcggtcttcctcaccttcgtgctctgcttctacatcttcctctgtgccaagcgctacggcggcagggcgccgcccccgcccgcggggcgcggcgtcgcggcgtggctgcgcttcatgctcggcggctggggaggagggggaaggggagtcgcggacggcggcgccgacgcgtggtgctacgagggcgggctggatgacaagtccctggcgaagctgccgcgccgggaggtgggcaagtgcgaggtgctcgacgactgcgccgtctgcatcacggagctcaaggccggggacacggcgcgcgtgctgccgcggtgcggccacggcttccacgtcgactgcgtcgacatgtggctccgctcccactccacctgcccgctctgccgctgccccgccgtcgacgagccgcccgtgccccccgtgctgcccgccgtgcccacgccggaggctgacccggagtcccccaacttccccaccaacgtgctcttcttcggctcggaggacggcgtcagcaccggccgctcgcagtcgccggccccgtcgtcgacgccttccccaccgcaggaacatgtcgccgccgaggcggcgcgcccgtgcgggctgcggaggctgattgggtgtggtggcgcgacgccgcccacgcagccgccgcaccattaccaccaccaccaacacgacgaagcggacggggacatcgagatgggcctcgccgccggcgagagcagcgcggcgtcgcggccggtgaagccgccgcagcccggttcctgaggctgctgctggtttcttgtgtgccgtttccttgtgtgacatcgcgagtttttttattcaaaaaaaaagacatcgcgagtttttcttttatgcttcccttcttcgcgtgagtgtttcccgtaggaagagagaacggtaaaagatgtacagattcttatagccgcctgatgtaaattcctcgtgccggtagaacatgaactgggaagagaaatcgaacagaaaaaaaaaaaaaaaaaaaa

SEQ ID NO: 5592 - protein, 273 aa, Panicum virgatum
  misc_feature: Ceres CLONE 1822875
  misc_feature (1)..(42): Pfam Name: zf-C3HC4 Pfam Description: Zinc finger, C3HC4 type (RING finger)
MAVTATTVAAATTMLAAVAAVFLTFVLCFYIFLCAKRYGGRAPPPPAGRGVAAWLRFMLGGWGGGGRGVADGGADAWCYEGGLDDKSLAKLPRREVGKCEVLDDCAVCITELKAGDTARVLPRCGHGFHVDCVDMWLRSHSTCPLCRCPAVDEPPVPPVLPAVPTPEADPESPNFPTNVLFFGSEDGVSTGRSQSPAPSSTPSPPQEHVAAEAARPCGLRRLIGCGGATPPTQPPHHYHHHQHDEADGDIEMGLAAGESSAASRPVKPPQPGS

SEQ ID NO: 5593 - DNA, 1543 bp, Panicum virgatum
  misc_feature: Ceres CLONE 1822926
  misc_feature: Encodes the peptide sequence at SEQ ID NO. 5594
acgaaacacggcggcagcagcagccttcgtggcctcgtgggtgcccgcctgcctatccatccaccatccttcctccctcctgcctcccgcgcgcgcgccctcggctcggacaggccgagcggtagcgagggagggcggggcggcgcgggcctcgcaatgcagcagcagcagcagccggagcccgccgatccgccggggcgggcgttcccacccccgccggcgccggcgcgggccgccgcgcgcggggcgcaccaccgccgggccagatctgaggtcgccttccgcctcccggacgacctcggcctcggcggcggcggcggccccgaaggcgacggcttcgacgagatcggctccgaggacgacctcttctccaccttcatggacatcgagaagatctcctcctcgggtccctcagaccgcgaccgcgaccgcgccgcggagacctcctcgccgccgcgccccaagcaccgccacagcagctccgtcgacggctcgggcctctacttctcccccggcgtcggcggcggcgcggggaaggacgccgccgcgtcgctggccgaggtcatggaggccaagaaggccatgagccccgagcagctggccgagctcgccgccatcgaccccaagcgtgccaagagaattctagctaacagacaatcggcggctagatcaaaagaaagaaaggctcgttatataacagaacttgagcggaaggttcaaacgcttcagactgaagccaccaccctttcagcacaactcacactatttcagagagacacaactggactttctgcagaaaatgcagagctcaagataaggttgcaggccatggagcaacaggctcaactgcgtgatgctctgaatgatgcactgaagcaggaactggagaggcttaagcttgctactggtgagatgaccaattccagtgagacatataacatgagatttcaacatgtcccgtacaactcttcattcttcctgctttcccagcaaaatacagcaccacacccgggtagtgcccagttggcaccatcgttcaacccacctcatcccaatgtgccaaatcaccagatgctgtcccacccacacactctcccagatataatgcagcaagactctcttggacggctgcaaggtttggacattggaaaggggcctctggttgtgaagccggagagcagctcgatctctgcaagcgaaagcagcagcaccttctaacgaggcctacacatcagaatccacagtttcattagatcactttgttcatagcctgacatccttgtgctgctttcagttctgtaagcttattttttattcaattcattcgtttagttgagattgttcgtaatcgcatggacagatcaaaccgtgttgtagaatgatccggcaactcacatcttgtttgttttgggttcatttcctgtgtgcatgtttggtaatcagggcggtcggagtggagtctctgatgatattgtgttgcttttagccatgttgacttgacctctatggattctctttggaacaaaaaaaaaaaaaaaaaaaa

SEQ ID NO: 5594 - protein, 353 aa, Panicum virgatum
  misc_feature: Ceres CLONE 1822926
  misc_feature (1)..(65): Pfam Name: bZIP_1 Pfam Description: bZIP transcription factor
  misc_feature (1)..(55): Pfam Name: bZIP_2 Pfam Description: Basic region leucine zipper
MQQQQQPEPADPPGRAFPPPPAPARAAARGAHHRRARSEVAFRLPDDLGLGGGGGPEGDGFDEIGSEDDLFSTFMDIEKISSSGPSDRDRDRAAETSSPPRPKHRHSSSVDGSGLYFSPGVGGGAGKDAAASLAEVMEAKKAMSPEQLAELAAIDPKRAKRILANRQSAARSKERKARYITELERKVQTLQTEATTLSAQLTLFQRDTTGLSAENAELKIRLQAMEQQAQLRDALNDALKQELERLKLATGEMTNSSETYNMRFQHVPYNSSFFLLSQQNTAPHPGSAQLAPSFNPPHPNVPNHQMLSHPHTLPDIMQQDSLGRLQGLDIGKGPLVVKPESSSISASESSSTF

SEQ ID NO: 5595 - DNA, 1878 bp, Panicum virgatum
  misc_feature: Ceres CLONE 1822942
  misc_feature: Encodes the peptide sequence at SEQ ID NO. 5596
gtttctttcctgaatcgctgttcggatcgtgtcggttctccgtgttgttgtccaaagaaaaagaaaaaaaaaagaagttttcttccgcgttgcccgtctctcggattgtggaaaggccgctcctttcggagatttccgcgtgcttctcgtcgagactagtcgaccgggcttcggatcgagctgtttgggggtggggaaattttgaggccaagaagaggtcggaatcggatcgggagttcttcgggtcggagtgagcggaaggcgagggatttgggaggagttcgtgtcgccagccgcggtggggggaaatcgattgttgagcgggttggaggcggagatgggagccggagccgaggtcatgcatcaggtcgtgccgctgctggagacaccgttccaccggtgcgtcgtcaagagcgtcgaggtcgtcgaggaggtggtcgcggtggcacccatgccggtgcaggtggcggcgccggcgtcgccgaaggcggtcgtgcaggagttgaaaagattttctaatgctggggatagtgtatctgtggaaccccttcagtttgtcccaagcattcgatctggtagctttgctgatattggacctaggcggtacatggaagatgaacatattcgaattgatgatctttctgctcatcttgctccagtgcttatgttctctgaacttagtgccttctatggagtctttgacgggcatggtggttcagatgcagctgcctacatgaagaagcatgcaatgaaattgttctttgaggatgctgaattcccacaagcctcacaggaagataaaatgtttgctgaatctgttgaggattcagtccgcaaggctttcttgcgggctgaccttgctctggctgatgattcactcatcaaccgttcttctggaaccacagcactgacagcattgatcctgggaaggcaacttttggttgcaaatgctggggattgccgtgcagtcctttgtaggaaaggcgtagcagtggagatgtcaaaggatcacaggccaacatatgatgcagagcgtcaaagggttattgagtctggtggatatattgaagatggctacctcaatggagttctctccgtgacccgggctcttggtgactgggacatgaaactgccccaaggctcggcatcacccctcattgccgagccagagatccgctggaccaccctcactgaggatgatgagttcctgatcattgggtgcgatgggatatgggacgtgatgaccagccaacacgcggtgagcacggtccgcaaggggctgcggcggcatgacgaccctgagcggtgcgctcgggagctcgccatggaggcgaagaggctcgagacctttgacaacctcacggtgatcgtggtctgtttcgtgtcggagctcagcggggggccggcgcccctagagccgacatccaatagtaggctaaggtgctgcaagagcttgtctccggaggcactctccaagctgaggcgatggctggactccgaccactagaccattctgttgtagaagtagagggctctgttctgtgctgcggccgtgtaaatatcggtgctgatgttcgtccctctattatggctgtgcttacatagttacatggccagcaattttgtagcgagttcctggcagcgagtctgttcctgctgctgcttttgttttacaccatttgttggatgtacataccattgtttggtaactgttgtccggctcgccagagggtttgttttggtaactagtttgcagccccgttgcctgctggggtggagggtttttttttttttttttagcattgcgttgtttacagtagtctgtcaatgatgtgatgcaaacatgaatatctgcaaccagggcttcagtgtgctgat

SEQ ID NO: 5596 - protein, 389 aa, Panicum virgatum
  misc_feature: Ceres CLONE 1822942
  misc_feature (1)..(265): Pfam Name: PP2C Pfam Description: Protein phosphatase 2C
MGAGAEVMHQVVPLLETPFHRCVVKSVEVVEEVVAVAPMPVQVAAPASPKAVVQELKRFSNAGDSVSVEPLQFVPSIRSGSFADIGPRRYMEDEHIRIDDLSAHLAPVLMFSELSAFYGVFDGHGGSDAAAYMKKHAMKLFFEDAEFPQASQEDKMFAESVEDSVRKAFLRADLALADDSLINRSSGTTALTALILGRQLLVANAGDCRAVLCRKGVAVEMSKDHRPTYDAERQRVIESGGYIEDGYLNGVLSVTRALGDWDMKLPQGSASPLIAEPEIRWTTLTEDDEFLIIGCDGIWDVMTSQHAVSTVRKGLRRHDDPERCARELAMEAKRLETFDNLTVIVVCFVSELSGGPAPLEPTSNSRLRCCKSLSPEALSKLRRWLDSDH

SEQ ID NO: 5597 - DNA, 1105 bp, Panicum virgatum
  misc_feature: Ceres CLONE 1822963
  misc_feature: Encodes the peptide sequence at SEQ ID NO. 5598
cccaccagccaactgccacacgtcgtcttctcttccccatctgcgctgcgccgcccgccaccgaggacccaggcggcgagagatggagtcgccgttccggccggacgtgctgagcggcaaggcggcgctggtcacgggcgggggctccggcatcggcttcgagatcgccacccagctcgcgcgccacggcgcgcaggtcgccctcatgggccgccgccgcgaggtcctcgacaaggccgtcgccgcgctccggtcccagggcctcagggctgttggtttcgatggagatgtccgcaagcaagaggatgctgcacgggtgcttgcagcaaccgttgagcattttggaaagctggacatccttgtcaacggtgcagccggcaatttccttgcttccccagaggatttgaagcccaagggattccaaaccgttcttgacattgatactgtgggtacatacacaatgtgttacaaagccatgaagtatctcaaaaaaggcggaccagggagagagccatcctctggtggtctcatcataaacataagtgccacactgcactacactgcagcttggtaccaaattcatgtctctgctgctaaggcaggcgtggatagtatcaccagatcattagccctggaatggggagcagattatgacattagagtcaacggaatcgcaccaggaccgattcaagacactccaggaatgaggaagcttgcacctgaggaaatgagcaaggggcgtcgagaaatgacaccattatttaagcttggagagaaatgggacatagcaatggccgcactctatctggcttctgatgcaggaaaatatgtcaatggggctacaattattgttgatggaggcctttggttaagtcgtcctcgccatattcccaaggaggaagtgaaggcgctctctaaggttgtcgagaagaaggtcgggacctctggggttggcgtgccatccagcaaattgtgatggcaaatttggctatgtacctcttcagtgtgttctgtaccatattgatgtcactcaccagtattgttgtcagtttggtaatgccagctgagcagagtctgtttagttcaaaaaaaaaaaaaaaaaaaa

SEQ ID NO: 5598 - protein, 297 aa, Panicum virgatum
  misc_feature: Ceres CLONE 1822963
  misc_feature (1)..(175): Pfam Name: adh_short Pfam Description: short chain dehydrogenase
  misc_feature (1)..(297): SWISSPROT Homolog: EC 1.3.1.34 Peroxisomal 2,4-dienoyl-CoA reductase
MESPFRPDVLSGKAALVTGGGSGIGFEIATQLARHGAQVALMGRRREVLDKAVAALRSQGLRAVGFDGDVRKQEDAARVLAATVEHFGKLDILVNGAAGNFLASPEDLKPKGFQTVLDIDTVGTYTMCYKAMKYLKKGGPGREPSSGGLIINISATLHYTAAWYQIHVSAAKAGVDSITRSLALEWGADYDIRVNGIAPGPIQDTPGMRKLAPEEMSKGRREMTPLFKLGEKWDIAMAALYLASDAGKYVNGATIIVDGGLWLSRPRHIPKEEVKALSKVVEKKVGTSGVGVPSSKL

SEQ ID NO: 5599 - DNA, 1185 bp, Panicum virgatum
  misc_feature: Ceres CLONE 1822966
  misc_feature: Encodes the peptide sequence at SEQ ID NO. 5600
ctgacccctaaccacacaaggctcagcgctagcgttcctcgcgcccgcgccgccccgatcggaaacaaggaagcatggacgcggccgtctcgaatccgtcgtcgatcaagaggatcgcgctggtcaccggggggaacaaggggatcgggctggagacgtgccggcagctggcgaccagggggctcaaggtcgtcctgacggcgaggaacgaggcgagggggctggaggcggtcgaggccatcaggcgctccagcggcgccgccgccgccgccgaggttttcttccaccagctggacgtcaccgacccctccagcgccgcccggctggcggatttcgtcaggggccagttcgggaggcttgacatcctgatcaataatgctgggatttcaggtgttgaccgagatccaattttgtttgccaaagtcaaggatcaggttgaaggcatggatgtgaaccagagagttgagtggatgacagaaaattcaaaagagacatacgaggaagctaaacaatgtatgaggacgaactactatggtgccaagattgtcacggaggcactacttccccttcttcagttatcctcttccggaaggattgtcaatgtttcgtcaggctttgggctgctgagaaacttcaacagtgaagaacttaggaaggagtttgatgacattgacaatcttactgaaaagagactggaagaactgttggatttgttcctagaagattttaaggccaacttattagaggcacatgggtggccaacaggtggatcttcagcctacaaagttgccaaagcagcccttaatgcatacacaaggattcttgctaagaagtatcctacactgcgtatcaactgtctgacacctggttatgtcaagaccgatatttgtatgcacatgggagtattgacacttgaagagggtgctcgcaaccctgtaaaagtcgctctcttgcctgacgatggcccaaccggtgcttattttgatctgaatggggaggcgccctttgtgtgatcatattatttgatcacgtttcccttactcagttttagaataatagaaaaggatatagagttgttggtgctgataaatattgtagtttgacttgtgtactcaaactatatgattcatcgtcttctatatgatctctctggagacgttttcacaaaaaaaaaaaaaaaaaaaa

SEQ ID NO: 5600 - protein, 312 aa, Panicum virgatum
  misc_feature: Ceres CLONE 1822966
  misc_feature (1)..(154): Pfam Name: adh_short Pfam Description: short chain dehydrogenase
MDAAVSNPSSIKRIALVTGGNKGIGLETCRQLATRGLKVVLTARNEARGLEAVEAIRRSSGAAAAAEVFFHQLDVTDPSSAARLADFVRGQFGRLDILINNAGISGVDRDPILFAKVKDQVEGMDVNQRVEWMTENSKETYEEAKQCMRTNYYGAKIVTEALLPLLQLSSSGRIVNVSSGFGLLRNFNSEELRKEFDDIDNLTEKRLEELLDLFLEDFKANLLEAHGWPTGGSSAYKVAKAALNAYTRILAKKYPTLRINCLTPGYVKTDICMHMGVLTLEEGARNPVKVALLPDDGPTGAYFDLNGEAPFV

SEQ ID NO: 5601 - DNA, 1093 bp, Panicum virgatum
  misc_feature: Ceres CLONE 1823006
  misc_feature: Encodes the peptide sequence at SEQ ID NO. 5602
acgccggaccctgccacttgcacccaagcccccaaaccctctgcggcgctccctcccccactccgtctccctcgcaatggcggcgccgcctctccagcccgtgccaccgcccgcggccgtgaacggcgacgcgttccgcgtgggtttcatcggcccgggcaacctggcggagagcatcgcccgcggcgtcgcggcgtcgggcgtcctcccggccaacgccatccgcaccgcgccccaccgccgccccgagcgcggcacggccttcgcctccatcggcgcgtgcctgctcgacaccaatgcccaggttgtcgacgacagtgatgtgattgtcatctccgtgaagcctcagatcgtaaagcaggttatacttgaactgaagccactgctgtcagatgaaaagcttctggtgtctattgctgctggcgtcaagatgaaagatttgcaggattggtctggtcaacggagaatcattagagtaatgcccaacaccccttcagctgttagacaagctgcatcagtgatgtgtttgggagagatggctactcagaaagatgcgaaccgtgtaagaagtttattcagcgccattggaaaggtttggacagctgaagagaaatattttgatgctgtaactggcctgagtggtagcggtccagcctacattttcttagcaatagaggccatggctgatggtggagtcgctgctgggcttcctcgggaccttgcacttggtcttgcatctcaaacagttcttggtgctgcaaccatggtgagcgagacaggaaaacatccaggccaactgaaggatcaggtcacttctccagcaggcactactatagctggggttcaggagctcgagaagggtgcattccgtggaacgctgatcagtgctgttgttgctgccgcaaagcgttgctgcgaactgtcctagatctaggttgaagttcatcttaccagatttcgacagttgcattctgttgatatattcgtcttgaacggcatggtgtgaattgttgggataataacttgacagcttttagagcagtcgtgatgtaatcggttaaacatgttttgcaaaaaaaaaaaaaaaaaaaaa

SEQ ID NO: 5602 - protein, 283 aa, Panicum virgatum
  misc_feature: Ceres CLONE 1823006
  misc_feature: Great-hit functional homolog of the protein sequence given in SEQ ID NO 9419
  misc_feature (1)..(247): Pfam Name: F420_oxidored Pfam Description: NADP oxidoreductase coenzyme F420-dependent
  misc_feature (18)..(283): SWISSPROT Homolog: EC 1.5.1.2 Pyrroline-5-carboxylate reductase
  misc_feature: Useful for making plants with modulated drought sensitivity
MAAPPLQPVPPPAAVNGDAFRVGFIGPGNLAESIARGVAASGVLPANAIRTAPHRRPERGTAFASIGACLLDTNAQVVDDSDVIVISVKPQIVKQVILELKPLLSDEKLLVSIAAGVKMKDLQDWSGQRRIIRVMPNTPSAVRQAASVMCLGEMATQKDANRVRSLFSAIGKVWTAEEKYFDAVTGLSGSGPAYIFLAIEAMADGGVAAGLPRDLALGLASQTVLGAATMVSETGKHPGQLKDQVTSPAGTTIAGVQELEKGAFRGTLISAVVAAAKRCCELS

SEQ ID NO: 5603 - DNA, 1244 bp, Panicum virgatum
  misc_feature: Ceres CLONE 1823016
  misc_feature: Encodes the peptide sequence at SEQ ID NO. 5604
gaccaaacacttgcattgcacgtagccctatcccatcatctattcaaagattccaaacccctatctctgtataaatatctgtccctgctgcaagcaatgtctatctatcgatcgagaacaagaaccatctcactgcagtctcatctcatcatggcgttccaacgccaccgttcgtggctgctcctcctcgccctcgcttgcctgttgtacctcgctgccacggccgccgaggccaagcggaccggcgagctgacggtgttctggggccggaacaaggacgagggcaccctgcgcgaggcctgcgacgccgggctgtacaacaccgtggtcatctccttcctccgcgtcttcggccacggtaaatactggaccgacctctcgggccacccgctccacggcatcggcgccgacatcaagcactgccagtccaagggcatcccggtgttcctctccatcggcggcgggggcaccgactactccctcccgtcctcggcgtcgccggaggccgtcgcgaaccacctctggaacgcgtacctcgggggcggcagcggcgatgtgttccgccccttcggcgacgcggcggtcgacggcgtcgacttctacatcgaccatggcgcgccctccgagccctacgacgagctcgcgcgccgcctcgactacttcaacagcatgtactaccacgccacggccaagcacgtgcggctcacggccacgccgcgctgcgcgttcccggaccgccgcctcgagcgcgcgctggagacggggctgttcgagcgcatccacgtccgcttctacggcgacgaggaggagcggtgctcgtacaagaatggcggggtcgacggcgtcgtggaggagtgggagaagtggacggcgaggtaccccgggagccagctctacgtggggctcgccgcggccgagagcggcgtgccggatggggcgtcgccgcccgtcgaggtgtacctcaagtacctctactacgacctgctgcccaaggtgcagaaggcggacaactatggcgggatcatgatctgggacaggttcaccgacagcaggaccggatacaacaccgccgtcaagggctgggcgtcctgctcttatggcggctgtgtttaatttatttatttcactataatatatatatatatatatatatatatatatatatgcgcgcgcgccattactgtatggactgcagttgctttcgattgcagtcaatggaataaaaataaggctgatgaatttcc

SEQ ID NO: 5604 - protein, 338 aa, Panicum virgatum
  misc_feature: Ceres CLONE 1823016
  misc_feature (1)..(263): Pfam Name: Glyco_hydro_18 Pfam Description: Glycosyl hydrolases family 18
MSIYRSRTRTISLQSHLIMAFQRHRSWLLLLALACLLYLAATAAEAKRTGELTVFWGRNKDEGTLREACDAGLYNTVVISFLRVFGHGKYWTDLSGHPLHGIGADIKHCQSKGIPVFLSIGGGGTDYSLPSSASPEAVANHLWNAYLGGGSGDVFRPFGDAAVDGVDFYIDHGAPSEPYDELARRLDYFNSMYYHATAKHVRLTATPRCAFPDRRLERALETGLFERIHVRFYGDEEERCSYKNGGVDGVVEEWEKWTARYPGSQLYVGLAAAESGVPDGASPPVEVYLKYLYYDLLPKVQKADNYGGIMIWDRFTDSRTGYNTAVKGWASCSYGGCV

SEQ ID NO: 5605 - DNA, 1205 bp, Panicum virgatum
  misc_feature: Ceres CLONE 1823019
  misc_feature: Encodes the peptide sequence at SEQ ID NO. 5606
gtcgcatcgaatccaccctccgcttcgtccccccaggtccgggcggcgccggggcggagaaaatggcctcggcggcgtcggcgccggtattcgagagggtggccgggatccgaaccatcgccgagtccggccgctttaaggcctggttcttggaccagttcggcgtccttcacgacggcaagaagccgtaccccggcgccattttggcattggagaagcttgcagtgaatggggcgaagatggtgataatcagcaattcctctaggcggtcgtctgtgacaatggataagctcaagagcctgggtttcgatacatcttgtttccttgcgaccatcaccagtggggagctcacacatcaacaccttctcaagaggaatgatccatggtttgctgcccttggaagaaagtgtatccatatcacctggggcaatcgtggtgcgatttctctagagggtcttggtttggaagttgtggacaatgttgatgatgcagaatttatattagcccatggtactgaagcccttggttcaccttccggtgaccctcttcccaaaagtcttgaggagcttgagcaggttctaatgcttggcctagaaaggcagcttccaatggtggtagctaatccggattatgtcactgtcgaagctcgagatttacgtgtcatgcctggcactctggcagctaaatatgagaatctcggtggtgaagtgaaatggatggggaagcctgataaggtgatctataactcagcaatgtccctagctggagttgatgcttatgaatgtatcatggtgggtgattcactgtaccacgatgtcaaaggggcaaatgcatcaggaatcgcatctgcgttcattactggagggattcatgcagctgaacttgggctcagtgaatctggagaaactactggggaggatgccatcaatacactgtgtagcaagcatggatcatatccctcatatgttttgccttcatttacatggtagaaacacggtccagttatttcttttggggtgcacccttaacaccggaaagtgattttaggcaaacaactgttctggaagagtctcaggaggatgaagcccttggaggcattactttctgtacttaataattgccatgattgttcgataatcgttgattttgatcaataaaagctggatgcagctatgctatgaagtcaaaaaaaaaaaaaaaaaaaa

SEQ ID NO: 5606 - protein, 308 aa, Panicum virgatum
  misc_feature: Ceres CLONE 1823019
  misc_feature (1)..(103): Pfam Name: Hydrolase Pfam Description: haloacid dehalogenase-like hydrolase
MASAASAPVFERVAGIRTIAESGRFKAWFLDQFGVLHDGKKPYPGAILALEKLAVNGAKMVIISNSSRRSSVTMDKLKSLGFDTSCFLATITSGELTHQHLLKRNDPWFAALGRKCIHITWGNRGAISLEGLGLEVVDNVDDAEFILAHGTEALGSPSGDPLPKSLEELEQVLMLGLERQLPMVVANPDYVTVEARDLRVMPGTLAAKYENLGGEVKWMGKPDKVIYNSAMSLAGVDAYECIMVGDSLYHDVKGANASGIASAFITGGIHAAELGLSESGETTGEDAINTLCSKHGSYPSYVLPSFTW

SEQ ID NO: 5607 - DNA, 1537 bp, Panicum virgatum
  misc_feature: Ceres CLONE 1823039
  misc_feature: Encodes the peptide sequence at SEQ ID NO. 5608
accactacccgtcgcgtccatccgtttcctcccccacccccccttctctctcctccccacacgcccggctgcccaccgctcctcctcctcccacctctcatgcgcgagggtccgtggggtccaccgcctcccgccgcgcgcctctcgcccccgcttccggtgctggtggtggtgctgctgctcctcctctccctcctgctcgcggggcggccggcctcctgctcctgccgctcggaggaaggcgccgcgggggtggcggcggcagcagcaaagcgcatggggctcgacggggacgggccgccggacgccgccggcggcatcagtaacagtgaaaatggtcgctacatttatggagttgcaagttctcctgggaaaagagcatcgatggaggacttttatgaggcaaggatagacgacgttgatggagagaaagttggaatgtttggcgtatatgatggtcacggtggagtgcgagcagctgaatatgtcaagcagcaccttttcagcaatttaattaaacacccaaagttcatcactgataccaaggctgcaatcgccgaaacttacaaccaaacagattcagaatttttgaaagctgatagtagtcagactcgagatgctggctcaactgcctcaacagctattattgttggtgatcgtttacttgttgcaaatgtcggagattctagagccgttataagtaaaggtggacaggccattgctgtttcaagggatcacaaacctgatcagtcagatgagagacaaagaattgaggatgctggaggcttagttatgtgggctgggacatggcgtgtgggtggtgttcttgccgtttctcgagcatttggtgataaactcttgaagcagtatgttgttgctgacccagaaatcaaggaggaggtggttgacagctcccttgaattcctcatccttgctagtgatggactctgggatgtcgtgactaatgatgaagctgttgccatggtgaagcctattcaggacccccaggaagcagcagacaagcttctccgagaagcttccaaaaggggaagttccgacaacatcacagttgtcattgtccgcttcctagatggaacgacctctggtgataaatcaggcgaagagaaagagaaagagtctgcccatgaccaaacttcctagttgctcatgcagaatcatgcatgcgttcttctggatgttgtatctgatgctcgaagtagatgccttgtcgctgtgcgtccgcgcagctgttccgcaaggaaactgactcgccccaactgtcattctcctgttgctcttggtcttggctggcctagatggacgacagggctagtgctgttactgtatgatccaaggtggactcttccatttccattaagctttgtaatgtagcttttccgttgctgttgattcatgaatcgtgcttggaggttttcttcgcagcaagtgcgtgtaaaactgttggaacgatttgaagcaagctgtgcaccgcagtatgtaacaattaatctcccaacaaaaaaaaaaaaaaaaaaaa

SEQ ID NO: 5608 - protein, 353 aa, Panicum virgatum
  misc_feature: Ceres CLONE 1823039
  misc_feature (1)..(241): Pfam Name: PP2C Pfam Description: Protein phosphatase 2C
MREGPWGPPPPAARLSPPLPVLVVVLLLLLSLLLAGRPASCSCRSEEGAAGVAAAAAKRMGLDGDGPPDAAGGISNSENGRYIYGVASSPGKRASMEDFYEARIDDVDGEKVGMFGVYDGHGGVRAAEYVKQHLFSNLIKHPKFITDTKAAIAETYNQTDSEFLKADSSQTRDAGSTASTAIIVGDRLLVANVGDSRAVISKGGQAIAVSRDHKPDQSDERQRIEDAGGLVMWAGTWRVGGVLAVSRAFGDKLLKQYVVADPEIKEEVVDSSLEFLILASDGLWDVVTNDEAVAMVKPIQDPQEAADKLLREASKRGSSDNITVVIVRFLDGTTSGDKSGEEKEKESAHDQTS

SEQ ID NO: 5609 - DNA, 1963 bp, Panicum virgatum
  misc_feature: Ceres CLONE 1823130
  misc_feature: Encodes the peptide sequence at SEQ ID NO. 5610
gtgagcgacgcatcgcggcgcagcccccacctcccctccacccctcgtctcccgccgcatctccgcggcgcggtccttcccgacgagccgccgccgccgccgctccccctccatcggccagggagaagatggagggagctggcaaggatggcaacccgctgaggaattaccggattggtaagactctggggattggttcattcggtaaggtcaaaattgcggagcatataagtactggacacaaggtggcaatcaagatcctcaaccgtcgtaaaatcagaggcatggagatggaagaaaaagttaagagagagattaaaatattgaggttatttatgcacccacatatcattcgcctctatgaggtcatagacacgccggctgatatttacgttgttatggagtatgttaagtccggggaattgtttgattacattgttgagaaaggtaggttgcaggaggacgaggctcgccgtttcttccaacagattatatccggtgttgaatattgccatagaaacatggtggtgcatcgtgatctaaagccagaaaacctcctattggattcaaaatgcaatgttaagatagcagattttggtttaagtaatgttatgcgggatggtcattttctcaagacaagctgtggtagcccgaattatgctgctcctgaggtgatatctggtaaactatatgctggtcctgaagttgatgtgtggagctgtggagttattctttatgcgcttctatgtggtaccctgccatttgatgacgagaacataccaaacctttttaagaaaataaagggtggaatatatacccttcccagccatttgtcaggtgcagcaagagatttgattccaagaatgctggttgttgatcctatgaagcggattaccattcgtgagattcgtgaacatgattggttcaaaattcatctcccgcgctatttgaccgtgcctcctccagatagtgcacaacaagttaaaaagattgatgaggaaactctccatgaggttataggtatggggtatgacaagaatctgttggtggagtcaatccaaaatagactgcaaaatgaggcaactgttgcatattatttattgttggacaatcggctccgtacaaccagtgactatctcggagctgaatgccaagaagttatggactcctcattctcaaacatagcatcatatgaaacaccaagttcagcacgtgggaatcggcagcaaatatttatggactctccagttggcttgagacagcattttccagctgaaaggaaatgggctcttgggcttcagtcgcgagcacatcccagagaaataatgactgaagtgctgaaagctctgcaagaattgaatgtttactggaaaaagattggtcactataatatgaagtgcagatggaatcctggctttcctggtcaaattcataacaatcataacttcagcgcagagtccattggaactgacggcttgagtgagaggttaaatttgatcaagtttgaaattcagctttacaaaacaagagacgagaaatacctccttgacttgcaaagagtcaatggaccacaactcctctttctggacttgtgtgcggcctttctagctcagctcagagttctttgattcccggtgtttgccttccatcaattgcattccttacgtttcactagaggaatgtcgaatctcttacaaagctgtaaatagtaatctctccagtagattgaatttctggagtatgtagattgtagacatgcgaagctgttgtgcgtggctatcctctgaactagactttgtggggcaagatgcctcctggttctttacggctggcccggctgccagtgaaggcactaggatatacagtgaactagtgataagtgcttttgctggcaaaatgtctatctacatgaataatctcagctattacaatggctaattgaaagctgagctgcttacaggcc

SEQ ID NO: 5610 - protein, 499 aa, Panicum virgatum
  misc_feature: Ceres CLONE 1823130
  misc_feature (1)..(499): SWISSPROT Homolog: EC 2.7.11.1 SNF1-related protein kinase catalytic subunit alpha KIN10
  misc_feature (11)..(499): SWISSPROT Homolog: EC 2.7.11.1 SNF1-related protein kinase catalytic subunit alpha KIN11
MEGAGKDGNPLRNYRIGKTLGIGSFGKVKIAEHISTGHKVAIKILNRRKIRGMEMEEKVKREIKILRLFMHPHIIRLYEVIDTPADIYVVMEYVKSGELFDYIVEKGRLQEDEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSGAARDLIPRMLVVDPMKRITIREIREHDWFKIHLPRYLTVPPPDSAQQVKKIDEETLHEVIGMGYDKNLLVESIQNRLQNEATVAYYLLLDNRLRTTSDYLGAECQEVMDSSFSNIASYETPSSARGNRQQIFMDSPVGLRQHFPAERKWALGLQSRAHPREIMTEVLKALQELNVYWKKIGHYNMKCRWNPGFPGQIHNNHNFSAESIGTDGLSERLNLIKFEIQLYKTRDEKYLLDLQRVNGPQLLFLDLCAAFLAQLRVL

SEQ ID NO: 5611 - DNA, 1684 bp, Panicum virgatum
  misc_feature: Ceres CLONE 1823257
  misc_feature: Encodes the peptide sequence at SEQ ID NO. 5612
acagctccactcgccgagtcaccggcagcccgcagccttgcgggagcccaaaatccacccggaagcttgaccaccggacggtttgctcgccaccccctcgcttcctccgcccgcccgcccgccgcgatacgcctccctcggtccccgatcaccgcctcggccggctccgccctcgcgcagtcaggctcatcgacacccgtatgcctctccacgccgcgtgcgttgcagggcgtggcctcccgtcgtcctcctcgccccctcgcgccggcggcaggcgctccctctccgccggcgagaggccccacagcgtcgcctttgccgcgccgctccggacgcgcgcagttcggacaaaggcggtcttaagcagtgatggtgcccctggaatgagcgattctccccatgtagtgtgctttggcgaattgctaattgactttgttccaactgtcaatggagtgtcattggcagaagcaccagccttcaagaaggctccagggggtgcacctgccaatgttgcagttggaatagctcgccttggtgggtcatcagctttcattgggaaggttggtgatgacgaatttggctatatgttagctgatatattgaagcagaataatgtaaacactcaaggattactttttgatgctcatgctagaacagctttggcttttgtgacactacgaagtgatggtgaacgtgaatttatgttctatcgtaatccaagtgctgatatgctacttgaagaaaaagaacttgaacttgatctaataaggaaggcaaaaatattccatcatggctcaataagtcttatagctgagccttgtaaaactgcacacattgcagctgccaaagcagctagagatgctggagtacttgtttcatatgatccgaatttgaggcttccattgtggtcatcagctgaggacgctagagatggtatcctgagcatatgggaaactgctgatgttatcaagataagtgaagaggaagtttcctttctgacgaacggggaggatccatatgatgatgctgttgtgaagaaacttattcaccccaacctgaaattgcttcttgttactgaaggtccagatggctgtaggtattattctaaggattttagtgggagagttggtggactgaaggtaactgctgttgatacaactggtgctggagatgccttcgttgctggaatactatctcaattagccacagatttttcactgctccaggacgaaggccgattgcgagaagccctgaagtttgcaaacgtctgtggagctctgacggtgacagagagaggcgcgattccagcactgcccgcccgacagcaagtgctcgactcccttgccatcgttgttgcctgaatgaccagcgtccttcttgctgcgcatggcaatgtgaatcagcagagcgcatgtcagatcaggtgtgatttcgtttccctaccaattgatatcttggcggtgtgacccccataggccaaataaatccggtgcatgaggctgtttcctgtccattttttaccgtgtataataaagttggattccgagccatcgttatcaggtttatgagtgttgggcatgtctccgaatacctgtacagccttgctggataataacatgagtgcatcacgaaagcagtttgccacgggaagcgtggctctgattaaaaaaaaaaaaaaaaaaaa

SEQ ID NO: 5612 - protein, 386 aa, Panicum virgatum
  misc_feature: Ceres CLONE 1823257
  misc_feature (1)..(310): Pfam Name: PfkB Pfam Description: pfkB family carbohydrate kinase
  misc_feature (52)..(382): SWISSPROT Homolog: EC 2.7.1.4 Fructokinase-2
MPLHAACVAGRGLPSSSSPPRAGGRRSLSAGERPHSVAFAAPLRTRAVRTKAVLSSDGAPGMSDSPHVVCFGELLIDFVPTVNGVSLAEAPAFKKAPGGAPANVAVGIARLGGSSAFIGKVGDDEFGYMLADILKQNNVNTQGLLFDAHARTALAFVTLRSDGEREFMFYRNPSADMLLEEKELELDLIRKAKIFHHGSISLIAEPCKTAHIAAAKAARDAGVLVSYDPNLRLPLWSSAEDARDGILSIWETADVIKISEEEVSFLTNGEDPYDDAVVKKLIHPNLKLLLVTEGPDGCRYYSKDFSGRVGGLKVTAVDTTGAGDAFVAGILSQLATDFSLLQDEGRLREALKFANVCGALTVTERGAIPALPARQQVLDSLAIVVA

SEQ ID NO: 5613 - DNA, 1712 bp, Panicum virgatum
  misc_feature: Ceres CLONE 1823285
  misc_feature: Encodes the peptide sequence at SEQ ID NO. 5614
agtgggcttgcttgttcgctcgctgcctctctcctccgttgcgctcatgtgttggtgcttcgcctgcctcggcctgttctgagttcatcaggttgtttgctggattctttagtatcccatcaggccaaggatcctgcgagagctttggagccagagggttgttgcctccgtcttgggtgaggcttcagtttcctttgacgaggcaaggcggcgataatgagcttcaagggccacgaggggcttgggcaggtggccgccgggagccaggcctcccatgttgcggccggagccccactgccgtggtgggcgggcccccagctgctgtacggcgagtcggcacccctgtcgccggaggagacgcgccgggacggccagttccaggttgtgccgggggctcagggcggcacaccggatccggcgccgccggctgccaccaagagagggagccctgaggtcttgaaattctctgtgttccaagggaatctggagtcgggtggtaaaggagagaaaaacccagaacactctaccactatcgcgctgcagtcaccatttccagaatacaatggccgtttcgagatcggtcttggtcaatccatggtcccttccaattattcttgtgatgaccagtgctatggcgtgcttaccacttatggaatgagatcaatgtccggtgggaggatgctcttgccactgaatgcacctgctgatgcacccatctacgtgaatccaaagcagtacgaaggcatcctccgtcgccgccgcgcacgcgccaaggccgagagagagaacaggctggcgaaaggcagaaagccgtatcttcacgagtctcgccacctccacgcgatgcgccgggcaagaggctccggcgggcgcttcctcaacacgaagaaagaggggggtggcgcgaacgcgaacggcgccggcaagacggtgtcagcgcgcctcgccacgtctcctagcaccgagcctccacgggtgccggagctcggcaagggcaacaacggcagcaacccgcgctgccactcccggagcagcgtctccagcctgtccggctccgaggtgacgagcatctacgaccaccacgacgaccacgcgagccgccaccagtacggcggcatggagccgcacctccgggcgccttccttcttcaccccgctgccggccatcatggacggtgaccacggcggggctgccaccatcccctccttcaagtgggttgccagcgacggctgctgcgagctcctcaaggcgtgaaccgaggaggaggggatggctactcagacggccggccttcgccccgttggctggctgtctgtctgtaggcaaatcattcttggctgttctgcaatgggttttgaacctcctcatcacctagctacctacccatgtccctgaaactcgtacagtgctgggtttcaggggtcctgtgatgctggagctcccccatatgcctgtaacatagtgtacccaaaagcactgctgcttggtactgcttgttgatagcagtgtctcagtacgtaattctgtgatgtcaggtcgatcagtgtctgaataattgaggtgtcggacttcacagttgctccagttctcggattggaggtgtgtctgggtctgtttgaagctttgaggtctgaaactttgtgctcggtgaagatactgtgcttaatgtgtaagtttgggacccgttctgctaaaaaaaaaaaaaaaaaaaa

SEQ ID NO: 5614 - protein, 345 aa, Panicum virgatum
  misc_feature: Ceres CLONE 1823285
  misc_feature (1)..(57): Pfam Name: CBFB_NFYA Pfam Description: CCAAT-binding transcription factor (CBF-B/ NF-YA) subunit B
  misc_feature: The sequence is a functional homolog of  SEQ ID NO 1334 in the  11/479,226 US patent application
  misc_feature: Useful for making plants with modulated growth and phenotype characteristics
MSFKGHEGLGQVAAGSQASHVAAGAPLPWWAGPQLLYGESAPLSPEETRRDGQFQVVPGAQGGTPDPAPPAATKRGSPEVLKFSVFQGNLESGGKGEKNPEHSTTIALQSPFPEYNGRFEIGLGQSMVPSNYSCDDQCYGVLTTYGMRSMSGGRMLLPLNAPADAPIYVNPKQYEGILRRRRARAKAERENRLAKGRKPYLHESRHLHAMRRARGSGGRFLNTKKEGGGANANGAGKTVSARLATSPSTEPPRVPELGKGNNGSNPRCHSRSSVSSLSGSEVTSIYDHHDDHASRHQYGGMEPHLRAPSFFTPLPAIMDGDHGGAATIPSFKWVASDGCCELLKA

SEQ ID NO: 5615 - DNA, 1550 bp, Panicum virgatum
  misc_feature: Ceres CLONE 1823440
  misc_feature: Encodes the peptide sequence at SEQ ID NO. 5616
aactccccgagctccgatccgaccaacgccgccgtctcggcgcccgtgccggcgtcgcgcgcaggggaggaagaccggccggccggcccgcccgccgccatgccgagctccccgaaggtcttcttcgcctcctcgaccccctcctcgcgccgcgcgggggcgctgcgccggttgctctcctcgccggccttctccgtggcctgcctcctcttcggcctcgccggcttcctcgccgccgctctcaccctctccgcctccccgcccgccgcgcgcagccgctgcccggactcctcccgcccgctctccgtctccgtcgcgtgggaccgccgccccggggatgtctcttccgcgggctccgcggagctcccggcccacctcaccaccggatcgcgcggccggcacaaggtcatggccttcgtcgggatcttcaccgggttcagctccatcgggcgccgccgcgcgctgaggcggacgtggctccccgcggatcgccagggcctacttcgattggaggaagctactggtctggcattccggttcgtgattgggaaaagcaactcaaagaacaagatggctgttcttgacagagaagttgaagaatttgatgattttgtgcttttagatatcgaggaggagtatagcaggctcccatacaaaacgttagccttctttaaggctgcctatgcattgtatgattctgatttctatgttaaagctgatgatgacatctacctgcgaccagatagactttccttgcttttggctaaagagcggtcacatccacaaacatatattggatgcatgaagaaggggccagttttcactgatcctaagttgaaatggtatgagccccaatccttcttacttggatctgaatacttccttcatgcatatgggccaatttatgctttgtcagctgacgtggtggctagtttggttgccttgagaaacaacagtttccgtatgttcagcaatgaggatgttacaattggatcctggatgcttgctatgaatgtcaaccatgagaacacgcatgcactttgtgagccagactgcacagagtcctcaattgctgtttgggatattccaaaatgctcagggctatgccatccagaggtaaaaatgctagagcttcatcaaagaaaagaatgcacgggtggtccaaccgtggcagctgaggtgtcggagtctgatgaccgatgatttcttcatccgaaacacgaactgcatagttgacctctgcccctaacacaatagatgtgcttggagtattcattggattcgtcaggtacaatcattgcgggatcactgttcaagaaacctatacaggcagcgtcataacctagcgctgtagcaaaggcatcctcgttcagcattcttgtcacagcagccttctttgctcttcctttttacaatgcaaccatgatggtcgcttggaacgtccatcctgtctcgtagtagagaggaattttgttgtatagaaattgaagagaatgcattggcaattgaatagaccacacacaccttccgaaaaaaaaaaaaaaaaaaaa

SEQ ID NO: 5616 - protein, 367 aa, Panicum virgatum
  misc_feature: Ceres CLONE 1823440
  misc_feature (1)..(196): Pfam Name: Galactosyl_T Pfam Description: Galactosyltransferase
MPSSPKVFFASSTPSSRRAGALRRLLSSPAFSVACLLFGLAGFLAAALTLSASPPAARSRCPDSSRPLSVSVAWDRRPGDVSSAGSAELPAHLTTGSRGRHKVMAFVGIFTGFSSIGRRRALRRTWLPADRQGLLRLEEATGLAFRFVIGKSNSKNKMAVLDREVEEFDDFVLLDIEEEYSRLPYKTLAFFKAAYALYDSDFYVKADDDIYLRPDRLSLLLAKERSHPQTYIGCMKKGPVFTDPKLKWYEPQSFLLGSEYFLHAYGPIYALSADVVASLVALRNNSFRMFSNEDVTIGSWMLAMNVNHENTHALCEPDCTESSIAVWDIPKCSGLCHPEVKMLELHQRKECTGGPTVAAEVSESDDR

SEQ ID NO: 5617 - DNA, 1115 bp, Panicum virgatum
  misc_feature: Ceres CLONE 1823467
  misc_feature: Encodes the peptide sequence at SEQ ID NO. 5618
acacaagagagcggagttcttatccggttcttcgccggccgtgcgcgctctgcagagtgcagagtactgggcagcgagtgcaaggactacctgttttgttcacttgttctagcgcgtcatgatgggcagcgagtgcaaggaccacctgcagctccacgccggcttcggcggcggcggcgggggaggcgcgcagcagcagcatcgccaggaggaggcggtcgccgtcgcgccgttcgtcgccaagacgttccacatggtgagcgacccggcgacggacgccgtcgtgcgctggggcggcgccagcaacaccttcctcgtcctcgaccccgccgccttctccgactacctcctgccctcctacttcaagcaccgcaacttcgccagcttcgtccgccagctcaacacctacgggttcaggaaggtggacacggaccggtgggagttcgcgcacgagtcgttcctgcgcgggcaggcgcacctgctgccgctgatcgcgcgcaaaaaaaagaaggccgccggcggcggccgggagctgggcgaggagggggaggaggtgcgcggcaccatccgcgccgtgcagcgcctgcgggaggagcagcggggcatggaggaggagctgcgggccatggaccgccgcctgcgcgccgccgagagccgcccgggccagatgatggcgttcctcgccaagctggccgacgacccgggcgtcgtgctgcgcgccatgctcgccaagaaggaggagctggcggccgccggcaagggcgcgccgccgccgctgccggccgtcgaggcgcccggcaagcgccgccgggtcggggccggggcagaggcggccgtcgcgggcgacgccgcggcggagctggcggcgcagggcaggggtgccgtgccgttccccttctctgtcctcggccaagtgttctactagggtggatagggacagacaggtggacctgtagtagtagtgtgtatatatgactcgtagcataactttgcctccgttttatctgctagtttagtactctagtggtttgtacacggtgaacgggtttgttatgcagagctgagaaagaaaagttagtgtggtgattatggagtaaaaaaaaaaaaaaaaaaaa

SEQ ID NO: 5618 - protein, 268 aa, Panicum virgatum
  misc_feature: Ceres CLONE 1823467
  misc_feature: The sequence is a functional homolog of  SEQ ID NO 1233 in the  11/479,226 US patent application
  misc_feature: The sequence is a functional homolog of  SEQ ID NO 144 in the  10/666,642 US patent application
  misc_feature: Useful for making plants with modulated growth and phenotype characteristics
MMGSECKDHLQLHAGFGGGGGGGAQQQHRQEEAVAVAPFVAKTFHMVSDPATDAVVRWGGASNTFLVLDPAAFSDYLLPSYFKHRNFASFVRQLNTYGFRKVDTDRWEFAHESFLRGQAHLLPLIARKKKKAAGGGRELGEEGEEVRGTIRAVQRLREEQRGMEEELRAMDRRLRAAESRPGQMMAFLAKLADDPGVVLRAMLAKKEELAAAGKGAPPPLPAVEAPGKRRRVGAGAEAAVAGDAAAELAAQGRGAVPFPFSVLGQVFY

SEQ ID NO: 5619 - DNA, 1379 bp, Panicum virgatum
  misc_feature: Ceres CLONE 1823526
  misc_feature: Encodes the peptide sequence at SEQ ID NO. 5620
gcgaggagaaccagtacccactccttatctccctttgttgagtggtcatctagaagattgcatcaagaaacatcctacatatagaccgaattcctagtgaaagtgcacacacaagtaggagatcatggtggccaaggagtttgggagagaagtaataagcatggacaaggtgaagacggacggagaagcgctgatcgccgccggagacgaggaggaagacgacgtggtgctgccggggttccggtttcacccgaccgacgaggagctcgtcacgttctacctccgccgtaaggtggcgaggaagccgctcagcatagagatcatcaaggagatggacatctacaagcatgatccatgggacctccctaaggcgagcacggctggtggagagaaggaatggtacttcttctgcctgcgagggaggaagtaccggaacagcatcaggcccaacagggtcaccggctccgggttctggaaggccaccggcatcgaccgccccatctactccgccaccaataattctggcgagtccatcggcctcaagaagtccctcgtgtactaccgcggcagcgccggcaagggcaccaagaccgactggatgatgcacgagttccgcctcccgccggccgccgccaattcctccccgagcatgcaagaagctgaggtctggaccatctgcaggatcttcaagaggaacatcacctacaagaggcagcagccgcagcagctgtggaggcagccggtggccaccggcaacggtctgccgccggcggactcgagctccaacacggggagcttcgagtccgacggcggggacgagtacatgaacttcctgccgaccgccgctccgagcgtgccccggcagcgtcacttcagcaatcagatgaacatcctaaacggcggcggcggcggcgacttcttcagggagagcgtgcacagccaccagcagtttcagaggcagtggttcaattccgtacctccaccggcaatagagcagaagccgaagctgaactctccggcgatgaccattgcgttccatcagaacgatcagagccttgccgcgaacgattgctacaaagacgggtactgggatgagattaccaggctcatggagatcaatgatccagcagtattttacgactgtagatatgcttgatccatagggagatacctagcttcatcttcagagttcagactccaaattagtattcaccgatcaggaactcaatccagtgtgtaagactgacatgcagggcccgtgccgcagaggccgctagtcagttagattttgcctgcaatctgctcccaaccagacttgtgttttcttttcctgattgaatatatactaatatacaccataaaaaaaaaaaaaaaaaaaa

SEQ ID NO: 5620 - protein, 343 aa, Panicum virgatum
  misc_feature: Ceres CLONE 1823526
  misc_feature: The sequence is a functional homolog of  SEQ ID NO 328 in the  10/374,780 US patent application
  misc_feature: The sequence is a functional homolog of  SEQ ID NO 852 in the  10/225,066 US patent application
  misc_feature: Useful for making plants with modulated growth and phenotype characteristics
MVAKEFGREVISMDKVKTDGEALIAAGDEEEDDVVLPGFRFHPTDEELVTFYLRRKVARKPLSIEIIKEMDIYKHDPWDLPKASTAGGEKEWYFFCLRGRKYRNSIRPNRVTGSGFWKATGIDRPIYSATNNSGESIGLKKSLVYYRGSAGKGTKTDWMMHEFRLPPAAANSSPSMQEAEVWTICRIFKRNITYKRQQPQQLWRQPVATGNGLPPADSSSNTGSFESDGGDEYMNFLPTAAPSVPRQRHFSNQMNILNGGGGGDFFRESVHSHQQFQRQWFNSVPPPAIEQKPKLNSPAMTIAFHQNDQSLAANDCYKDGYWDEITRLMEINDPAVFYDCRYA

SEQ ID NO: 5621 - DNA, 1681 bp, Panicum virgatum
  misc_feature: Ceres CLONE 1823571
  misc_feature: Encodes the peptide sequence at SEQ ID NO. 5622
aaaactcaagtcctacactcccttcatcctcgacccctcaacctcaggcgtcagtagtaggcaccacacgcagacgcaggcagcatggtgaacgaagccagcaaagagcacggcggccacgaggtgaccgtcacggtggcgccggcgctgccggtgcaggggtgccgcctggcgctgtccaacctggacctcctcctgccgccgctcgacgtcagcctcttcttctgctatctccacccggcgcccgccgcggccgcgctcaaggaggcgctggccaagacgctggtggcgtactacccgctggccggggaggtggtggccaacgccgacggcgagccggagctgctgtgcaacggccgcggcgtcgacttcacggtggccaccgcggccgccggcgccgagctgcgggaggtccggctcggcaccgtggacgagggcgttgagaagctggtgcccgccaagaaggccggcggcgttgtggcagttaaggtgaccaagttcgggtgcggcggcgccgtcgtcgggtgcaccttcgaccaccgcgtctgcgacgcctactccttcaacatgttcctcgtcgcgtgggccgcggccgcccggggcagctctgcctccgcgccgccggccccgtccttccgccgctccctcgtcgccccgcgcgacccgccgccgccgcgcgcgccgtgcaccgacgccctcatcgaccgcctgttctgcccccgcagcgccgcgccgcccccacctgccgtcgctgcggcgagctccgtcaaccggatctaccgcgtatccgccgaggacatcgccgcgctgaaggcgtccgcggggccggggcgcacgaagctggaggcgttcacggcgcacctgtggcggctctgctccagggcggcctccccgcgccagagccagtgctgcatgggcgtggtcgtggacgggcgcgcccgcatgtcccccgacggcgccatgaggggctacttcggcaacgtgctcaccatcccctacggcgtcaccggctcggaggacctccgccgcatggccctcgccgacgtggcgggcgacgtgcacaggtgggtggcggaggccgccaccggcgagcacttccggggcctcgtggactgggtggaggcgctgcggcccaagccggcggcggcgagggcgtacctgggaggcaccggcgggaacgaggcgatggcgtgtgtcgtgtcgtccgggatgagcttcccggtggacaaggcggacttcgggacggggctcccggcgttcgcgtcgtaccacttcccgtggcccgccggcgccgggtacgtgatgccgatgccgagcgcgcgcggggacggcgactgggtggtgtacgcccacgcggcgccggagctggccaaggtgatggaggaggagcccaccgtgttcagggcgctggagaacagctacgtgttccagtgacgacgtggataaatgctaatgtgtgtcatggatatctgcctacgctgcatcatctaacagagtaatctgcagactgcagtgcggtgccacgaatttgtgccggtggtaagtatgcttgtgaaaaatattatttgctaaattatgtcggggaatgaatgtagtagaatatgtaatggtgacaaacagtgttattattagtgccaatataatggatttgactgtgtcagaaaaaaaaaaaaaaaaaaaa

SEQ ID NO: 5622 - protein, 449 aa, Panicum virgatum
  misc_feature: Ceres CLONE 1823571
  misc_feature (10)..(437): Pfam Name: Transferase Pfam Description: Transferase family
MVNEASKEHGGHEVTVTVAPALPVQGCRLALSNLDLLLPPLDVSLFFCYLHPAPAAAALKEALAKTLVAYYPLAGEVVANADGEPELLCNGRGVDFTVATAAAGAELREVRLGTVDEGVEKLVPAKKAGGVVAVKVTKFGCGGAVVGCTFDHRVCDAYSFNMFLVAWAAAARGSSASAPPAPSFRRSLVAPRDPPPPRAPCTDALIDRLFCPRSAAPPPPAVAAASSVNRIYRVSAEDIAALKASAGPGRTKLEAFTAHLWRLCSRAASPRQSQCCMGVVVDGRARMSPDGAMRGYFGNVLTIPYGVTGSEDLRRMALADVAGDVHRWVAEAATGEHFRGLVDWVEALRPKPAAARAYLGGTGGNEAMACVVSSGMSFPVDKADFGTGLPAFASYHFPWPAGAGYVMPMPSARGDGDWVVYAHAAPELAKVMEEEPTVFRALENSYVFQ

SEQ ID NO: 5623 - DNA, 1405 bp, Panicum virgatum
  misc_feature: Ceres CLONE 1823576
  misc_feature: Encodes the peptide sequence at SEQ ID NO. 5624
agagagctagagagagagagagagacggggagcgagagatctagtgagatagcctagtgccaaccccttggaggattcttttcaccttgtaagtagcagcaacgcagtaacaggccggccgcgggcgcgttcgaatcgatcggcatgacggtcgtcgacggcggcggcgcggcggcgcccgggcgcgggcagacggtgtgcgtgaccggcgccggcgggtacatcgggtcgtggatcgtcaagctcctcctggagcggggctacgccgtccggggcaccgtgcgcaaccctgatgacgcgaagaacgcgcacctgaggacgctccccggcgcggcggagaggctggctctgtgccgcgccgacctgctcgactacgacgccatgcgggccgccgtcgccggctgccacggcgtcttccacaccgcgtcgccggtgaccgacgatccggagcaaatggtggagccggcggtgcggggcacgcgccacgtcatcgaggcggcggcggcggaggccggcacggtccgccgcgtggtgctcacgtcgtcggtcggcgccgtcgccatggaccccgggcgcgcgccggacgccgtcgtggacgagtcctgctggagcgacctcgacttctgcaggcgcaccaggaactggtactgctacgggaaggcggcggcggagcgggcggcgtgggaggcggcggcggcgcgcggggtggacctggtggtggtcgtccccgtgctggtgcagggcccggcgctgcagccagcggtgaacgccagcctcgcgcacgtgctcaagtacctcgacgggtccgtcgcgacgttcgccaacgccgtgcaggcgtacgtccacgtccgcgacgtcgccgacgcgcacgtccgcgtcttcgagacgcccggcgccgccggccgctacctctgcgccgacgccgtgctccaccgcgaggacgttgtcagaaccctccgcaagttcttccccgagtaccccgtcccggaaaggtgctctgacgaggtgaacccaaggaagcagccgtacaagatatcgaaccagcggctgagggatctaggcatggagttcacgccggcggcgcaggccctgtacgagaccgtcatatgcttccaggagaagggcatcctcccagtccctgctactgctactccgtcgccgtcgtcgctgccctgatcgctgagctacacatttcaggcgctgattcgatcggttcgataaaaaaaaaatgtagcagtcaatgtaatgtattccgttgtggtgggcttcaggtaccgaagtgcttaagattgagcagcagcagttttagtttttatgtcgtctgcagctagatttgatctcgaaataagcaaatgaaacaagatggcatgcatgcagtatgatccaaaaaaaaaaaaaaaaaaaa

SEQ ID NO: 5624 - protein, 343 aa, Panicum virgatum
  misc_feature: Ceres CLONE 1823576
  misc_feature (1)..(240): Pfam Name: Epimerase Pfam Description: NAD dependent epimerase/dehydratase family
MTVVDGGGAAAPGRGQTVCVTGAGGYIGSWIVKLLLERGYAVRGTVRNPDDAKNAHLRTLPGAAERLALCRADLLDYDAMRAAVAGCHGVFHTASPVTDDPEQMVEPAVRGTRHVIEAAAAEAGTVRRVVLTSSVGAVAMDPGRAPDAVVDESCWSDLDFCRRTRNWYCYGKAAAERAAWEAAAARGVDLVVVVPVLVQGPALQPAVNASLAHVLKYLDGSVATFANAVQAYVHVRDVADAHVRVFETPGAAGRYLCADAVLHREDVVRTLRKFFPEYPVPERCSDEVNPRKQPYKISNQRLRDLGMEFTPAAQALYETVICFQEKGILPVPATATPSPSSLP

SEQ ID NO: 5625 - DNA, 1363 bp, Panicum virgatum
  misc_feature: Ceres CLONE 1823590
  misc_feature: Encodes the peptide sequence at SEQ ID NO. 5626
gtgagctaaccccttttttttctcctgtaaaatcggctacgtctcaagaacatcccagttcctcccaccatccccacatccccacatccccccaaaaaaaatctcaaatctgttcatcccccggatttacttttgtttccttcctcacaatttgttgcgcctcatcttcggcgacctcgccgccggcgacttgacggaacaaacctgacctccgactgaagttttctctcgttggcaagcgtcgccgccgtcctcctgctgtgccccctcgactgcactgaactggcgtcgagtagagaaataaggaagcttgggaacaagttttcggctctacacctagatgctgaaaatagtggggaagataacagtggagctgaagttgcgcaggcattttccatgacagaagaaactgcttccagggaacttggtaaaactgagcagaatgaaacaattgcagtacaccatgaggaaggagcacttgtatcatcatccggtgattacaggatgcctttagtatggatagacttggaaatgactggtttggatattacgaaagatcggattttggagattgcttgtatcattacggatggtaaacttacaaaacaaatagagggtcctgacttggttataaaccagagcaaagattgtttagataatatggatgaatggtgcaaaactcaccactcagctagtggtttgacagaaaaagtactgcagagtgaactttctgaatgtgatgcagaggcacaagtgttagacttcgttaggaggcatataagttcaggcaccccattattagctgggaattctgtttatgtggatttattatttctgaagaagtatatgccacagcttgcagccattttctctcatgtaattgttgatgtgagtagtgtgatggctctgtgcatgcgatggtatcccaaagaaaggaagcaaactccaagaaagcagaaggcccacagggcaatggatgatatcaaagaaagcatcagagaactaaagtactacaaggacaacattttcaaaccacagaaatccaagcggtagctgcatgagtgaagtatgcagccaccatcgtgttgaataattgaatcgactgagagcttttcaggttgaaggtctcatgccgcttttgagctcacatgcaaggttccattgatgttctgtatacattgtttagtatttgggacttatggcgtattcttggtgggattctgaacgttactagatgaacctcgttactgcatcacgtacatttacatgtatagattgcaattacttggctacttcctatgttaaatggcatggtgtctatgattggcatagatgccacctcgaaaaaaaaaaaaaaaaaaaa

SEQ ID NO: 5626 - protein, 218 aa, Panicum virgatum
  misc_feature: Ceres CLONE 1823590
  misc_feature (1)..(165): Pfam Name: Exonuc_X-T Pfam Description: Exonuclease
MTEETASRELGKTEQNETIAVHHEEGALVSSSGDYRMPLVWIDLEMTGLDITKDRILEIACIITDGKLTKQIEGPDLVINQSKDCLDNMDEWCKTHHSASGLTEKVLQSELSECDAEAQVLDFVRRHISSGTPLLAGNSVYVDLLFLKKYMPQLAAIFSHVIVDVSSVMALCMRWYPKERKQTPRKQKAHRAMDDIKESIRELKYYKDNIFKPQKSKR

SEQ ID NO: 5627 - DNA, 1007 bp, Panicum virgatum
  misc_feature: Ceres CLONE 1823605
  misc_feature: Encodes the peptide sequence at SEQ ID NO. 5628
ggtttccccatccgctcctaactcctccgttcgatcgaagccgcagagctgggttcgattcgtttcggcgactaggttcgttttggagtttaggtgagtatctgcatcaaagatagcatgagcggtacaaggcgtgccccgaggagacagtcgcaagatgggacagctggtaaagtagtggtgaacttagaagcaagctccccagtggtgggtagccctcatggagtaccagctactgttgctggcgcacaaaactcacctattgatgtggacgcaattgaagatgaagtgcaggcaatatcgccctcacgagtgccccctccaaggaggaacaggagaatcaggaggcgaccagtaacagtggttgacttggaggtggaaggtgtccaggaagggaacaaacgccagagggttgtacctgtgcattgcctctctcaaaaaaagggtgaagggtctagctttcagtcaaataaggaggttcccaaggaaccaatttttacctgcccaatatgttggaataagatggaggatccctccacaacatcttgtggccatatcttctgcagcacatgcatcaagcaagccatcaaggttcagaagaaatgtccaacgtgcaggaagggcctgagagcaaatagtatccatcggatttaccttccaagcactgctagttaaggtccattggctgtgtcaaagaaacttctggtactataaggctgggcaatatcagaagttttttccagggtgaacagttgatggttttcaccctagcctgtatcatgtaactgcagcgccaggagctcatcagctcattgcgaccacttcctgacaagggaagtggatagcttcagtttttactcgaattttattgcaccttacaacttgagatgttgttgtgttgtatgtattaggttaatggcttagttgatcagtgtaactgggatttgcttcaatcttaaatgataatagtcagtcgcaagctttagcaaaaaaaaaaaaaaaaaaaa

SEQ ID NO: 5628 - protein, 185 aa, Panicum virgatum
  misc_feature: Ceres CLONE 1823605
  misc_feature (1)..(38): Pfam Name: zf-C3HC4 Pfam Description: Zinc finger, C3HC4 type (RING finger)
MSGTRRAPRRQSQDGTAGKVVVNLEASSPVVGSPHGVPATVAGAQNSPIDVDAIEDEVQAISPSRVPPPRRNRRIRRRPVTVVDLEVEGVQEGNKRQRVVPVHCLSQKKGEGSSFQSNKEVPKEPIFTCPICWNKMEDPSTTSCGHIFCSTCIKQAIKVQKKCPTCRKGLRANSIHRIYLPSTAS

SEQ ID NO: 5629 - DNA, 1226 bp, Panicum virgatum
  misc_feature: Ceres CLONE 1823682
  misc_feature: Encodes the peptide sequence at SEQ ID NO. 5630
aaaaaagaagtccttcccactttctccccttgtctcgctcgctcgctcggccgtcggccgccttctttccaagcggcgacgacagggggagtggtgccgccttttccagttcttcgtcggacgcttcgccggccgacaataatggcgtcgccaatctctgcaagacgctatcaacaatttccattagtacataacaatggacttccgagattttctcgagtaaagatggcatgcttgggaataaaacaaactagatatcattctgaaaccaacttatcttcatcagcaagtcctgaagatgccagcaagctccatcccgtagtcaaaatgtgtggcatcacatcagctagagatgcagaaatggctgtagaggccggagctaaacttataggcatgatactgtggcctaactctaaacgctccgtctcgttatctgaggcaaaagaaatatcaagggttgcacaatcttatggtgccgaatcagttggagtctttgtggatgatgatgaagatactatcttacgagtgtcggattcatgtgaccttaactttatccagctccatggagatgaatctcgtgcattggttcatactctttccaagaataatcgcattgtttatgtgctgaatgctgatgaagatggaaaactaataaactctcctcctgttttggaatatgcacttgattggttcttagtggacagtgcaaaaggcggaagtggaaagggattcaactggcagaggttccagatgccaacagtcaaaagcaagaatggatggctattagctggaggacttcatgcagataatatttgtcaagccttttctgctctgaaaccaaatggagttgacgttagcagtggcatatgtgctcctgacggtatccataaagaccccaacaggatttcttccttcataagtaatgtgaaatccctgagttgcagatcataatgtcatttggttgttgggagcttagtttcattcatttacttaccttgcggagcctagctaatttggcgttgcaatctgaagccaagctgttcagcatggccggttgagggaaaaatagtgatcaaatttctgaagagcaaacgttatatgtattgtatttgttggtagtgtgatgtaataagtggattttgcatgcatctccagatgaaaggcaataataaaccacacatcgtacatcgatgtattttctgcagcaaaaaaaaaaaaaaaaaaaa

SEQ ID NO: 5630 - protein, 269 aa, Panicum virgatum
  misc_feature: Ceres CLONE 1823682
  misc_feature (1)..(201): Pfam Name: PRAI Pfam Description: N-(5'phosphoribosyl)anthranilate (PRA) isomerase
MASPISARRYQQFPLVHNNGLPRFSRVKMACLGIKQTRYHSETNLSSSASPEDASKLHPVVKMCGITSARDAEMAVEAGAKLIGMILWPNSKRSVSLSEAKEISRVAQSYGAESVGVFVDDDEDTILRVSDSCDLNFIQLHGDESRALVHTLSKNNRIVYVLNADEDGKLINSPPVLEYALDWFLVDSAKGGSGKGFNWQRFQMPTVKSKNGWLLAGGLHADNICQAFSALKPNGVDVSSGICAPDGIHKDPNRISSFISNVKSLSCRS

SEQ ID NO: 5631 - DNA, 1191 bp, Panicum virgatum
  misc_feature: Ceres CLONE 1823703
  misc_feature: Encodes the peptide sequence at SEQ ID NO. 5632
atgtactcgagcgaagaatttagctacctccaagtaccacaataatgccttcccacggggctccacagcaggttgccaacgatggcacgtcgtcgttcctcgccgacaagtccgcgaaggtcttcctcgccggccacaaaggcatgctgggctccgccgtgcaccgccgcctggccgcgctgggcttcaccaacgtcgtcggccgcacccgcgcggagctggacctcacctgcgaggccgcggtgcgcaagttcttcgacgcggagcgaccccgctacgtgatcctcgccgcgggcaaggtgggcggcctgcacgccagctcggccgcgccggtcgacttcatgaccgagaacctccgcatcaccacgaacgtcctcgccgccgcccggctctgcggcaccgtgcgcaagctgctcttcctcgccacctccgccatctaccccgcggacgccccccagccgatcccggagtccgcgctcctcgccggccctccggcgccggggaacgagtggtatgccatccccaagatcgtgggcatcaagatgtgccaggcctaccgcgccgagctcggcatggacgccatcgtggcggcgcccaacaacctgtacggcccgcgcgagccgttcccgtcggagagctcccacgtcatcccggcgctcatccgccgcttccaccgcgccaaggccgccggcgcccccgaggtcgccgtctggggctccggcctccagctgcgcgagttcacgcacgccgacgacgccgcggacgccatcgtgctgctgatggacaggtactcgggcgccgagcacgtcaacgtcgggagcgggcgcgaggtgacggtgcgcgagctcgcggagatggtgagggaggtggtcgggtacgaggggcgggtcgtctgggacacgagccggccggacggcgtgatgaggcggctgctggatagctccaagatgagggagatggggtgggagcccaaggtcgagctgcgggatgggctcaagaagttgtacgagggatacctgggtagcagcgtcgtctccaactttgaaaccgtgaacagatgaactcaagcgcgtacatggactccgtgtatctgagagactgagactgtcaatctgctggtgcagcttggtctgtaataaactggtaaaaatattcggaaatattaagaaacaaaaaaaaaaaaaaaaaaaa

SEQ ID NO: 5632 - protein, 338 aa, Panicum virgatum
  misc_feature: Ceres CLONE 1823703
  misc_feature (1)..(233): Pfam Name: Epimerase Pfam Description: NAD dependent epimerase/dehydratase family
  misc_feature (19)..(325): SWISSPROT Homolog: EC 1.1.1.271 GDP-L-fucose synthase 1
MPSHGAPQQVANDGTSSFLADKSAKVFLAGHKGMLGSAVHRRLAALGFTNVVGRTRAELDLTCEAAVRKFFDAERPRYVILAAGKVGGLHASSAAPVDFMTENLRITTNVLAAARLCGTVRKLLFLATSAIYPADAPQPIPESALLAGPPAPGNEWYAIPKIVGIKMCQAYRAELGMDAIVAAPNNLYGPREPFPSESSHVIPALIRRFHRAKAAGAPEVAVWGSGLQLREFTHADDAADAIVLLMDRYSGAEHVNVGSGREVTVRELAEMVREVVGYEGRVVWDTSRPDGVMRRLLDSSKMREMGWEPKVELRDGLKKLYEGYLGSSVVSNFETVNR

SEQ ID NO: 5633 - DNA, 1094 bp, Panicum virgatum
  misc_feature: Ceres CLONE 1823713
  misc_feature: Encodes the peptide sequence at SEQ ID NO. 5634
aaaccagatgctccggctcgccccgcccgccccccgccgccgcacccgggcagccatggacgccggcgcgttcgccagcagcgactactactcctcctcggggacgccgtcaccggtcggcggcggcggcggcgcggacggcgacggcgacggctcctccccctcgtcgtacatgacggtgtcgtcggcgccgcccaagcgccgcgccggacggaccaagttcaaggagacgcggcacccggtgtacaagggcgtgcgccggaggaaccccggccgctgggtctgcgaggtgcgggagccgcacggcaagcagcggatatggctcgggaccttcgagaccgccgagatggcggcgcgcgcgcacgacgtcgccgcgctcgcgctccgcggccgcgccgcatgcctcaacttcgccgactcgccgcgcctgctcagggtgcccccgatgggcgcggggcacgacgagatacggcgggcggccgccgtggccgctgagcagttccggccggctcccggtccgggcaatgcggccgccgaggaggtggccgccgcgccgccggaggccttgcctagcgcgccgcagaacttcgatgacccctactgcattgtcgacgacaggctcgacttcgggatgcaggggtacctcgacatggcgcaagggatgctcattgacccgccgccgatggctggttcatccgctagcggcggcgacgacgatgacgataacggtgaggttaagctctggagctactgatccaccgccgcgcgcgtttgaaacttccctgtacagcctatgggaacctagtactggtgaaatgtgtaccggttgccctttcccttctcaagttgccggtaatgttaatgtatcttccctgcgcttctgatgaagtgtgatcaggagaagcagaagactggggctgctcagtttggtagacggttgtgaaagtttggcgctagatcatcgcccttgttgctgcaggatgcatgaggtcagtgatctcgggagtgctgagagcacttgtgtaataagcagaaaaaacaagtggcttgatgtatggatttgcaaactcccccaaaaaaaaaaaaaaaaaaaa

SEQ ID NO: 5634 - protein, 248 aa, Panicum virgatum
  misc_feature: Ceres CLONE 1823713
  misc_feature: Great-hit functional homolog of the protein sequence given in SEQ ID NO 9353
  misc_feature (1)..(64): Pfam Name: AP2 Pfam Description: AP2 domain
  misc_feature: The sequence is a functional homolog of  SEQ ID NO 1232 in the  10/374,780 US patent application
  misc_feature: The sequence is a functional homolog of  SEQ ID NO 1238 in the  10/374,780 US patent application
  misc_feature: The sequence is a functional homolog of  SEQ ID NO 1722 in the  10/412,699 US patent application
  misc_feature: The sequence is a functional homolog of  SEQ ID NO 192 in the  11/375,241 US patent application
  misc_feature: The sequence is a functional homolog of  SEQ ID NO 1958 in the  10/374,780 US patent application
  misc_feature: The sequence is a functional homolog of  SEQ ID NO 2241 in the  10/666,642 US patent application
  misc_feature: The sequence is a functional homolog of  SEQ ID NO 424 in the  10/714,887 US patent application
  misc_feature: The sequence is a functional homolog of  SEQ ID NO 46 in the  10/412,699 US patent application
  misc_feature: The sequence is a functional homolog of  SEQ ID NO 57 in the  10/838,616 US patent application
  misc_feature: The sequence is a functional homolog of  SEQ ID NO 576 in the  11/435,388 US patent application
  misc_feature: The sequence is a functional homolog of  SEQ ID NO 692 in the  11/435,388 US patent application
  misc_feature: The sequence is a functional homolog of  SEQ ID NO 718 in the  11/435,388 US patent application
  misc_feature: The sequence is a functional homolog of  SEQ ID NO 72 in the  10/669,824 US patent application
  misc_feature: The sequence is a functional homolog of  SEQ ID NO 72 in the  10/870,198 US patent application
  misc_feature: The sequence is a functional homolog of  SEQ ID NO 770 in the  11/435,388 US patent application
  misc_feature: The sequence is a functional homolog of  SEQ ID NO 98 in the  10/675,852 US patent application
  misc_feature: Useful for making plants with modulated low light sensitivity
  misc_feature: Useful for making plants with modulated growth and phenotype characteristics
MLRLAPPAPRRRTRAAMDAGAFASSDYYSSSGTPSPVGGGGGADGDGDGSSPSSYMTVSSAPPKRRAGRTKFKETRHPVYKGVRRRNPGRWVCEVREPHGKQRIWLGTFETAEMAARAHDVAALALRGRAACLNFADSPRLLRVPPMGAGHDEIRRAAAVAAEQFRPAPGPGNAAAEEVAAAPPEALPSAPQNFDDPYCIVDDRLDFGMQGYLDMAQGMLIDPPPMAGSSASGGDDDDDNGEVKLWSY

SEQ ID NO: 5635 - DNA, 1273 bp, Panicum virgatum
  misc_feature: Ceres CLONE 1823724
  misc_feature: Encodes the peptide sequence at SEQ ID NO. 5636
gttctggcccccacgagctcgcaatctttcttttctcctctcctctcctccgtcgctagttgggagctagggttccggcgcgcctcttccagacgcgagggctggccatggagggagccgccgcggcccggaagagatcccggccggagacggccaacggggccgcagccggtgggaagcgctccaaagaaacggagtcatttcaaactggtcaatcaagcaaatcgaagccttgcaccaagtttttcagtaccattgggtgcccttttggtgagggatgtcattttctgcactttgtccctggtggatacccagcggttgcaaaaatgctcaacctaggcagccctgctgtatctgcaccagcaagagctcctgcagatcatgctgctgttgctaactctcatccagcttcgatgggcaagacacgcatgtgcaccaaatacaacactgtcgaaggctgcagatttggcgataagtgccattttgcccatagcgagagagaacttggcaagccagcttacatgactcatgaagcccctccaatgggtggtcggtttggaggccgacctgaaccacctccgccagttgccatgggtcctccagcagggaactttggcgcctcagctactgccaagatcagtgttgatgcctcgcttgctggcggcataattggtaagggcggggtcaacacaaaacagatatgccgagttacgggtgtcaagctctcgatccgcgaccatgagtcagatccgaacctgaagaacatcgagctggaaggcaacttcgaccagatcaagcaagccagcaacatggtgagcgacctcatcgccaccatcagcgccagcatgccacccaaaaaccctgcgccagcaggaggccgagggggtgcccctgggggcaggagcaactacaagacgaagctatgtgagaacttcgtgaaggggggaacctgcacattcggggagcggtgccacttcgcccatggtgagaacgagcagcggagaggtgccgcttgagagctgatgtgctctaggcaccgagatgtacatgcatcttgggcgggcgacccgtatcggctgcccatttgctactgtgactattctctttacagcgttattaggcacttagactgttgtattgcgatttcagtgtattattaagctctagctaagcctttttgaaatatgttttggaagaaatccttaatctgacatgcccgtgtacgttttgagcattttattggtcacatagcgaaaaaaaaaaaaaaaaaaaa

SEQ ID NO: 5636 - protein, 302 aa, Panicum virgatum
  misc_feature: Ceres CLONE 1823724
  misc_feature: Great-hit functional homolog of the protein sequence given in SEQ ID NO 9321
  misc_feature: Great-hit functional homolog of the protein sequence given in SEQ ID NO 9714
  misc_feature (1)..(27): Pfam Name: zf-CCCH Pfam Description: Zinc finger C-x8-C-x5-C-x3-H type (and similar)
  misc_feature: The sequence is a functional homolog of  SEQ ID NO 600 in the  10/666,642 US patent application
  misc_feature: Useful for making plants with altered alkaloid content
  misc_feature: Useful for making plants with altered terpenoid content
  misc_feature: Useful for making plants with modulated growth and phenotype characteristics
MEGAAAARKRSRPETANGAAAGGKRSKETESFQTGQSSKSKPCTKFFSTIGCPFGEGCHFLHFVPGGYPAVAKMLNLGSPAVSAPARAPADHAAVANSHPASMGKTRMCTKYNTVEGCRFGDKCHFAHSERELGKPAYMTHEAPPMGGRFGGRPEPPPPVAMGPPAGNFGASATAKISVDASLAGGIIGKGGVNTKQICRVTGVKLSIRDHESDPNLKNIELEGNFDQIKQASNMVSDLIATISASMPPKNPAPAGGRGGAPGGRSNYKTKLCENFVKGGTCTFGERCHFAHGENEQRRGAA

SEQ ID NO: 5637 - DNA, 1549 bp, Panicum virgatum
  misc_feature: Ceres CLONE 1823753
  misc_feature: Encodes the peptide sequence at SEQ ID NO. 5638
tctgtgactccgtccgtgagtcactcatcctcttcgtctctctcctatccgtcaaccactcgatgcagcggccggcggtagtaggagcggccggcaagcgggagggcggtgcggcggccggcaggagggcggtgcagcggccgacagcgggagggctgtgcagcggccggcgcgagggctgtgcggcagtcggtgagctcggcaccaagcgggtggccgaggaagatggtgcagccaacatgtctgactcgtcaaggaccatccctccggagctgctcccgtcggaggacctgcatccgctgccaatgccggtgatcaacctcggccacctcagcctggattccgcaacccgataccgtgtggttgatgatgttgccaaagcatgccgtgatctagggtacttccaggttataaaccatgggatcagtcaatctgtcatggattgtgctcttgaagcagcttcagatttcttcaaactaccaagtgagacaaaggaaaagtttgcatcggaggaccttcgacgacctgttagatatgatacaagctcaaaagatagcattagcatgcccagggcattcctaaagcattatgcccatccactcagcgaatggattcaatattggccacagcaaccaccaatctacaggaaatacatgggaaagtatgcttctgaagtaaggatggtggctttgcaactggtggaagcaatagtagaaggcctaggattgggcaaggaatacctgaatgagaaatttcatgaaggctcccaagtattgtcagtgaactgctatgctaaagcatcacaaagtgccacgactatagggctggctccacattctgatcatggatttcttaccatcttgctcacaagttgtgggggccttgaagttgttgatcccagcagcaacatctggaaaagggttcagcaacttccacacgctttgcatgttcacattggtgaccacatggaagttctgagcaatggcagaatgaaaacagttgtgcatcgtgcccttctgaatcctgaagaagcaaggatttctatagctagcattcatggttttgcactgcatgagaaggtcacctgtgccaaggagctagtggatgaagaaaatcccccaaagtacaaagagagcagcttcagcgacttcctggaccatctcacagctaatatggacaacaagcacaggaactttctcgaaagccttcgaatgtaaggattgcagagcataattaggggtaactggtgctatggtatttgagaaggcagatcgagctatggttcatcttcacatgttgaaatctaaagtgtccgtgtaatcttcaaataaagccatatctgtggctgccggtgtccatttccagttttacatgaagcattcaaaactcgcatgtgtaatcatctttggccatcatccacaaccttgagctcagaaaccatcttcgggaacttggagtgcatgtgaatatggcatagatgactcaatcaatgtaaaaaatatctttatatgtatgcatgacaattacttaaaaaaaaaaaaaaaaaaaa

SEQ ID NO: 5638 - protein, 384 aa, Panicum virgatum
  misc_feature: Ceres CLONE 1823753
  misc_feature (1)..(101): Pfam Name: 2OG-FeII_Oxy Pfam Description: 2OG-Fe(II) oxygenase superfamily
MQRPAVVGAAGKREGGAAAGRRAVQRPTAGGLCSGRREGCAAVGELGTKRVAEEDGAANMSDSSRTIPPELLPSEDLHPLPMPVINLGHLSLDSATRYRVVDDVAKACRDLGYFQVINHGISQSVMDCALEAASDFFKLPSETKEKFASEDLRRPVRYDTSSKDSISMPRAFLKHYAHPLSEWIQYWPQQPPIYRKYMGKYASEVRMVALQLVEAIVEGLGLGKEYLNEKFHEGSQVLSVNCYAKASQSATTIGLAPHSDHGFLTILLTSCGGLEVVDPSSNIWKRVQQLPHALHVHIGDHMEVLSNGRMKTVVHRALLNPEEARISIASIHGFALHEKVTCAKELVDEENPPKYKESSFSDFLDHLTANMDNKHRNFLESLRM

SEQ ID NO: 5639 - DNA, 1821 bp, Panicum virgatum
  misc_feature: Ceres CLONE 1823782
  misc_feature: Encodes the peptide sequence at SEQ ID NO. 5640
acaattcacacacacacacacagagtcctctgatccgctctccttttctgcttctcttccaccgcgccaagccacaccaatggcggcgcgcgctctcttgatgctgcgggaggcctccccgtgggcgctggccggcgcggcggcggccgtggcgctgctgtggctggtggcctggacggcggagtgggcctggtggacgcctcggcgtctcgaccgggccctgcgggcccagggcctcaagggcacccggtaccgcctcttcaccggcgacctggcggagaacgcccggatcaaccgggaggctcgcaccaagccgctgccgctcggctgccacgacatcgccccacgcgtgcagcccatgctccacagagccatcaaggaatacgggaaaatgtcgttcacctggttcggtccaataccgagggtgatgataccagacccggagttagtcaaagaggttttatctaacaagtttggccactttggaaaaccaaggagtagtcgtatcgggaagctgctagccgatggggttgtcaatcatgacggcgagaagtgggcaaaacacaggagaattctcaatcctgccttccaccatgagaagataaagcggatgctgcctgtattttccacttgttgcgctgaaaccattactaaatgggagaattcaatgccttctgaggggtcttttgaggtagatgtctggccggagttccagaatctcacgggagatgttatctcaagaaccgcatttggtagcagctatcaagaggggatgaaaattttccagctgcaaggagagctagctgaacgccttgtacagtctttccaaacaatatttatcccaggatattggtttttgcccaccaaaaataatagaaggatgcgagaaattgatcgggagatccggaaaactctgcgcgaaataattagaaaaagggagaaggccattaaagatggcaaaacaaataatgatgacttgctgggcttattactggagtcaaacatgaatgaatcgaaagggaatgcaaagctgggattgtcaacggaagatgtgattgaggaatgcaaactattttactttgccggtatggagacaacatcagtcctgcttacttggactctcattgtgctaagcctgcacccagaatggcaagagggggcaagagaagaagttctgaaccactttggtagagccaaaccagattttgatagcttgaaccacctgaagacggtaaccatgattttgtacgaggtccttaggttgtacccgccggcaacctttatagtcagaagaacatacaaggagatggagctcggcagcatcatatatcctgccggagtgaaccttcagctgcccattctcttcatccaccatgatccggagatttggggaaaagatgcgagcgagttcaatcctgcaaggttcgctgacggcgtctccaacgctaccaagcaccagggcgccttctttccgttcggagggggtccccggatctgcatcggccagaacttcgcgttgctggaagcgaagatggcgctgtgcaccatcctccagcgcttctccttcgagctctcaccatcctacacccatgcgccgtacaccgtgatcaccctgcaccctcagcacggcgctcagatcagactgaagaagctctgacgaccatgacgctcatgccgggtagatgccatcatatactgtcaatttgcatgatgtatgtaaattagattttaacctttgaaatgaataaagcagggagagaatgtacatggatagagaaatttaggtactcattcaaacagttataccatgtatcgtttgcc

SEQ ID NO: 5640 - protein, 525 aa, Panicum virgatum
  misc_feature: Ceres CLONE 1823782
  misc_feature: Great-hit functional homolog of the protein sequence encoded by LOCUS At3g14690
  misc_feature (16)..(525): SWISSPROT Homolog: EC 1.3.3.9 Cytochrome P450 72A1
  misc_feature: Useful for making plants with modulated cold sensitivity
MAARALLMLREASPWALAGAAAAVALLWLVAWTAEWAWWTPRRLDRALRAQGLKGTRYRLFTGDLAENARINREARTKPLPLGCHDIAPRVQPMLHRAIKEYGKMSFTWFGPIPRVMIPDPELVKEVLSNKFGHFGKPRSSRIGKLLADGVVNHDGEKWAKHRRILNPAFHHEKIKRMLPVFSTCCAETITKWENSMPSEGSFEVDVWPEFQNLTGDVISRTAFGSSYQEGMKIFQLQGELAERLVQSFQTIFIPGYWFLPTKNNRRMREIDREIRKTLREIIRKREKAIKDGKTNNDDLLGLLLESNMNESKGNAKLGLSTEDVIEECKLFYFAGMETTSVLLTWTLIVLSLHPEWQEGAREEVLNHFGRAKPDFDSLNHLKTVTMILYEVLRLYPPATFIVRRTYKEMELGSIIYPAGVNLQLPILFIHHDPEIWGKDASEFNPARFADGVSNATKHQGAFFPFGGGPRICIGQNFALLEAKMALCTILQRFSFELSPSYTHAPYTVITLHPQHGAQIRLKKL

SEQ ID NO: 5641 - DNA, 1406 bp, Panicum virgatum
  misc_feature: Ceres CLONE 1823826
  misc_feature: Encodes the peptide sequence at SEQ ID NO. 5642
attccgccgcgactcgcggcgcccgctcgtggccggtgcgcgcgcggccgcaaccgccaccaccgccttcccactcccgaatagcagtagtcctcctgccactttcctcgtccctgtcttgcttgccatctcccccccccctcccctctgctgctctgcactccgtccggcgcggccttccctcccgcgagagggcgcgtcgcagggacgccggcatcgccgccaaccgggtgcctgcctaaccggccgatttccttccttgcatagcccccattccaccgcacaaatagcgcgcggctttcccaattcccgtcccgtggccctcttccgagatctttgccacttggtgcgtcctcctgtagcggctgggggcgatggagtggggggacagggccaaggccgccgcggcggcggacgagagggccggaggtggggaggggctcggggggttcgtcaaggtgatgaccgacgagcagatggaggtgctccgcaagcagatctccatctacgccaccatctgcgagcagctcgtcgagatgcaccgcaccctcaccgagcaccaggactccattgcaggaatgaggttcagtaatatgtactgtgatcctctaattattcctggaggtcacaagatcacagcaaggcaacgatggcaacctacaccgatgcagctgcagatccttgagaacatatttgaccaaggcaatggaacgccaagcaagcaaaagataaaggagataacagcagagctctcacaccatggccagatctctgagacaaatgtctacaactggtttcagaacagacgggcacggtcgaagcggaagcaggctgctgctgctttacctaataataacgctgaatctgaagctgaagtggatgaggaggccctaaccgacaagaagccgaagtcagataggctgctccatgatgacaaggctatgagtgttcacaatgctgagcggatctcagggatgcaccactttgatgcagatcatgatcaaatcagtggcatgatgtatggatccagtgaaaacagcatgagatcgtctggcaattcaggccagatgtccttctacgagaacatcatgtcgaattcaagaatcgaccatttcccagggaagatggagagctcccggagcttctcacatctccagcacggggatggcttcgacatgtttggatgacatctctctgcaccgagttaccctgtaaaaagtgtttgttgacagcattcgcccaattcgctgacatgaaagttcatccctgagggactctgtgttgcttgccctggtctggtttaaccaacccccagatggaagctagctctcgtggcatcgacttgttggaatatgtgtaagaagttgatatatagtatttgcccgtagtctatcatacgcgcaatt

SEQ ID NO: 5642 - protein, 270 aa, Panicum virgatum
  misc_feature: Ceres CLONE 1823826
  misc_feature: Great-hit functional homolog of the protein sequence given in SEQ ID NO 9233
  misc_feature (1)..(62): Pfam Name: Homeobox Pfam Description: Homeobox domain
  misc_feature: Useful for making plants with altered Lignin content
  misc_feature: Useful for making plants with modulated nitrogen use efficiency
MEWGDRAKAAAAADERAGGGEGLGGFVKVMTDEQMEVLRKQISIYATICEQLVEMHRTLTEHQDSIAGMRFSNMYCDPLIIPGGHKITARQRWQPTPMQLQILENIFDQGNGTPSKQKIKEITAELSHHGQISETNVYNWFQNRRARSKRKQAAAALPNNNAESEAEVDEEALTDKKPKSDRLLHDDKAMSVHNAERISGMHHFDADHDQISGMMYGSSENSMRSSGNSGQMSFYENIMSNSRIDHFPGKMESSRSFSHLQHGDGFDMFG

SEQ ID NO: 5643 - DNA, 1161 bp, Panicum virgatum
  misc_feature: Ceres CLONE 1823870
  misc_feature: Encodes the peptide sequence at SEQ ID NO. 5644
cttgcggctgcgctccccctctcgtcttgcgcggtcacgccgccgtcggccgcatcggagccgactccgccccagccgcgcgcggcaaccagccacccagcagagcgcgcatagcccccagtgaatccatcggcagccttctcaccatcagaccgcgaccatccgccgtccagcctcgctccgcccgaatcgaccacccaatcccctcgccgcacgcacggcggcgccatggacgccacgctgctgctctccgccgtcgacgccaccttcgctgcccggcgacgcccttgtacgcccgcgcgccgcccggggcgggttgtgccaggcctgcgtccggcgccctgcaggtccgtccacgcgcgagccaccgcagcggctgcgccagctgccgggcaaagcaatgcagtctacacggttggtgacttcatgacgaggaaggaaaatctccatgttgtcaaacctacgacatcagttgatgaagccctcgagctgttggtgcagcacaggatttctggcttccctgtggttgacgacaattggaagctggttggggtcgtctcagattatgatctgttagcactggactcaatgttaggaaatggacttcctgatacagatacaaacatgttccctgatgtggaaagtacttggaagacattccgtgagatccagagactactaagcaaaactaatggcaaagtcattggtgatgttatgacttcttcgccccttgtggtgcgtgaaaatactaatctggatgcggctacaaggttgctacttgaaaccaagtaccggagattacctgtagttgatagcacggggaaacttgttgggatgataacaaggggaaacgtcgttggagctgctcttgaaataaagaagaaatctgaagaaggtgcttgaatcgcagtgcctttggcattcaattcattgatgcttcgtttggatttcaatgtctcttaaagaaggcattcagctggaggaattgaattgggcttgaataccaaatccaagctgcattggaaatggtctgcaatgccaatgttgttgtttggatgtgcttgtaattagtagctagaatcaaaggctggaatgcaattccaattcttgtttggatgtacaacacatggaattgtgaatgttgaaaggtttgaacattat

SEQ ID NO: 5644 - protein, 224 aa, Panicum virgatum
  misc_feature: Ceres CLONE 1823870
  misc_feature (94)..(133): Pfam Name: IMPDH Pfam Description: IMP dehydrogenase / GMP reductase domain
  misc_feature (76)..(115): SWISSPROT Homolog: EC 1.1.1.205 Inosine-5'-monophosphate dehydrogenase
MDATLLLSAVDATFAARRRPCTPARRPGRVVPGLRPAPCRSVHARATAAAAPAAGQSNAVYTVGDFMTRKENLHVVKPTTSVDEALELLVQHRISGFPVVDDNWKLVGVVSDYDLLALDSMLGNGLPDTDTNMFPDVESTWKTFREIQRLLSKTNGKVIGDVMTSSPLVVRENTNLDAATRLLLETKYRRLPVVDSTGKLVGMITRGNVVGAALEIKKKSEEGA

SEQ ID NO: 5645 - DNA, 1205 bp, Panicum virgatum
  misc_feature: Ceres CLONE 1823895
  misc_feature: Encodes the peptide sequence at SEQ ID NO. 5646
atttcccgtttcccgattcaagtcagcggtttagggttcgagatctcccgcaccgcatcgcgtcgcagcagccatggcggcaggcatgtttactaccgtcaaggtgagcaatgtgtccctgaaagcagaacagcgtgatataaaggaattcttttccttttctggtgacattgttcatgttgaaatgcagagtggtgatgagctgtctcaagttgcttacattacttttaaagacaaacaaggagctgagacggcaatgcttctcacgggggctacaatagttgatatggctgtcattgttacacccgctactgattatgagctacctgcagaagttatagctgctctagagcccaaggacacaaaaccttctgcccttcaaaaggccgaggacattgttgggaccatgctggcgaagggatttatccttggtagggatgcactggacagagcaaaggctctggatgagaagcatcagctcacatcaactgcgactgctagagtatcttccttcgacaagagaatcggtctaagtgagaagatcagtgtcgggacttcagctgtcaatgataaagttaaggaaatggaccagaagtaccaagtctctgagaagacaaaatcagcactggcagctgcggaacagagtgtctcgactgctggatctgccattatgaagaacagatatgtcctcactggtgcagcatgggtaactggcgccttcagcaaagtcacgagtgcagccaacgatgttggtgcaaaggctaaggagaaaatagcggctgagcaggagcacacgaatgttgagggtgggtctgcagcgcaacctgacatctcggaaggcccagtaacacatagggacatggatggcgaatttgcaaagatgcatgtctctgaaacccctgaaaacatccccgtctccacatcagcgactgtccctgctattactgttgaggagcccagcaaggcatccccgcccgatgatgctcctaaaaagccagaacctgctcagggattgattctatgatatgatttgcgccccatacatgtgtaaatagacatgatatggttgttgaactcatttctagtgttgtggttgctatcttctggttgaaacctctttgaaggttgaaagttatttggacctaaaagagtttgcattgttacatgatacttttatcaatatatcattattaccctgcagcggg

SEQ ID NO: 5646 - protein, 316 aa, Panicum virgatum
  misc_feature: Ceres CLONE 1823895
  misc_feature: Great-hit functional homolog of the protein sequence given in SEQ ID NO 9413
  misc_feature: Great-hit functional homolog of the protein sequence given in SEQ ID NO 9561
  misc_feature: Useful for making plants with altered alkaloid content
  misc_feature: Useful for making plants with modulated biomass
  misc_feature: The plant is abnormally small.
MAAGMFTTVKVSNVSLKAEQRDIKEFFSFSGDIVHVEMQSGDELSQVAYITFKDKQGAETAMLLTGATIVDMAVIVTPATDYELPAEVIAALEPKDTKPSALQKAEDIVGTMLAKGFILGRDALDRAKALDEKHQLTSTATARVSSFDKRIGLSEKISVGTSAVNDKVKEMDQKYQVSEKTKSALAAAEQSVSTAGSAIMKNRYVLTGAAWVTGAFSKVTSAANDVGAKAKEKIAAEQEHTNVEGGSAAQPDISEGPVTHRDMDGEFAKMHVSETPENIPVSTSATVPAITVEEPSKASPPDDAPKKPEPAQGLIL

SEQ ID NO: 5647 - DNA, 1336 bp, Panicum virgatum
  misc_feature: Ceres CLONE 1823951
  misc_feature: Encodes the peptide sequence at SEQ ID NO. 5648
atgagatgagagccgcagccacatccacatccactgccgccgcgctcctcgccccgcgcctgacgtgctccgccagccgcgcgcgcctcctctcctcccgccccccgctccgccgcatctccgtcatggccgccgccccctcctccttccgcccggaggaggcacgctcccctcccgcgctcgagctcccaaccccgcctctctccaagttcaaggtggcgctgtgccagctctccgtgacggcggacaaggctcgcaacatctcgcacgcgcgtgcggccatcgaggcggcggccgccaaaggcgccaagctcgtgctcctccctgagatatggaatggtccatattcaaatgacagctttccagagtacgctgaggacattgaggctggtggagatgcagccccttcgttttcaatgatgtcggaggttgctcgcagcttgcaaattactcttgttggtggatccatagctgaacgttctaataacaacttgtacaatacatgctgcatcttcggttccgatggcaagcttaagggtaaacatagaaagatccatcttttcgacattgatattccagggaagattactttcaaggaatcaaagactcttactgctgggcagaatcctactgttgtagacacagatgtcggccgaattggtattggtatatgctatgacatccgcttccaggaattagcaatgctatatgctgcaagaggtgctcatttgttgtgctatcctggtgcattcaacatgactaccgggccattgcactgggagttgctgcaaagggcgagggctgcggataaccagctgtttgttgcaacatgtggtccagctcgagatgccagtgcaggttatgttgcttggggacactccactcttgttggaccttttggagaggtgattgcaacgactgagcatgaggagacaactataatagcagaaatcgactattcattgattgagcagaggaggcaatttcttcctctgcaataccaacggcgtggcgatctctatcagctggtagatgttcagagactgggttctcagtagcgagcctgggacgaagcaggactgcaggagagtctttgactctgcaggcttactcgtacggcttcgttcatgagatgcacatgcatgcatttgtctggacagatccgatcgagctggtttgtgaagagaagatgaataaggtggctcaataacttgtagtaccttaccttcagcctcccgagtcgccaaagatgattactcctgtgtattaagaggatgtattgtcttcatgaaacaaagataatgaaagatgttcgtctaatttctttcttgactcg

SEQ ID NO: 5648 - protein, 350 aa, Panicum virgatum
  misc_feature: Ceres CLONE 1823951
  misc_feature (2)..(179): Pfam Name: CN_hydrolase Pfam Description: Carbon-nitrogen hydrolase
MRAAATSTSTAAALLAPRLTCSASRARLLSSRPPLRRISVMAAAPSSFRPEEARSPPALELPTPPLSKFKVALCQLSVTADKARNISHARAAIEAAAAKGAKLVLLPEIWNGPYSNDSFPEYAEDIEAGGDAAPSFSMMSEVARSLQITLVGGSIAERSNNNLYNTCCIFGSDGKLKGKHRKIHLFDIDIPGKITFKESKTLTAGQNPTVVDTDVGRIGIGICYDIRFQELAMLYAARGAHLLCYPGAFNMTTGPLHWELLQRARAADNQLFVATCGPARDASAGYVAWGHSTLVGPFGEVIATTEHEETTIIAEIDYSLIEQRRQFLPLQYQRRGDLYQLVDVQRLGSQ

SEQ ID NO: 5649 - DNA, 1887 bp, Panicum virgatum
  misc_feature: Ceres CLONE 1823984
  misc_feature: Encodes the peptide sequence at SEQ ID NO. 5650
ccttacctctggatcgctggccgttgacttgacggcagcggccggtacggtggagtcaacggcctccgtctatagtgacgcggcataggcatcatgcattgtcttcctcacttcatcaacctgtccaccattcccgtctccccctggccttcgcctcgcctcgctgccgtggccgcgcaacgccttcccgcacccaccaacgcgcgtcttccacctcgcgcgccctctcaggtctcctccaaatcccgcctaatccgctggatttcccttgctaattctagcagctcttgtcgctgctctgccaaacccctgctctgagctcatccgattggcggctccggcctctgggcgaagcgggtgttttgaagcacgggttggtgggcgacggcgaatcagggatggaattccccagaggaagcgggaggcggccacagcagcagcagcagcagccggagccggagcacctgcagccgatgacgccgctgccgctcgcgcggcaggggtcggtctactcgctcacgttcgacgagttccagagcgcgctcggcggtgcgggcaaggacttcggatccatgaacatggacgagctcctccgcagcatctggacggccgaggagacgcacgccgtcgccgccgccaacgcgtcggcggcgtccgcggccgcggcggacctcgccgcgcgggcggcgtccatccagcggcagggatcgctcaccctcccccgcacgctcagccagaagaccgtcgacgaggtctggcgcgacatcatgtgcttcggcgggccctccgccgcgcaggccgaggcgccgcccccgccggcccagcggcagcagacgctcggggagatcacgttggaggagttcctcgtgcgcgccggcgtggtgagggaggacatgacggcaccaccgcccgtaccaccgttggctgtggcggcgccaccgccgccgcctcctccgcaaccgccaatgctatttccccatggcaatgtgtttgctcccttggcgcctccaccactgtcgttcgggaatgggttggtgtcgggagctgtcggtcaggcaggtggtgccgcgccctcggcggtatcgccggtgaggccggttacgtccagcgggtttggcaagatggaaggaggggatttgtcctccctgtcgccatcgccggtgccgtacgttttcaacggtggtctgaggggaaggaagcctcctgctatggagaaggtggttgagaggaggcagcggcggatgatcaagaaccgggagtccgccgccaggtcgcgccagaggaagcaggcatatatgatggagttggaagctgaggtggcaaaacttaaagagttgaatgaggagttgcagaaaaaacagattgaaatgctggagaaagaaaagaatgaggtcctggagagaatgagccggcaagttgaaccaacggcaaagagaatttgtctgcggaggacattgacaggtccttggtaggctgtagacatgtacctagcagtatctctcgtctggaggacaggagtgtacatagtaggcgcacatgaactcaccatcgcctcgctgccgttgttgacacagccaataatccagagcttcagtctcgtaggcggatagattgcctgtaattttttttgaagtaaaattgcctgtaattttcactgcataggttttgggccctttgcaaaaagagttccagtgagtagaggagtttgtatgtagtcgggtcagtttattgacccaaggagcgcgtgcttatactccattaggcttttatggtttggtgtgataccatgaatcattagttcagcatgttagatgttatacatccggcgaatttgtatgcataaaccatatagcactctgctttgtaaaatcaagttgcttatgctgt

SEQ ID NO: 5650 - protein, 357 aa, Panicum virgatum
  misc_feature: Ceres CLONE 1823984
  misc_feature: Great-hit functional homolog of the protein sequence given in SEQ ID NO 9426
  misc_feature (1)..(65): Pfam Name: bZIP_1 Pfam Description: bZIP transcription factor
  misc_feature (1)..(55): Pfam Name: bZIP_2 Pfam Description: Basic region leucine zipper
  misc_feature: Useful for making plants with modulated drought sensitivity
MEFPRGSGRRPQQQQQQPEPEHLQPMTPLPLARQGSVYSLTFDEFQSALGGAGKDFGSMNMDELLRSIWTAEETHAVAAANASAASAAAADLAARAASIQRQGSLTLPRTLSQKTVDEVWRDIMCFGGPSAAQAEAPPPPAQRQQTLGEITLEEFLVRAGVVREDMTAPPPVPPLAVAAPPPPPPPQPPMLFPHGNVFAPLAPPPLSFGNGLVSGAVGQAGGAAPSAVSPVRPVTSSGFGKMEGGDLSSLSPSPVPYVFNGGLRGRKPPAMEKVVERRQRRMIKNRESAARSRQRKQAYMMELEAEVAKLKELNEELQKKQIEMLEKEKNEVLERMSRQVEPTAKRICLRRTLTGPW

SEQ ID NO: 5651 - DNA, 1210 bp, Panicum virgatum
  misc_feature: Ceres CLONE 1824035
  misc_feature: Encodes the peptide sequence at SEQ ID NO. 5652
acttcccaagcaatccccggcctctactaaagaaacgccaatctcccgaccgcactccccttgtcttctcctgtcgcgagccgccggaagcttcgccccctgacgcgtgggccccccgctcccctcgcctccccgtcgccggccatggccggccagccgccgccgcccgggggcgccgaggacgacttcctcgagcacttcttcgccttcccctccgcggcctccgccggtgccggcgggggccacgcgggcgccggtgacggcggggaccaccccttccccctcgccctcagcctcgacgccgccgccgaggcctccgccaagcaggaccgggaccccgtgcagctcgccggcctcttcccgccggtgttcggcggcggcgtgcagcagccgcacctccgcggcccaccgcctccccagatgttccatgcgcagccgaagccgggcgagggagccatggcgccgcagccgccggcaccgcggcccaaggtgcgggcgcggcgggggcaggcgaccgatccccacagcatcgctgagaggctaaggagagagagaatagcagaaaggatgagggcattgcaggaattggttcccaacacaaacaagacagatagggcagccatgctagacgagatccttgattatgtgaagtttcttaggcttcaagtaaaggttttgagtatgagcagactgggtggtgctggtgcagttgcgcagctggtttctgatattccactgtcagttaagggtgaggcaagtgacagtgggagcacacagcagatatgggaaaaatggtcaactgatggcacagagaagcaggtggcgaagctgatggaagaagacattggggcagcgatgcagttcctgcaatccaaagcactatgcatgatgcccatttcacttgcaatggcaatctatgacactcagcatccccaggatggccactcactgaagcctgaacccaatacgtcttcctagtatagtaacatcaaccttagcatgcatttcacctctgatactatttaggcatcgatatatccaaagtgtatgatataccgagcgtttcaatgtgctaaccatgaagtaggaaaggaccaaaaggatcagctcctctccaatcaattaaattggtatatgatgtagcctcccctttccctattttgttcaaagtagctttgattgcaaggatatggtaagcaatattctactc

SEQ ID NO: 5652 - protein, 277 aa, Panicum virgatum
  misc_feature: Ceres CLONE 1824035
  misc_feature (1)..(50): Pfam Name: HLH Pfam Description: Helix-loop-helix DNA-binding domain
  misc_feature: The sequence is a functional homolog of  SEQ ID NO 1106 in the  10/225,066 US patent application
  misc_feature: The sequence is a functional homolog of  SEQ ID NO 1211 in the  11/479,226 US patent application
  misc_feature: The sequence is a functional homolog of  SEQ ID NO 220 in the  10/225,068 US patent application
  misc_feature: The sequence is a functional homolog of  SEQ ID NO 2368 in the  10/374,780 US patent application
  misc_feature: The sequence is a functional homolog of  SEQ ID NO 390 in the  10/412,699 US patent application
  misc_feature: The sequence is a functional homolog of  SEQ ID NO 546 in the  10/412,699 US patent application
  misc_feature: The sequence is a functional homolog of  SEQ ID NO 909 in the  11/479,226 US patent application
  misc_feature: Useful for making plants with modulated growth and phenotype characteristics
MAGQPPPPGGAEDDFLEHFFAFPSAASAGAGGGHAGAGDGGDHPFPLALSLDAAAEASAKQDRDPVQLAGLFPPVFGGGVQQPHLRGPPPPQMFHAQPKPGEGAMAPQPPAPRPKVRARRGQATDPHSIAERLRRERIAERMRALQELVPNTNKTDRAAMLDEILDYVKFLRLQVKVLSMSRLGGAGAVAQLVSDIPLSVKGEASDSGSTQQIWEKWSTDGTEKQVAKLMEEDIGAAMQFLQSKALCMMPISLAMAIYDTQHPQDGHSLKPEPNTSS

SEQ ID NO: 5653 - DNA, 1346 bp, Panicum virgatum
  misc_feature: Ceres CLONE 1824075
  misc_feature: Encodes the peptide sequence at SEQ ID NO. 5654
acagtccggattgcaaagatcgcaagagcagcagccagccataggaatctggacgtgcccctaactgccaacccacaacatctcctcaccacattactgctcgtaaccttcgatctgcatcccagcaaggagatcaaagatgtttacagctcatatatcctccccgccggcactgacctagatctctctcttctcaagctcccacgtagcatgcgcgcagcagctgctgctcaacgagccacatgttgctagtagactagtcttagtacctagctagagagagagagagagagagagagagagagagagagagagagagagagagagagagggagggaagaagcaaagcaagaaggagagaaggcgagcggagaggctgagagaggagagcgcgcaatggagcagcagcatcaggagcggccgcgggaggtgtaccgggagtgcatgcgcaaccacgcggcgaagctgggcacctacgcctccgacgggtgctgcgagtacacacccgacgacggccagcccgccgcgatgctctgcgccgcctgcggctgccaccgcaacttccaccggaaggccttcctcgacgcggccgcgggggcgcccggcggcggcggcggcggcttccacggcgcaatgctgacctcctcccccggcgcgccggctggctacggcatgcacatggcgatagccgccgccggcatgggcggggacggcggcgcgcacggctccgcgggcaggcggcggacgcggaccaagttcaccgatgagcagaaggagcgcatggcgcggttcgcggagcggctcggctggcggatgcccaagcgggagcccggccgcgcgccgggggacgacgaggtggggcgcttctgccgggagatcggggtcaccaggcaggtcttcaaggtctggatgcacaaccacaaggccggcggcggcagcgggggcgcgggcgccggcgccggcgtcgccgctcagacgtcgtcgtccacgacgcgtggcggcgtcggcggcgtcgggccaggaggagggagcatgtctccggtgatgggcggcgtcggcgaggacgacgaggaggtgaggggaagcgagatgtgcatgtagcatccttattacttacggcggcaatggcaaggtctgttggctgtgatcgatgattaacacctccttttgctgctaattccttttggtgattttgcttccgtgagttcatgattgttgatgatgagaggctgattgtttgaacggctgtacctgtactgatgctgggctactgtgatcattcattcattgatatgttggtgacctcttaatttcctgtcttatcagtaataccctatttcgccacg

SEQ ID NO: 5654 - protein, 234 aa, Panicum virgatum
  misc_feature: Ceres CLONE 1824075
  misc_feature (1)..(56): Pfam Name: Homeobox Pfam Description: Homeobox domain
  misc_feature: The sequence is a functional homolog of  SEQ ID NO 124 in the  10/714,887 US patent application
  misc_feature: The sequence is a functional homolog of  SEQ ID NO 124 in the  11/435,388 US patent application
  misc_feature: Useful for making plants with modulated growth and phenotype characteristics
MEQQHQERPREVYRECMRNHAAKLGTYASDGCCEYTPDDGQPAAMLCAACGCHRNFHRKAFLDAAAGAPGGGGGGFHGAMLTSSPGAPAGYGMHMAIAAAGMGGDGGAHGSAGRRRTRTKFTDEQKERMARFAERLGWRMPKREPGRAPGDDEVGRFCREIGVTRQVFKVWMHNHKAGGGSGGAGAGAGVAAQTSSSTTRGGVGGVGPGGGSMSPVMGGVGEDDEEVRGSEMCM

SEQ ID NO: 5655 - DNA, 1338 bp, Panicum virgatum
  misc_feature: Ceres CLONE 1824084
  misc_feature: Encodes the peptide sequence at SEQ ID NO. 5656
aaaacctttcgtcttttcccctgtctctgcctacaaagactcgcggccccggcagagtgcttccccgcgaaggctgctcctccggtcctccctctcccttccgccccgcattcggccgcctcggttcgccggcggcgagatggccatcgatcacgcgacccctctcgggctgaagagcagaggcgcaatgggcggcggcggcgagtgcgacgacggcgcggagaaccagcggtggccgccgtggctgaagccgctgctgtccacgagcttcttcgtccaatgcaggatccacgcggacgcgcacaagagcgagtgcaacatgtactgcctcgactgcatgaacggcgcgctctgctccctctgcctcgcgcaccaccgcgaccaccacgccatccagattcggaggtcgtcgtaccacgacgtgatccgggtgtcggagatacagaaggtgctggacatcgccggcgtgcagacgtacatcatcaacagcgcgcgcgtggtgttcctcaacgagcggccgcagccccgccccgggaagggcgtcaccaacacctgcgaggtctgcgagcgcagcctcctcgactgcttccgcttctgctccctcggatgcaagattgtcggaacgtcccgcggctaccgccccaggaagaagtacgccggcgccggcgccggcaacaagaacaggaagagggcggcgctcaaggacgtgcgatgcgactcggaggactcgtgcacgggcagcagcggcggcagcagcgtcgtgcagagcttctcgccgtccaccccgccgccgaccgccgccagctgccgcccctggaacaagcgccgcaagggcgtcccgcaccggtcccccttcggcagcctcatcgtcgagttctaattgcactacctcatcaccttgacaatgcaccctgtactgtacacatgacatagcccagcccagaaggaataaccgtgcgcctctggacgtggaggtcggccggctggccggcgcgaacgccggcgaagggcgggagcggtaagaacacacctagcgtttctgctatagacctatagttgttcgcttctttcaggttttagtagtttacagttacagttgctagtcactactataggcagtaagccagtaaggtagctgctagcctgctacttacagcaacgttctaagttttgcagccttgtacattgtaatataccgctacttactccccaaatgctagatgtatatattgatattctgtcaacagtgtggggtaggaatgtaggatgcagtgagcgcgaggtggtcgtgtgttgatcatcagcacagtaaaagaaataagaaatgctgctcctcgg

SEQ ID NO: 5656 - protein, 246 aa, Panicum virgatum
  misc_feature: Ceres CLONE 1824084
  misc_feature (1)..(112): Pfam Name: PLATZ Pfam Description: PLATZ transcription factor
  misc_feature: The sequence is a functional homolog of  SEQ ID NO 664 in the  10/666,642 US patent application
  misc_feature: The sequence is a functional homolog of  SEQ ID NO 668 in the  10/666,642 US patent application
  misc_feature: Useful for making plants with modulated growth and phenotype characteristics
MAIDHATPLGLKSRGAMGGGGECDDGAENQRWPPWLKPLLSTSFFVQCRIHADAHKSECNMYCLDCMNGALCSLCLAHHRDHHAIQIRRSSYHDVIRVSEIQKVLDIAGVQTYIINSARVVFLNERPQPRPGKGVTNTCEVCERSLLDCFRFCSLGCKIVGTSRGYRPRKKYAGAGAGNKNRKRAALKDVRCDSEDSCTGSSGGSSVVQSFSPSTPPPTAASCRPWNKRRKGVPHRSPFGSLIVEF

SEQ ID NO: 5657 - DNA, 1172 bp, Panicum virgatum
  misc_feature: Ceres CLONE 1824091
  misc_feature: Encodes the peptide sequence at SEQ ID NO. 5658
aagatcccaccctgcttgaccgccttcgaccacgccgctgccgcccaagccgcgggctggttgctccgattgggagtgccaatcggagccaacagcaggggaagcacatgctgccgttcgtcctagagttcctctgctctgctagtagtgtgtagtaaggaaaaagaagaagaaatcaaggagcaaggagtagggagctgctctgctctgttatgttcttgcaagaaacgacggtgattctgcacagaggaagaaatcaaggagcaaggagaagcgatggcttcctcgagcgggagcgggagcggcagctcgggctcgctctccgcgaccctcgcggccgccgcgggcacggaggaggagctgcgcgctcatggagcagcgttgcgccaagcggatctctccaaccgcgagtctgcgcgccgctcgcggatgcgcaatcagcgccacctcgacgacctcaccgcgcaggccgcgcacctgcgccgcgagaacgcgcacgtcgccaccgcgctcggcctcaccacgcacggcctcctcgccgtcgacgccaagaacgccatcttccgcacccaggccgcggagctcgccgcgcggctcgcctccctcaacgacatcctcgcctgcatgaacaccaacgccgccgccgtcgctgcggcccgtgctgcgccggtcctctgcgcgggtccttgtcgtcttcctctgtgcggtccttgtgtctgcggagctcctcgcgagatccgccctcacgcagccccgagctcgccaccatggcccgagcccgcccctggtccttgcgccatggcgtgcagggaggggcggcgcgcgcaaggagggcggccgcgcagggaggggcggcgcggaggccagcgtcgcgagcaggaaggagaagccgattcgtttattggaaatgggtggcctctatttccagggacttgggccttcaatttggaggcccatgcaaaatgggagtccaaataaggcctccattggagttgagttttaatccaaaactcataaaaaatgggatgggggcctgtttggagacttgggctggagatgctctaagcttgcacatcttataaatcttagacacacggtaacttgtgataatgtgagtggtagcatttcaggtgctttccagaaagcagcaatgaacttgccttctctctctc

SEQ ID NO: 5658 - protein, 233 aa, Panicum virgatum
  misc_feature: Ceres CLONE 1824091
  misc_feature (7)..(53): Pfam Name: bZIP_2 Pfam Description: Basic region leucine zipper
  misc_feature (7)..(65): Pfam Name: bZIP_1 Pfam Description: bZIP transcription factor
  misc_feature: The sequence is a functional homolog of  SEQ ID NO 366 in the  10/412,699 US patent application
  misc_feature: The sequence is a functional homolog of  SEQ ID NO 855 in the  11/479,226 US patent application
  misc_feature: Useful for making plants with modulated growth and phenotype characteristics
MASSSGSGSGSSGSLSATLAAAAGTEEELRAHGAALRQADLSNRESARRSRMRNQRHLDDLTAQAAHLRRENAHVATALGLTTHGLLAVDAKNAIFRTQAAELAARLASLNDILACMNTNAAAVAAARAAPVLCAGPCRLPLCGPCVCGAPREIRPHAAPSSPPWPEPAPGPCAMACREGRRAQGGRPRREGRRGGQRREQEGEADSFIGNGWPLFPGTWAFNLEAHAKWESK

SEQ ID NO: 5659 - DNA, 1065 bp, Panicum virgatum
  misc_feature: Ceres CLONE 1824125
  misc_feature: Encodes the peptide sequence at SEQ ID NO. 5660
cccctccaaggtcaccaagaataacccaaccaaagcatataatttagcggaggagagagacctctcgatcgaggcaccagcaatggccggaggcgacgacctgaagctgctcggcatgtgggcgagcccgttcgtgctgcgggtgaagctcgcgctcagcctcaagggcctgagctacgagtacgtcgaggaggacctcggcaacaagagcgagctcctgctccgctccaaccccgtgcacaaggcggtgcccgtgctcatccacggcgggaagcccgtctgcgagtcgtcggtcatcctgcagtacatcgacgaggccttcgccggcgccggcccgtccctcctccccgccgacccctacgaccgcgccgtcgctcgcttctgggctgcctacatcgacgacaagatgctggccgcctggaaccaggcgtcgaggggcaagacggaggaggagagggccgagggaatgaagcagtctctcgccacggtggagaccctggagggagccctgagggatgattgcggcaagggcaagcccttcttcggcggcgacagcgccgggtacgtcgacgtcgtgctcggcggcctgctcggatgggtgcgggcacacatggagctccagggcgtcaactccttggaccccgatcggactccgctcctggcggcgtgggcggagcgcttctggtcgctggaagccgtcgagccggtcatgcccgacgtgagcaagctggtcgagttcggcaagatgctgcaggcccgtcaagcagcggcggcggccgccggcaactgaagggacgttggtcttgagctccgccctcttggtttcggcttctgttcgattggaaataaggcagtgttgccgtgttggtcagtccccagttagtatatggaggccgccttgtgtgcaatgagtgttgccgtggatgtctcgcgagtagtaagacaggtttttttttttttttgtgtaacatttgtttctgagttgtcacgttacagtgtaaagtgtttttgtgtgcgtgcgccttttaatttccaataatcagtcttttctcggcatgagaacac

SEQ ID NO: 5660 - protein, 235 aa, Panicum virgatum
  misc_feature: Ceres CLONE 1824125
  misc_feature (1)..(105): Pfam Name: GST_C Pfam Description: Glutathione S-transferase, C-terminal domain
  misc_feature (1)..(74): Pfam Name: GST_N Pfam Description: Glutathione S-transferase, N-terminal domain
MAGGDDLKLLGMWASPFVLRVKLALSLKGLSYEYVEEDLGNKSELLLRSNPVHKAVPVLIHGGKPVCESSVILQYIDEAFAGAGPSLLPADPYDRAVARFWAAYIDDKMLAAWNQASRGKTEEERAEGMKQSLATVETLEGALRDDCGKGKPFFGGDSAGYVDVVLGGLLGWVRAHMELQGVNSLDPDRTPLLAAWAERFWSLEAVEPVMPDVSKLVEFGKMLQARQAAAAAAGN

SEQ ID NO: 5661 - DNA, 1551 bp, Panicum virgatum
  misc_feature: Ceres CLONE 1824159
  misc_feature: Encodes the peptide sequence at SEQ ID NO. 5662
gtgaacttaacggagctgctgattggttaggtctacctcatatgctgctgcttattagctcttgctccgttccatcgcatcgttcattctccggccctgccctggtagcatccatatagcagctgctagctagctatttcaaggagagatcgatcgagcatcatccattgcatgcgcatcttcgtcgatctcttgtccctcccatctcaatctcatctagctatctgcagggcaggcaggcgcacatggatcatcagcagcagcagcagacgccatgcgtgcccccagggttcaggttccatcccacggaggaggagctggtggggtactacctcgcccgcaaggtggccgcccagaagatcgacctcgacatcatccgggaggtggatctctacaggatcgagccatgggatctccaagagcggtgcagctactacggcggcgccggcggccaggaggatgagcccaccgagtactacttcttcagctacaaggaccgcaagtaccccagcggcacgcgcaccaaccgcgccaccgccgccggcttctggaaggccaccggcagggacaagcccgtgctctcctccggccgctcatccgccgcctgcctcagcgtcatcggcatgaggaagacgctcgtcttctaccgcggccgagctcccaacggcaggaagaccgactggatcatccacgagtaccgcctccaaaacaacgagcacgcgccggcgcaggaggaaggatgggtcgtctgccgcgccttccagaagccgatgcccaaccagcagcagagacacggctgctacgccggcagcttcccggccggctaccccagcatgcccacctactactacgacggctccaacgccgccgccgccgcacacgcgcggctactgatgggcggcgctgcagctccggcggcgatgcatgaccacaccctggtgcaggcagccgagtccaagctgcaggtgcatctcctcgccgacatgccgccgccgctccacagcccagccttcgacgccgccggccagtcctacgagcaatctgcggcggagtcgtcggcggtcgactggaacctgctgagcagcctgctgccggcggcgcagcttaacttccatcagccgccggcttcgccttcatgctccaagaacaacaatgacctgtgatgtgatccgtcaccgttatgactgcgtacgttcacgactgatcgatcgattatgtattgacgaccgaccaattattagctaagtattcctttcttgtagctagggtgtattatattcatcatttcactgagatcttcctggaactgattcatcagctaccacttactcctagttctcatcatgcatctgctgatcgatttatttcttccacatatacacacacacacacacacacacatctgtattattgatcacaacacaacataacatcattatatttgcctactacaaactacaaatggttttccctcttgttttttttttacttgtttctgcgtgcacaagaatgaaatttaaaactcctagctcaaaaaaaaaaaaaaaaaaa

SEQ ID NO: 5662 - protein, 305 aa, Panicum virgatum
  misc_feature: Ceres CLONE 1824159
  misc_feature: Great-hit functional homolog of the protein sequence given in SEQ ID NO 9289
  misc_feature: Useful for biocontainment applications
  misc_feature: Useful for making plants with altered cell wall content and/or composition
  misc_feature: Useful for making plants with altered lignin content
  misc_feature: Useful for making plants with modulated biomass
  misc_feature: The plant produces a reduced number of seeds.
MDHQQQQQTPCVPPGFRFHPTEEELVGYYLARKVAAQKIDLDIIREVDLYRIEPWDLQERCSYYGGAGGQEDEPTEYYFFSYKDRKYPSGTRTNRATAAGFWKATGRDKPVLSSGRSSAACLSVIGMRKTLVFYRGRAPNGRKTDWIIHEYRLQNNEHAPAQEEGWVVCRAFQKPMPNQQQRHGCYAGSFPAGYPSMPTYYYDGSNAAAAAHARLLMGGAAAPAAMHDHTLVQAAESKLQVHLLADMPPPLHSPAFDAAGQSYEQSAAESSAVDWNLLSSLLPAAQLNFHQPPASPSCSKNNNDL

SEQ ID NO: 5663 - DNA, 1064 bp, Panicum virgatum
  misc_feature: Ceres CLONE 1824162
  misc_feature: Encodes the peptide sequence at SEQ ID NO. 5664
gaagaaaaaaaaaaggccgcatcaacctccgccagcgaagaccggccggccggcggccgtagtcaggagacgccggcgcagcttcaacctcagcgcgcgtgccttaaccttcccaagcgcagccgcgccatgcgcgcctccgtcaccgaaatcagcgtcttcacggccgcggccgcgcatgtgctctgcttcgccggcttcgctgtcgcccactcaatcgctggccgcggagctctcgtctccgaccctgcgcgcgccctccgtctcctcgtggtctgtgaagcgcccgtagtcatcgcagtgttcagctacctccggcgtgaccccaaaagctgctcgttttccaaggctgctgcaagaggattgatcggcttgcccgtgggagcattccttaatgcgtttggagcaattgttcttggtgcacctgttggaatcaagtacttgatggttactatttattggtcacttctcgtgtccctgttcacctttgttcctgcagcatgtgtctttggagcatccaagattgattggcagaatgtgctttctcactccatttatttcacgccaactgaagttgagaactacatgatctctgcaccttgtcatggagctgtgctaggagcatggctgggtgcttggcctttgccccttgactgggagagaccttggcaggaatggccaatctgtgtcacttatggggcagttgctgggcatttggttggaatggcagtgtcacctgtcctaatagctgttcacaagagaagggtccgtgcaaaagctgactagcctgtggatgatgagtgctgccatacttttttttatctctcttatttcctggttagatacgactaatccagaatcttgtagtgtacaactgttcttcccacaaagcaatgcgtttttttattagctttcttgttatagtgggagtaccgatggctttcaatagctttatcgagattctcattgttagctccttcagcgagcccttattgctgctgtacattattttcatgattgtaacaattgatgttagctttttccaaaaaaaaaaaaaaaaaaaa

SEQ ID NO: 5664 - protein, 218 aa, Panicum virgatum
  misc_feature: Ceres CLONE 1824162
  misc_feature (147)..(188): Pfam Name: PIG-F Pfam Description: Phospho-ethanolamine N-methyltransferase
MRASVTEISVFTAAAAHVLCFAGFAVAHSIAGRGALVSDPARALRLLVVCEAPVVIAVFSYLRRDPKSCSFSKAAARGLIGLPVGAFLNAFGAIVLGAPVGIKYLMVTIYWSLLVSLFTFVPAACVFGASKIDWQNVLSHSIYFTPTEVENYMISAPCHGAVLGAWLGAWPLPLDWERPWQEWPICVTYGAVAGHLVGMAVSPVLIAVHKRRVRAKAD

SEQ ID NO: 5665 - DNA, 897 bp, Panicum virgatum
  misc_feature: Ceres CLONE 1824167
  misc_feature: Encodes the peptide sequence at SEQ ID NO. 5666
atccagctgaatcgctgtgctgtgcctgtaggtggccaacccctcctcgccgcccgcggccatggatcccgactccgaggtgaccttcgacttcctgccctacctctgccagtacaagagcggccgcatccaccgccccggcggctccccaacggtccccgccggcacggaccccgccaccggcgtcgtctccaaggacgtccgcgccggccccgcctccgtccgcatctacctcccgcccggcgccgccggcaagatcccggtcgtcgtctacttccacggcggcggcttcgtggtcggctcgccggcgcggccgagcacgcacaactacctcgtcgacctggtgcacccgtacttcacgggcagggaggccgtcggcggcgaggtcgcgttcggccccgagatccgggggtacatggaccgcacgtggcgcttcgtggtctcggagacggtggggctggacgacccgcgcgtgtgcccgttcgtggacgacgccgcccgccgggcctccgccgggatcccgtgcgagcgtgtgctcgtgtgcgtcgccgagaacgacttcctgctcagggagcgcgggctctggtaccaccgggagctcaaggccagcgggtacgccggcgagctggagatcttcgagtctaagggcgtcggccacgcgttccacttcgacctgctcggctccgagcagggcgtccagctgcaggagcggaccgtcgctttcatcaacaaatgaatggaatctcggctcctgatgtcgacaagggttcatgaagatatattattgtctatttctcatgaaataagtgtttatgagttttgtgctaccatcgatcatttccatacttcaactcgatcatttccatacttcaactgtaataccttgaaatttgcttc

SEQ ID NO: 5666 - protein, 224 aa, Panicum virgatum
  misc_feature: Ceres CLONE 1824167
  misc_feature (117)..(226): Pfam Name: Abhydrolase_3 Pfam Description: alpha/beta hydrolase fold
MDPDSEVTFDFLPYLCQYKSGRIHRPGGSPTVPAGTDPATGVVSKDVRAGPASVRIYLPPGAAGKIPVVVYFHGGGFVVGSPARPSTHNYLVDLVHPYFTGREAVGGEVAFGPEIRGYMDRTWRFVVSETVGLDDPRVCPFVDDAARRASAGIPCERVLVCVAENDFLLRERGLWYHRELKASGYAGELEIFESKGVGHAFHFDLLGSEQGVQLQERTVAFINK

SEQ ID NO: 5667 - DNA, 1158 bp, Panicum virgatum
  misc_feature: Ceres CLONE 1824271
  misc_feature: Encodes the peptide sequence at SEQ ID NO. 5668
acctccgctccttccaccaccgccaccacccgccgccccctcccgcccccaccatgtccgacctccgcccgccggagcaccaggtcgccggccaccgcgcctccgccgacaagctgggcccgctcgtcgacggttccggtctcttctacaagccgctccaggccggggaccgcggggagcacgagcgcgccttctacgaggccttctccgcccacgccgccgtcccgccccgcatccgggacgccttcttcccgcggttccacggcacgcgcctcctccccacccaggcgcgccccagggacccgcacccgcacctcgtcctcgacgacctcctcgcgggcctccgggcgccctccgtcgccgacatcaagatcggtgccatcacgtggccgccgagctcgccggagccctacgtcgccaagtgcctcgccaaggaccgcgggaccaccagcgtcctcctcggcttccgcgtctccggcgtccgggtcgtcgcccccgggggcgccgtgtggcgcccggagcgccaggagctcaaggagctggacaccgccggcgtccgccgcgtgctccggcgctacgtgtcgtccgctcccggcgagggggcggactgcgcgctcgccgcggcggtgtacggcggggaaggtggagtcttgtcgcagctgcgcgagctcaaggcgtggttcgaggagcagactctgttccacttctactcggcctcgattcttctgggctacgatgccaatgcagtgtcagccaccggagttgggggcggggtgagggtgaagctggtggactttgctcatgtcgctgagggtgatggggtgatcgatcacaacttcctgggcgggctctgctcgctgattaagttcatttctgacattgtttcggaggctcctgagacgccgccattggctccttaacaggcggagatcttggcatatgggagttgatgacaaaggcgtaaagttttgttcgaaaaggaaacctccgagctgctggttgtggaaatgcgagactcctcagctcagcccggttggccttcgctgcaaacatacggcaacctgtacctaatcttctgaaatactctggggatcgaatacgttggatctgattgcataaagaaaacctagaggtcaccaaaaaaaaaaaaaaaaaaaa

SEQ ID NO: 5668 - protein, 288 aa, Panicum virgatum
  misc_feature: Ceres CLONE 1824271
  misc_feature (1)..(271): Pfam Name: IPK Pfam Description: Inositol polyphosphate kinase
MSDLRPPEHQVAGHRASADKLGPLVDGSGLFYKPLQAGDRGEHERAFYEAFSAHAAVPPRIRDAFFPRFHGTRLLPTQARPRDPHPHLVLDDLLAGLRAPSVADIKIGAITWPPSSPEPYVAKCLAKDRGTTSVLLGFRVSGVRVVAPGGAVWRPERQELKELDTAGVRRVLRRYVSSAPGEGADCALAAAVYGGEGGVLSQLRELKAWFEEQTLFHFYSASILLGYDANAVSATGVGGGVRVKLVDFAHVAEGDGVIDHNFLGGLCSLIKFISDIVSEAPETPPLAP

SEQ ID NO: 5669 - DNA, 1488 bp, Panicum virgatum
  misc_feature: Ceres CLONE 1824331
  misc_feature: Encodes the peptide sequence at SEQ ID NO. 5670
gcacaggctccagctctgctccccaaacggccaaacccatcccagccgtcaaccctagcgacggcggcccgagcggcggatcggcagagcggcaccggcacggcaggggcaggggcagggcgcaggggcggaggccggaggagccgcgcgctcgcgtcgccgcgggacgcagccgccgagccgcgcaagagcgacctcctgctccccggctgccctgctcggcgggcggcggccaggagcaggacgcggcgcggcgcgtgcaggcgggccgcgtgcggccagccgggtagccgacgtccggcgaccagggagcggcgctgtgcttcaattgctaggatgttctcgctgagcctgattcagcatgacctgccgatgccgccgcacctgctgagccgccccctcctcgacgccatcaaggccgagctcgagaggctcttcctggacaaggttatcgcgaaccttgggctgtgcgtgtctgtctatgatatccgatccgttgaaggcgggtccatccatgcgggagagggctgctcgatctatagagtttcatttcgtttgctgatgttcaagccctttaatggggaggttcttgttgggagaattagcggatatgatgataaggggttgcaggtttcacttgatttcttcagtgacatatgcatccctggacatttgatgcagtatggcacagtgaggggaccagatggtaggtggatgctgaagaccgacgataatgatgagctatatctagatcttgatgatgagataaggttcttggtatctagcacaaagtacatgcctatcccaattaaccaaaaggagggtgatccaccatttgctccaatgcagattgttggaagtattaaaggagatggtcttggtcttcttgcttggtggtcagctgacgaagagggagaggaggcggctgagcaatagtaaagtgttgcttaagggatctctttgtgtagtttacaatctcatcctactagcatgttacgtaacctatataaccccgatacttcaacatgaccccgtatcacgtatccgatacgtatccgcgtatccgtatccgatacacctttgtgcctttaacttttgcagaaatttgacgtatccacgtatccgtatccttccgataccgatacgcgtatccgtatccgtgttgcataaggtaactgtatctagtagcagtaacatggtacttagggatcttacatggtttttacatattatgtattctttttgagtcgggcgtgctggatctcttctggcactcccagttgttactgctgctgcgacctattgccgtcgatttcttaaaaaaaccaccaaagaaaagtaggtcagattcttagaagttatgtatgtatgtatgtaatacccttaagttttctgaatattttgttagatgtataaacttataatatggagtattctccctgcaaggatatttcagcaggccagcaccaaaaaaaaaaaaaaaaaaaa

SEQ ID NO: 5670 - protein, 199 aa, Panicum virgatum
  misc_feature: Ceres CLONE 1824331
  misc_feature (1)..(109): Pfam Name: RNA_pol_Rbc25 Pfam Description: RNA polymerase III subunit Rpc25
  misc_feature (1)..(70): Pfam Name: RNA_pol_Rpb7_N Pfam Description: RNA polymerase Rpb7-like, N-terminal domain
MFSLSLIQHDLPMPPHLLSRPLLDAIKAELERLFLDKVIANLGLCVSVYDIRSVEGGSIHAGEGCSIYRVSFRLLMFKPFNGEVLVGRISGYDDKGLQVSLDFFSDICIPGHLMQYGTVRGPDGRWMLKTDDNDELYLDLDDEIRFLVSSTKYMPIPINQKEGDPPFAPMQIVGSIKGDGLGLLAWWSADEEGEEAAEQ

SEQ ID NO: 5671 - DNA, 1275 bp, Panicum virgatum
  misc_feature: Ceres CLONE 1824344
  misc_feature: Encodes the peptide sequence at SEQ ID NO. 5672
gacggacaaaagcctcccttcacagtttccctcccctcccttcccaaagctactttcccacaaacccaaaccaaaacagcttgcgtcttccatttcttttcttgttggccttcttcttgcttgcttactcgttcgttgcttcttgagcccctccgcgccttgcccaagcctctgtgtgttttataggcttgggagctcgtgatagggggtggaggagacacgaagaggagtctgcttcgtcttccttgaggagtcatgttccatggcggcaggccgttgtccctcagggggtctctcaaggcccttgaagctgatatccaccatgccaacaccctagctcatgctatacacagggcgtatgggggtgcctgcgtgcagatgaggttgtcctacagctccatggctccaatcatcctcaaccttatccagtggatggattgcagctgctccttgtcatacaccctccctagttaccttggcctgctcgaggttcttgtctacaaggtttatgttgatgaagatgcctctatatccaccatagaaaggagagcaagcctgaaggaattctatgctatcatatacccgttcttaaaacagcttgagggcaacttgatggacaaggactgcaaggggaaagggtggtgtaaggagtccggcggcggccggaaggttgttgccgatgatgaccgggaggatgagtgtggcatttgtttggagacctgcaccaagatggtccttccaaattgcaaccatgccatgtgcatcaactgttaccgagactggtatacaagatcccagtcatgcccattctgccgtggaagcctcaagagagttcagtcccgagacctctgggtgctcaccggtgacgatgatgtgatcgacacggtgatcttggagaaggagaacgtgaagcacttgctcagcttcatcgatagcctgcctctgatagtccccgataacatgttgttggtctactacgactacctagtctaacaaagctccactctgaaattctgaaagaggagagagatctgggatgatgaagcggtgtacaagcaggcaagggtgtccagcagccgaccatcctctgcggatcgagttggcaagtgaagccgttgctgaagaaactctgtggtatgccatgccgtcgcactggccttgcgtgatggcattgttccttgtaataattgtaaagaaaaatgtctcgagttttactagcttgacatttctccgccggcaaattgccggcttattcaaaaaaaaaaaaaaaaaaaa

SEQ ID NO: 5672 - protein, 245 aa, Panicum virgatum
  misc_feature: Ceres CLONE 1824344
  misc_feature (1)..(38): Pfam Name: zf-C3HC4 Pfam Description: Zinc finger, C3HC4 type (RING finger)
MFHGGRPLSLRGSLKALEADIHHANTLAHAIHRAYGGACVQMRLSYSSMAPIILNLIQWMDCSCSLSYTLPSYLGLLEVLVYKVYVDEDASISTIERRASLKEFYAIIYPFLKQLEGNLMDKDCKGKGWCKESGGGRKVVADDDREDECGICLETCTKMVLPNCNHAMCINCYRDWYTRSQSCPFCRGSLKRVQSRDLWVLTGDDDVIDTVILEKENVKHLLSFIDSLPLIVPDNMLLVYYDYLV

SEQ ID NO: 5673 - DNA, 1152 bp, Panicum virgatum
  misc_feature: Ceres CLONE 1824359
  misc_feature: Encodes the peptide sequence at SEQ ID NO. 5674
attcgtccctcgtcctcctctgctcctcgcctcctcccctccctcgaaggccggccggcgcagggcgggagatcgatccgaacttggagttgagtcggctccttcttctgctgggtaccatgaggaggttggtgttgaccgccctcgtcgcgagggggctcgtcaggtcgtgccgcgcgccgacgacagctgtaaggctcgcgaacccgttcctcgagggatttccttcctgctaccttagcgagactgcttgatacagatgtgatggctgtgtcacaaccagcttttcagcagtttatgaactactcgtcaggacatggtggtgatcctaatgcaaacggggattcgactgtaacacgaatagctattgaccgtgatacacatcaagatttcaaaccaacgagcaaaaatttggacacgtctttgcatgacattgttgctcaggatatcagagagaacccagtcttgatctatatgaagggtttccctgagtctccaatgtgtggcttcagtgcactggcagtcaaagtcttccagcaatatgatgtccctatctgtggtagagatattctgggagatctcaggctcaaagaggctgttaaagcccacactaactggcctacgtttccacaaatatttatcaaaggagagtttgttgggggatctgacatcatactaagcatgcaccagaagggggaactaaaggatctgcttggagacatcacacaaagagatggacaaaaggcggatgctaactagccatgaagcaatccacgttacattgtttttcacagaatattattctcttagacaatcctttggtgacttttgcatgctgtgttctttgcagctctggtcccaggtttggttgatctggctttctgactgaggcaatcatgatcatgtccaggagtgcaccaagttctctgtcagaaactcagaatgaataatgccactacgcaatgccattatttttgtgcattgcatatggagcttgagttccaggatacataggttgcattacactgcccatgttttgtaattcaaatgaacctgcaataacaagtggtaaggctgtaaaatgcttagggatacctgtttttgttcaatatatttacttggtgctgtttgcaaaaaaaaaaaaaaaaaaaa

SEQ ID NO: 5674 - protein, 164 aa, Panicum virgatum
  misc_feature: Ceres CLONE 1824359
  misc_feature (1)..(65): Pfam Name: Glutaredoxin Pfam Description: Glutaredoxin
MAVSQPAFQQFMNYSSGHGGDPNANGDSTVTRIAIDRDTHQDFKPTSKNLDTSLHDIVAQDIRENPVLIYMKGFPESPMCGFSALAVKVFQQYDVPICGRDILGDLRLKEAVKAHTNWPTFPQIFIKGEFVGGSDIILSMHQKGELKDLLGDITQRDGQKADAN

SEQ ID NO: 5675 - DNA, 1577 bp, Panicum virgatum
  misc_feature: Ceres CLONE 1824412
  misc_feature: Encodes the peptide sequence at SEQ ID NO. 5676
atctcgaatcgaatccgcgcgacgcgccccctgctgagccggcgagaagatgccgcggttgacgccggcggacgcgaccctgatcctggaccacgccctgggcgacccctcggtccccgccgccgccgtccacgcgctgctcgcagcgctgcccttcccctccgatccgaccccgcgcctccgccgcgcggtgctcctccgccgcctcgccgccgacccggtctccgcctccgcgctcgacacgctccacctcctcgcgtcgctccccgcctccgcgtccccctgcccgccccccatcgccgccgcccacatcgccgtcgcgggcttcctcgcggcgtccgcgccggacttcgacgccgccgccgcggcgctcttcgcgcgccccgacggccgcgcggtcggcgagggagggcctcccgcgctcgcctccgacgccgccgtcgccgcggtggaccagttcgaggccgccgtcgggaactcgttctcgcaggtcgtgcttaggggcctgtggggcgaccgggccgccgcggaggagcgggtgagggagctcctcgccgccgagtgggccgtgattgggccgtcgctgctggaggtggcggcggagcggatcgtcggggatgggtccatccagacatggcgtgacgcgaaggaggccacccgcgccaagttccgtgtgcttgctggggaagaaaaaacacgccaaattttgggcaaacttgaagaatctacctctcgtgtaaacccgatttcgacaccagaatttttcaaggtgatggatgctcttaaaacaagctctgcggagcttcacagtgtagtggaggatccacttccggctgcaaaggcagctgcagatgaggtggtggctacaagggtggataggacagttaatttaaatgctgaaactggtcagccagcagcttgtggcactgccggctcaagtgtgcttcatgaaaagaacaatggtccaaataaaggcacacctcccagccttatggattggaacgcgacggcacagacctttcagtgggaggactcgcctgatcctgagggttcagaaccagcattgcgtagaccgcacttgcctagccctaggagaacaccactttctcctttgccaccggcaggaaacaaaaataagcgtagaagggcaaggaagtggtgcttgttagaagaagaaacactaagaaagggtgttgaactgtatggtagcggtaattggaaggatattctgagtaacaaccctgatgtttttatcggcagaacaccagtggacttgaaggataagtggaggaacatgatgaggtagtgggtaaccttttatctggacaaggtaatggagcctgtgttcattctggctgaagtaacctcacgttctggcgtttgctgtggtgaagtagagagccttcaaccatttcgtgacgttactaataatgtaacaaatgctcaccgaataaactgcttcactgaagggctgtattgaacctatgtatagcacgttgcctgtgtgtacgaatgctgtaccgtcgaagtacactgtacgtataatcttatcttatgcaaaaaaaaaaaaaaaaaaa

SEQ ID NO: 5676 - protein, 418 aa, Panicum virgatum
  misc_feature: Ceres CLONE 1824412
  misc_feature (1)..(51): Pfam Name: Myb_DNA-binding Pfam Description: Myb-like DNA-binding domain
MPRLTPADATLILDHALGDPSVPAAAVHALLAALPFPSDPTPRLRRAVLLRRLAADPVSASALDTLHLLASLPASASPCPPPIAAAHIAVAGFLAASAPDFDAAAAALFARPDGRAVGEGGPPALASDAAVAAVDQFEAAVGNSFSQVVLRGLWGDRAAAEERVRELLAAEWAVIGPSLLEVAAERIVGDGSIQTWRDAKEATRAKFRVLAGEEKTRQILGKLEESTSRVNPISTPEFFKVMDALKTSSAELHSVVEDPLPAAKAAADEVVATRVDRTVNLNAETGQPAACGTAGSSVLHEKNNGPNKGTPPSLMDWNATAQTFQWEDSPDPEGSEPALRRPHLPSPRRTPLSPLPPAGNKNKRRRARKWCLLEEETLRKGVELYGSGNWKDILSNNPDVFIGRTPVDLKDKWRNMMR

SEQ ID NO: 5677 - DNA, 1702 bp, Panicum virgatum
  misc_feature: Ceres CLONE 1824458
  misc_feature: Encodes the peptide sequence at SEQ ID NO. 5678
atcgcccgaaaccaggatgggtagccagggacaaccggcacccggcgcccgcggagacgatgacgactccggcggaagagcagcgcacttcgtgttcgtcccgctgatggcgcagggccacctgatcccggccgtcgacaccgcgctgctgctcgccacccacggcgcggtctgcaccatcgccgcgaccccggccacggccgtgcgggtgcgcgccacagtcgactccgcccggcgctccggcctgcaggtccgcctcgtagagttcccgctcgactacgccgcggccggcatgccggacggggcagacaacgcggacaacgtcccggtggagcacatgtggagctacttccgcgccctgccgctcctcagcgcgccgatcgagagctacctccgcgcgcacgcgccgttcccgacgtgcgtcgtgtcggacttctgccacccgtggaccacggtgctcgcggccaaccttggcgtcccgcggctcagcttcttcagcatgtgcgccttctacctcctgtgccagcacaacgtcgagcggttcaaggccttcgaaggcgtcgccggcgacgacgagccggtcgttgtgccggggctggagaagaggttcgtggtgacgagggctcaaactcctgggtttttccggcagttggcggcctggcaggagttcgcggactacatcgagcgcgcgatggccgaggccgacggcgtcatcatgaacaccttcgaggagatggagccggagtacgtcgccggctacgcggcggccaggaagatgaaagtctggaccgtcgggccggtgtcgacctaccaccacaagcgcgacgcgacgctggctgcgagagggtacgccgccgccgccatcgacgccggcgagtgcctccggtggctcgacggcaaggagcccggctccgtcgtctacgtcagcttcggaagcgtcgcgcgcgctggcgggaagcaggccgtggagctcggcctcgggctggaggcgtcggggcacccgttcatctgggtggtcaggaacgccgacgagtacgaggagtcggtgcgcgagttcctgggcgagctggaggcgcgcgtggcggggcacggcctgctggtccgggggtgggccccgcaggtgctgatcctgtcccacgccgcggtgggcgggttcgtgacgcactgcgggtggaactcgacgctggaggccatcacggcggggctcccggtagtgacgtggccacacttcacggaccagttcctgaacgagaagatggccgtggatgtgctgggcatcggcgtcagcgtcggggtcacggagccgctcatgtaccaggcggtggagaaggagatcgtggtggggcggggcgcggtggaggcggccgtgaggagcgtcatgggcgccggggaggaggcggaagagaggcggcggcgggccctcgcgctcgcggccaaggcgagggcggccatgcaggaaggcgggtcgtcgcacgggaacctgctggatttggtcaagcgcttcaaggccgtttcttgattagcgtagtgtggtgagcgaatggcagattggcagttgcaaaaccatggtggggacggtttctgtccgcaaagctgattctgcgaccgtaacgttagaaacttacggtcgatcactgtcccaccggacacccttatcttctccttccacggccccaccgatcaaaaaaaaaaaaaaaaaaaa

SEQ ID NO: 5678 - protein, 500 aa, Panicum virgatum
  misc_feature: Ceres CLONE 1824458
  misc_feature (1)..(126): Pfam Name: UDPGT Pfam Description: UDP-glucoronosyl and UDP-glucosyl transferase
MGSQGQPAPGARGDDDDSGGRAAHFVFVPLMAQGHLIPAVDTALLLATHGAVCTIAATPATAVRVRATVDSARRSGLQVRLVEFPLDYAAAGMPDGADNADNVPVEHMWSYFRALPLLSAPIESYLRAHAPFPTCVVSDFCHPWTTVLAANLGVPRLSFFSMCAFYLLCQHNVERFKAFEGVAGDDEPVVVPGLEKRFVVTRAQTPGFFRQLAAWQEFADYIERAMAEADGVIMNTFEEMEPEYVAGYAAARKMKVWTVGPVSTYHHKRDATLAARGYAAAAIDAGECLRWLDGKEPGSVVYVSFGSVARAGGKQAVELGLGLEASGHPFIWVVRNADEYEESVREFLGELEARVAGHGLLVRGWAPQVLILSHAAVGGFVTHCGWNSTLEAITAGLPVVTWPHFTDQFLNEKMAVDVLGIGVSVGVTEPLMYQAVEKEIVVGRGAVEAAVRSVMGAGEEAEERRRRALALAAKARAAMQEGGSSHGNLLDLVKRFKAVS

SEQ ID NO: 5679 - DNA, 1587 bp, Panicum virgatum
  misc_feature: Ceres CLONE 1824485
  misc_feature: Encodes the peptide sequence at SEQ ID NO. 5680
atggtccccttccatctgacctgagctccgtcccgtctctctccgatcttgcgcagctcttccaaaacccctcaaaagcggaggcgtgttcaagtgtgtatgaatctgaacacagagagacagagttcagagacactgagctgcggcagaaggctacaaggcgcgaaacttctttgaccggaacaaagagccccgactgtgccggtgcctgctaccagtgatcatggtgaaggaagaggagatcgtcgcacaggcaggagggcgagcctacatggacttgcttggtctcggggaagaggactacttgctgtgcctgtccccttcctcctacttctcttccagtgtcgtctccacgacgacgaccaccaccagtgccactcctgctgcggcggcgtctcctacctgcgcctcctacctggacccggctcccgcttatcaccacatgttaagcttcgccggccaagagcagtaccatggtggtgatgtcgtctttggcttccagtaccacggcggtgatcaggcagcgattccggtggctgttccgcagaagtccagcccaaccaccgagtgctcctcctccatctcctccatgtcgtcctcgccgcctgcaacaacaatctcggccatctccagcccaaagccacagggtttcaagaagaagggatcaagaagcagtgatcaaagaaaggctgcgcctgctgctgctgttgctcatgctgctactgctactggtgctgctacgaacaagaggcccagggtgaggagggagaagctcggggagaggatcatagctctgcagcagctggtttctccattcggaaagtctgatacggcttccgttctgcacgaggcgctgggatacatacgcttcctgcacgaccaggttcaggtcctgagctcgccgtacatgcagcgcctgccggcctcggtgcacgccccggcgcaggagggcgcggccgggacggtggtggagccgccgcgggcgagcgacctgcggagccgggggctgtgcctggtgcccatctcgtgcacggagcacgtcgccggcggcgggcacggccacggcaacggcgccgacctctggtccgtggcggcgcgggtggagaacaagggggcggctgccggaacgctgcctggcgctggtggccaccccggttacctggcctagctgactgcggcagacttgctttacagattatgtacggggttatcgctctaatcaggttcttttggggttcattaatcagctcccgtactcccatcaccttttgcttaaagtaaaacttttgggaggtggctgctgctgcttttgctggaaaagggcgcagggatctagccatacaaaccctatttccgcagatgccacagcgcagcaggcagtgggggggtcaagtgtgtgtatattttggaggttttcttttagcttagaactactccatgctcttagtactgagcgtctgagcttagtagagagaagacagcgatgcgacgatgccgagatctttggcacgaatgtctccgtggtgtcacgcctcacgacaggcattgaatggaagttgctgccgccaaaaaaaaaaaaaaaaaaaa

SEQ ID NO: 5680 - protein, 314 aa, Panicum virgatum
  misc_feature: Ceres CLONE 1824485
  misc_feature: Great-hit functional homolog of the protein sequence given in SEQ ID NO 9207
  misc_feature (5)..(50): Pfam Name: HLH Pfam Description: Helix-loop-helix DNA-binding domain
  misc_feature: Useful for making plants with altered Lignin content
MVKEEEIVAQAGGRAYMDLLGLGEEDYLLCLSPSSYFSSSVVSTTTTTTSATPAAAASPTCASYLDPAPAYHHMLSFAGQEQYHGGDVVFGFQYHGGDQAAIPVAVPQKSSPTTECSSSISSMSSSPPATTISAISSPKPQGFKKKGSRSSDQRKAAPAAAVAHAATATGAATNKRPRVRREKLGERIIALQQLVSPFGKSDTASVLHEALGYIRFLHDQVQVLSSPYMQRLPASVHAPAQEGAAGTVVEPPRASDLRSRGLCLVPISCTEHVAGGGHGHGNGADLWSVAARVENKGAAAGTLPGAGGHPGYLA

SEQ ID NO: 5681 - DNA, 1110 bp, Panicum virgatum
  misc_feature: Ceres CLONE 1824499
  misc_feature: Encodes the peptide sequence at SEQ ID NO. 5682
gtctcttcggagacctccgataaaattagaatgatgtagagaagagtatgccttctgcgtaagaatgacatgagagctcccgcggcagccatggagaccctcctctccccctccacattgttcgccccgctccgcggctcccggaggccggccctcgccgctaccgccaccgtctcgtcgaggcccgccgacgtctcctgcgcgctcaagaagccgcaggcgggtgcgggtctcgccgccgccggcaggagctcggtgtcgttcctgcaccacggcctggcggccgccgcgctgtcgctggccatcagcctgtcgcccgcgcccgtgccggcggcggcgtcggagttcgacgtgctgaacgacgggccccccgtggactcgtacgtggtggacgacgccggcgtgctgagccgcgtgaccaagtcggacgtcaagcgtctggcgcgcgacctcgaggcccgcaagaacatccgcctcaacttcatcaccgtccgcaagctcaccagcaaagccgacgcgttcgagtacgcggaccaggtgctggagaagtggtacccgacgatcgaggagggcggcaacaagggcatcgtcgtgctcgtcaccagccagaaggagggcgccgtcaccggcggcccggccttcatccaggccgttggcgagcaggtcctcgacgccaccgtgtcggagaacctcccagtgctggcgacggaggagaagtacaacgaggcgatcgtcagcacggcgaggcggctggcggcggcgatcgacgggctgccggacacgggcggcccggcgttcaaggagaacaagcgggagtccaacttcaagacgaaggaggagacggaggagaagcgcgggcagttcacgctcgtcgtcggcggcctgctcgtcatcgccttcgtcgtgcccatggcgcagtactacgcctacgtgtccaagaagtgagttgtgagccatggcgcgcttctgtacagtaactttacaccgatccaagaggaagatgacttcgtcgtctctcccaggatgagcatcttcgatctgttggaggaattcttagaggtgaacagagaatggttaatacaagtgcacacctgtgcactcttctctatt

SEQ ID NO: 5682 - protein, 291 aa, Panicum virgatum
  misc_feature: Ceres CLONE 1824499
  misc_feature: Great-hit functional homolog of the protein sequence given in SEQ ID NO 9543
  misc_feature: Useful for biocontainment applications
  misc_feature: The plant produces a reduced number of seeds.
MRAPAAAMETLLSPSTLFAPLRGSRRPALAATATVSSRPADVSCALKKPQAGAGLAAAGRSSVSFLHHGLAAAALSLAISLSPAPVPAAASEFDVLNDGPPVDSYVVDDAGVLSRVTKSDVKRLARDLEARKNIRLNFITVRKLTSKADAFEYADQVLEKWYPTIEEGGNKGIVVLVTSQKEGAVTGGPAFIQAVGEQVLDATVSENLPVLATEEKYNEAIVSTARRLAAAIDGLPDTGGPAFKENKRESNFKTKEETEEKRGQFTLVVGGLLVIAFVVPMAQYYAYVSKK

SEQ ID NO: 5683 - DNA, 915 bp, Panicum virgatum
  misc_feature: Ceres CLONE 1824510
  misc_feature: Encodes the peptide sequence at SEQ ID NO. 5684
aatttccttagccacctcctccccaatttgctccgcaccgaccacgaaccgaacagcgcgccgccgccgtcgctccctctccacctccatttcctccccctttctcttcgccttccccccctaccggagacacaaccagcgtcctgggcagccgctgcagtctcgttgccgctcgcttcgccgaccaatccggaggcaggccagggcggacgggacgggatgttctccggcgactggacgccgccgtgcggcagctgctgcaccaagaagtacgcgagcctcgtgcagatcccatggagggtgttctgcaagaaggggtgcaacgcggacggagacacctgggaagaatgcataggaaaatgtactgaaatctgctacaaagatccagtgttggaagatcgccagtggagtgcttacattgatcgatctccagggcaggatagttactctttggagtgcttcaatgcttgtgtgtctggttgtggattcaggttcgagatcccaacagagaaggttgaagagatcaagcccaacaggccgtccaagccgccacctcctgaagtgaagccaactatgggtccagcctctgctgctgggagccgtgaagacgtgccatgcacatcggcctagttgcctccaactccaaatctttgatgttctaattgctctgttctcctcactcgtcctcccccttctctttctggaaaacgtacggaatgttttctttgttatcatagctagtggtactcgcgaaatttagagtgaagaatttgtagcactggcagtaagagatgacgaggggagtgcagctatgtattgtacacaagtaacaggagttttacttgataaatggcatgacatgacatgtttcagagcttcacgagcgtgaagcatcaaaaaaaaaaaaaaaaaaaa

SEQ ID NO: 5684 - protein, 136 aa, Panicum virgatum
  misc_feature: Ceres CLONE 1824510
  misc_feature: Great-hit functional homolog of the protein sequence encoded by LOCUS At4g21720
  misc_feature: Useful for making plants with modulated nitrogen use efficiency
MFSGDWTPPCGSCCTKKYASLVQIPWRVFCKKGCNADGDTWEECIGKCTEICYKDPVLEDRQWSAYIDRSPGQDSYSLECFNACVSGCGFRFEIPTEKVEEIKPNRPSKPPPPEVKPTMGPASAAGSREDVPCTSA

SEQ ID NO: 5685 - DNA, 1449 bp, Panicum virgatum
  misc_feature: Ceres CLONE 1824512
  misc_feature: Encodes the peptide sequence at SEQ ID NO. 5686
cgaaacaagattagataaaccgaaaggccaatcgccatcgccaaatcgccaccgtcagtcatgatgtctccgacggcccccgcaacggccgtcttcctctccgcggcggcgccctcccccaccactcgtcggcggcgcagccggctcgccgccatctccgcatccctctcgccctcgtcctcctccgaggagccgttgctggtgcgcgcggcgcggggcgaggatggcctcccgcgcccgccggcgtggatgatgcggcaggcggggcggtacatggcggagtaccaggcgctggccaagcgccacccctcgttccgggagcggtccgagaaaacggacctcatcgtcgagatcactctgcagccctggcgcgccttcgcgcccgacggcgtcatcctgttctcggacatactcacgccgctgccggcaatcggggtgccgttcgatatctccgattccaaggggccgctgatccaatcgcccgtgcggtccgaggaacaggtcaggcagctcgtgcccatcgacctcgataagctcaatttcgtcggggagtcgctcaggattctgcgaaatgagattgatggaaaagctgctttgctaggatttgtgggggccccgtggacaattgcaacttatgttgtcgaaggggggatgaccaacacatacacaaatataaagagcatgtgccatactgctccaaatgttttgaggggccttctctcacaccttgcacaagcaatatctgactatatcatttaccaagtaaactctggggctcaatgtatacagatatttgattcatggggtgggcaacttccacctcatgtgtgggagcagtggtcaaaaccatatatcaaacagattgtgagtaggattaagaatgagtgccctcatgtaccccttgtcttgtatataaatgggaatggaggtttacttgagcaaatgaaggatacgggagttgatgtcattgggcttgactggacagtggacatggctgatggaaggagacgccttggtaatggaattggtgtacaagggaatgtggatccagcatttctattttcaccgttaccagtattgactgatgaaattcatagggttgtgaaatcagctggtccaaaaggtcatattcttaatttgggccacggtgtgctacaaaaaacacctgaagaagccgtagcacatttctttgatgtcactaggagcttgagatatgacacccttttccaaggttcagttgctggagaattgcaggctgttgcatgaccacagcaaatggcattctcattttcatcaaatgtctatttgatatatggtgtattatcctagattcctagtgttgactagttcagtaccttctgccttgtaattgtaagagccatgcgtttcgggatattgtcatttgacagcaaatcgacgcaatttattcaaaaaaaaaaaaaaaaaaaa

SEQ ID NO: 5686 - protein, 401 aa, Panicum virgatum
  misc_feature: Ceres CLONE 1824512
  misc_feature (1)..(342): Pfam Name: URO-D Pfam Description: Uroporphyrinogen decarboxylase (URO-D)
  misc_feature (40)..(385): SWISSPROT Homolog: EC 4.1.1.37 Uroporphyrinogen decarboxylase, chloroplast precursor
MMSPTAPATAVFLSAAAPSPTTRRRRSRLAAISASLSPSSSSEEPLLVRAARGEDGLPRPPAWMMRQAGRYMAEYQALAKRHPSFRERSEKTDLIVEITLQPWRAFAPDGVILFSDILTPLPAIGVPFDISDSKGPLIQSPVRSEEQVRQLVPIDLDKLNFVGESLRILRNEIDGKAALLGFVGAPWTIATYVVEGGMTNTYTNIKSMCHTAPNVLRGLLSHLAQAISDYIIYQVNSGAQCIQIFDSWGGQLPPHVWEQWSKPYIKQIVSRIKNECPHVPLVLYINGNGGLLEQMKDTGVDVIGLDWTVDMADGRRRLGNGIGVQGNVDPAFLFSPLPVLTDEIHRVVKSAGPKGHILNLGHGVLQKTPEEAVAHFFDVTRSLRYDTLFQGSVAGELQAVA

SEQ ID NO: 5687 - DNA, 1364 bp, Panicum virgatum
  misc_feature: Ceres CLONE 1824518
  misc_feature: Encodes the peptide sequence at SEQ ID NO. 5688
aaaaaagctcccccttctctcctctcctctcctccacacttcgaggaaacgtccaagcagttcctcattaggaggctaaacgcgattaggaggtagcgaatcgtttactgatagcctagttagagtcggatctgagcaatgggggaggagcaggtggcgacgaggccggaggccgcggcggcgccggagctgacggggttcgtcatgagcgccgaggaggccgagcgcgccgcggcggcggccggcgtggccaccgtgcaggacctgctgccgctgctggtgccgtccgcgatgaagcgggcggtcgtcccgatctcgcggttccccgtcggcgccgtggggctgggcgccagcggccgcgtctacgtcggggtcaacctcgagttccgcggcctcccgctgtgccactccgtccacgcggagcagttcctcgtcgccaacgcggccgccgcgggggagtccgcgctgcgcgccgtcgccgtctcccacatgccctgcggccactgccgccagttcctgcaggagatccgcggcgcctccggcatccagatcctcgtgaccaccgacgccgaggaaggctgcgcgcccgagtggcgcacggtggcgtccctcctcctccgccccttcgggccccacgacctcctccccgaggacgtgcccctcgtcctcgagccgcacgacaaccccctgggcgaccccgtccccgcggtcgccaatggcttcgccgccggcgacctggaggcgcgcctgagggaggccgcggaggcggccgcgcgggcgtcgcacgcgccgtacagcgagtgcccgtcggggttcgcggtggcggacggcgacggcaggatctacgccggcggctgcctggagtccgcggcctacaacccgacgctgggccccatccaggcggccatcattgcgatggtggcagccggaggaggccccgccggggacgtggtggtggcggccctcgtggagaaggagcgggccgcggtggcgcaggagacgacggccaggatcttcctgggctccgtggccccacatgctagcctccacgtgtacaactacaggccgtccgatgcgtgaggagccccgtcgggaccttgtggcggtagatgggatcgagataatgttcataaaaaaatgatttaagaataaactgagaaaacaaatcctgtgcagttgggtgagctgttacttccacatggcgctgggctattgactagcagtagcaagccagcctgggagctggggcctacttgctcagagtgattagttttcttctgttgtcatgtgtgttattgaaaaaaaataaacaatgaaatggaagatgaaatagttgtattaaacaaaaaaaaaaaaaaaaaaaa

SEQ ID NO: 5688 - protein, 313 aa, Panicum virgatum
  misc_feature: Ceres CLONE 1824518
  misc_feature (1)..(138): Pfam Name: dCMP_cyt_deam_2 Pfam Description: Cytidine and deoxycytidylate deaminase zinc- binding region
  misc_feature (2)..(103): Pfam Name: dCMP_cyt_deam_1 Pfam Description: Cytidine and deoxycytidylate deaminase zinc- binding region
MGEEQVATRPEAAAAPELTGFVMSAEEAERAAAAAGVATVQDLLPLLVPSAMKRAVVPISRFPVGAVGLGASGRVYVGVNLEFRGLPLCHSVHAEQFLVANAAAAGESALRAVAVSHMPCGHCRQFLQEIRGASGIQILVTTDAEEGCAPEWRTVASLLLRPFGPHDLLPEDVPLVLEPHDNPLGDPVPAVANGFAAGDLEARLREAAEAAARASHAPYSECPSGFAVADGDGRIYAGGCLESAAYNPTLGPIQAAIIAMVAAGGGPAGDVVVAALVEKERAAVAQETTARIFLGSVAPHASLHVYNYRPSDA

SEQ ID NO: 5689 - DNA, 1260 bp, Panicum virgatum
  misc_feature: Ceres CLONE 1824524
  misc_feature: Encodes the peptide sequence at SEQ ID NO. 5690
ctccgaggaaggggcgcacgcacaggcatcgcatctccagctttggggccagacaaatggcggcttcctgcgcctccaccctcccttcactctccttcgtctcctcctcctcttccaattcacctcggcggttcaggcgctctagggtggtggccatggccagcgtggggcagaaggtctacgcgcccggcgtggcggtgtcggagggcaatggcggactgccgaaaatcgacctcaaatccccgcatggaagcgaggctgagatctatctgtttggagcatgcgttacatctttcaaagtcgctaatggcaaggacttgctctttgttcgaccagatgcagtgttcaatgggcagaaacccataagtggcggaattccacattgtttcccccagtttggcccaggtcccatgcagcagcatgggtttgcacggaatgtgaattggtccatcgcagattcagaagtcaccgaaggagatccggctgtaactttggaacttaaagatgactcttatagccgttctatgtgggattttagcttccaagcattgtacaaggtttccctgcactctacaagcttgtcaacaactctaaaaataacaaatatggatgacaagcctttctcattcaactcagcactccacacttacttccgtgcttccatagctggcgtttctgtgaaaggtctgaaaggttgtaagactctcaataaagatcttgacccgaaaaatcctttggagggcaaagaagagagggaggaggtgacttttccaggatttgttgactgcatctaccttggtgcaccgagtcagctcatcctggacaatggattgggtgacaaaattgccatatcaaattcaagttggtcagatgcagtgttgtggaatcctcaccagcagatggaggcctgttacaaagattttgtctgtgtggaaaacgcaaagattgaaacagtacaactggagccgaaacaatcttgggtggcagagcagaaaattgaactagtctgaagataatgccttgctgcaactgcatcaagcagtgagataattcttcatggcacatgtcatcacaatagctgtgcacccaaattatccaatgtttcatgtaaaagggaataagtgatgctgatcaggatgttttttttttggcagtatgatgtttactgcgttgcaaatgtacaattcaaactacacggactctgttgaaatggaagcgagtgcccatattaatctttgataaaaaaaaaaaaaaaaaaaa

SEQ ID NO: 5690 - protein, 317 aa, Panicum virgatum
  misc_feature: Ceres CLONE 1824524
  misc_feature (1)..(260): Pfam Name: Aldose_epim Pfam Description: Aldose 1-epimerase
MAASCASTLPSLSFVSSSSSNSPRRFRRSRVVAMASVGQKVYAPGVAVSEGNGGLPKIDLKSPHGSEAEIYLFGACVTSFKVANGKDLLFVRPDAVFNGQKPISGGIPHCFPQFGPGPMQQHGFARNVNWSIADSEVTEGDPAVTLELKDDSYSRSMWDFSFQALYKVSLHSTSLSTTLKITNMDDKPFSFNSALHTYFRASIAGVSVKGLKGCKTLNKDLDPKNPLEGKEEREEVTFPGFVDCIYLGAPSQLILDNGLGDKIAISNSSWSDAVLWNPHQQMEACYKDFVCVENAKIETVQLEPKQSWVAEQKIELV

SEQ ID NO: 5691 - DNA, 1611 bp, Panicum virgatum
  misc_feature: Ceres CLONE 1824525
  misc_feature: Encodes the peptide sequence at SEQ ID NO. 5692
gctgctcccttctctcaaactctaatgatagcatagagagaagacatacctccaggctccaggcatcctcctttccctctcctcctccaagccccaaacccttttcctctttcccctgccccaagaacttcatctcatctccaggccattccccttttgcgcaggagctcgcggagacagtgggcggagagcttcatcgctgcaccactacttcactggagatccgcccactcccatggaggagatcacccaccagtacttcggagttggcgcaagcggccacggccagcaccaccacctgtggggatcctccctcagcgccgtcgtcgcgccgccgccgccgcagccgccgagcgcggggctgccgctcaccctgaacacggctgccaccgtgaacagcggcgccaacggcggcaacccggtgctgcagcttgccaacggcggcagcctcctcgacgcgtgcatcaaggcgaaggagccctcgtcgtcgtcgccctacgccggcgacgtcgaggccatcaaggccaagatcatgtcccacccgcactactactcgctcctcgccgcctacctcgagtgccagaaggtgggggcgccgccggaggtgtcggcgaggctggcggcgatgacgcaggagctggaagcccggcagcgcacggcgctcggcgggctcggcgccgcgacggagccggagctggatcagttcatggaggcataccatgagatgctggtgaagttcagggaggagctgacgaggccgctgcaggaggcgatggagttcatgcggagggtggagtcgcagctcagctcgctctccatctccggcggatcgttgcgcaatatcctttcctctggctcttccgaggaggatcaagaaggtagtggaggagagacagagctccctgaaattgatgcacatggtgttgaccaagagctcaagcaccacctcctgaagaagtacagtggctatctgagttctctcaagcaagaactgtcaaagaagaagaagaaagggaagctccctaaggaggctcgccagcagctccttagctggtgggatctgcactacaaatggccttacccctcagagactcagaaggtggcgctggcagagtcgactggacttgacctgaagcagatcaacaattggttcatcaaccagcggaagcggcactggaagccatctgaggaaatgcaccacctgatgatggatgggtaccacacaactggggccttctacatggacggacacttcatcaatgatggcgggctgtaccggctcggctagcgccactatcgcttccatttcacaccactacctagctaaacactaatggttccaagtgtcagaagtactgaagacttggctagctatctaatgttgtgtgccgcatgcatgggctgtaagtaggccatgcttaactattttgttgcaagtgctactatatctgtgccctatgcttacatgcatgaacattgctttaggtcctactccacattgtggtggtgtgcttttgattttgtgtggttgtatgcgtgacctgacagatggatcactgattcctacatgtttgaataatttgcacgatctaaaaaaaaaaaaaaaaaaaa

SEQ ID NO: 5692 - protein, 350 aa, Panicum virgatum
  misc_feature: Ceres CLONE 1824525
  misc_feature: Great-hit functional homolog of the protein sequence given in SEQ ID NO 9329
  misc_feature: Great-hit functional homolog of the protein sequence given in SEQ ID NO 9639
  misc_feature (1)..(60): Pfam Name: Homeobox Pfam Description: Homeobox domain
  misc_feature: Useful for biocontainment applications
  misc_feature: Useful for making plants with altered Lignin content
  misc_feature: Useful for making plants with modulated biomass
  misc_feature: The plant is abnormally small.
  misc_feature: The plant produces a reduced number of seeds.
MEEITHQYFGVGASGHGQHHHLWGSSLSAVVAPPPPQPPSAGLPLTLNTAATVNSGANGGNPVLQLANGGSLLDACIKAKEPSSSSPYAGDVEAIKAKIMSHPHYYSLLAAYLECQKVGAPPEVSARLAAMTQELEARQRTALGGLGAATEPELDQFMEAYHEMLVKFREELTRPLQEAMEFMRRVESQLSSLSISGGSLRNILSSGSSEEDQEGSGGETELPEIDAHGVDQELKHHLLKKYSGYLSSLKQELSKKKKKGKLPKEARQQLLSWWDLHYKWPYPSETQKVALAESTGLDLKQINNWFINQRKRHWKPSEEMHHLMMDGYHTTGAFYMDGHFINDGGLYRLG

SEQ ID NO: 5693 - DNA, 1434 bp, Panicum virgatum
  misc_feature: Ceres CLONE 1824711
  misc_feature: Encodes the peptide sequence at SEQ ID NO. 5694
attttttttttcaagactcatgcttgccttctatctaagcactactcctcctagttaattagctagtagcatctctcatctcctcctcccttcttgaggctccgatctatacagtagctagtagtcaacagtagtataaactgtgtgtagtagtagactgttgtgtagaggttgctacagagcaatccaacagctagcacatcagagctgagcagtcaccattgtttatcagtcgccatgacgagctcgactagactgcctaatcttccagctgggttccgcttccaccccacagatgaggagctcatcgtccactacctcatgaaccaagcttcctccatcccatgccctgtccccatcatcgccgaggtcaacatctaccagtgcaacccatgggatcttcctgccaaagctttgtttggagagaacgagtggtacttcttcagcccgagggatcgcaagtaccccaacggcgcccgccccaaccgcgccgccggatccggctactggaaggccaccggcaccgacaaggccatcctgttgactccgacgagcgagaacatcggagtcaagaaggcccttgtgttctacggcggtaagcctcccaagggtgtcaagacagactggatcatgcacgagtaccgcctcacaggagctaacaagaacaccaagcgtagaggatcctccatgaggctggacgactgggtcctctgcaggatccacaagaagagcaacaattttcagttgtctgatcaggaccaggaaggctccactgtggaggaagaatccctcaacaacaagatgaatggcacaattacagcctcgcccaagtctgaagccaataatgatggtcatgatcatcagttccatccgacgacgatggccatgaacaaatcatactcaatcaccgatctcctcaacaccatcgactactcggcgctctcgcagctcctcgatgccccagctgaacctgaaccaccgctaatctacccaacaacaacacaaacacatcacgaagcactacttaactataacaacaacgtgaacaatagccacttcaatatgccacaagtagacgcatattcagatcatgttgcgactaattgcaacggtctgaagaggaagcgagtgatgactatggatggtgctgaatcctccttcgacgatgatggcagcagtaacttcagtagaaaactactgaagctgccaagtgattcacggagcagcagccacagccattttggcagcacgacgagcagctactgcaaccagcagcttgtggacacgagtggttttcagcacagcagcctgctgagctatccattcctcgagatgcagtagtatctatgtagtattacaccgagagcttggtgtgaatgaattcatacagctgaaacttcgactgggtcaaattaaaaaaaaaaaaaaaaaaaa

SEQ ID NO: 5694 - protein, 367 aa, Panicum virgatum
  misc_feature: Ceres CLONE 1824711
  misc_feature: The sequence is a functional homolog of  SEQ ID NO 2110 in the  10/374,780 US patent application
  misc_feature: The sequence is a functional homolog of  SEQ ID NO 304 in the  10/225,066 US patent application
  misc_feature: The sequence is a functional homolog of  SEQ ID NO 954 in the  11/435,388 US patent application
  misc_feature: Useful for making plants with modulated growth and phenotype characteristics
MTSSTRLPNLPAGFRFHPTDEELIVHYLMNQASSIPCPVPIIAEVNIYQCNPWDLPAKALFGENEWYFFSPRDRKYPNGARPNRAAGSGYWKATGTDKAILLTPTSENIGVKKALVFYGGKPPKGVKTDWIMHEYRLTGANKNTKRRGSSMRLDDWVLCRIHKKSNNFQLSDQDQEGSTVEEESLNNKMNGTITASPKSEANNDGHDHQFHPTTMAMNKSYSITDLLNTIDYSALSQLLDAPAEPEPPLIYPTTTQTHHEALLNYNNNVNNSHFNMPQVDAYSDHVATNCNGLKRKRVMTMDGAESSFDDDGSSNFSRKLLKLPSDSRSSSHSHFGSTTSSYCNQQLVDTSGFQHSSLLSYPFLEMQ

SEQ ID NO: 5695 - DNA, 1718 bp, Panicum virgatum
  misc_feature: Ceres CLONE 1824749
  misc_feature: Encodes the peptide sequence at SEQ ID NO. 5696
tcgcagatagccatacccattctgttcccctcccaaacaaaacttgctttgaaatctcgcttcactgcgaacgctgcagcggaggaagaaaaagaaagaagaagaaaaaaaaaacaattcgtggcggaaatcagcaagcaaaagaagaaaataatttccataagaaatcgcccaatcccccttcctccttttctcttgaggcttcgtaacgtgcggggaacttagccaggatggtggcgatcgagaaccagagccaggtcgcgcgggcggcggcggcggaggcggtgccggcagcggggccgcggatccccaaggaggcgcggcagctgctgcacgacctggcggcggcgtgggcggacgtggcggactgccgcgcgctccaggtcgtgccgctcaagggcgccatgaccaacgaggtgtaccaggtgcgctggctcaccggcgtcccctccgcggtcggcgaggcggaggagccccggggggagagggaggtgaggaaggtgctcgtgcggatatacggcgacggcgtcgacctcttcttcgaccgcgaggacgaggtgcgcaccttcgagtgcatgtcccgccacggccagggtccccgcctcctcggccgcttccccaacggccgcgtcgaggagttcatccacgcaaggacactgtcagctgccgaccttcgcgatcctgagatttcagccctcgttgcttccaaactgagggaattccacaaccttgacatgcctggtcccaaatctgtgctcatttgggacagactaaggaactggctcaaaactgctaagaacttatgctcgtctgatgaagccaaagaatctcggctggacagcctggagaatgagattactgcattgcagaatgatgtttcaggtgattaccactggattggtttttgtcacaacgatcttcagtacggcaacatcatgattgatgaagagaccaacatgctgaccatcattgattatgagtatgcaagctttaacccagttgcatacgacattgctaaccatttctgtgagatggcggctgactatcattcagcaaatcctcatatcctggactacagcaaatatccagatactgatgagcagaaacgtttcgtcaagacatacctgagcatttctggtgaggaacctgatgcggaagaggtggagaacctgctccaaagcattgagaagtacacgctcgccagtcatctagtatggggcctctggggaataatctcggatcatgtcaacgatattgacttcgactacaaggagtatgcaaggcagagattcgagcagtactggcagaagaagactgcaaatctgcaatcttgacttcttgaacatgtgaataaaacacccatggcctcaagggctccttgaggacctgtgttgcgaacacgaggtcgctgacaaagcgagaagatgttgaaaatgatactgacaacaatgatgacgaagaaccccttcttgggatcagggagctcatgttccggaacttgattggcttcggcttcatgaaggaagaagctatggggcttcggttgctcgtttgtacagtacgaaggcaaggcaacgatgataaaagccccggggttgcttgctgtatgcttagtttggctagcattgccgtgggctgttttgctgttgtgtttccagtttctgtatgcttgatgctaatatagtggagattttggccaaaaaaaaaaaaaaaaaaaa

SEQ ID NO: 5696 - protein, 367 aa, Panicum virgatum
  misc_feature: Ceres CLONE 1824749
  misc_feature (1)..(204): Pfam Name: Choline_kinase Pfam Description: Choline/ethanolamine kinase
  misc_feature (1)..(232): Pfam Name: APH Pfam Description: Phosphotransferase enzyme family
MVAIENQSQVARAAAAEAVPAAGPRIPKEARQLLHDLAAAWADVADCRALQVVPLKGAMTNEVYQVRWLTGVPSAVGEAEEPRGEREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLKTAKNLCSSDEAKESRLDSLENEITALQNDVSGDYHWIGFCHNDLQYGNIMIDEETNMLTIIDYEYASFNPVAYDIANHFCEMAADYHSANPHILDYSKYPDTDEQKRFVKTYLSISGEEPDAEEVENLLQSIEKYTLASHLVWGLWGIISDHVNDIDFDYKEYARQRFEQYWQKKTANLQS

SEQ ID NO: 5697 - DNA, 1259 bp, Panicum virgatum
  misc_feature: Ceres CLONE 1824766
  misc_feature: Encodes the peptide sequence at SEQ ID NO. 5698
agccgcctcgcgtccttcgtccccgtcctcccggcacaaccaggccagcacgccagcgtcacgggaaggctagggttccggcgagcgcgacggcgagggcgagcgccatggcggggattcgatggccgccggaggacccggagatcttcccgtcccggatggtcggcagcggcgtttgggtgcccgtcgggcccccgggcgagatggcgtcggacgacgaccggtcggtggccgcggactcgtggtcgatcaagagcgactacggcagcaccctcgacgatgagcagcgctacgccgacgccgccgaagtcctcctcgcctcgtcctccgcctccgccgcggccgcgccgtccgcgtcggtcgccgccaacccctcctccgacttcagcttcgacaaggatgtccctgactccagcgacgtggagcctccgttgctggttatgcagaatttccaggatggtgcttatgctgaggatcttgctaatttccatgagcgcagccatgctgatgactggtttggtactgaggtcatggatatccgtgtaggctggaccaaaaatttgtgctcaagcaaggatttgcccagctgcagcgtacttgacattgggaccggaagtggtaggctcttgcagcagcttgcaaagcaagggttttctgatctgactgggattgactatagtgaaggcgcgattgagcttgcacgaaatcttgcaattcgtgacgggtttgagcacattaatttcttggttgatgatgtattagagtcaaagttggagagaagatttgaacttgtcatggatgaagggactcttgatgcaatagggctccatcctgatggacctgtgaagagaatgatgtattggcaatcagttgctagcttggtttcccctggtggtatattggtcatcacatcgtgcagcagaaccaaggatgagttggcgcaggaggtggagaacttcaaccaaagaaagcttggtgctatgggctcaggagtgctagccattgatgctgcggtgttcagctaccttgaccacgttcagagttaccctagcgtggatagttcttccatcacgaccgttgccttcctgcataagtgaaacatacatgtacgcctgattgcctgggttattgcccccagaaagatatcgtacctgttactatattaactatgtacccaaatcactgatgtatctggatggcattttagtattttactgttggattggttctttggggttcaaaaaaaaaaaaaaaaaaaa

SEQ ID NO: 5698 - protein, 329 aa, Panicum virgatum
  misc_feature: Ceres CLONE 1824766
  misc_feature (1)..(102): Pfam Name: Methyltransf_12 Pfam Description: Methyltransferase domain
MAGIRWPPEDPEIFPSRMVGSGVWVPVGPPGEMASDDDRSVAADSWSIKSDYGSTLDDEQRYADAAEVLLASSSASAAAAPSASVAANPSSDFSFDKDVPDSSDVEPPLLVMQNFQDGAYAEDLANFHERSHADDWFGTEVMDIRVGWTKNLCSSKDLPSCSVLDIGTGSGRLLQQLAKQGFSDLTGIDYSEGAIELARNLAIRDGFEHINFLVDDVLESKLERRFELVMDEGTLDAIGLHPDGPVKRMMYWQSVASLVSPGGILVITSCSRTKDELAQEVENFNQRKLGAMGSGVLAIDAAVFSYLDHVQSYPSVDSSSITTVAFLHK

SEQ ID NO: 5699 - DNA, 1775 bp, Panicum virgatum
  misc_feature: Ceres CLONE 1824859
  misc_feature: Encodes the peptide sequence at SEQ ID NO. 5700
ttccgtcactcgcgtacggcggcgagggttccccagtaagcctctcctggttcccggcggtttccctcgatccaaccccatcgaaacaaatcgtcttcagaaatttctccttttatttaaccgcaatccgcagccactgagcaacagcagtgtttactgaatttcagcaatagattccagtctccgtctctcttaattctgccaacttatccgatagcgtttatttttcacctgtaattttaccttttggtacctcgaacgcaaatttgaaatttctttcaccaaatcatgattctgatttgatcggagaacagaaaaggggaaaaaaaaaccatagattgttgcatgttcagatggacaactttaaccaatgcaatcatcttggcttttccattcattacagattgactcaagagacatgaatggaggcgtggcgccgcagaccccgccggacagcccctccatggatgccggtgtcgccaagccgccgcgccaccacctcacctcgattcgccactgcgccagcagcgcgcgcatcgccgccgccgccgccgcgtcgtcccccgactacggcctggatttggggacgctgagcttgatctcgcccaccgacgtccggactgggttcctgcccgtcttccgatcggggagctgcgctgagattgggcccaaatcgtatatggaggacgagcacgtctgtgtggacaacctcatcgagcacctcggggggcgcgccgccggcatccctgccccgggcgccttctacggggtgtttgatggtcatggcggtacagatgcagcatgttttgttcgcaagaacttactcaaattcattgttgaagatatgaatttccccacgaacgttggaaaggcaataagaggtgcatttctgaaggctgatcatgcactagcagattcccattcccttgataacaattccggaaccactgcattgacggctcttatatttggcaggacactgttcgttgcaaatgcaggtgattgccgagctgtcctaggaaaaagaggtagagcagtggaactatcaagagaccataaacccacctgcaagagtgagaagattagaattgaaaaactaggtggtactgtttttgatggctatctcaatggtcagctagcagtagcaagggcacttggagactggcacatgaaaggcccaaaaggctcaattagccctctgagtgcagaacctgagttgcaggagattgtgctttctgaagaagatgagttcttaataataggctgtgatgggctttgggatgtgatgaccagtcaatgcgctgtgtcgatcgtaaggaaagaactgatgcaacacaataacccagagaagtgctctggcgagctagtccaggaagcgctgaaacgggatagttgtgataacttgaccgttgtggttatatgtttctcatccaatccaccccctcaaattgagatcccaaggccccgtgtacgaagaagcatttccttggaagggttgcatttactcaggggagctctggacagtaatgcctgatctcagtccattctttcactagccatttcatgttttatcatacaattttgcacgaataaatcccgtagaattacgagaaattttgtcgagaggatttaggctaattatttgcagagttgaggtataacttaattgtattggtaagcaaggtttttaatgtcaacagtgtaattatcagtaatctcttttcttttggtgcacacaagagttgcattttctgcaaaaaaaaaaaaaaaaaaaa

SEQ ID NO: 5700 - protein, 387 aa, Panicum virgatum
  misc_feature: Ceres CLONE 1824859
  misc_feature (1)..(256): Pfam Name: PP2C Pfam Description: Protein phosphatase 2C
MQSSWLFHSLQIDSRDMNGGVAPQTPPDSPSMDAGVAKPPRHHLTSIRHCASSARIAAAAAASSPDYGLDLGTLSLISPTDVRTGFLPVFRSGSCAEIGPKSYMEDEHVCVDNLIEHLGGRAAGIPAPGAFYGVFDGHGGTDAACFVRKNLLKFIVEDMNFPTNVGKAIRGAFLKADHALADSHSLDNNSGTTALTALIFGRTLFVANAGDCRAVLGKRGRAVELSRDHKPTCKSEKIRIEKLGGTVFDGYLNGQLAVARALGDWHMKGPKGSISPLSAEPELQEIVLSEEDEFLIIGCDGLWDVMTSQCAVSIVRKELMQHNNPEKCSGELVQEALKRDSCDNLTVVVICFSSNPPPQIEIPRPRVRRSISLEGLHLLRGALDSNA

SEQ ID NO: 5701 - DNA, 1495 bp, Panicum virgatum
  misc_feature: Ceres CLONE 1824900
  misc_feature: Encodes the peptide sequence at SEQ ID NO. 5702
aaagggaagcgcaggggatgagcccggttgtagtggtagtggcgccccctcctctcccagctcctgccaatgctccattcagctgctcctcttcttcgccttcttcagtttatgtcatttgctggttgtcgttgattgactcgtgagctgactagtttgtctgtggagagcttgaaatttcagtacaagtttcagatagggtttggggagagatgttctcatctatcagcttatttggaagctctcagcagcctgctctcaagttttacagaaaatgcttgccaaataacccacattttgcactgaccatgcattcagttgcgatgtccatgggtaaatctatgattatgaagagggcacgtatgaagccacatgccacagacatcaagaggaacccccaggcccgtgacctttacaaattggtttatagactccctgaaaaccttagctggcttttggcgccaccagaaatccctaaaagaccagcctcaaagaagataaaacagaagggtgaaatggtgactggtaagtttggtgtgatcttggagtgggagggagttgtcgtggaagatgacgatccagacttggagccccgggtttggtatgttctatcacttgaagaggcaaagtctttccctccagatgcaatgctgaaagaaattgagggaatgagaactgagcaggctatctcagaagtcttatgttggtcagaagatccagaagaaattaaaaggttggcagcacgcaaagaggtaatatatcaaatgctccgaggaggatactaccaactgcgaccaggtgtccttgatttcttgaacacccttgtggattttgaaattccaatagcaattgcaagtcttcgctcaaggaagagccttgaagaaggtattaaaactgttggtctgcaaggctacttcgatgctctaattgcattagaggatttctgcctggggaaacctgatggtgagatgtttgaggtcgcagcagagcaacttggtcttgacccagatgtttgtgttgtgtttggtaattcaaacttaacgacagaatctgcatatactgctgggatgaagtgtgtggcagttgcaggccgacaccctgcctatgagctccaaggagcaaaccatgttgtgagatggcttgatcaactctctattgtttatttgcataggcttgtcaatggtgaggttattggtcgcaggggcagagaatccgacatggatatggagattgtgtttgaggaatgatgcttctgcaaacatgacgtaccaatatattgttgtacttataatctggtgtagcctaagtaatgcattacattttgtaaacgaaccaagcagtgcgagatcaggactaaggatagtcctgggcttgcattacgtgcttggttttactgtgatgcatcactgtaattcctttagcttaactactactcttagtcattagagatttcaagtgaagaaacacctgccagtaaaaaaaaaaaaaaaaaaaa

SEQ ID NO: 5702 - protein, 344 aa, Panicum virgatum
  misc_feature: Ceres CLONE 1824900
  misc_feature (3)..(189): Pfam Name: Hydrolase Pfam Description: haloacid dehalogenase-like hydrolase
MFSSISLFGSSQQPALKFYRKCLPNNPHFALTMHSVAMSMGKSMIMKRARMKPHATDIKRNPQARDLYKLVYRLPENLSWLLAPPEIPKRPASKKIKQKGEMVTGKFGVILEWEGVVVEDDDPDLEPRVWYVLSLEEAKSFPPDAMLKEIEGMRTEQAISEVLCWSEDPEEIKRLAARKEVIYQMLRGGYYQLRPGVLDFLNTLVDFEIPIAIASLRSRKSLEEGIKTVGLQGYFDALIALEDFCLGKPDGEMFEVAAEQLGLDPDVCVVFGNSNLTTESAYTAGMKCVAVAGRHPAYELQGANHVVRWLDQLSIVYLHRLVNGEVIGRRGRESDMDMEIVFEE

SEQ ID NO: 5703 - DNA, 1646 bp, Panicum virgatum
  misc_feature: Ceres CLONE 1824910
  misc_feature: Encodes the peptide sequence at SEQ ID NO. 5704
aagctaagccctcctctctttctcctcggcgtcttcccttcttctccatctgcttccactccccatcgtctagggttttgctccaaaccctagctgccgccgatcccctcccgcttcatggaagtcgagggcgaggtccccgccacggcggcggcggcgatcgcaaacggcctgtggggcggggaggaggcctccccggcgcccttctccgcggagcaactggacgtggaggcctacgccgcgcagtactcggggcggacccgcctcgcgcgcctcatcttcgtcgcggaccggtgcggggtggagacgatgaagcttgaggcgctgcggatggcgtacgacgagatcaagaggggagaagacgtgcagctccaccgcgacgtcgccctcaaaatcaacgtccgcctcggcccccggtacgggctcgaccaggcctgggtggataccgtcagccgccgtgccgagcagcgcaaggagaagctcgagaacgagctcaacggctacagaactaacctgatcaaagagagcatcagaatgggttataatgacattggtgatttcttctatgctcatggccaactttcagatgccttcaaaagctacatcaggacacgagactactgtaccacttccaagcatatagttcagatgtgcatgaatgtgattctggttagcattgagctggggcagtttgcacatgtttcaaactatgtcagtaaagcagagcaaaccccagactctttggatcctatcattgttgcaaagttgcgtgcagctgcaggattagccaatttggaaacaaagaaatacaagcttgctgctcgtaagtttgttgagacaggaattgaactaggaaacaactactctgaagtcattgctccgcaagatgtggctgtctatggtgccctttgtgcacttgcttcttttgatcgttctgacctgaagagcaaagtcattgacaatattaacttccgtaactttctggagctggtgcctgaagtaagggagctggttaatgatttttatgcaagtcgctatggatcatgcttggggcatcttgagaagcttaagccgaacctgctactggatattcatctgcatgggcatgtagagactctgtacacagatattcgccacaaagcaatcatacagtacacactcccatttatatctgttgatctcaacacaatggcaactgccttcaagacttctgtgtccatgttggagaaggagctggctgctctgatcaccgagaacaaaatacaggcccggatagactcccacaacaagattctttacgcaaggcatgctgaccagagaaacacaactttccaacgtgttctccagactggcaacgagttcgagagagatgtcaagtctatgcttctgcgagccaacctcctcaagcatgagtacaaccagaggaccggatcaaggaagatgtgaagttgtgagcatcgccgctagacattgctatctgcctctccttttggaaatatttgttttgctgaaatgtcttgttgaggttatggatggttgagcatcaggagatgtgatgatctgtcatgctcattttgtgggcaagaattacattgaactcttaatgctttggaggtggtacatatgaaaaaaaaaaaaaaaaaaaa

SEQ ID NO: 5704 - protein, 442 aa, Panicum virgatum
  misc_feature: Ceres CLONE 1824910
  misc_feature: Great-hit functional homolog of the protein sequence given in SEQ ID NO 9463
  misc_feature: Useful for making plants with modulated low light sensitivity
MEVEGEVPATAAAAIANGLWGGEEASPAPFSAEQLDVEAYAAQYSGRTRLARLIFVADRCGVETMKLEALRMAYDEIKRGEDVQLHRDVALKINVRLGPRYGLDQAWVDTVSRRAEQRKEKLENELNGYRTNLIKESIRMGYNDIGDFFYAHGQLSDAFKSYIRTRDYCTTSKHIVQMCMNVILVSIELGQFAHVSNYVSKAEQTPDSLDPIIVAKLRAAAGLANLETKKYKLAARKFVETGIELGNNYSEVIAPQDVAVYGALCALASFDRSDLKSKVIDNINFRNFLELVPEVRELVNDFYASRYGSCLGHLEKLKPNLLLDIHLHGHVETLYTDIRHKAIIQYTLPFISVDLNTMATAFKTSVSMLEKELAALITENKIQARIDSHNKILYARHADQRNTTFQRVLQTGNEFERDVKSMLLRANLLKHEYNQRTGSRKM

SEQ ID NO: 5705 - DNA, 1272 bp, Panicum virgatum
  misc_feature: Ceres CLONE 1824928
  misc_feature: Encodes the peptide sequence at SEQ ID NO. 5706
gacacacacagtcacacactgctgccatcgattcggatccgcaggtagctgtaggcctcccgggaggaatcctcttccactcaccagcccagagatctcttcacccctgcctctcctccgcttcgctgcggccggcgacggcgggaacaccggccgcctccgattcgatcccaaccgggggtctccccggcggctagccatggcggagccgctcagctcatcccaagatgcgcccaatccctctgctccggaacggagagtactggtgatgaacaagcacggggagaacctcgtggggctgctgcaccacgcggggtcgaacaaggttgtcgtgctctgccatggcttcacggcttccaaggatgatggaatcattgttgatcttgcggctgctataacaaatcgtgggattagtgtgttttgctttgatttcagtggaaacggagaaagcgaaggtgaattccagtacggtaactacaggaaggaggctgatgacctgcattctgttgtttcatatctttaccgggagaagtttgatgtagcagcagttgttggtcacagcaaaggtggagatgtggtggttctatatgcctctatctataatgatgtccccatggtggttaacctttctggtcgatttgatttgaagaaaggtgttgaagagcgcctaggcaaagaatttatggataggataaccaaagaaggctacattgatgttacaaacaagtcaggaaagtttttgtacagagtaaccaaagagagcttgatggaacgactgaacactgatatgcatgcagcaagcctttccatcagcaaagaatgcaggttctttacaattcatggttcagctgatgagatcataccagtggaagatgcatatgagtttgcaaagcttatacccaaccacaaactgcgtgtcattgagggagcaaatcactgctacaccgctcatcgtaaagagctttctgatgccgtcgtagaatccatcacatccagtgaggcaggggataccccaccctagagcagtgcgtccctcgccagcatcgatggcttcctctgacgccgtcgcctttccacgctttgtcacgcagctcctcagtcaccttgcttaaaggattacacagacagaacctggttttgctcttcatttttttttgttatcttgagttgtggcctgggtcctgcgacattgccacaatggtgtttggcggttgcttgccaaggtacaatcaatggattccgttggtacactaaaaaaaaaaaaaaaaaaaa

SEQ ID NO: 5706 - protein, 273 aa, Panicum virgatum
  misc_feature: Ceres CLONE 1824928
  misc_feature (1)..(75): Pfam Name: Abhydrolase_1 Pfam Description: alpha/beta hydrolase fold
MAEPLSSSQDAPNPSAPERRVLVMNKHGENLVGLLHHAGSNKVVVLCHGFTASKDDGIIVDLAAAITNRGISVFCFDFSGNGESEGEFQYGNYRKEADDLHSVVSYLYREKFDVAAVVGHSKGGDVVVLYASIYNDVPMVVNLSGRFDLKKGVEERLGKEFMDRITKEGYIDVTNKSGKFLYRVTKESLMERLNTDMHAASLSISKECRFFTIHGSADEIIPVEDAYEFAKLIPNHKLRVIEGANHCYTAHRKELSDAVVESITSSEAGDTPP

SEQ ID NO: 5707 - DNA, 1414 bp, Panicum virgatum
  misc_feature: Ceres CLONE 1824929
  misc_feature: Encodes the peptide sequence at SEQ ID NO. 5708
gtttccctcgagcgcaaaccgaaacgactcgtcctcacctctccgtcctccgcagatcgccgccgcctctccgtcctccgcagatcgccgccgcctcgtcgccctcctccgccccccgatggccgccgccgacccgccgccgcgcgggggtgccgcggcccccgcgcccgtgctgcggcggagccccagcatcgagcgcatcccggaggacgcgcgccgcatcctgctccgcctggccggcgagctctggggcggcgacgtggacccgggcgcgctcgccgtgtcccagctcaagggcgccatgaccaacgaggtcttccggatcacctggcccggcggcgagggcgacccgcggaaggtgctcgtgcgcatctacggccagggcgtcgaggtcttcttcgaccgcgccgacgaggtccgcaccttcgagtgcatgtcgcgccacggccaggggccccgcctcctcggccgattcgccaacggccgcgtggaggagttcatcaacgccaggacgctgtctgcggcggatctgcgcgacccggagatatcagcgctgatagccaagaagctgagggagtttcacgatctcgacatgcctggacccaatgatgtctcgttgtggcataggctcaggaggtggcttgagcaggctcgtgtcaggtgttccgaggaagagtccaaacaatttcagctgaataagcttggcgatgagattgcgttgctggagaaggtgctgtcagggttcaatcagtcagtaggattttgccataatgatctgcagtatgggaatattatgatatatgaagagaccagacaagtcaccctgattgactacgaatatgccagttttaaccctgttgcatttgacattgctaatcacttctgtgagatggctgctgattaccatacatcaacacctcatgtgctggactttgcaaaatatcctgacattgaggagcagcgaagatttgtttggacataccttagctcttcaggtgaaaatccattggatgaggaagttgaaaacttactaggcttgattgcaaagtatactcttgcaagccatctcttttggggcctttggggaataatctcggcgcacgtgaacaaaaacatcgacttcgagtacatggagtatgcaaggcaacgcttcgatcagtactggcagacaaagcctagaatacttggatccaactgatgattagccaattctttttcttgttttacgggctcttggctagctagtcgctagctagtcctgtgaattctattcttcagtagcgtctagttgctgcccgttctttgctgctgattattcagctcgttctgtaagtttttaattataatgtatttaaccgaaaatgcaagcaatgcgattgacatatagggagcagaaaaaaaaaaaaaaaaaaaa

SEQ ID NO: 5708 - protein, 359 aa, Panicum virgatum
  misc_feature: Ceres CLONE 1824929
  misc_feature (1)..(204): Pfam Name: Choline_kinase Pfam Description: Choline/ethanolamine kinase
  misc_feature (2)..(232): Pfam Name: APH Pfam Description: Phosphotransferase enzyme family
MAAADPPPRGGAAAPAPVLRRSPSIERIPEDARRILLRLAGELWGGDVDPGALAVSQLKGAMTNEVFRITWPGGEGDPRKVLVRIYGQGVEVFFDRADEVRTFECMSRHGQGPRLLGRFANGRVEEFINARTLSAADLRDPEISALIAKKLREFHDLDMPGPNDVSLWHRLRRWLEQARVRCSEEESKQFQLNKLGDEIALLEKVLSGFNQSVGFCHNDLQYGNIMIYEETRQVTLIDYEYASFNPVAFDIANHFCEMAADYHTSTPHVLDFAKYPDIEEQRRFVWTYLSSSGENPLDEEVENLLGLIAKYTLASHLFWGLWGIISAHVNKNIDFEYMEYARQRFDQYWQTKPRILGSN

SEQ ID NO: 5709 - DNA, 1295 bp, Panicum virgatum
  misc_feature: Ceres CLONE 1824941
  misc_feature: Encodes the peptide sequence at SEQ ID NO. 5710
acggcgagggcacgcaagatcgtcgcagcgcacgatggccgccggacgcgccgagggcgccgccgggagccgggagacggtctgcgtgacgggcgccggcgggttcatcgcctcgtggctcgtcaagctcctcctcgcccgcggctacgccgtccacggcaccgtccgcgacctggctgagaggaagaccgcccatttgaagcagcttgagaacgcatccgagaacctcaaacttttcaaggccgatatcctggactacgacgccatggcagctgcgatcgcggggtgccagggagttttccacgttgccaccccagttccttcggggaagataactgatccagagcgagaaatgctggggcctgctgttcatggcaccacaaatgtactcaaggccgcctcagctgcgggtgcgcggcgtgtggtcgtggtttcgtccatggtggctgttgagatcgacccgaaaggttggcccaaggacaagatcaaagatgaaggctgctggtcagacccagaagcctgcaggaacaaccaggattggtactctgttgccaagatcgcttcggaacagggtgcgcttgagtatgggaagcaaaccgggctggatgttgtaactgtcaaccccgccctggtcttcggcccccttctgcagccaactcttaacacgagctgccagttcctcgtctacttcctgaaaggaggtcctgatcgaatgaggaacaaactttggcacatcgttgacgtccgggacaccgcagatgctcttttgctggtgtatgagacacctgaagcctccggtaggcacatctgcgcacctcatttcatcagcgcccgtgaccttctggacttactgaagagcatgtacactgagtaccctttcatgagcaaggagagcatctgtgacatggatcacccagctccaatgacgtctgacaagctgaagaaactggggtggaaggtcaggccgttgaaggaaactatcgcggataccgttgaattctgccagaacgctgggtttcttgaggatgtggaggggagtccctgccgttttcctgatatttacaacaaaatctagcttaagaaagaatctagggccggaggaagcgcacgtgtggcaactgtttcgcttcagctgctgcttgatgcttactgtattgttgagcagcaggaatatattttttcccaataatatgttttcccgcactctgatttcaactatgagaaccacttcagtgctgatcgtttttaaagaaacaaacaataattagaacccttaaaaaaaaaaaaaaaaaaaa

SEQ ID NO: 5710 - protein, 346 aa, Panicum virgatum
  misc_feature: Ceres CLONE 1824941
  misc_feature (1)..(244): Pfam Name: Epimerase Pfam Description: NAD dependent epimerase/dehydratase family
MAAGRAEGAAGSRETVCVTGAGGFIASWLVKLLLARGYAVHGTVRDLAERKTAHLKQLENASENLKLFKADILDYDAMAAAIAGCQGVFHVATPVPSGKITDPEREMLGPAVHGTTNVLKAASAAGARRVVVVSSMVAVEIDPKGWPKDKIKDEGCWSDPEACRNNQDWYSVAKIASEQGALEYGKQTGLDVVTVNPALVFGPLLQPTLNTSCQFLVYFLKGGPDRMRNKLWHIVDVRDTADALLLVYETPEASGRHICAPHFISARDLLDLLKSMYTEYPFMSKESICDMDHPAPMTSDKLKKLGWKVRPLKETIADTVEFCQNAGFLEDVEGSPCRFPDIYNKI

SEQ ID NO: 5711 - DNA, 1388 bp, Panicum virgatum
  misc_feature: Ceres CLONE 1825014
  misc_feature: Encodes the peptide sequence at SEQ ID NO. 5712
agccgccgtaccgcagcactacaccgctccgcccctcaactgcggcaggtacccgccgccgggaagcgtcgagccatgacctccgccaccgccgcggcgaatgtcgccgtcatcggtgccggaatttcgggcgccgtgtgcgcgtcgctcctcgccgggcgaggcttggccgtgacgctcttcgactccggccgaggcgccggcgggcgcatggcgcagcggagggaggttatggaggatggcacggagcttcgcttcgaccacggtgcgccctacttcaccgtgaccaacgatgaggttgccagggtcgtaagtgggtgggaggcgcgagggatcgttgctgaatggaaggccatgttcgcatgctttgatcgggctaccggcaaattcactgacttcgaaaaggagggatcaactaagaagtatgtgggagtgccaggcatgaactcgatatgcaaatcactctgttcagaggatggtctggtggccaaatttggtgtcactgttggcaagatggactggcttcaagataggagttcatggtcactagctagcttggatggaaaagatcttggcaattttgattatgttgtagccacagataagaatgtggcatcaccaagattttcagggttgactggaaggccaccgcctcttgacttgtcgctgtttccacagttgtctgtaatggttcaagatatcccagttcgtccctgttttgctcttatggtagcattctcagagcctttggctatggtacccgttcatggtttctctttcaacaattctgattctctgagttgggccttttgtgatagtagtaagccagggcgtgcttgtgtacctcctaacagacaatcttgggtattgcactcgactgctaaatatgcttccaaggtaataaataatattggcccacggaaaccttcagcagatgcacttgctaaggtggcagaggaattgttcagggaattccaggctacaggattgagcattccacaaccaatattcatgaaagctcacagatggggtagtgctttcccagccatttctataggtggagatgataaatgtgtttgggacaaaagcacgaaattggcaatttgtggagatttctgtgcaagtccaaatattgaaggagcggtccttagtgccatgagaggaacttcaaaaatcatgggatgtttaaactgtccatcagggttgtgacttgtgagttgtatatttaatcaactacaaccccctgcccccttctccaactctctctatgtaattgttatacaaataaagaataaagctccacgatgagccctattgttttgttgaatgttttgttacaaaataagaaataaaggtacatgactttataaaaaaaaaaaaaaaaaaaa

SEQ ID NO: 5712 - protein, 377 aa, Panicum virgatum
  misc_feature: Ceres CLONE 1825014
  misc_feature (2)..(36): Pfam Name: Pyr_redox_2 Pfam Description: Pyridine nucleotide-disulphide oxidoreductase
  misc_feature (1)..(66): Pfam Name: Amino_oxidase Pfam Description: Flavin containing amine oxidoreductase
MTSATAAANVAVIGAGISGAVCASLLAGRGLAVTLFDSGRGAGGRMAQRREVMEDGTELRFDHGAPYFTVTNDEVARVVSGWEARGIVAEWKAMFACFDRATGKFTDFEKEGSTKKYVGVPGMNSICKSLCSEDGLVAKFGVTVGKMDWLQDRSSWSLASLDGKDLGNFDYVVATDKNVASPRFSGLTGRPPPLDLSLFPQLSVMVQDIPVRPCFALMVAFSEPLAMVPVHGFSFNNSDSLSWAFCDSSKPGRACVPPNRQSWVLHSTAKYASKVINNIGPRKPSADALAKVAEELFREFQATGLSIPQPIFMKAHRWGSAFPAISIGGDDKCVWDKSTKLAICGDFCASPNIEGAVLSAMRGTSKIMGCLNCPSGL

SEQ ID NO: 5713 - DNA, 1421 bp, Panicum virgatum
  misc_feature: Ceres CLONE 1825034
  misc_feature: Encodes the peptide sequence at SEQ ID NO. 5714
ggcaagaggcaggcagccaccagcccaccacttcgctccccgccacccgcgcccgccctccgttgcccgttcgaccgtcctccctctcgtgccccctcctccctgcctccctccagccggcgtcgcagggctatctgcacccgtgccgcaaaagcaatggaggtgggcgctagcatggcgatgcaggcacgcgcgcctggcgccggtgccggggccggcgggcgccgaggcgcgttcctcggctgggagaagcaggcccgggtggggagcctgcgggttggaggagctgccggagcggcagccgtggctgtgcgggctcccgggaccaagtccgtcgccccgctctgctgcgtcagggcatcgcgagggagctcccataactcagttgacgaggccctcttgttaaagaggaaatcagaagaagttctgttccacttgaatgggcggtgcatttacctagttggaatgatgggctctggaaagagcacggtgggaaagatattggctgaagttctggggtattcatgctttgacagcgataagttggtagaacaagcagttggcatgccttccgtagctcaaatatttaaggttcatagtgaagcatttttcagagagaatgagagtaatgtcttgagggatttgtcctcaatgcggagattagttgttgcaactggaggtggtgctgttattaggccaatcaactggaattacatgaagaaaggtctatctgtttggttggatgtgcctttggacgcacttgcaaaacgtattgctcaagtggggactgcttctcgtcctctcctagaccagccatctgacgatccatacacagtggctttcacgaaactgagcatgcttgcggagcaaagaggtgaggcttatgcgaacgccgatgcaagagtgtctcttgaagagattgcagctaagcagggccacagtgatgtttctaagctgacaccgactgatatcgccatcgaggcgctactccagattggaaacttcgtcactgaacatcccacaatccatggccaagttggcgacttgcaagtcgattctcagagccgcaggatccagaccttgtagaattttgaccccatgtgtaccagtagagtacagccgctctacaatatttgtttgttcttggttctgaaatctgaaaaggatgataggatgaaagataccctacctgcaaaagggtagactgtagagcaactgatgatgggtggagctaatgagagaagctccacggatgaaaaagggttttacagtttttttttaagagaaaaggtttttacagctaccatgttcaccccgttggttttcgacaagctttctttgctctgcagagtctgtttcagagacatgaattttgtacaaagttcgcatgaaattcatggcaaaaaaaaaaaaaaaaaaaa

SEQ ID NO: 5714 - protein, 309 aa, Panicum virgatum
  misc_feature: Ceres CLONE 1825034
  misc_feature (1)..(176): Pfam Name: SKI Pfam Description: Shikimate kinase
  misc_feature (76)..(290): SWISSPROT Homolog: EC 2.7.1.71 Shikimate kinase, chloroplast precursor
  misc_feature (94)..(253): SWISSPROT Homolog: EC 2.7.1.71 Shikimate kinase
MEVGASMAMQARAPGAGAGAGGRRGAFLGWEKQARVGSLRVGGAAGAAAVAVRAPGTKSVAPLCCVRASRGSSHNSVDEALLLKRKSEEVLFHLNGRCIYLVGMMGSGKSTVGKILAEVLGYSCFDSDKLVEQAVGMPSVAQIFKVHSEAFFRENESNVLRDLSSMRRLVVATGGGAVIRPINWNYMKKGLSVWLDVPLDALAKRIAQVGTASRPLLDQPSDDPYTVAFTKLSMLAEQRGEAYANADARVSLEEIAAKQGHSDVSKLTPTDIAIEALLQIGNFVTEHPTIHGQVGDLQVDSQSRRIQTL

SEQ ID NO: 5715 - DNA, 1548 bp, Panicum virgatum
  misc_feature: Ceres CLONE 1825081
  misc_feature: Encodes the peptide sequence at SEQ ID NO. 5716
aaaagatccttctctctctcgcatccgcccaaaacgcacgcgcccgctcggcctgcacctctgccgcgtagccatccaagacaagccaaatcgctgctccttcctcggctcctcctccgcccgcgcttaattaaacaaaacccacccaaatttaagcgatccgcaaacagccgaaagcgaggaaggcaggtggcgtctgcgccgtcgggaatttcgccccgcttcctcgtcgtcgtcgatccatccacccaccaacccatggccgcgccgagggagcgcgaggctccggcgacgagatgaggggaggcgcggcgggatgagcatgaggtgcaagaagcacccgttcccggccggcggcggcggcgtctgcgccacgtgcctccgcgaccgcctgctcgtgctcgcggccgagcggaacggcgcgtcctccccgcccgcgcgcgcgcaggcgcaggcccctccggcgcccgagcccgcggcgttcccgaggtcggtgtcgccgtacgtgtcccgcagcaagtcggacgccgcgggcgggggcggcgcgctcaggcaccacccgagcctgctcttcttccggacgccgcaggtggggccggcctacggcggcgcagcgctccaggagggcgacatcggctacgagtacgagaagcggcgcgcggggaagttctcggtcctcgccacgctcttcggccaccaccacagatcggcgcaggagggcaagcatcaggggggcgccagggagcgcaagaagcattcttggctcgtcggaatcataccgcgccgccgcaagaagcaggcgccggcggcggccgccgcctcctcgccgccgtcggccccgcccagtcgcttctgccgcgtgctcagcaaccggggcctctcgccggagcgggacagccatggaagcggcgaggagagcagctcgcccgccgcggacccgccgtggaggccgtccccttccccgatgcggaagaccccgtgccggcgccgccagaccaacagcatggcgtcgggcttcgccgtctgcctcagcccgctagtgcggcccagcccggggcgccgccaccgcccggtccagccgccagaccccggcgccttctccagcgagctccggtcatcgccgctccacaacctctcgtccgtcgcctccgtcacgcgctgccgctcccggaagctcgccgacggtggccggttccggtgatctttccatgtttacccttttcatcccctgattatcaccacttaatcaggattactagtccaatttcttagcttctcttccttttttggatttacattttgtccacctgtgaagagaagagtctgtctgtaagattggcacacccaaactccaaaccactccgttgacatgtacaaggttaggttactactgcttgtcggcccaacatgattatgtggcaatgtaacaagctgcttgtatcaagtatttgttcatgtttgtacagctagctatctaatcttgttgttttgcaaaattgaactctctttaatccaagctttttccggcaaaaaaaaaaaaaaaaaaaa

SEQ ID NO: 5716 - protein, 294 aa, Panicum virgatum
  misc_feature: Ceres CLONE 1825081
  misc_feature: Great-hit functional homolog of the protein sequence given in SEQ ID NO 9728
  misc_feature: Useful for making plants with modulated flowering time
  misc_feature: The plant flowers significantly late compared to wild-type.
MSMRCKKHPFPAGGGGVCATCLRDRLLVLAAERNGASSPPARAQAQAPPAPEPAAFPRSVSPYVSRSKSDAAGGGGALRHHPSLLFFRTPQVGPAYGGAALQEGDIGYEYEKRRAGKFSVLATLFGHHHRSAQEGKHQGGARERKKHSWLVGIIPRRRKKQAPAAAAASSPPSAPPSRFCRVLSNRGLSPERDSHGSGEESSSPAADPPWRPSPSPMRKTPCRRRQTNSMASGFAVCLSPLVRPSPGRRHRPVQPPDPGAFSSELRSSPLHNLSSVASVTRCRSRKLADGGRFR

SEQ ID NO: 5717 - DNA, 1003 bp, Panicum virgatum
  misc_feature: Ceres CLONE 1825089
  misc_feature: Encodes the peptide sequence at SEQ ID NO. 5718
acggcaccattcgccgccctccgccgcgggtactcctccctcgccaagatccgtcaagtgttcctccctccttgttgccgccgccgccgccgccgccgcctcatcctccggcgacccggaggcggggagggagagtgcgccggcgtcgtccggcgatcgagtgggcgggaggagatgttcctggtggactggttctacggggtgctggcgtcgctggggctgtggcagaaggaggccaagatcctcttcctcggcctcgacaacgccggcaagaccacgctcctgcacatgctcaaggacgagagattggttcagcatcagcctacgcaatatccaacttctgaagagctgagtatcggaaagatcaagtttaaggcatttgatttgggaggacatcagatcgctcgccgtgtgtggaaggattactatgccaaggtggatgcagtggtgtaccttgtggatgcctacgacaaggagcggtttgctgaatcaaagaaggagcttgacgccctcctctcggatgattctctggccaccgtacccttcctgatcctgggcaacaagatcgacatcccttatgctgcgtcggaggaggagctccgctaccacatggggctgagtaactttaccactggtaagggcaacgttaacttgggtgagtccaacgtccgccccctggaggtgttcatgtgcagcatcgtccgcaagatggggtatggcgaggggttcaagtgggtgtcacagtacatcaagtagagttagctagctacagtgatactcctgtttctaccttagcttaccacacaaaagagataggaagctagcttaccgtggtcatggacaagtggtagttcatggtggcagtacagatgtggtcatatggaagtagtgtaaagtctgggatcttgccagattttccttcaattacagtgtgatcttggaagaggagcttactttaaacttgaagaatggtggggctcttcaaaaaaaaaaaaaaaaaaaa

SEQ ID NO: 5718 - protein, 193 aa, Panicum virgatum
  misc_feature: Ceres CLONE 1825089
  misc_feature (1)..(188): Pfam Name: Arf Pfam Description: ADP-ribosylation factor family
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGNVNLGESNVRPLEVFMCSIVRKMGYGEGFKWVSQYIK

SEQ ID NO: 5719 - DNA, 1885 bp, Panicum virgatum
  misc_feature: Ceres CLONE 1825118
  misc_feature: Encodes the peptide sequence at SEQ ID NO. 5720
gaaagcgatcgacctcatcatgagttcagttgcgtgcgcgcgcctcggtcccaacctcacagcaaagcaagcaacggcgacgccttttcagttcggctccggagctgctgcgcgcctgctaatcttcacgactggagcggcacggcacccactgagccacccaccggcgtccgcgcgagcgtgaggggctgacctgagcggagcggagcaactgaggtcttgagcggggtcggtggtgcgagcaggcatggcggcggcgctggcgcggcgggtcgcggcggcggccctggcgcgggggcgcgggatgtgctcggcgcccgcggcggcggggcgcgccgccgcggcactgtcctccgaggagctcatgcggatggagcgggactgcagcgcccacaactaccatccgatccccatggtattctccaaaggagaaggttcacacatagtggaccctgaaggcaacaaatacattgattttctctctgcttattctgcagtcaatcagggtcattgccatccaaaagttctgagagctttaatagaacaggcagaaaggcttacactcagttctagagctttctacaatgataaattcccaatctttgcggaatttctgacaagcatgtttggatatgacatgatgttaccgatgaatactggagctgaaggagttgaaactgctatcaagttggctaggaaatggggttatgagaagaaaaagataccaaagaatgaggctttgcttgtctcttgctgtgggtgtttccatggtcgaactcttggtgtcatttccatgagttgtgacaacgatgcaactcgtggttttggtcctttggttcctggccatcttaaagttgattttggagatattgatgggttaaagaaagtttttgaagagcatggagaccggatttgtggttttttgttcgaacctatccaaggtgaagccggggtagtaatcccaccagatggctatctgaaaggagtcagagatttgtgttctaagcacaacattttaatgattgctgatgagatccaaacaggcatagctaggacaggcaaaatgctggcatgtgattgggaaaacattcgacctgacatggtgattctaggcaaagcacttggtgctggagttgtcccagtcagtgcagttcttgcagacaaggacgtcatgctgtgtatcaaaccaggggaacatggaagtacatttggtggtaatccgttggctagcgctgtggcagttgcatcactgaaagtggtgagagatgaaggtcttgttgaaagggctgcaaagttaggacaagagttcagggaccagctacagaagatccagcagaaattccctcaaatcataaaagaagtgcgcggaaggggtttgctgaatgcagtggacttaaacaatgatgcactgtctcctgcttctgcatatgacatctgcatcaagttgaaggagagaggcattctagcaaaacccacacatgacaccataatccgattagccccacccctttcaatcagtcatgaggagcttgcacaagcatcaaaggcgctcagtgatgtgctggagattgacttgccacagatgcagaagcagatcaagaagccagaatcagaggcagagaagcctgtctgtgacagatgcggcagggacttgtacggatgagccatttccagcgacgcctccgagcatagatagctgcattttcacaacagaaagcgcggattgtcaatattcttagtcaccgtagtattatccatctcgttgcatgtatattctgggaatgttgttgcttgtgctgttaccgtgattaatggcaaataaatgggggtagcattcacctgcactgtgaatctaccatgaagtcaaaaaaaaaaaaaaaaaaaa

SEQ ID NO: 5720 - protein, 471 aa, Panicum virgatum
  misc_feature: Ceres CLONE 1825118
  misc_feature (1)..(329): Pfam Name: Aminotran_3 Pfam Description: Aminotransferase class-III
  misc_feature (28)..(458): SWISSPROT Homolog: EC 2.6.1.13 Ornithine aminotransferase
MAAALARRVAAAALARGRGMCSAPAAAGRAAAALSSEELMRMERDCSAHNYHPIPMVFSKGEGSHIVDPEGNKYIDFLSAYSAVNQGHCHPKVLRALIEQAERLTLSSRAFYNDKFPIFAEFLTSMFGYDMMLPMNTGAEGVETAIKLARKWGYEKKKIPKNEALLVSCCGCFHGRTLGVISMSCDNDATRGFGPLVPGHLKVDFGDIDGLKKVFEEHGDRICGFLFEPIQGEAGVVIPPDGYLKGVRDLCSKHNILMIADEIQTGIARTGKMLACDWENIRPDMVILGKALGAGVVPVSAVLADKDVMLCIKPGEHGSTFGGNPLASAVAVASLKVVRDEGLVERAAKLGQEFRDQLQKIQQKFPQIIKEVRGRGLLNAVDLNNDALSPASAYDICIKLKERGILAKPTHDTIIRLAPPLSISHEELAQASKALSDVLEIDLPQMQKQIKKPESEAEKPVCDRCGRDLYG

SEQ ID NO: 5721 - DNA, 1360 bp, Panicum virgatum
  misc_feature: Ceres CLONE 1825129
  misc_feature: Encodes the peptide sequence at SEQ ID NO. 5722
aaattcgacgacgaaaaaaaaaactcggaattctttttcagtctccccagccgtgcgacgacccgaccggaaggaggaggagccgaggaggaggaggagagcggagaggaaggaggggcccgccgccgccgccgccgcttgtgaggagtttggtttctgagagggggaggcgattgcgagggttgcagaggaggagggattcgggatggccggccaggaccatgtggtggttcatgtggatggcttggcgaaatccaaggacgacggggtcgccgagaagccgtctgggggtgtgaccacctcggcggctgctgcgtctccctccgcggttgttcacgtggtcgatgagaatgaggagggcggcggtggggaggaggagccgctcatccaggcagccgagtgccgcatatgccaggaggaggacagtgtcaagaatctcgagaagccgtgcacttgcagtggcagcctcaagtatgctcatagagcttgtgttcaacgctggtgcaatgagaaaggagacactacatgtgaaatttgccatgaggaatacaagcctggttacaccgcaccacctcgtgttgaaccagatgagacaaccatagacatcgatggagatttgattatggatttgcgtgacccaagaattctcgctgtagcagctgcccagcgtcgtcttcttgaggcagaatatgatggttatgctacgacagatgcaagtggtgctgcattctgccgttctgctgcacttattttaatggcactgttgttgctgaggcatgcattgtccatctcagacaacgaaggaaacgatgatgatgcttctaccatgttctcacttttcttgctgcgagctgctgggtttctgctgccatgctatattatggcttggatcttcagtattttgcatcgccggcgacaaagacaggaagaggctgcactggcggcagcagaggtaggcttcatcctacagtcagcccgcggacgtgccgccctccagtttgccattgctccagactcccctgccactccacagcagcaggagccatcaccgcagcagccacagcagcaatagctagcaacgcagccccagtagttcgtcacgactactgaccataccgtacatccctggttatttcgttgtttatgcccactgattgaagaaggttaggccagctcagcttctgcttcctatttgccaagtaggatggcaaacacacacttcgattcagcggaaaccctctgtaccttgtgcttgagcgagtgtaatcgaagcatcgaacttaatgtaaattcattgtttacattcgccagttgagttactgtgacaggaatttgagtttaaaaaaaaaaaaaaaaaaaa

SEQ ID NO: 5722 - protein, 288 aa, Panicum virgatum
  misc_feature: Ceres CLONE 1825129
  misc_feature (1)..(46): Pfam Name: zf-C3HC4 Pfam Description: Zinc finger, C3HC4 type (RING finger)
MAGQDHVVVHVDGLAKSKDDGVAEKPSGGVTTSAAAASPSAVVHVVDENEEGGGGEEEPLIQAAECRICQEEDSVKNLEKPCTCSGSLKYAHRACVQRWCNEKGDTTCEICHEEYKPGYTAPPRVEPDETTIDIDGDLIMDLRDPRILAVAAAQRRLLEAEYDGYATTDASGAAFCRSAALILMALLLLRHALSISDNEGNDDDASTMFSLFLLRAAGFLLPCYIMAWIFSILHRRRQRQEEAALAAAEVGFILQSARGRAALQFAIAPDSPATPQQQEPSPQQPQQQ

SEQ ID NO: 5723 - DNA, 1312 bp, Panicum virgatum
  misc_feature: Ceres CLONE 1825165
  misc_feature: Encodes the peptide sequence at SEQ ID NO. 5724
ataacggcgccgcgaccccaccgtatcccgcctcgccccactcctcactgccctcgctttcgctcgccatccgcacacccgccttcgcgatgccttcgcccgccacggccgcggccgtggccgcgtcggcgcctctccaccgccgcgcctgctcgcgtcagcacctccctccggcctcccggtgcttcctcccctcccgcgcgctcctcaattccgcgcgcctcttcaccgcccccgccccgctgcccgtccacgcgccgaggctgcctcccacggcggcgagggcggccagccccgacgccgcggccgcgagatcgcccacatcaggcggacagatgctggtgttcgtcccgccgcacccgctgataaagcattgggtctccgtcctgcgcaacgagcagacaccctgctccatattcaagagtgctatggcagagcttggtcgtctgctcatatatgaagcatccagagattggttgcctacaatcactggagagattgaaacacctgtagctgtagctagtgttgaatttattgatccaagagagcctgttctggttattccaatactgagagctggtcttgccctagctgaacttgcttcatcagttctgccagccaccaagacctatcaccttggccttcgtagggatgaagaaacacttcaaccttcaatatatctgaacaacctgccagacaatattccagaggggtctcgagtgctagttgttgacccaatgctggccaccggtgggacgattgttgctgctattgacttgttaattgaacgtggagttaccagcaagcagattaaagtagtatctgctgttgcagcacctcctgcgctgcaaaagctcaataacaagttccccgggctccatgtgtacacaggaataatagatcctgaagtaaacgagaaaggttttataattccagggttgggggatgctggtgacagaagctttgccacataatctgactgcacgatttaattcggccagctgtctaccatcgagaatctttgcatcagttccataagaacggagcaactgcgagtaaagaggcgttcattgctgtagatgccctcatttgagattttgttcattctctgtaatacaattagctgcccaccattttgtaactaaccattatgtatgattgcgtagaatataaggctagttcagatgtctccagatggaaaaatctttttgaaaggacaacgctccattcaaaatggcacatgctggattagtgaattggtgcttcctaatatttctcctgtcgaaggaataaaaccgtctcatcatgtttc

SEQ ID NO: 5724 - protein, 294 aa, Panicum virgatum
  misc_feature: Ceres CLONE 1825165
  misc_feature (72)..(294): SWISSPROT Homolog: EC 2.4.2.9 Uracil phosphoribosyltransferase
MPSPATAAAVAASAPLHRRACSRQHLPPASRCFLPSRALLNSARLFTAPAPLPVHAPRLPPTAARAASPDAAAARSPTSGGQMLVFVPPHPLIKHWVSVLRNEQTPCSIFKSAMAELGRLLIYEASRDWLPTITGEIETPVAVASVEFIDPREPVLVIPILRAGLALAELASSVLPATKTYHLGLRRDEETLQPSIYLNNLPDNIPEGSRVLVVDPMLATGGTIVAAIDLLIERGVTSKQIKVVSAVAAPPALQKLNNKFPGLHVYTGIIDPEVNEKGFIIPGLGDAGDRSFAT

SEQ ID NO: 5725 - DNA, 1194 bp, Panicum virgatum
  misc_feature: Ceres CLONE 1825200
  misc_feature: Encodes the peptide sequence at SEQ ID NO. 5726
attaacatagcacgccaagcgaaagtctatccagttaaaaggagtccagtaggaacatgggctctggcgacgacggcccgacaacacagctcatgaagatcgccaaggtggaccttcgcgggctgcagtccaacacgatggcgtgggcggaggccagggccgcggtgaccgcgtccatggcggctcacggctatgtggtggtcgtgcacgacgcgcttgacgcggagcttcggcgcgccctgttcggccgagccttgccggagctctacgcgctcccgtttgacaccaagaaaagcagcggtgccttctcaaacggcccgcatagaggctacgacgggcaggtcccgagtgaggtcttggagagcgtcgccatcctgaacccggttgaacccggcaacgtccgagacttcactggccgcctctggccacagggcaacccaggtttctgcgacacgatcgtgtcattcgccaagaacgtgctggaattagcacagacggtggagaggatgaccctagagggcctgggggtccacgaggagagcattgcctggcagctcttctcgcagtcccatactgctcggatgatgctctatgggacgccaccagacaaggagaccagcaatatctccctgggggcgcaccccgacgatcaaatgaccacggtgatcgcgcagcacgaggtggggggcctcgaggtgcaggtcgatggcggacggtggctcgccgtgcctcccgagccgggcaccctcatcgtcattggcggcgaccagttaacgcttgtcacgaacgggagggtgccggcgtgtatccaccgggtgagagcaccgagtggccgcgagcgcttctcggtgctgctcagccggcgtcgcaagggcgaccccataatgcgcgccatggatgagctcgtcgacgaggaccaccccctgatgtacaacccctgcagtcacgaggagtacagggcgttccgcttatccgaggaagggcgcaaactgcgagagcacaatccactgaaggctttctgcggtgtggagaaagatgggtccaaggaatgaacactcccccaggacgtacatcacacacaccgtattgtccaatcaatcatcacaaagggagtaaacctcccttggattcttagaatgacacggtgtttgataaaaaaattatttcctcctgcaaaaaaaaaaaaaaaaaaaa

SEQ ID NO: 5726 - protein, 331 aa, Panicum virgatum
  misc_feature: Ceres CLONE 1825200
  misc_feature (1)..(95): Pfam Name: 2OG-FeII_Oxy Pfam Description: 2OG-Fe(II) oxygenase superfamily
MGSGDDGPTTQLMKIAKVDLRGLQSNTMAWAEARAAVTASMAAHGYVVVVHDALDAELRRALFGRALPELYALPFDTKKSSGAFSNGPHRGYDGQVPSEVLESVAILNPVEPGNVRDFTGRLWPQGNPGFCDTIVSFAKNVLELAQTVERMTLEGLGVHEESIAWQLFSQSHTARMMLYGTPPDKETSNISLGAHPDDQMTTVIAQHEVGGLEVQVDGGRWLAVPPEPGTLIVIGGDQLTLVTNGRVPACIHRVRAPSGRERFSVLLSRRRKGDPIMRAMDELVDEDHPLMYNPCSHEEYRAFRLSEEGRKLREHNPLKAFCGVEKDGSKE

SEQ ID NO: 5727 - DNA, 1268 bp, Panicum virgatum
  misc_feature: Ceres CLONE 1825212
  misc_feature: Encodes the peptide sequence at SEQ ID NO. 5728
cgggctcaactaggccggccggctatcccatgtcacccatggcgtcctccaccaccaaacgcgcgctgctcctcctgctcgccgtcctcctccacggctgcccctgctcggcggcggcagcggcggaccacggtgggcgcgccggcggccgcagccccgccatggaggagcggttccggcggtggaaggtggagtacaaccggtcctacgccacggccgccgaggagcggcgacggttccgggtgtacgcgcgcaacgtggcctacatcgaggccaccaacgccgaggccgcggcggcggggctcacgtacgagctcggcgagacggccttcacagacctcaccaaccaggagttcgcggccatgtacacggcgccggcgccgctgcatgcggacggcgacgacgaggacgcgccggcggtgatcacaacgcgcgcggggctggtcgacgcgggccgccagctgctgccgccgtacgcgaacctgtccgacggcgcgccggcgagcgtggactggcgcgccagcggcgccgtcacgccggtgaaaaaccagggccgatgcgggtcgtgctgggccttctcgacggtggcggtggtcgagagtatctatcagatccggacgggggagctggtgtcgctgtcggagcaggagctagtggactgcgacacgctggacgccggctgcgacggcggcatcagctaccgcgcgctacggtggatcgccgacaacggtggcatcaccaccgaggccgactacccgtacacggcggccacgggggcctgcgacagggccaagctctcgcacaacgcggtgagcatcgcggggctccgccgcgtcgccacccgcagcgaggcgtcgctggtgaacgcagtggcggcgcagccggtggccgtgtccatcgaggccggcggggccaacttccagcgctacaggaagggcgtctacaacgggccgtgcgggaccaggctcaaccacggcgtcaccgtcgtcgggtacggccaggagcccggcggcggggacaggtactggatcgtcaagaactcgtggggggagggctggggcgacggcgggtacatcaggatgaggaaggacgtcgccggcaagccggaggggctctgcggcatcgccatccgcccgtcctacccactgatgtgacaccactgatgtgacatgatgtatatacatcctttttccttcttccattttagtcaacttatgatcgagtcaaacttgtttttttttcgttttcaaaaaaaaaaaaaaaaaaaa

SEQ ID NO: 5728 - protein, 374 aa, Panicum virgatum
  misc_feature: Ceres CLONE 1825212
  misc_feature (2)..(215): Pfam Name: Peptidase_C1 Pfam Description: Papain family cysteine protease
  misc_feature (151)..(374): SWISSPROT Homolog: EC 3.4.22.33 Fruit bromelain precursor
  misc_feature (157)..(374): SWISSPROT Homolog: EC 3.4.22.31 Ananain precursor
MSPMASSTTKRALLLLLAVLLHGCPCSAAAAADHGGRAGGRSPAMEERFRRWKVEYNRSYATAAEERRRFRVYARNVAYIEATNAEAAAAGLTYELGETAFTDLTNQEFAAMYTAPAPLHADGDDEDAPAVITTRAGLVDAGRQLLPPYANLSDGAPASVDWRASGAVTPVKNQGRCGSCWAFSTVAVVESIYQIRTGELVSLSEQELVDCDTLDAGCDGGISYRALRWIADNGGITTEADYPYTAATGACDRAKLSHNAVSIAGLRRVATRSEASLVNAVAAQPVAVSIEAGGANFQRYRKGVYNGPCGTRLNHGVTVVGYGQEPGGGDRYWIVKNSWGEGWGDGGYIRMRKDVAGKPEGLCGIAIRPSYPLM

SEQ ID NO: 5729 - DNA, 1115 bp, Panicum virgatum
  misc_feature: Ceres CLONE 1825239
  misc_feature: Encodes the peptide sequence at SEQ ID NO. 5730
atcagtcaccagagcccagcatttcgctagaatccaaggctgttttcctgttgcaagcgcgcgcaaggatggtgaacctggtggaggcgcagaagccgctgctgcacttcctggtccggagggccgggctgcggcagcacaccgtcgacgtcgacggcgccggcacggtcatcaccttctgggtgcccaaggacaaggtgcccagcgacaagcccaccgtgcgggacgccactacgcccgataccaaactcccgccgccgcagccagcggcggcggccaagaaggataggcccgccgtcgtgctcgtgcacggcttcgccgccgagggcatcgtcacctggcagttccaggtgggcgtgctggcgaagcactacgacgtgtacgtgccggacctgctctacttcggtggctcgacgtcgccgtcggcggaccggtcgccggggttccaggcggagtgcctggcgacggcgctgcggaagctgggcgtgggcccgtgcgctgtggtcgggttcagctacggcgggatggtgtcgttcaagatggcggaggcgcacccggacctggtgcggtggctcgtcgtgtcgggctccgtcgtggccatgaccgactccatcagcgaggaggcgctggagcggatcggcgtcaagtcgtcggcggagctgctgctgccggagtccgtcagggggctcaaggcgctgctctccatcgccacctaccggaagctctggttccccgaccgcctccacagggactacctcgaggtgatgttcaccaaccgcaaggagagagcggagctgctggaaggtttggtggtcagcaacaaagacgccaccgtgcccgtcttgccgcagaaaatacttctgctgtggggggagaacgacaacatcttcaacatcgagctcgccaagacaatgaaagagcagctgggcgagaagacgatgctgcaaagcataagcaaggcagggcatctcgtgcacctggagaggccctgcgtctacaaccgttgcctcaaggagttcctggcgtcagtcacggccgcagaaaccacccccaagcagtgacgacagggagggagtctacctacaacaatgtctgaaaaaaaaaaaaaaaaaaaa

SEQ ID NO: 5730 - protein, 330 aa, Panicum virgatum
  misc_feature: Ceres CLONE 1825239
  misc_feature (1)..(215): Pfam Name: Abhydrolase_1 Pfam Description: alpha/beta hydrolase fold
MVNLVEAQKPLLHFLVRRAGLRQHTVDVDGAGTVITFWVPKDKVPSDKPTVRDATTPDTKLPPPQPAAAAKKDRPAVVLVHGFAAEGIVTWQFQVGVLAKHYDVYVPDLLYFGGSTSPSADRSPGFQAECLATALRKLGVGPCAVVGFSYGGMVSFKMAEAHPDLVRWLVVSGSVVAMTDSISEEALERIGVKSSAELLLPESVRGLKALLSIATYRKLWFPDRLHRDYLEVMFTNRKERAELLEGLVVSNKDATVPVLPQKILLLWGENDNIFNIELAKTMKEQLGEKTMLQSISKAGHLVHLERPCVYNRCLKEFLASVTAAETTPKQ

SEQ ID NO: 5731 - DNA, 1231 bp, Panicum virgatum
  misc_feature: Ceres CLONE 1825284
  misc_feature: Encodes the peptide sequence at SEQ ID NO. 5732
gatcagagacggagggactctctcctcgtgccgcttcgattcgatccaaaccgagcaagccccaaacccgaccgcatctatggccgacggcggcggcggtggcggcgccggcgagccagcggccggcgctggctcggcgccggtgtgcagcttcgtgaggaaaccacccaagaacatccggaagcgccccgccgcgcccgcaggctccgacgacgaggacgacggcggcggcgccctcgcggccttgcggtcgaagaagggcccgtcctccgcgggcaagctcgtcttctcctccgccgacgcgtcctccgagccgcggcggttccagtacgaatcctcccggacgatccagtccacggatagccgagccaccgccacgctcgagacggagacggagttcgaccgcgacgcgcgcgccatccgcgagcgccagctcaagcaggccgagaaggccctcaagaagaacccctccggtgcctcctccgcctccgcctccggggaggtgtacaaggggatccacggctacacggactacaaggccgggttccgccgggagcacacggtggccagcgagaaggccggcggctcgcacggcccgctccgggcctccgcgcacatccgcctctccgcgcggtttgactaccagcccgacatctgcaaggactacaaggagacgggctactgcgggtacggtgattcctgcaagttcatgcacgacagaggggattacaagtccgggtggcagctcgagaaggagtgggaggaggcggaaaaggcccgcaagcggcgcattgcgatgggcggtggcgatgggagcgatgatgaggcagcggatgaggaggacgacgacgacgacgatgaggccctgccctttgcctgcttcatttgcaggcagccttttgtagatccggttgtcacaaaatgcaagcactacttttgtgagcattgcgcattgaagcaccactcgaagaacaaaaagtgcttcgtctgcaacaagtcgactatgggcatcttcaacgctgcgcaggagatccgcaagaagatggcccaggacaagaagcagcagcagcagcagcagcagcatgaggattagtaactttaggcacgaatgcaaacttagctgttgtacttgtacgttgatgtaatagcttcgttctgatttttttttgtccatcataaaaaaatgagaagaaaaggaaattcagaaacccaaaaaaaaaaaaaaaaaaaa

SEQ ID NO: 5732 - protein, 337 aa, Panicum virgatum
  misc_feature: Ceres CLONE 1825284
  misc_feature: Great-hit functional homolog of the protein sequence given in SEQ ID NO 9226
  misc_feature (1)..(38): Pfam Name: zf-C3HC4 Pfam Description: Zinc finger, C3HC4 type (RING finger)
  misc_feature (1)..(27): Pfam Name: zf-CCCH Pfam Description: Zinc finger C-x8-C-x5-C-x3-H type (and similar)
  misc_feature: The sequence is a functional homolog of  SEQ ID NO 870 in the  11/435,388 US patent application
  misc_feature: Useful for making plants with altered alkaloid content
  misc_feature: Useful for making plants with altered terpenoid content
  misc_feature: Useful for making plants with modulated growth and phenotype characteristics
MADGGGGGGAGEPAAGAGSAPVCSFVRKPPKNIRKRPAAPAGSDDEDDGGGALAALRSKKGPSSAGKLVFSSADASSEPRRFQYESSRTIQSTDSRATATLETETEFDRDARAIRERQLKQAEKALKKNPSGASSASASGEVYKGIHGYTDYKAGFRREHTVASEKAGGSHGPLRASAHIRLSARFDYQPDICKDYKETGYCGYGDSCKFMHDRGDYKSGWQLEKEWEEAEKARKRRIAMGGGDGSDDEAADEEDDDDDDEALPFACFICRQPFVDPVVTKCKHYFCEHCALKHHSKNKKCFVCNKSTMGIFNAAQEIRKKMAQDKKQQQQQQQHED

SEQ ID NO: 5733 - DNA, 1150 bp, Panicum virgatum
  misc_feature: Ceres CLONE 1825334
  misc_feature: Encodes the peptide sequence at SEQ ID NO. 5734
ccctacttcgtcttccggacttccactcatgagcgcttagcaaaccagccatcgcagctccagagctccagctcccgggccgctcctcgatcgccggagacgccatggaccgcagggagaagttccgcaggggctcgtcgagctcggcggcggcggcggcgtccatggccgcgctcgccgccgccgcggcggctggggagggatcgagctccggctccggctcggccgacggggcgcttccgccgcacggggaggaggaggaggaccagaagcctcccaagctggcggccgtgggaggcgtctccagctcctccccgtccccggtgccggcgaggaggggtgcggcggcgggcggcggcggcgggccgaggtgccaggcggagcggtgcaacgccgacctgaacgaggcggcgcagtactgccggaggcacaaggtgtgccagacgcactccaaggcccccgtcgtgctcgtcgccggcctccgccagcgattctgccagcaatgcagccggttccacgagctgtcggagttcgacgacaacaagcgcagctgccgcctgcgcctggcggggcacaacgagcgccgccggaagagcgcggcggacacgcacgggcacggcggcgatggcgccggagccggcgccggcgccggcgacgggtgccgccacgccgaccaggacggccggggccaccaggggaacccgccgccgccgaaccacttccagcagatcagataaatctatctaattaagcatgctctctctcttctgtcatgcagctagttagcagcacatgtatgtgccaatgtgtgtgcgtgcgtctaccctactacccccagggtcgtatattgcattgccctacgtgctaacttggcggctcccatcacctcctgtaataacgtgacgggctcccgtgtgcgcgcaccggccggaggtgtatgtgctatgtgtccatctgccaaaaaacctagttgatgatgctgattgttgtaacctaacctgctggcaatttaagcaggaactgctagagtaattgttgctgctgttgttgctgctgctgttgttgttgttgttgtgtgtgtatgttatggatggatgagttaccggatgtgtaatccagtggcctgtgccaaaaaaaaaaaaaaaaaaaa

SEQ ID NO: 5734 - protein, 210 aa, Panicum virgatum
  misc_feature: Ceres CLONE 1825334
  misc_feature: Great-hit functional homolog of the protein sequence given in SEQ ID NO 9240
  misc_feature: Useful for making plants with altered Lignin content
MDRREKFRRGSSSSAAAAASMAALAAAAAAGEGSSSGSGSADGALPPHGEEEEDQKPPKLAAVGGVSSSSPSPVPARRGAAAGGGGGPRCQAERCNADLNEAAQYCRRHKVCQTHSKAPVVLVAGLRQRFCQQCSRFHELSEFDDNKRSCRLRLAGHNERRRKSAADTHGHGGDGAGAGAGAGDGCRHADQDGRGHQGNPPPPNHFQQIR

SEQ ID NO: 5735 - DNA, 1346 bp, Panicum virgatum
  misc_feature: Ceres CLONE 1825422
  misc_feature: Encodes the peptide sequence at SEQ ID NO. 5736
gccccactctctcgagctgcactgcacgcggcctcctgctggccaaagatcacgctgctcattagtcgcagcctcaagactacctcgaccgcaggaaaactttgatccaacgccatgggcggcctctccatgggccaggccttcgtgcaggcccccgagcaccgcccgaagcccaccgccaccgaggccaccggcatcccgctcatcgacctctcgccgctcgccgccggcgacgccgacgcgctggccgcggaggtgggcgcggcgagccgggagtggggcttcttcgtggtggtggggcacggcgtgccggcggaagccgtggcgcgcgcgacggcggcgcagcgcgcgttcttcgcgctcccggccgagcggaaggccgccgtgcggaggagcgaggcggagccgctcgggtactacgagtcggagcacaccaagaacgtcagggactggaaggaggtgttcgacctcgtcccgcgcgagccgccgccgccggcagccgtggccgacggcgagctcgtcttcgccaacaagtggcctcaagacctgccgggattcagagaggcgctggaggagtacgcgaaagcaatggaggagctggcgttcaagatactggagctgatcgcccggagcctgaacctgaggcccgaccggctgcacggcttcttcagggaccagaccaccttcatccggctgaaccactaccctccgtgcccgagccccgacctcgccctgggcgtgggccggcacaaggacgccggggccctgaccatcctgtatcaggacgacgtcggcgggctcgacgtccggcggcgctccgacggcgagtgggtccgcgtcaagcctgtccccaactccttcatcatcaacgtcggcgacatcatccaggtgtggagcaacgacaggtacgagagcgcggagcaccgggtgtcggtgaactcggccaaggagcggttctccatgccctacttcttcaacccggcgagctacaccatggtggagccggtggaggagatggtgagcgaggggaacccgccccggtacaacgcctacaactggggcgacttcttcagcaccaggaagaacagcaactacaggaagctggacgtggagaacatccagatcgcgcatttcaagaagggcgtcgccgccgcctaggacatgactaaagatccatgacgaggcgccagccaggcggccggtgtcgtcttcgatcgggtggcatgcatctgcatgcggtagaaatatatgtgtgcgtgttctgtactaataataatcgtgatgtggcgagtactttggcatgcttggaaataacagccctgtgttggccgttctggtttgtctgc

SEQ ID NO: 5736 - protein, 347 aa, Panicum virgatum
  misc_feature: Ceres CLONE 1825422
  misc_feature (1)..(102): Pfam Name: 2OG-FeII_Oxy Pfam Description: 2OG-Fe(II) oxygenase superfamily
MGGLSMGQAFVQAPEHRPKPTATEATGIPLIDLSPLAAGDADALAAEVGAASREWGFFVVVGHGVPAEAVARATAAQRAFFALPAERKAAVRRSEAEPLGYYESEHTKNVRDWKEVFDLVPREPPPPAAVADGELVFANKWPQDLPGFREALEEYAKAMEELAFKILELIARSLNLRPDRLHGFFRDQTTFIRLNHYPPCPSPDLALGVGRHKDAGALTILYQDDVGGLDVRRRSDGEWVRVKPVPNSFIINVGDIIQVWSNDRYESAEHRVSVNSAKERFSMPYFFNPASYTMVEPVEEMVSEGNPPRYNAYNWGDFFSTRKNSNYRKLDVENIQIAHFKKGVAAA

SEQ ID NO: 5737 - DNA, 1169 bp, Panicum virgatum
  misc_feature: Ceres CLONE 1825429
  misc_feature: Encodes the peptide sequence at SEQ ID NO. 5738
aaccgtcagagcactgcataccaagaactcgaggaagaagatggcgaaatcttttccggcaatgctgctggtcacggcgctcgcgctggcggggctagccgccggagcgcgcgccggcgacatcgcaatctactggggccagaacggcaacgggggcacgctggcggaggcgtgcgccaccggcaactacaagttcgtcaacgtggccttcctcaccacgttcggcaaggcccagacgccggtgctcaacctggccggccactgcaacccggccaccaacggctgcacgggcgtgggcgcggagatcaagtcgtgccagagccggggcgtcaaggtcctgctctccatcggcggcggcgtcggcagctacggcctgtcgtccccggccgacgccgggcaggtcgccgcctacctctggaacaactacctcggcggcgcgtccaagtccaggcccctcggcgacgcggtcctcgacgggatcgacttcgacatcgagatcggcgggagcctgtactgggacgatctggcccggtccctcaagtcctactcccgtcaggggcgccggccggtgtacctcgccgcggcgccgcagtgcccgttcccggacgcgtcgctggacaccgcgctgcgcacggggctgttcgactacgtgtgggtgcagttctacaacaacccgccgtgccagtacagcgcgagcgccggcgtgggcggcctggcgcgcgcgtgggcgcagtggacgtcgatcagggcggggcgggtattcctggggctcccggccgcgccccaggccgccggcagcgggttcgtgccgacgagcgacctggtatcgcaggtgctccccgtggtcaggaactccaccaagtacgggggcatcatgctgtggtcgaggttctacgacgggctcaccgggtacagcgacgcggtcaagtcccaagtgtgagctgttgctcgtggcatgtcggctctcgggcgtgtgtggtgcacatgcgtccatgtgcgtgggtcgtgcaggatcgagtactctgcagagaaacgtagagacacagtgatgggtatgaaagaccatgtgtcttggctctagagatctctctgaatctgatgtgctttggcatgtactatctccatcgattcaatgaactgcgagcaaacaaaaaaaaaaaaaaaaaaaa

SEQ ID NO: 5738 - protein, 299 aa, Panicum virgatum
  misc_feature: Ceres CLONE 1825429
  misc_feature: Great-hit functional homolog of the protein sequence encoded by LOCUS At5g24090
  misc_feature (1)..(263): Pfam Name: Glyco_hydro_18 Pfam Description: Glycosyl hydrolases family 18
  misc_feature (1)..(299): SWISSPROT Homolog: EC 3.2.1.14 Acidic endochitinase precursor
  misc_feature (1)..(299): SWISSPROT Homolog: EC 3.2.1.14 Hevamine-A precursor [Includes: Chitinase
  misc_feature: Useful for making plants with altered cell wall content and/or composition
MAKSFPAMLLVTALALAGLAAGARAGDIAIYWGQNGNGGTLAEACATGNYKFVNVAFLTTFGKAQTPVLNLAGHCNPATNGCTGVGAEIKSCQSRGVKVLLSIGGGVGSYGLSSPADAGQVAAYLWNNYLGGASKSRPLGDAVLDGIDFDIEIGGSLYWDDLARSLKSYSRQGRRPVYLAAAPQCPFPDASLDTALRTGLFDYVWVQFYNNPPCQYSASAGVGGLARAWAQWTSIRAGRVFLGLPAAPQAAGSGFVPTSDLVSQVLPVVRNSTKYGGIMLWSRFYDGLTGYSDAVKSQV

SEQ ID NO: 5739 - DNA, 1195 bp, Panicum virgatum
  misc_feature: Ceres CLONE 1825431
  misc_feature: Encodes the peptide sequence at SEQ ID NO. 5740
aagatagttttgcgcctccccatccatccttgtccgttggtgagggcgtcgtgctccggccgctccattatcagcagcgcccggcggctcatgctgccgcggccgaacgccggcgccgtccggcctccggagccgctcttctccttcggcgtgatcgcggacgtgcagtacgccgacatcccggacggccggtccttcctcggcgtgccgcgctactaccgccacagcctggccgtcctccggcgggcggtccggagctggaacgcccacgggggcgtccggttctgcgtcaacttcggcgacatcgtggacggcttctgccccagggaccggtcgctggcggcggtgcgcgagttcgacggcttccgcggcgggccggcgtaccacatgctcggcaaccactgcctgtacaacctgccccggagcgacctcgtgtcggagctgcggatgccgtcgccgccggggcgcgcctactacgacttctcgccgtggcccgggtaccgcttcgtggtgctggacgcctacgacttcagcgccgtgggccggccgcggggtgacccggtggcggcggcggcgcggcggttcctggaggagcggaacccgaaccgcgacaagaacagccccagcgggctggaaggcgccgcccgccggttcgtcatgttcaacggcggcgtgggcggcgcgcagatgcggtggctggacgccgtcctccgcggcgcggcggcgcggggggagaaggccgtcgtgtgcagccacctgccggtgcacccgggcgcggcgtcgcccacggggctcatgtggaactacgaggacgtggcggccgtggtgcgccggcacgaggggcgcatcgtggcctgcctcgccggccacgaccacaggggcggctacgccgtggacgaccgcggcgtgcaccaccgcacgctggaggcggcgctcgagtgcccgccgggcaccgacgccttcggccgcgtcgaggtgtaccccgaccgcctccggctcgtcggctccgacagaatggccaccacggagatgccgctcaactcctcctccagctctagtgatgatgagtaccagattgggtgatctatactatacctgcatgaacaagaccaatgtacaaatccactgcaatgagaatgattagcaactcgtgcaattggcagtactgattgaataaaaaaaaaaaaaaaaaaaa

SEQ ID NO: 5740 - protein, 330 aa, Panicum virgatum
  misc_feature: Ceres CLONE 1825431
  misc_feature (1)..(256): Pfam Name: Metallophos Pfam Description: Calcineurin-like phosphoesterase
MLPRPNAGAVRPPEPLFSFGVIADVQYADIPDGRSFLGVPRYYRHSLAVLRRAVRSWNAHGGVRFCVNFGDIVDGFCPRDRSLAAVREFDGFRGGPAYHMLGNHCLYNLPRSDLVSELRMPSPPGRAYYDFSPWPGYRFVVLDAYDFSAVGRPRGDPVAAAARRFLEERNPNRDKNSPSGLEGAARRFVMFNGGVGGAQMRWLDAVLRGAAARGEKAVVCSHLPVHPGAASPTGLMWNYEDVAAVVRRHEGRIVACLAGHDHRGGYAVDDRGVHHRTLEAALECPPGTDAFGRVEVYPDRLRLVGSDRMATTEMPLNSSSSSSDDEYQIG

SEQ ID NO: 5741 - DNA, 1514 bp, Panicum virgatum
  misc_feature: Ceres CLONE 1825470
  misc_feature: Encodes the peptide sequence at SEQ ID NO. 5742
gtgctctctcctctctctccttgctttctgtgcctctgaagagcagtgcttctatgtcatctatagctagatagcacagagcaagctgcctgccaaggcagatagaaaattagcaaaaacgtctggaggcagtgggatttggtagctaggtgttgcttttagcttcgtttgcgaggcatatttcttagttgtgacctcatggggagggctccgtgctgcgataagaacaatgtgaagaaagggccatggtctcctgaggaggatgccaagctcaaggagttcatcgagaagcacggcaccggtgggaattggattgctcttcctcaaaaagcagggctaagaagatgtggcaagagctgtaggcttagatggttaaactacctgaggcctaacattaagcatggggagttcactgagcaagaagacagggtcatctgcagcatgtatgcaagtataggaagcaggtggtcaatcatcgcgtctcagctccccggtcgcactgacaatgacatcaagaactactggaacaccaagctaaagaagaagctcctaggctccacagccaccccaccccttccccgtgcgccgcggcagcatcaccggcccctcaatctcatgctccaacacacgtcaccctcgttaccccaacccacctacaacagcttcttctccagcgccggagccctcctcgaccccatcagtggcatcccatcattaacactgccgccaccccaggattacatgctaaactccggctgccttgccattccaaacgcgccttcacttctgcacgggcacggcgctccacagcagcagtttcaccaccatgtggtcaaggaggagagcggcaacatgatcgcattcggcagcgaccagcagagctgcagctcctcagacggcatgcacagccagccgcagttcgggcatggcaaggcgctgagctttgacggctacttcggctacaacaatggaagcagcatcgtgcaagaacacaggatgcttcaactccatgatcatcaccaggcccagcaggtgccggtcgagtacaactacgaggagatcaagcagctgctattgagctcaacaaccaacggtaatttgcatggccatggccatggccaggacggcagcatggaagggttcggctcgcaagggaaggtgacgatgatgtaaatttgactaggagacatggaaaagtgattgatcaatcaaggtgtgtgtcttactgctgtatttttttccattttaccttgtagcagtgtactagtggtggtgcgtgtgtgtgcgcgctcgcgcatcctatgtcatgcatggctgcatacacgtgccagagttgcgtgcgttacagcctgtgtatgtgaccgtgacatgggaccgagactctctctcctccgtcctcttatatattactgttgtacttctccctcttttttctcagcagaggtatagtgtcatgagcatgtatgcatgagctacaaacactgtgggaagtggaaaaaaaaaaaaaaaaaaaa

SEQ ID NO: 5742 - protein, 324 aa, Panicum virgatum
  misc_feature: Ceres CLONE 1825470
  misc_feature: Great-hit functional homolog of the protein sequence given in SEQ ID NO 9214
  misc_feature (1)..(49): Pfam Name: Myb_DNA-binding Pfam Description: Myb-like DNA-binding domain
  misc_feature: The sequence is a functional homolog of  SEQ ID NO 1656 in the  11/479,226 US patent application
  misc_feature: The sequence is a functional homolog of  SEQ ID NO 834 in the  10/412,699 US patent application
  misc_feature: Useful for making plants with modulated nitrogen use efficiency
  misc_feature: Useful for making plants with modulated growth and phenotype characteristics
MGRAPCCDKNNVKKGPWSPEEDAKLKEFIEKHGTGGNWIALPQKAGLRRCGKSCRLRWLNYLRPNIKHGEFTEQEDRVICSMYASIGSRWSIIASQLPGRTDNDIKNYWNTKLKKKLLGSTATPPLPRAPRQHHRPLNLMLQHTSPSLPQPTYNSFFSSAGALLDPISGIPSLTLPPPQDYMLNSGCLAIPNAPSLLHGHGAPQQQFHHHVVKEESGNMIAFGSDQQSCSSSDGMHSQPQFGHGKALSFDGYFGYNNGSSIVQEHRMLQLHDHHQAQQVPVEYNYEEIKQLLLSSTTNGNLHGHGHGQDGSMEGFGSQGKVTMM

SEQ ID NO: 5743 - DNA, 1254 bp, Panicum virgatum
  misc_feature: Ceres CLONE 1825540
  misc_feature: Encodes the peptide sequence at SEQ ID NO. 5744
ccccgcggccgagccagcgaacggaagaacagagcacgccgccggcggcgaacccgcgcagagctcggctcaatcatggatgcagagatgggcgacagctactgggaggagacgcagcgctatctggagtacgaggagctcagcatctacctggaggcgcaggaggacgccatgtcctgctacgactccagctcgccggacgggtccaactcccattcctcctcggcagctccggcgggtgatggtaagggggccggcagcggcgcggcggacggggccaacaagaacatcatcatggagcgcgaccgccgccgcaagctcaacgagaagctctacgcgctgcgcagcgtcgtgcccaacatcaccaagatggacaaggcatcgatcatcaaggacgcgatcgagtacatccagcagctgcaggcggaggagcggcaggtgctgcaggaggtgcgcgcgctcgagtccgccgcctgcgcgccgcaggcgatcgacgacgagggcctcctcccgctcgaggcggcggagcgggcgaagaagccgaagcgcgcgcggtcgtcggtgccgctgtccgccgccgccccccacggcgccgcgccgccgccgccgccgcccccgcccctggaggtcctggagctgcacgtgtcggaggtgggcgagcgcgtgctggtggtgagcctggcgtgcagcaagcgccgcgacgccctggcccgcgtgtgccgcgccatcgaggagctccggctccgcgtcatcaccgctagcatcacctccgtcgccggatgcctcatgcacaccgtcttcgtcgaggtagatgaaatggatgggatccagatgaagcagatggtcgaggctgctctcgctcagatcgacgccaccggaagcccgccaagttacatgagctattaggctgagggctaataataactatgtcaggatatgatagttttccatctagtttaccaacatagtccctcgccagataagaagttatgttgtgtgtttgctgtgtgctgctgcccttttctcaacatcccccttacgcatgtgggaggtacggtgatgttcatttttctaagaggcagccggtcaaaatttaggtaagagactgagcaagtttggatttcatgtcataggccttcacgagcataacataacttcttatatggtaatgaataacaggtatatggtaatgaataacaaggagactcaccccttaaagaactttggtgtgcaatgaatactgcgcatgttcgg

SEQ ID NO: 5744 - protein, 276 aa, Panicum virgatum
  misc_feature: Ceres CLONE 1825540
  misc_feature (1)..(48): Pfam Name: HLH Pfam Description: Helix-loop-helix DNA-binding domain
  misc_feature: The sequence is a functional homolog of  SEQ ID NO 1195 in the  11/479,226 US patent application
  misc_feature: The sequence is a functional homolog of  SEQ ID NO 538 in the  10/412,699 US patent application
  misc_feature: Useful for making plants with modulated growth and phenotype characteristics
MDAEMGDSYWEETQRYLEYEELSIYLEAQEDAMSCYDSSSPDGSNSHSSSAAPAGDGKGAGSGAADGANKNIIMERDRRRKLNEKLYALRSVVPNITKMDKASIIKDAIEYIQQLQAEERQVLQEVRALESAACAPQAIDDEGLLPLEAAERAKKPKRARSSVPLSAAAPHGAAPPPPPPPPLEVLELHVSEVGERVLVVSLACSKRRDALARVCRAIEELRLRVITASITSVAGCLMHTVFVEVDEMDGIQMKQMVEAALAQIDATGSPPSYMSY

SEQ ID NO: 5745 - DNA, 1364 bp, Panicum virgatum
  misc_feature: Ceres CLONE 1825601
  misc_feature: Encodes the peptide sequence at SEQ ID NO. 5746
agctcgctccatcatcgaccaccggtaacgaccacctatcccggccggtagcagcagcagcagtgtgcagtgctaccacccacgctgccccgcgcgccgtggtctgtgctcttgtggacacactggcctccacccatccccctcaccgcggctcgccatccgcggcaaaggccacggtacagattcggccggtcgatttatagccacaccatggcgaggaagtgctcccactgtggcaaccacggccacaactccaggacctgcggcctgggacacagcagagaaaccatgcctcgccagggcggcgacaacggcggcggcggtgtcggcgggctgaggctcttcggagtgcaggtccacgccgccggcagcggcggcgcggcgtccatgaggaagagctacagcatggactgcctgcagctcgcggcgcctgctggctgctccctcgtctcgccgtcgtcgtcgtcttcgtcctcgctgctgctgtcgatcgaagagggcttggagagggcggccaccaacgggtacctgtctgatggaagtgccagagttgtggcagagaggaagaaaggcgttccatggagcgaggaggagcaccggcagttccttgccggcatggagaagctgggcaagggcgactggcggggcatctccaggaactacgtcacgacgaggaccccgacgcaggtcgccagccatgcccagaagttcttcctcaggcagagcagcatggggaagaagaagcgccggtccagcctatttgacatggtaccgatctgtgagaacaattcgagcatctccgatccgccgggcagcgagggcgcctcgacttctctgtcgctgaacgtgccgcgccacgaacgcgcggagaggaggacgacggccttcgacctgaatttcacggaggacgacggcagggccgacgtgtcctcggcgtcaggtgcggggacccggccgctcccggcggagctgcagccttctcatcatggccctgctgggcacggccaccactgctctccgttggacctggagctgggcatgtccctgtccaccccatccgtcggaacatgacgcgcctagtcatcgtcatcctagtcatcgtcatggacacacgcatgtcgctccatgtttcaccagcgcaagttgccatggccaggtgtgctgttgtgtcagttcttgccagatggagtggaggcgctaggcaatattgttcgtgaaaaaacgttgtgcaagcagcactaactgtggataccgtaccttgtgtagtactataatcagaatcggttctgctcctgtatacactgcacattccttgttcatcattcccctgcgcgctaggcttcgaaaaaaaaaaaaaaaaaaaa

SEQ ID NO: 5746 - protein, 286 aa, Panicum virgatum
  misc_feature: Ceres CLONE 1825601
  misc_feature (1)..(48): Pfam Name: Myb_DNA-binding Pfam Description: Myb-like DNA-binding domain
MARKCSHCGNHGHNSRTCGLGHSRETMPRQGGDNGGGGVGGLRLFGVQVHAAGSGGAASMRKSYSMDCLQLAAPAGCSLVSPSSSSSSSLLLSIEEGLERAATNGYLSDGSARVVAERKKGVPWSEEEHRQFLAGMEKLGKGDWRGISRNYVTTRTPTQVASHAQKFFLRQSSMGKKKRRSSLFDMVPICENNSSISDPPGSEGASTSLSLNVPRHERAERRTTAFDLNFTEDDGRADVSSASGAGTRPLPAELQPSHHGPAGHGHHCSPLDLELGMSLSTPSVGT

SEQ ID NO: 5747 - DNA, 1448 bp, Panicum virgatum
  misc_feature: Ceres CLONE 1825624
  misc_feature: Encodes the peptide sequence at SEQ ID NO. 5748
acagataacagccttcttgcttgcttcagctggctagccggtagcgcccctcacggcctcactccaccggaattcccactccacctcacctcatcagggttctcgagttcttcaggtagctctggtctggtctggtctggtcaggtgactgcagctggtcgatcttgcctcagcagatcaagtgccatggaggaagactccagagggagagctccttccactccccaactgctaaacctcatccgaggcgagggagaatggaaggtggttagggaggcagcagatggagggagatcgtcaagaaccacaagctctgaagccgaggaggacacggagctggagctgaagctgaagctcggcctccctggtgtccaagaggaagagagaccagccggccccagagagaagatgcagcaagaacaggagagctgcacggcactctcccttggttgcttcccgtcacattcgaggctcgccgctagcactgctactgccacaggggcaaagagaggcttcttggcgaccgttggtgccaaggcagaaggttgtaatcagaggcaccaggacaggcaagggtgtggggacgagttaacattgggagatgaaaacatggcaggtgagaggaagaaagggtgctgtcccccatcgtcgtcgcatgactcggctgctgcgcctgtgcacagcagcagcagcaacccccaccaccaggggagaggtgctgttcatccagtggtcggttggcctccagtccgggccatcaggagaaacctcacaaatggtagttcatctaagcaatcccctgaccgacaaaacgatgaagctggtgacaaggcgaagctaacctgcaagaggagcccgcttgtcaaaataaacatggacggcatccccattggaaggaaaatagaccttgcagcatacgacaactttcagaagctgtcgtctgccgtccaggagttgttttctggctttcttgaagctcagaaggatttagactgcactaaaagtggagagcaaggaacggaagagaaactattttctgggttattggatggaagtggcgaatacactttagtttatgaaggcgatggagggagcaggataccaattggggacctaccttggaatgtatttatttctaccgctaagagactgagggtcatgaaaagttcagaacctccccatggcttgattaaaactacctcggggagggcagcagatcattaaaatgaggccagtcgtgcagccattggatcatgcaagctgtttcaatcaccggcttccttcagatgactctttttcgcttgtagagataaatctactaagataaatggtagcatattgcagatgcctgaatgcactgcatattttgtaatttccttgctatttctgatatagctatgcagcatgatctagtaggatttccttgccaaaaaaaaaaaaaaaaaaaa

SEQ ID NO: 5748 - protein, 345 aa, Panicum virgatum
  misc_feature: Ceres CLONE 1825624
  misc_feature (2)..(277): Pfam Name: AUX_IAA Pfam Description: AUX/IAA family
MEEDSRGRAPSTPQLLNLIRGEGEWKVVREAADGGRSSRTTSSEAEEDTELELKLKLGLPGVQEEERPAGPREKMQQEQESCTALSLGCFPSHSRLAASTATATGAKRGFLATVGAKAEGCNQRHQDRQGCGDELTLGDENMAGERKKGCCPPSSSHDSAAAPVHSSSSNPHHQGRGAVHPVVGWPPVRAIRRNLTNGSSSKQSPDRQNDEAGDKAKLTCKRSPLVKINMDGIPIGRKIDLAAYDNFQKLSSAVQELFSGFLEAQKDLDCTKSGEQGTEEKLFSGLLDGSGEYTLVYEGDGGSRIPIGDLPWNVFISTAKRLRVMKSSEPPHGLIKTTSGRAADH

SEQ ID NO: 5749 - DNA, 1075 bp, Panicum virgatum
  misc_feature: Ceres CLONE 1825638
  misc_feature: Encodes the peptide sequence at SEQ ID NO. 5750
agcttcccaaacactgcatcatccaccaaaccattccacctcctcctctgcttcctcttcttccttccccttcctcgttccccttctacatcagagaagagaaaccaacccaacaaggatcggaaggagtgccagccatgagcaaggactgcggcaaccacggcgaggacgacctccgccgctcgtgccggcgcctgctcgcgctcctcctgggcctggccctcatcgtcgccatcatcgcgctcatcgtctacctcgtcctccgccccacgcacccgcgcttcttcctgcaggacgcctccctccgccagctcgacctctccaacggctcctccaaccttctctccaccacgctccaggtcaccgtcgcctcccgcaaccccaacgaccgcgtcggcgtctactacgaccgcctcgacgtctacgcctcctacaagtaccagcagatcaccgtcgccgcctcgctcccgcccgtctaccagggccacggcgacgttgacgtctggtcgcccgtcctcgccggtcccaacgtccccttcgccccctacctcgccgccgcgctccagcaggactgccaggcgggctacctcatcctccaggtcaagatcgacggccgcgtccgctggaaggtcggcagctggatctccggccactaccacctcttcgtcacctgcccggccttcctcgtcaccaacggcggcaacggcgcgccgggggccagcggattcaagttccagaccaccacctcctgccgcgtcgaggtctagctagctaccaaggctttgctgctgccggggaggtaggtgtctgtcagtgtctgcctgtccatcatagcatgcagaagggggcaaaaacagaggccgcggaagcagagagatcttcttcttgatgctcagggtcagagcgatgcggaaataaccgatcaattcaatacgtaccagtgaagtgaatccatcaacgattctgctaccgctgctgctgcgtataaaaatgtaaaggatgtttcatttttctttcggtaggcttgattaatactataatagtagtacgatcagaaaaaaaaaaaaaaaaaaaa

SEQ ID NO: 5750 - protein, 209 aa, Panicum virgatum
  misc_feature: Ceres CLONE 1825638
  misc_feature: Great-hit functional homolog of the protein sequence given in SEQ ID NO 9244
  misc_feature: Useful for making plants with altered protein content
MSKDCGNHGEDDLRRSCRRLLALLLGLALIVAIIALIVYLVLRPTHPRFFLQDASLRQLDLSNGSSNLLSTTLQVTVASRNPNDRVGVYYDRLDVYASYKYQQITVAASLPPVYQGHGDVDVWSPVLAGPNVPFAPYLAAALQQDCQAGYLILQVKIDGRVRWKVGSWISGHYHLFVTCPAFLVTNGGNGAPGASGFKFQTTTSCRVEV

SEQ ID NO: 5751 - DNA, 1200 bp, Panicum virgatum
  misc_feature: Ceres CLONE 1825647
  misc_feature: Encodes the peptide sequence at SEQ ID NO. 5752
aaccgtccgtccccctcgcgttcgtgtgctttcagttcccactccctcctccctcctcgccgcccccgccctcctccctctccgccgcggacgggcgcgggcccaggcaggcaccgacggcgccgtcgcgcatgcaggaggcggtggccgcggccgcggccgagccgggccgccggccggcgcagcagcagcagttcgcgggcgtcgacctccgccggcccaagggctacgccgcgccggcggcgggccagcctgcggagggggatccctgcccgcggtgcgcgtcgcgggacaccaagttctgctactacaacaactacaacacctcgcagccgcgccacttctgcaagggctgccgccgctactggaccaagggcggcacgctgcgcaacgtccccgtcggcggcggcacccgcaagaagccctcgtcctcgccgccctcgtcctacgcggccgccgccaactccgacaagcccaggaagccgtccaagaagaagcgccgcgccgtcgccccgcccccggagcccgctccagccgccaccgccgccgccgccgctgcagcagccaccgacgcccccaagacggagacgatcgaggcgacgacggcgaccaccacgacgacggcgacaccggcgacgaccgaccccgcgagcgagatcaccacggagctcgtggtcccggcggcggcggaggaggaggactccctcgcccacctgctgcagccggacgtcgcgctggggctcggcatctccgaattcccggccgggaaggggctggacgcggagccggactcgttcgagtggcccgcggcgttcgacctgggcgcgtgctggggcagcgccgggttcgccgacccggaccccgccggcctgttcctcaacctcccgtgacggcggacactgcgtcgtgctccgggccgttctgcgcgccggctcctacgccggctgctcaggtgtgggttttgcgaccgacctgatcaacggttctcttctttgcagcttaactagtggtacatgataacatgctttggggtatatgatatgatcgtgacgacgacgacgaccttgattttagctttgtttttgggaggtcaactagtggctaactctacagctccggggtggtgtttcatctgtctatagactgagctttgtttgagcttcttcttaaatggttatgcacaagttcattttcttttgc

SEQ ID NO: 5752 - protein, 252 aa, Panicum virgatum
  misc_feature: Ceres CLONE 1825647
  misc_feature: Great-hit functional homolog of the protein sequence given in SEQ ID NO 9483
  misc_feature (4)..(62): Pfam Name: zf-Dof Pfam Description: Dof domain, zinc finger
  misc_feature: The sequence is a functional homolog of  SEQ ID NO 1967 in the  11/479,226 US patent application
  misc_feature: Useful for making plants with modulated nitrogen use efficiency
  misc_feature: Useful for making plants with modulated growth and phenotype characteristics
MQEAVAAAAAEPGRRPAQQQQFAGVDLRRPKGYAAPAAGQPAEGDPCPRCASRDTKFCYYNNYNTSQPRHFCKGCRRYWTKGGTLRNVPVGGGTRKKPSSSPPSSYAAAANSDKPRKPSKKKRRAVAPPPEPAPAATAAAAAAAATDAPKTETIEATTATTTTTATPATTDPASEITTELVVPAAAEEEDSLAHLLQPDVALGLGISEFPAGKGLDAEPDSFEWPAAFDLGACWGSAGFADPDPAGLFLNLP

SEQ ID NO: 5753 - DNA, 1340 bp, Panicum virgatum
  misc_feature: Ceres CLONE 1825668
  misc_feature: Encodes the peptide sequence at SEQ ID NO. 5754
aagatccgcccgccggcctctcttttctccggacgcgctgcttcgcgaagcacccctcccctcctcctcacatccgctccgctcccgtccttctctccaccgaccccctttccccaccgacatggccgccgcctcagccgcctccgagggattcgtcggcgcgcccgacgccctccccctcgacaaggcggcggcttcgggctccgggagcggcggcggcggcggcggcgaccgggtggtggattgcggggtctgcgcgatttgcctcgataagatcgcgctccaggagacggcccttgtcaagggatgcgaccacgcctactgcgtgacgtgcattttgaggtgggcatcctacaagcagacccctcaatgcccacagtgcaagcacccatttgaattcctcagcgtgcaccgttctcttgatggctgcctacatgactacctgtttgaggagagcgtttgccttctcctaagggccgcctggtttgaacctcttatcgtagaggctcatgaagaggctccggaagaagacgagatttacctccagtaccaatatgatgacgatgaagatgatcttgacgaggaatcttattacatgagcaggtccccaagcattcgtattggtaacaggaggtggggtgacaatgggtacatcagaggaggcaggagagaggccaggccagtaaatgctgatgctgctggtccatccaggaccccaaagaagaaagagagagctgcatctacgtcgggttcaggatcggggtcagtatccaaggatgcctctggaaggcgggcgaaaagggctcagaagcgggaagctgcagacaaggccgctgcagagaagcacctgaagcacctgcagaggatgggactcgtgaaagcacctgcacctgaagtgcccgcggaggtcggccctcaggtgaacgagtgatccaccagcagctgctgtatataaatggtgctgttagggaaactgcagcccttgggccactaaataatcttcctctgggaagaactggagcggtggccttgtatcatggcaacttggccgcattgtacagttgttttagtttgtcaacactctttagatccagcacacagaaaatgaactgctgtctgcaccacagttgcagctgtgtggttttatctcactcagaatctttttagattcgggtatattaggggattaaattgcaattaatgtgggcatctaagatagggtgttgcaaatcaggtgatgaaccaattgccgctgcaactgtgaactgtgtaaacagtctgtctggtgacatgttttattgatgtagtcggtgtcttgacaaaaaaaaaaaaaaaaaaaa

SEQ ID NO: 5754 - protein, 269 aa, Panicum virgatum
  misc_feature: Ceres CLONE 1825668
  misc_feature (1)..(43): Pfam Name: zf-C3HC4 Pfam Description: Zinc finger, C3HC4 type (RING finger)
MAAASAASEGFVGAPDALPLDKAAASGSGSGGGGGGDRVVDCGVCAICLDKIALQETALVKGCDHAYCVTCILRWASYKQTPQCPQCKHPFEFLSVHRSLDGCLHDYLFEESVCLLLRAAWFEPLIVEAHEEAPEEDEIYLQYQYDDDEDDLDEESYYMSRSPSIRIGNRRWGDNGYIRGGRREARPVNADAAGPSRTPKKKERAASTSGSGSGSVSKDASGRRAKRAQKREAADKAAAEKHLKHLQRMGLVKAPAPEVPAEVGPQVNE

SEQ ID NO: 5755 - DNA, 1680 bp, Panicum virgatum
  misc_feature: Ceres CLONE 1825706
  misc_feature: Encodes the peptide sequence at SEQ ID NO. 5756
actttctgccatgatgagaagaaaacgagcaaactcttcttccacgtcaagcgcgaaccattcagcgcaagccacagccaatccatctatctagctagagaaatcccggcccgcctccatggaatccgtcgccgtcgtgtcggtgccgttcccggcgcagggccacctgaaccagctcctgcacctgtcgttgcagctcgcggcgcgggggctgcccgtgcactacgcggcgccggcggagcacgtccgccaggcccgcgcgcgcgtgcacggctggggcgacgacgcgctccgccgcgtccagttccacgagctcgccatctccgagtacgtctcgccgccgccggatcccgccgcgggctcgcccttcccgtcgcacctcatacccctgtgggaggccttcaccgccagcgcgcccgccccggtcgcggcgctcctccaagaggcctccgcctcccaccgtcgcgtcgtggtcctgtacgacctcgtcaacggcttcgtcgccgaagaggctgcgcggttgcccaacggagaggggtacgcgctgcactgctccgccgtctcggccatcgtcgggcaggtggaagaagggggcaggcttctgcgcgagcgcgggctcgagtacctccccatcgacccctacctgacggaggagttcatggagtacctccacaaacggacgaggacggagcaatccatggttgtcggcgccggcttgctcgccaactcgtgccgcgcgctcgagggcgatttcatcgattttctagcccagcaaatggcggccggcggcaagaagttgttcgccatcgggccgttaaacccgctgctggacgcgggcgcgcccgagcagagcagcagaagccggcacgggtgcctccgatggctcaacgaacagccgccggcatccgtgctctacgtgtcgtttggctccatgtcctcgctgcgcggcgaacaaatcgaagagctcgcggcggcgctgcgcggcagcaaccagcgcttcatctgggtcctccgcgacgccgaccgtgccaacgtgttcgcggacgatggcgagagccggcacgccaggctgctcgccgagttcaccaagcagatcgatggcagagggttggtgatcaccgggtgggcgccgcagctggatatcctggctcaccctgtcacggcggcgtttgtgagccactgcgggtggaactcgacgatggagagcatcagccacgggaagcccatcctggcgtggcccatgcactccgaccagccctgggacgcggagctcgtgtgcaagtacctcaagaccggcttcctggtgaggccatgggagaagcacgccgaggtgattccggcggcgaccatacagcaggtgatcgagaggatgatggtctctgaggaagggttcgcggtgcggcagcgtgcagtggcgctcggtgaggccgtccgtgcgtccgcggttgcgggcgggtcatcccaaaatgaccttgaggacttcattgctcacatcacaaggtaagaggtccaagaatgcaggaccaattggtgtatcaatctgaatttcagttctattttcttcccgaaaagaagctgtattgtgttttctacaagtggttagtaggaaaaaaaatggattgtaccgaataaaattgagctcccgggacccggtttcaaacaaaaaaaaaaaaaaaaaaa

SEQ ID NO: 5756 - protein, 461 aa, Panicum virgatum
  misc_feature: Ceres CLONE 1825706
  misc_feature (2)..(138): Pfam Name: UDPGT Pfam Description: UDP-glucoronosyl and UDP-glucosyl transferase
  misc_feature (1)..(461): SWISSPROT Homolog: EC 2.4.1.215 Cis-zeatin O-glucosyltransferase 1
  misc_feature (1)..(461): SWISSPROT Homolog: EC 2.4.1.215 Cis-zeatin O-glucosyltransferase 2
MESVAVVSVPFPAQGHLNQLLHLSLQLAARGLPVHYAAPAEHVRQARARVHGWGDDALRRVQFHELAISEYVSPPPDPAAGSPFPSHLIPLWEAFTASAPAPVAALLQEASASHRRVVVLYDLVNGFVAEEAARLPNGEGYALHCSAVSAIVGQVEEGGRLLRERGLEYLPIDPYLTEEFMEYLHKRTRTEQSMVVGAGLLANSCRALEGDFIDFLAQQMAAGGKKLFAIGPLNPLLDAGAPEQSSRSRHGCLRWLNEQPPASVLYVSFGSMSSLRGEQIEELAAALRGSNQRFIWVLRDADRANVFADDGESRHARLLAEFTKQIDGRGLVITGWAPQLDILAHPVTAAFVSHCGWNSTMESISHGKPILAWPMHSDQPWDAELVCKYLKTGFLVRPWEKHAEVIPAATIQQVIERMMVSEEGFAVRQRAVALGEAVRASAVAGGSSQNDLEDFIAHITR

SEQ ID NO: 5757 - DNA, 1857 bp, Panicum virgatum
  misc_feature: Ceres CLONE 1825796
  misc_feature: Encodes the peptide sequence at SEQ ID NO. 5758
gtttccgtttgatttgattattacttcctcttaattatttctgggctgccatgtatatatcccttctcccctactttgttcttcttcttcttaagaaggctgtgcttggccctcctccttccgccctcccccatcacaaccgcctccacaacaacaagggatcggacagcaaggggtggatcgatcgatcgaccgagccccgcgccaccaggccaccaccaacataaccggctggtggtactggtagagaccagtaggaagggcggccaggccagcatgaagggcggcgacgtgagcagcattagcccgctggtctccttcgtcctcggcgccgccatggccaccgtctgcgtcctcttcttcatgtccgccagccccacacgccgcctcgccgacatctccgccttctcctccggaaacgccaccagcagcgacctccgcctcgcctcctccgactccgacaacggggtggtcgccgacggcgacgtcgaggtcaccgccacccccgcgccggcgccggcgccggtccaggcggcgtcgccgtggggcgaccttgaggaggtgctccggcgcgcggcgaccaaggaccggacggtgatcatgacgcagatcaacgcggcgtggacgcgcccgggctccctgctggacctcttcttcgagagcttccgcagcggggagggcggcgtggcgcggctgctggagcacctggtgatcgtgaccatggacccggccgcgtaccagggctgccaggccgtgcaccgccactgctacttcctccgcacctccaacggcgtcgactaccgctccgagaagatgttcatgagcaaggactacctcgagatgatgtggggccgcaaccgcttccagcagaccgtcctcgagctaggatacaacttcctcttcacggacgttgacgtgatgtggttccgtgaccctttccgccacatctccatggcggcggacatcgccatttccagcgacgtgtacatgggcgacccctacagcctgcgcaacttccccaacggcggcttcctcttcgtgcggtcgtcggccaagaccatcgacttctaccgcgcgtggcagcaggggcggtggcgcttcttcgggaagcacgagcaggacgtgttcaacctcatcaagcacgacatggccgccaagctcgacctcgccatccagttcctcgacaccacctacatcagcggcttctgccagctcagcaaggacctcaacaagatctgcacgctccacgccaactgctgcgtcggcctcggcgccaagctccacgacctccggggggtcctcgacgtctggaggaactacacagccggcacgccccaagaccgacgcgccggcaagttccaatggaagctcccaggaatctgcatccactgaatatcagatcgatcgatctcatcctttgctagctagctacctaggaatatttctaggtccgatcgatgtggtaatccattattcgtttcgatcgagatcggccgcgccggccggtgcactacgtacgattgtgcacggcgatgccggccagcagctagcgcatgaattcaggtggctgcctggcttcttgcattgtccattctttctctgctgcttcttatttctttgagtttatataatttattgaggagatttcttcaagccatcggagctgctgggtagctaggtttcattcttttgatttctgatgatgaaaggcaggctagaggtagaaccgagacatatgtactgttaagttatactgctgctgcaccctccttattaattattatgtatgtatgactgtaatgtacccaacacaggttaattatatacaatattaattaaaaaaaaaaaaaaaaaaaa

SEQ ID NO: 5758 - protein, 371 aa, Panicum virgatum
  misc_feature: Ceres CLONE 1825796
  misc_feature: Great-hit functional homolog of the protein sequence given in SEQ ID NO 9753
  misc_feature: Useful for making plants with modulated biomass
  misc_feature: The plant is abnormally small.
MKGGDVSSISPLVSFVLGAAMATVCVLFFMSASPTRRLADISAFSSGNATSSDLRLASSDSDNGVVADGDVEVTATPAPAPAPVQAASPWGDLEEVLRRAATKDRTVIMTQINAAWTRPGSLLDLFFESFRSGEGGVARLLEHLVIVTMDPAAYQGCQAVHRHCYFLRTSNGVDYRSEKMFMSKDYLEMMWGRNRFQQTVLELGYNFLFTDVDVMWFRDPFRHISMAADIAISSDVYMGDPYSLRNFPNGGFLFVRSSAKTIDFYRAWQQGRWRFFGKHEQDVFNLIKHDMAAKLDLAIQFLDTTYISGFCQLSKDLNKICTLHANCCVGLGAKLHDLRGVLDVWRNYTAGTPQDRRAGKFQWKLPGICIH

SEQ ID NO: 5759 - DNA, 1564 bp, Panicum virgatum
  misc_feature: Ceres CLONE 1825888
  misc_feature: Encodes the peptide sequence at SEQ ID NO. 5760
acacagataggtagtgtagtggagcactgcactctgccgagccatcggccatgacgccgccaccagcgccagccatggccgcggagagcgacgctgtccacggcgggcggcgccggcacgtgctcctgttcccgctcccgtaccagggccacatcaaccccatgttccggctcgctggcctcctccacgcgcgcggcttctccgtcaccgtcttccacacccacttcaacgcgccggacccggcgcgccacccgcagtaccgcttcgtccccgtccccgacggcacgtccggccctgcgcccgccgccatcgaggacgtcatcgcccagatcctcgcgctcggcgccgcgtgcgagtccgggttccgggaccgcctcgccgccgtcctggaggagtactcccgggacgccgtcgcgtgcctcattgccgacgcgcacctgctgccgatcttcgaggtgaccgcgaagctcgccgtgcccacgctggcgctgcgcaccggcagcgccgcctgctttgcgtgcttcctcgcgtacccgatgctcttcgagaaaggctacctccccgtgaaaggcatgtcctctgatcctgcgcccgtacgacagtcgcagcgtgacatgccggtgagcgagctgccaccgtaccgagtgcgtgacctgatggtgtttctcggcgacgaggaccgcggcagtttgcgcgagcttctggcccgcgccgtgacggccgtgaaggtctcctcgggcctcatactcaacacgttcgacgcgctcgagcggcgcgagctggagggcctccggtgggacctcaccgtgccggtgttcgacatcggcccgctccacaagttctccccggccggcgatagcagcctgctgcgccaggaccggagctgcctggactggctggacgcgcggccgccggcgtcagcgctctacgtgagcttcggcagcctagcctgcatgagcccgcgggacctggtggagacggcgtggggcatcgccggcagcggcgtgccgttcctctgggtggtccggccgggcatggtccgcgggtcggcgcaccaagagcaagagctccccgaggggttcgaggccgcgacgcgcgggcgcgggatggtggtggcgtgggcgccgcaggaggaggtgctgcgccaccgcgccgagggcggcttctggacgcacaacgggtggaactcgacgacggagagcgtgtgcgagggggtgccgatgctgtgctgcccctacttcggcgaccagatggggaacgcgaggtacgtggagcacgtgtggagggtgggtttcgaggtgggcggcgagctcgagaggggcgccgtcgaggcggcgatccgccggctgataaccggcaaggacggcgcggagatgagggcgagggccggcgagctgaagaaggcggcggaggagtgcatcggcaagggcgggtcgtcgtgcctggccattgataagctgatcgcgcacatgacgtccctgtaaaattagcttcttgtccctctgtcatcatgcttgaggttttcgtgtctgaactcggtaatcagttgaaactcttttcggtg

SEQ ID NO: 5760 - protein, 477 aa, Panicum virgatum
  misc_feature: Ceres CLONE 1825888
  misc_feature (1)..(162): Pfam Name: UDPGT Pfam Description: UDP-glucoronosyl and UDP-glucosyl transferase
MTPPPAPAMAAESDAVHGGRRRHVLLFPLPYQGHINPMFRLAGLLHARGFSVTVFHTHFNAPDPARHPQYRFVPVPDGTSGPAPAAIEDVIAQILALGAACESGFRDRLAAVLEEYSRDAVACLIADAHLLPIFEVTAKLAVPTLALRTGSAACFACFLAYPMLFEKGYLPVKGMSSDPAPVRQSQRDMPVSELPPYRVRDLMVFLGDEDRGSLRELLARAVTAVKVSSGLILNTFDALERRELEGLRWDLTVPVFDIGPLHKFSPAGDSSLLRQDRSCLDWLDARPPASALYVSFGSLACMSPRDLVETAWGIAGSGVPFLWVVRPGMVRGSAHQEQELPEGFEAATRGRGMVVAWAPQEEVLRHRAEGGFWTHNGWNSTTESVCEGVPMLCCPYFGDQMGNARYVEHVWRVGFEVGGELERGAVEAAIRRLITGKDGAEMRARAGELKKAAEECIGKGGSSCLAIDKLIAHMTSL

SEQ ID NO: 5761 - DNA, 1160 bp, Panicum virgatum
  misc_feature: Ceres CLONE 1826037
  misc_feature: Encodes the peptide sequence at SEQ ID NO. 5762
aaaaattttccaacccagcgcttaaaattccctccacacccaaatcacgtgacggggtctccgcccggacaagtcacgatgctgctccacccggcgtgcgaggcggcgtccctggacagcatccggcaccacctcctggacgagccgccggcggcgagcgcgagcgcggggccgcggccggtgtactgccgcagcacgagcttcggcagcctggtggcggaccagtggagcgagtcgctcccgttccgccccgacgacgccgacgacatggtcgtcttcggcgcgctctgggacgccttctcccggggctggctccccgacggctccttcgccgccgtcaagcccgagcccccggcgtccccggactccccctacgagttcggctcttgcctcggcggccgcctcctcctcgcgtcgcccgaggacgaggagttgcccgagacgccgacggccgaggcggcgtcggccgcgatgacgcccgggggcggcgaggaggccgcggcggtgggmagggggaagcactaccgcggggtgaggcagcggccstggggcaagttcgccgcggagatccgggacccggccaggaacggcgcgcgcgtgtggctcggcacctacgacagcgccgaggacgccgccgtggcgtacgaccgcgccgcctaccgcatgcgcgggtcccgcgcgctcctcaacttcccgctccgcatcggctccgagatcgccgccgcggcggcggccgcggccaccgctcccgccgtgggagagaagcggccgtcacccgagccgcccgcgagctccgactcttcctccccctcgacgtcctcctcctcgtccgggactcccaagcggaggaagagaggcgaggccgcggccgcgaccatggccatggccctggtgccgccggcgcagcctcccgtccagctgaccctcccggcccacccgtggttcgccgccggcccggtccagcagctagtgagctaagtggcgatgtactgatgttagtatcagtcgatcttcctcgcgagaaaattggctgcttgatgaatcgagccgagtgcaagaacagagcaacaagaagaggcttcycwyccayccacactgctccaagaaakgcgtggcakggaacctgycgccaakggaaycaggggkgctcaagkgaaacc

SEQ ID NO: 5762 - protein, 299 aa, Panicum virgatum
  misc_feature: Ceres CLONE 1826037
  misc_feature (1)..(66): Pfam Name: AP2 Pfam Description: AP2 domain
  misc_feature: The sequence is a functional homolog of  SEQ ID NO 1000 in the  10/412,699 US patent application
  misc_feature: The sequence is a functional homolog of  SEQ ID NO 501 in the  10/374,780 US patent application
  misc_feature: Useful for making plants with modulated growth and phenotype characteristics
MLLHPACEAASLDSIRHHLLDEPPAASASAGPRPVYCRSTSFGSLVADQWSESLPFRPDDADDMVVFGALWDAFSRGWLPDGSFAAVKPEPPASPDSPYEFGSCLGGRLLLASPEDEELPETPTAEAASAAMTPGGGEEAAAVGRGKHYRGVRQRPWGKFAAEIRDPARNGARVWLGTYDSAEDAAVAYDRAAYRMRGSRALLNFPLRIGSEIAAAAAAAATAPAVGEKRPSPEPPASSDSSSPSTSSSSSGTPKRRKRGEAAAATMAMALVPPAQPPVQLTLPAHPWFAAGPVQQLVS

SEQ ID NO: 5763 - DNA, 1156 bp, Panicum virgatum
  misc_feature: Ceres CLONE 1826085
  misc_feature: Encodes the peptide sequence at SEQ ID NO. 5764
ggcactccaccctcggcgacgacggatcacgaaacacttgaagaagaaagcagcaggcagcaacgcaatggcttggttcgcatcgacggcagccgttccgagctgcggcgccggggcccggcgcggcggccggtgcggggcccgcgcgtccgcggtggcgatggcgccggggacggcgaggacgcactacgaggtgctcggggtcggggccggggcgagcaggggcgagatcaaggcggcgtaccggcgcctggccagggaggtgcacccggacgccggcggctgcggcggcgacgagggcttcatccagctgcacgccgcctacgccacgctcgcggaccccgacgagcgcgcgcggtacgaccgctcggtggcgcggcccgcggcccgcggggcggcgccggcggggttccggccgcggaggtgggagaccgaccagtgctggtagggacacagctgcgcctgcccgttgcgccgcgacctacgctgccacccacctccgccgctccatccgtggccggcggtgaagtcgccggccggccggcccatcccatcatgttggtggaggaaaggggaagggcccacgtggcccacttcgacagcgggtcgcgactattctccgcgacccactgggccgatccgcgatcagcccccggcccacgagttggatcggggacgacgcggcggcgcggcggcggaggtcactgcactgacctgaccagggcggaggatgggcccagggagcaggggagctcctctctcttcgtagcttgtccccccctgttacacgaagagaggcatttttataacatctcttgtgtacttacttgatcaccttgtaaatatggataatctgtgtgaatataaattctcgtcttggacggtaaactatccaagtaggcaagaaacggtaataatttccaagggtttcaaaagtgattgtgaggattttggttaaagacaggcaagtcaaccaatgctaatcctgcctgtttagcagtcatgttcttgctctcgtggctctgcacacttgttgctcgctcgcgctcactcgagagttcagtagctgtgacatgacaagggtcccaagctagcagaacaccaccacaagttctctcacaaggcaggagtcgctgccccaaaaaattcagttgcc

SEQ ID NO: 5764 - protein, 126 aa, Panicum virgatum
  misc_feature: Ceres CLONE 1826085
  misc_feature (1)..(61): Pfam Name: DnaJ Pfam Description: DnaJ domain
MAWFASTAAVPSCGAGARRGGRCGARASAVAMAPGTARTHYEVLGVGAGASRGEIKAAYRRLAREVHPDAGGCGGDEGFIQLHAAYATLADPDERARYDRSVARPAARGAAPAGFRPRRWETDQCW

SEQ ID NO: 5765 - DNA, 1391 bp, Panicum virgatum
  misc_feature: Ceres CLONE 1826126
  misc_feature: Encodes the peptide sequence at SEQ ID NO. 5766
gcaactcaccaagcaaaacactcgagctgagctcatctcctagctcagagcctcttccgagcttccactacaagtgcttagctcagaagcagcagcaagtgagaagcttgcggcagtagcaatggccaagtcctacaccttactgttcggtgcagtggtcgtgctcgcgcttctagtgagccccattgcttgcacccgcaagctcgccaagccaaacaggcacaggcggccgacgcacaggccggcggtcagggcccgcagcaaccacacggctaccccctcggcctcctacgcctacggctccggcggctggctgtccgccggcgcgacgtactacggcgcccccaacggcgacggcagcgacggcggcgcatgcggctaccagaccgccgtcgggcagcggcccttctcgtcgatgatcgccgccgggagcccgtcgctgttcaagggcggcaaggggtgcggcgcctgttacgaggttaaatgcaacagcaacccggcgtgctcagggcagccggccaccgtggtcatcaccgacgagtgccccggtggggtatgcctcgccgaggccgcccacttcgacatgagcggcacctccatgggcgccatggcgaagcccggcatggccgacaggctccgcgccgccggaatcctcaaggtccagtacaagagggtgccgtgcaagtacagcggcgtgaacatcgcgttccgggtggaccagggctccaacccgttctacttggaggtgctggtggagttcgaggacggcgacggcgacctcagcgccgtcgacctgatggaggccgggtgcggcacctggacgccgatggtgcagaactggggcgcgctgtggcgctacaactccgacaccggcaaggcgctgagggcgcccttctcgctccggctcgcctccgactccggcaaggtcctcgtcgccaacaacgtcatccccgccggctggaaggccggagccacgtaccgctccttggtgaactactcctaaattactgctcgtcccagattaagtgttgtgaactggacaggactgtgtgtttgtcggggagtcggggtgtttgcgagaggcggtgtcagtcagaagaggaggaggagaagcaggttaaagaatcgtgttctttccctccctccaccggtctctgcagcccccggtgatgcgcgctgccgtgtactagtcgttgtgtctatttctctgtacgtgtttttcttttcttttttcttcctctaagttgtgaattgtgatgttgaggagagaagcttagcttgagctgcgactaatgttgcatgctggtgtatcagctatgaagaaaacaagaagaaatgaattgctgtaattcatcccaattacagtactccaaaaaaaaaaaaaaaaaaaa

SEQ ID NO: 5766 - protein, 293 aa, Panicum virgatum
  misc_feature: Ceres CLONE 1826126
  misc_feature: Great-hit functional homolog of the protein sequence encoded by LOCUS At2g45110
  misc_feature: Useful for making plants with altered cell wall content and/or composition
MAKSYTLLFGAVVVLALLVSPIACTRKLAKPNRHRRPTHRPAVRARSNHTATPSASYAYGSGGWLSAGATYYGAPNGDGSDGGACGYQTAVGQRPFSSMIAAGSPSLFKGGKGCGACYEVKCNSNPACSGQPATVVITDECPGGVCLAEAAHFDMSGTSMGAMAKPGMADRLRAAGILKVQYKRVPCKYSGVNIAFRVDQGSNPFYLEVLVEFEDGDGDLSAVDLMEAGCGTWTPMVQNWGALWRYNSDTGKALRAPFSLRLASDSGKVLVANNVIPAGWKAGATYRSLVNYS

SEQ ID NO: 5767 - DNA, 1407 bp, Panicum virgatum
  misc_feature: Ceres CLONE 1826140
  misc_feature: Encodes the peptide sequence at SEQ ID NO. 5768
acacagatcatactctcaacctgtgcagcagcacaagagattcagagagagaggtgtccctgtcattagagtctctgctcgtgctcggccttgccagaggaggaagaggagaggaaggccatctccgtcgtcgccatggctcagctcgccgatctcatcaaccttgacctctccgactgcaccgagaagatcatcgccgagtacatctgggttggcggctctgggatggatgtgaggagcaaagccaggacgctgtccggacctgtggatgatcctagcaagcttccgaaatggaacttcgacggctccagcacaggccaggctacgggtgacgacagtgaagtcatcctttgtccccaagccatcttcagggacccgttcaggaaggggaagaacatactggttatgtgcgactgctatgcgccgaacggggagccgattccgaccaacaagcggcacggggcggcgaagatcttcagccagcctgatgtcaaggctgaagaaccatggtttgggattgagcaggagtacacccttcttgagaaggacaccaactggcctcttggctggccattaggcggctaccctggccctcagggaccttactactgcgccgccggagcggacaaatcgtacgggcgggacatcgtggacgcgcactacaaggcctgcctctacgccggcatcgacatcagcgggatcaacggggaggtcatgccagggcagtgggagttccaggtcggccccgccgtcggcatctacgccggcgaccaggtctgggtggcccgctacattctcgagaggattaccgagatcgccggcgtggtcgtctccttcgatcccaagccgattccgggagattggaatggcgctggtgctcacactaactatagcaccaagtcgatgaggagcgagggcgggtacgaggtgatcaagaaggcgatccagaagctgggcctccggcaccgggagcacatcgccgcgtacggggacggcaacgagcgccgcctcaccggccgccacgagactgccgacatcaacaccttcatctggggtgtcgccaaccgcggcgcgtcggtgcgggtcggccgcgacaccgagaaggaaggcaaaggctacttcgaggaccggaggccggcgtccaacatggacccgtacgtggtgacctcgctgatcgcggagaccaccatcctgtggaagcccagccattccaacggcaacggcgtcgcggcaccttgatggttcttcccggatcctgcggaggggccacgggtttctccgacccgagtgtgtgcgtgtgagccgcgctgcggagatggcaactgagacggatgctgtcagacaatttcagatgacaataataaactgccgtgtgctccttctcgtcaaaaaagaaaaaaaaaaaaa

SEQ ID NO: 5768 - protein, 367 aa, Panicum virgatum
  misc_feature: Ceres CLONE 1826140
  misc_feature (1)..(253): Pfam Name: Gln-synt_C Pfam Description: Glutamine synthetase, catalytic domain
  misc_feature (1)..(367): SWISSPROT Homolog: EC 6.3.1.2 Glutamine synthetase root isozyme 2
  misc_feature (4)..(363): SWISSPROT Homolog: EC 6.3.1.2 Glutamine synthetase cytosolic isozyme 1-3
MAQLADLINLDLSDCTEKIIAEYIWVGGSGMDVRSKARTLSGPVDDPSKLPKWNFDGSSTGQATGDDSEVILCPQAIFRDPFRKGKNILVMCDCYAPNGEPIPTNKRHGAAKIFSQPDVKAEEPWFGIEQEYTLLEKDTNWPLGWPLGGYPGPQGPYYCAAGADKSYGRDIVDAHYKACLYAGIDISGINGEVMPGQWEFQVGPAVGIYAGDQVWVARYILERITEIAGVVVSFDPKPIPGDWNGAGAHTNYSTKSMRSEGGYEVIKKAIQKLGLRHREHIAAYGDGNERRLTGRHETADINTFIWGVANRGASVRVGRDTEKEGKGYFEDRRPASNMDPYVVTSLIAETTILWKPSHSNGNGVAAP

SEQ ID NO: 5769 - DNA, 1604 bp, Panicum virgatum
  misc_feature: Ceres CLONE 1826150
  misc_feature: Encodes the peptide sequence at SEQ ID NO. 5770
agcgaatccaaggagaccgaagagctccctctccctccacaaagggaacgagaagtagcagcctaatcgcgctaggctagctagccacacgatcggccatgtcgtcctcccccgacttctcccgcgtgctcccccgcgtgctcatcgtctcccgccgcaccgtccgcaagaacaagttcgtcgacttcgtcggagagtaccacctggacctcatcgtgggctacggcgcggtgccggtgatcgtgccgcgcgtggccggcgtgcacacgctgctggactcgttcgagcccatccacggcgtgctcctctgcgagggcgaggacatcgacccctcgctctacgagtcggccgccgacgccggcgccggcgcgctctcgccagagcagctcgaggccgtgcggcgcctgcacccgagcgacgccgccgtcgaccacgagaaggactccatcgagctccgcctcgcgcgccgctgcctcgagcgcaacatcccgtacctcggcatctgccgcggctcgcaggtgctcaacgtcgcctgcggcggctcgctctaccaggacgtcgagcacgagctcggccccgcggccgccgccgtccggcacatcaactacgacgactacgacggccaccgccacccggtgcgcgtcctgcccggcacgccgctgcacgagtggttcgcgggcgacctcgccgacgggggcgaggacgacggcgcgcaggcgcagcagctgatggtgaacagctaccaccaccagggcgtgcggcggctggcgcagcggttcgtgccgatggcgttcgcgccggacggcctggtcgaggggttctacgaccccgacgcgtacaaccccggcgagggtaagttcatcatgggccttcagttccacccggagcgcatgcgcaagccgggctccgacgagttcgactaccccgggtgcgccagggcctaccaggagttcgtccgcgccgtggtcgcgtaccaggagaagcaggtggccgccgccgcggcgccccggagcgccctccccgcgtcgccaaagctgaacaaggagatggagcggcggcgcaaggtcatcttccggagcttctcgctcgccaaggacatgtatatctccggcggccgcaccgagacgaagccggcggagcagcgcgacctcgacgccggcgccgagttcctcgagtcgaacacggcgtcgctgagcgtgcagcaggagaagcggctgaagcagatgggcgcgactgtgcggaacgcgtcggggtacctcaacagcctgaagctgaacgacgggcgggaggcggcggcgcgggcgctcatggcggagatgacggtgggccagctctcggaccttgcctccttctaccagaccatgggcaggatctgctccgaggtgctcgacgcgaagctgcagcgctgcacctgcacgagtgaagactccgtcgagcattcgatcgagcgtgtccgtgccagcacctgggggcttgttttacgccctcatgttattattagcgtgaaaatttgagtgtctaggcaagtgtttattggttaattactacgagtattctagtataatgttattgccatgatgtttgaaaaaaaaaaaaaaaaaaaa

SEQ ID NO: 5770 - protein, 471 aa, Panicum virgatum
  misc_feature: Ceres CLONE 1826150
  misc_feature (1)..(244): Pfam Name: Peptidase_C26 Pfam Description: Peptidase C26
MSSSPDFSRVLPRVLIVSRRTVRKNKFVDFVGEYHLDLIVGYGAVPVIVPRVAGVHTLLDSFEPIHGVLLCEGEDIDPSLYESAADAGAGALSPEQLEAVRRLHPSDAAVDHEKDSIELRLARRCLERNIPYLGICRGSQVLNVACGGSLYQDVEHELGPAAAAVRHINYDDYDGHRHPVRVLPGTPLHEWFAGDLADGGEDDGAQAQQLMVNSYHHQGVRRLAQRFVPMAFAPDGLVEGFYDPDAYNPGEGKFIMGLQFHPERMRKPGSDEFDYPGCARAYQEFVRAVVAYQEKQVAAAAAPRSALPASPKLNKEMERRRKVIFRSFSLAKDMYISGGRTETKPAEQRDLDAGAEFLESNTASLSVQQEKRLKQMGATVRNASGYLNSLKLNDGREAAARALMAEMTVGQLSDLASFYQTMGRICSEVLDAKLQRCTCTSEDSVEHSIERVRASTWGLVLRPHVIISVKI

SEQ ID NO: 5771 - DNA, 1660 bp, Panicum virgatum
  misc_feature: Ceres CLONE 1826160
  misc_feature: Encodes the peptide sequence at SEQ ID NO. 5772
gtgaagccgtctgtgctgcctcatttacagccaccgtccaactccaacccatcatcctctcttcctcccctcttcccttccatttctctcctcttccaccaaacccaaccagaggaattccccaaaaaaattccagagaccaaaccctcgaatcctccgagccctcgagaatcagcccgaatttcctctccgctgcgtcgcgatccggcttgatcccatggagcgcgtcttctccgtggaggagatccccaacccctactgggccccgccgcagccccaagtggcggcaaccggcgctgttgctgcgccaggaggcggtggcggaggaggagcggggggagcgggggacgcggcgggcgcgatgaaccggtgctcgtcggagtggtacttccagaagttcctggaggaggccgtgctcgacagcccggggcccgtggcgggcgtggggaggggcggcggtggaggtggagttgaggcggcggagagcaagccgctgggggtcgcggcggcggcctcgagcgcggttgttgacccggtggagtacaacgcgatgctgaagcagaagctggagaaggacttagctgccgtcgccatgtggagggtctctggtgcgacgcctccagaacgttctgcagctggttcgtccttgccaaatgtggatgtttcacatgcagtcgcctttaaacccattggagttgaaaacaagctagctgtcgctccagttgggggatcaggtccacaggtggtacaaaattctgatatcctatttaagcaaaccactagttcttcctcacgagagcaatcagacgatgatgacatggaaggagaagctgagactactggaaatgcaaaccctgttcaacagaggctgcagagaaggaagcaatccaaccgagaatcagctaggcgttcaagaagcagaaaggcagctcacttgaatgaactggaggcacaggtagcacagctaagagttgaaaactcttcactgttaaggcgccttgcagatgttaatcagaagtttaatgaggctgctgttgacaatagggtgctaaaggcagacgttggaaccttaagagcaaaggtgaagatggcagaggactcggtgaagcgggtgacaggcatgaacgctttgttccctgccggatctgatatgtcatccctcagcctgccattcaacggctccccatctgactccacctccgacgctgctgtccccatccaagatgacccgaacagttactttgctagtccaagtgagattggaggtaacaacggttacatgccagagatggcttcctcggctcaagaggatgacgattttgtcaacgcagccctggctgctggcaagatggacagaacagcctcactgcagcgggtggcgagcctggagcacctccagaagaggatgtgcggagggccagcttcatctgggtcaacctcctagacgtatgctccattgggataatttgacaatttcaacatacattgtagtggacattgatgttgatttgttcgttgtggacatatatggtcaactggtcattgacttattgtactcatgctgctgctgttcttgaaacgcaatagtgtttgccatgctcggtcatgtggactttgcttcgcaagttcagttttgacccaaaaaaaaaaaaaaaaaaaa

SEQ ID NO: 5772 - protein, 408 aa, Panicum virgatum
  misc_feature: Ceres CLONE 1826160
  misc_feature: Great-hit functional homolog of the protein sequence given in SEQ ID NO 9576
  misc_feature: Great-hit functional homolog of the protein sequence given in SEQ ID NO 9664
  misc_feature (1)..(55): Pfam Name: bZIP_2 Pfam Description: Basic region leucine zipper
  misc_feature (1)..(65): Pfam Name: bZIP_1 Pfam Description: bZIP transcription factor
  misc_feature: The sequence is a functional homolog of  SEQ ID NO 1232 in the  10/412,699 US patent application
  misc_feature: The sequence is a functional homolog of  SEQ ID NO 812 in the  10/412,699 US patent application
  misc_feature: The sequence is a functional homolog of  SEQ ID NO 926 in the  10/374,780 US patent application
  misc_feature: Useful for making plants with altered alkaloid content
  misc_feature: Useful for making plants with altered terpenoid content
  misc_feature: Useful for making plants with modulated endosperm cell number
  misc_feature: Useful for making plants with modulated endosperm size
  misc_feature: Useful for making plants with modulated growth and phenotype characteristics
MERVFSVEEIPNPYWAPPQPQVAATGAVAAPGGGGGGGAGGAGDAAGAMNRCSSEWYFQKFLEEAVLDSPGPVAGVGRGGGGGGVEAAESKPLGVAAAASSAVVDPVEYNAMLKQKLEKDLAAVAMWRVSGATPPERSAAGSSLPNVDVSHAVAFKPIGVENKLAVAPVGGSGPQVVQNSDILFKQTTSSSSREQSDDDDMEGEAETTGNANPVQQRLQRRKQSNRESARRSRSRKAAHLNELEAQVAQLRVENSSLLRRLADVNQKFNEAAVDNRVLKADVGTLRAKVKMAEDSVKRVTGMNALFPAGSDMSSLSLPFNGSPSDSTSDAAVPIQDDPNSYFASPSEIGGNNGYMPEMASSAQEDDDFVNAALAAGKMDRTASLQRVASLEHLQKRMCGGPASSGSTS

SEQ ID NO: 5773 - DNA, 1048 bp, Panicum virgatum
  misc_feature: Ceres CLONE 1826170
  misc_feature: Encodes the peptide sequence at SEQ ID NO. 5774
acagcaggcagaacaacacagagccaaaacacaccccccgatcctcatcctctgcgtgcacggtgcatctcgtcgagcacagaaccgaaagctagctagagctgccaatggcgggagcgggagccgcagccagcgacgagctgaaggtgctgggcgtgtggccgagcccgttcgtgatccctgtccgcatcgcgctcaacatgaaaggcctgtcctacgagtacgtggaggaggacctgtacaacaagagcttgctcctcgtgggctccaacccggtgcacaagaaagtgccggtgctcctccacggcggccgcgccatcaacgagtcccagatcatcctgcagtacatcgacgagttgtgggcggggacgccggcgctgctgccgtcggacccctacgagcgcgcgacggcgcggttctgggcggcgtacatcgacgacaaggtgaggtcggcgtgggtcgtgatggtgttcaggtataagaacaaggacgagtgggcggagggcgtggcgcgcgccggcgaggcgctcgacaccctggagggcgccttcagggactgctccaaggggaagcctttcttcggcggcgacggcatcggcttcgtggacctcgtgctcggcgggtacctggggtggttcggcgccttcggcaagattatcgggcgcaggttgattgatccggccaagacgccgctgctggccgcgtgggaggaccggttccgcgccgccgacgtcgccaagggcgtcgtgcccgacgacgtcgacaaggtgctcgcgtaccagcaggtcctgcttgctcggtagtgtgttgtgtactcctccaagtgagatcacgtttcgtcgcgttacgtgtgtgtacgatcgtcctacgatgagcgagcctcgatcccttctgtcactcagttttgctttcttccgtcaattaataatcgatcggtggtgtgctcaataaataaatgtatactacagtagtacctgaaacaagggctgcttattgtaactgttcagtttcttgaaacttatattaacaaaaaaaaaaaaaaaaaaaa

SEQ ID NO: 5774 - protein, 231 aa, Panicum virgatum
  misc_feature: Ceres CLONE 1826170
  misc_feature (1)..(74): Pfam Name: GST_N Pfam Description: Glutathione S-transferase, N-terminal domain
  misc_feature (1)..(105): Pfam Name: GST_C Pfam Description: Glutathione S-transferase, C-terminal domain
MAGAGAAASDELKVLGVWPSPFVIPVRIALNMKGLSYEYVEEDLYNKSLLLVGSNPVHKKVPVLLHGGRAINESQIILQYIDELWAGTPALLPSDPYERATARFWAAYIDDKVRSAWVVMVFRYKNKDEWAEGVARAGEALDTLEGAFRDCSKGKPFFGGDGIGFVDLVLGGYLGWFGAFGKIIGRRLIDPAKTPLLAAWEDRFRAADVAKGVVPDDVDKVLAYQQVLLAR

SEQ ID NO: 5775 - DNA, 1610 bp, Panicum virgatum
  misc_feature: Ceres CLONE 1826215
  misc_feature: Encodes the peptide sequence at SEQ ID NO. 5776
gcggatccaagcatgcccgcccagacctccccctctcctccgggggatgcgtggaagcaagccgaatcagggcagggccctgccctggagcgcgagggcgagacgagacagcgcccccactgctcccgtccacacaccattaccaccaccgcctgcccacccaccccgtctaccaccaccatctccgctgctgataggatgatgatgggtggagagagaaaccagacgagagagagagagagttgaaactccatccagccagacggtcggtggcgtttcttgcctgccggccgggcatgcgtgcttcggctccccatactcctgttgccaccaatccatgggcctttttgggttttcgacctcgcctcaccccatgggtcaggtcagaggagagccgagagctctccccgtcacacgccgcccgcggcaggagagagagaaagcaggcagccgggctgcggccgggcaagaaacttcccccacctccctcctcgcctttatttctatactcgatattgtcgtctccttcctcggtcccatctcctccccgccccctgctccgccttttcctctccggttcctcctcctccccctcgcctcgcctcccccgcgctccctttcttgcggtgtgggggagttgaggaggtgagcagctgaggtccggcgaggccaggttaggcggccatggcagccggcaagaaggccagggtcgtcttggcccagccggcgctcttctcccgagcgcccggccccgtccgcggctccggggaggaggaggcgtacagggccaggcttaggtaccaggccctcctccatgactaccaggagctcgtcaaggaagctcaagcaaagaagaggaggctgcacatggagaggctcaacaagcagaggctactggctgaagtcaaattcttgaggaagagatacaaatccatgtctgaaaacccatctcagacaattgtttgtagagtgaggaatccagcaatgcggccggcatgtcgcactgctgcttgggccaatgatgctcagcaccggtcgattcaagccattgggagttccagcagaagccagctggtgcaatggagacaagatgattctccaagagcatctccggtgattgacctcaatgaggcctgtgagccgggttatgagattgaaatgggtgaccatcatggttacggggagcctcttggcatcaacaatgtgaggaggtacccgatggaaggtgtcgctgctgccggccctagcgaggtgcgaattcctgcattctgggatgcccggagtctggagggccgagctgggaagaggaagatctcatggcaggatcagttggccctgagagtataggcaatgacagtatttagccgaagtaccatagtagtaggatctgtatgtgtcatcgctagctggtcaccagatgtaaaaggatctgcaggataatctggatggttgtttacccatgtctcatgatgaaaacatgggctgccttgtgatagcaaggtaggcgtgatggctgtcaccaaaaatgttaaggcaaatcctagtgtggaggactaatggttcaatgagagatgtaccttctgaggcagcaaaaaaaaaaaaaaaaaaaa

SEQ ID NO: 5776 - protein, 220 aa, Panicum virgatum
  misc_feature: Ceres CLONE 1826215
  misc_feature: Great-hit functional homolog of the protein sequence given in SEQ ID NO 9465
  misc_feature: Useful for making plants with modulated nitrogen use efficiency
MAAGKKARVVLAQPALFSRAPGPVRGSGEEEAYRARLRYQALLHDYQELVKEAQAKKRRLHMERLNKQRLLAEVKFLRKRYKSMSENPSQTIVCRVRNPAMRPACRTAAWANDAQHRSIQAIGSSSRSQLVQWRQDDSPRASPVIDLNEACEPGYEIEMGDHHGYGEPLGINNVRRYPMEGVAAAGPSEVRIPAFWDARSLEGRAGKRKISWQDQLALRV

SEQ ID NO: 5777 - DNA, 1470 bp, Panicum virgatum
  misc_feature: Ceres CLONE 1826241
  misc_feature: Encodes the peptide sequence at SEQ ID NO. 5778
gaacgccctcactcttttacccccttccactttcactttccccttccccgcccgcccgccgatccacactaccccgtctagcccagcgccaccgccacggtcgtcggagagagggcggcacaagcgcgatgggtcgcccgcccagcaccggcgccccggcgttccgcttcctcccgtccgaggtggcggagatggaggcgcgcctgcagcagctcaacaacgccatccccacccgcgccgtgctccagaccctcgccgacaagttctccgcctcgcccgagcgcgccggcagggtcgccatccagcccaagcaggtgtggaactggttccagaacaggcgctactcgcaccgggccaagaccaccagggccgcgccgccgccggcggctaagatgacgccctcgggggccgaccacatccagcacgccgccaactcatccgccttcagggccgcccagccctctgctgccgctgcgcaccacggctcctccccctccgcagggaagaaccctgtggagggtgtccaggttgagtttgaagccaagtcagctcgagatggcgcatggtatgatgttgctgcgtttctgtcacataggttgtttgaatcaggggaaccggaagtacgggttcgtttttctggatttggagcagaggaagatgaatggatcaatgttcgaaaatgcgtgcgacagcgttctcttccgtgcgaggccactgaatgtgttgcggtgcttcctggggacctcattctttgctttcaggaaggtaaagagcaggctctatattttgatgcccgtgtccttgatgcccaaaggagaaggcatgatgtaagaggatgccgatgtagatttcttgttcgctatgatcatgactcttctgaggaaattgttccactgaggaaggtgtgccgccgaccagaaactgattacaggcttcagattctgcatgcagccagagcagcagccaccattgatgctcacaccccaccacccaaagaggtcaaagtggaggcgacatccaacgagaagagcccagctcagcagaaacccccgaagcagcacaagatgatggacgtgaacaccgatgaggtgtcaatggtcaccagcgtggaacaacaagtgacaccaggcaagactgttgcccccttgccgtcagcaacaccagagacccgcaattccagttcagacgtcgtgatgaaggaagcggaggcttcctcggtgcttgaagatgatgatgaagtacaagtggttgaaaagatgaaagatggggagtagtttttcttttccgtacattgtgtgttggattaacttgttgtcgtcgtacaaacttgtctaatttttagtagtatctatttagctcagggcctattgtatttaccagctagcgtcttggtggcttggaagattactgcttaaacagcttaaatgaagcattgactgtttcaaaaggcaaaaaaaaaaaaaaaaaaaa

SEQ ID NO: 5778 - protein, 381 aa, Panicum virgatum
  misc_feature: Ceres CLONE 1826241
  misc_feature (1)..(67): Pfam Name: Homeobox Pfam Description: Homeobox domain
MGRPPSTGAPAFRFLPSEVAEMEARLQQLNNAIPTRAVLQTLADKFSASPERAGRVAIQPKQVWNWFQNRRYSHRAKTTRAAPPPAAKMTPSGADHIQHAANSSAFRAAQPSAAAAHHGSSPSAGKNPVEGVQVEFEAKSARDGAWYDVAAFLSHRLFESGEPEVRVRFSGFGAEEDEWINVRKCVRQRSLPCEATECVAVLPGDLILCFQEGKEQALYFDARVLDAQRRRHDVRGCRCRFLVRYDHDSSEEIVPLRKVCRRPETDYRLQILHAARAAATIDAHTPPPKEVKVEATSNEKSPAQQKPPKQHKMMDVNTDEVSMVTSVEQQVTPGKTVAPLPSATPETRNSSSDVVMKEAEASSVLEDDDEVQVVEKMKDGE

SEQ ID NO: 5779 - DNA, 1251 bp, Panicum virgatum
  misc_feature: Ceres CLONE 1826289
  misc_feature: Encodes the peptide sequence at SEQ ID NO. 5780
gtctagttttctcacgtcgttgtagcatccgcatctcacttccccagctccatgctccggccagagcactgcctccggttgctaccggcgaccgccctcgcctttgccgcggcctcggctcccttctcttgccccctctcccggccccgccgcggcacgacccggctccggcttccacaccgacgcgctctccatctcgggggcaaaccgtcgagcaccctgcgcgcgccggcgatgccggacgctgcggtggcgcccgcgcccgagatgccgcagcgggaggtggcacgggcgctcgcggagcaggcggtggcgcggctgggcccgcagctgctgccgtccgccgtgcccgacgacgtcgccgagttccgcaacgccgccgggaacgccgtcggctcgctcgacgtgcgccggggcgcgcctggctcgtcgatcgctttcatgatgcagtcctcgcttcactgcaaagtcccaaatggtgccattgacatcacatcgattctcatttttctaaacaccgcaacagatgcaccacatttcctattggagcttatacagggtagcccaacttcaattgtggtggttctggacctactcccacggaaagacctcgcattgcacccagactatttgcagaagtactatgaaaacactcggatggacgagcagcgtgcaaatattgaagaactactgcaagctcgtccataccgatcaccatcactcttcgtgcgcagtgcctgttcaccaacagcagtaatggtcaccattgactgtggacaaggaggagatggcgccttggaagagattgtgagtgggcgactggcgacggttgctaaggaggttcttcaaatttggcttgattgctgtgctgattccactgtggaaatggatgatacagagagggaatttcttctcaagagggatcaacttgtaagatccaagtcgattgaggtcgatctgactgcaagcctaccaaggatgtttgatcctgatgtgtctagtcgcgtcatatctgaaatcaggaaggcctttggtgtacaagagccgtagcatgcaaaaaaacatgtaggtacttggttagttgtagataaacaatgtttctggtccgtagttgctcgtgcttaaaacaaatgaatcaagatgttaaccacggtaatcgccagctccatgtactatcaccatcatccgcattggtatatgtcataagatattccgatctaaaaaaaaaaacaaaaaaaaaaaaaaaaaaaa

SEQ ID NO: 5780 - protein, 332 aa, Panicum virgatum
  misc_feature: Ceres CLONE 1826289
  misc_feature (3)..(256): Pfam Name: RCC_reductase Pfam Description: Red chlorophyll catabolite reductase ( RCC reductase)
MLRPEHCLRLLPATALAFAAASAPFSCPLSRPRRGTTRLRLPHRRALHLGGKPSSTLRAPAMPDAAVAPAPEMPQREVARALAEQAVARLGPQLLPSAVPDDVAEFRNAAGNAVGSLDVRRGAPGSSIAFMMQSSLHCKVPNGAIDITSILIFLNTATDAPHFLLELIQGSPTSIVVVLDLLPRKDLALHPDYLQKYYENTRMDEQRANIEELLQARPYRSPSLFVRSACSPTAVMVTIDCGQGGDGALEEIVSGRLATVAKEVLQIWLDCCADSTVEMDDTEREFLLKRDQLVRSKSIEVDLTASLPRMFDPDVSSRVISEIRKAFGVQEP

SEQ ID NO: 5781 - DNA, 1375 bp, Panicum virgatum
  misc_feature: Ceres CLONE 1826310
  misc_feature: Encodes the peptide sequence at SEQ ID NO. 5782
actccccccctccgcctctcgctccctttcgcatctggttcggagagctctcttgaagcctcgagcctgcctctcgcctgtgctctgctctgctccgcgcctccggctccgccgccgcgctagctgttgcattgcagcccgcgagccctgagctgatagctagctcgttcgttcttcatcacacttccgagacatggagttcgaagaccactgccacaaggtccaggagcccaagttcgactgcctgctcttcgacctcgacgacactctgtacccgttgagttctgggatcgcaggccatgtcaagaagaacattgaagactacatggttgagaagctgggtattgatgagagcaagatcgagaaccttggcaacctgctgtacaagaactacggcaccacgatggccggcctcagggcgatcggctacagcttcgattacgatgagtaccacgccttcgtccacggaaggctaccctacgacaacatcaagcccgaccctgttctcaagcacattctcaagaacctgcgcatccgcaaactcatattcaccaacggcgacaaggtccacgccgtgcgcgccctcaagaggctgggcctggaggactgcttcgaggggatcatctgcttcgagaccctgaacccgccgtgcccgccgcggggcgaccaggcgcccgagatcttcgacatcgccggccacttcgccctgtccggcactgccgacgagctccccaagactcccgtcctgtgcaagcccaacgtcgacgccatggaggaggcgctcaggatcgccaacgtcaacccccacaaggcgatcttcttcgacgacagcgtgcgcaacatccaggccgggaagcagatcggcctccacacggtgctggtgggcaagtcgcagcgtgtgaagggcgcggaccacgcgctggagagcatccacaacatcagggaggcgctgccggagctgtgggaggaggccgagaaggcggaggacgtgctctacgccgaccgcgtggccatcgagacctccgtcacggcgtaaaacccccccggcgcgccgtcagctagccgaagtttctcgacgtccagggccgctgcagcagcgagatcacgcatcacacgcgcccgggccagggactggtggtctctcacggtgggaactgaattccagcgatggccgggcagggaatttccgacaacagcaggggtgcagcatgtaacgggggggaacagatgacgagctcgtgatgggctggttctaatatagtatatacatacatatatatgtatcggccagaccttttgcttgtaaattactactagtagaagaaataataagaagaacaacggagtttacttgtaaaaaaaaaaaaaaaaaaaa

SEQ ID NO: 5782 - protein, 280 aa, Panicum virgatum
  misc_feature: Ceres CLONE 1826310
  misc_feature (1)..(219): Pfam Name: Hydrolase Pfam Description: haloacid dehalogenase-like hydrolase
MEFEDHCHKVQEPKFDCLLFDLDDTLYPLSSGIAGHVKKNIEDYMVEKLGIDESKIENLGNLLYKNYGTTMAGLRAIGYSFDYDEYHAFVHGRLPYDNIKPDPVLKHILKNLRIRKLIFTNGDKVHAVRALKRLGLEDCFEGIICFETLNPPCPPRGDQAPEIFDIAGHFALSGTADELPKTPVLCKPNVDAMEEALRIANVNPHKAIFFDDSVRNIQAGKQIGLHTVLVGKSQRVKGADHALESIHNIREALPELWEEAEKAEDVLYADRVAIETSVTA

SEQ ID NO: 5783 - DNA, 1292 bp, Panicum virgatum
  misc_feature: Ceres CLONE 1826333
  misc_feature: Encodes the peptide sequence at SEQ ID NO. 5784
ggcattagtagcagcggctgcagcccagcgcccccactcgtcggtccctctctcccgctgcgcgcgcgtgctgctctgcttctcttcttgcgccgagcgctgctcgcttgccgcggcgccggttgtcgatgagcatggggcgcttcgccagctcgatggatccgaggtcggggctggaggtggtcagggactggaacggggtcgcccaggtcgtgctgcgctcgcccaagggagcctctgcgcgggtgagcctgcacggcggccaggtagtctactggaggaacgaccgcggtgaggatctcctcttcaccagcagcaaggcaatcttcaagccgccaaatgcgatgcgaggtggaattcagatgtgtttcccacagtttgggtattctgggacattggagcgacatggatttgcaagaaacaggatatgggccctggatgatgagcatccaccgataaatcataatgataacatcaacaaagtttctgttgaccttatactaaaggcatctgaagatgacctcaaatgctggtcacattgttttgaattccgtctgagggtctctctttcaaaagatggggacctatcattagtctcacgcatcaggaatgtcaatggcaagccattcagtttctcatttgcttatcacacatatctttctgtttctgacatcagtgaggtgaggatagaaggtctggagacccttgattatcttgacaatcttagccacaaagaacggtttacagaacaaggagacgccataacatttgagtcagaggtcgatcgagtctatgttagctccccaaatgtagtagcagttcttgaccatgagaagaaacactcatttgtcataagaaaggaaggacttcctgatgttgttgtatggaatccgtgggaaaagaaatcaaagactatggtggactttggtgatgaggagtataagcagatgctttgcgttgatgcggccgcggtggagagagcaatcaccctgaaaccaggggaggagtggacagggaagctggagctttctgcagtttcatccaccaactgcagcgatcatcttgatcaccccgtcagcatctagcgtgtagtgtggaagttcacatttcatagtgctatatggtgttcgcctcataagagaagtaagaatctcctttgtacatccgagataagtaggtgcacgtgcacctataatcagtcagctgctcgaattgatctagaatcggcaattctattgtgacctggtctctggaatctaatgatagtaacgccttgcttcaggcataagcat

SEQ ID NO: 5784 - protein, 318 aa, Panicum virgatum
  misc_feature: Ceres CLONE 1826333
  misc_feature (2)..(276): Pfam Name: Aldose_epim Pfam Description: Aldose 1-epimerase
MSMGRFASSMDPRSGLEVVRDWNGVAQVVLRSPKGASARVSLHGGQVVYWRNDRGEDLLFTSSKAIFKPPNAMRGGIQMCFPQFGYSGTLERHGFARNRIWALDDEHPPINHNDNINKVSVDLILKASEDDLKCWSHCFEFRLRVSLSKDGDLSLVSRIRNVNGKPFSFSFAYHTYLSVSDISEVRIEGLETLDYLDNLSHKERFTEQGDAITFESEVDRVYVSSPNVVAVLDHEKKHSFVIRKEGLPDVVVWNPWEKKSKTMVDFGDEEYKQMLCVDAAAVERAITLKPGEEWTGKLELSAVSSTNCSDHLDHPVSI

SEQ ID NO: 5785 - DNA, 925 bp, Panicum virgatum
  misc_feature: Ceres CLONE 1826353
  misc_feature: Encodes the peptide sequence at SEQ ID NO. 5786
cccagctcgccactcccctgtccatctcgggctctcgtctctcccagctcgtcatctccatctcgccgccgtctcctctgccctcctcgcgccggcgccggacccaggagcgccgaggcagacgcgccatgctccccacgccgtcctccgcgtcggcgtcgctggcgccggcggccccgcagcaggggctcctccccagcggcgcatggacgtcggacggcgccgccgcctcgcggcaccagctggccatcagcaacggggtgctcctggccgcggtcatcttcctcttcatggtcgtcgtcttcgtcttcctgctctacctctacgccaagcgctacctgggcacctccaacccgctgctggcgccgtccacgccgtcctcccgcttcctcttcgtcgccgcgtccccgctcccgcagcgcggcctgcccgccgccgtcctccgctccctccccgtcacggtctacggcgccgccggctcccccgcctcccccggcaaggagcggctagagtgctcggtgtgcctgtccgaggtggccgacggcgagaagctgcggacgctgcccaagtgcgcgcacggcttccacgtcgagtgcatcgacatgtggttccagtcccacgacaccggccgcccgcccaagacgcccaagacccctccgtcggcgaactgattcgttgggatccccgagctccgggtcgcatttggcccacctcggccgatcaccggagccgcgcagacatgtgttcattctttctttcttctctctttttcccccttctcttctcgatttagaaaaaaaagaggaattttggctcaaaattctgatctgtaaacaaaagcagagacatcggtgttgattggttcgtggtgttggtggatagtacagtaattgaccaatttgttcaaaaaaaaaaaaaaaaaaaa

SEQ ID NO: 5786 - protein, 180 aa, Panicum virgatum
  misc_feature: Ceres CLONE 1826353
  misc_feature (1)..(38): Pfam Name: zf-C3HC4 Pfam Description: Zinc finger, C3HC4 type (RING finger)
MLPTPSSASASLAPAAPQQGLLPSGAWTSDGAAASRHQLAISNGVLLAAVIFLFMVVVFVFLLYLYAKRYLGTSNPLLAPSTPSSRFLFVAASPLPQRGLPAAVLRSLPVTVYGAAGSPASPGKERLECSVCLSEVADGEKLRTLPKCAHGFHVECIDMWFQSHDTGRPPKTPKTPPSAN

SEQ ID NO: 5787 - DNA, 1621 bp, Panicum virgatum
  misc_feature: Ceres CLONE 1826358
  misc_feature: Encodes the peptide sequence at SEQ ID NO. 5788
cactcctccgccccattaatatctagccggcccgccccccctctctctcctccttcaacagtgggtactctccacggccgccgccattagtgctccgtagagagtgggagagagaagctacccgttcttcctggcctcatcgagctgcgtaaactcctacgcgcggtcgatttctctctcctggctgggtcgctagctagggttcggttccatggatcagggcttcgggaatctcggggtcggaggcgggagcagcagcgggggctccaactccaaccccgccaaagcggcggcgtcctcctccttcctgcagctgccgctgtccacggcgggcccggcgtactacggcgcgccgctcgcgctcctgcaccaggcggccgccgggccgtcgtcgtcgtcgcagccgccgtacggcaagcagcacgccgccgagatctcgccggcggaggccgacgccatcaaggccaagatcgtggcacacccgcagtactcggcgctcctcgccgcctacctcgactgccaaaaagtgggcgcgccgccggacgtgctggagaggctgacggccatggccgcgaagctggacgcccggccgccgggccgccacgagccgcgcgacccggagctcgaccagttcatggaggcctactgcaacatgctggtgaagtaccgggaggagctgacccggccgatcgacgaggccatggagttcctcaagcgggtggaggcgcagctcgactccatcgccggcgccgccggcggctcctccgccgcgcgcctctcgctcgccgatggtaaatcagaaggggttggttcttctgaagatgacatggatgcaagtggccgtgagaatgagccacctgagattgatccccgagcagaggataaggagctcaagtaccagctcctgaagaaatacagtggctatttgagcagcctcaggcaagagttctccaagaaaaagaagaaagggaagctcccaaaggaggccaggcagaagctgttacactggtgggagctgcattacaagtggccttacccttcagagacggagaagattgcactcgcagagtcgacgggcctagaccagaagcagatcaacaactggttcatcaaccagaggaaacggcactggaagccctcggaggacatgcctttcgtgatgatggaaggctttcacccgcagaacgccgctgcgctctacttggatggcccgttcatggctgatggcatgtaccgccttggttcgtgaattgcagcggaccatttgatcagatcgtggggatatttcttctgtataccaggatgcgttgcgatgcaaggacattgttatggaatttttttgttaccgtttccgctgattcgtcccaagggctcgcactagtgtttatggcttgtagttctcctgtaatattgttaatttccgctggacggcttgtaatttaggtgtattttgaacttgatgaatgtccatgtaagtaccctggtagttaattcggcagtcgcctatttgtatgatttgtacgattcagattggtgaaacatgtccaggttggcctgtctgaatcaaaaagatggttaaaatgaactgcagatcatttcacaaaaaaaaaaaaaaaaaaaa

SEQ ID NO: 5788 - protein, 345 aa, Panicum virgatum
  misc_feature: Ceres CLONE 1826358
  misc_feature: Great-hit functional homolog of the protein sequence given in SEQ ID NO 9755
  misc_feature (1)..(60): Pfam Name: Homeobox Pfam Description: Homeobox domain
  misc_feature: Useful for making plants with modulated biomass
  misc_feature: The plant is abnormally small.
  misc_feature: There is no branching.
MDQGFGNLGVGGGSSSGGSNSNPAKAAASSSFLQLPLSTAGPAYYGAPLALLHQAAAGPSSSSQPPYGKQHAAEISPAEADAIKAKIVAHPQYSALLAAYLDCQKVGAPPDVLERLTAMAAKLDARPPGRHEPRDPELDQFMEAYCNMLVKYREELTRPIDEAMEFLKRVEAQLDSIAGAAGGSSAARLSLADGKSEGVGSSEDDMDASGRENEPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYLDGPFMADGMYRLGS

SEQ ID NO: 5789 - DNA, 1355 bp, Panicum virgatum
  misc_feature: Ceres CLONE 1826402
  misc_feature: Encodes the peptide sequence at SEQ ID NO. 5790
aataataaaaataagtcctaatcagtcctcgccttgtcgcccagctcacccgggttttcctcgccgagtcctcgcctcacacctcctccgtctccctcgcaggcatcgcccttgcgccgttccggccgattcctccatggcttccgacaggagcaaaacttcgaaaccagagaagccctctgcagcagcgggtgccagcctccccaatccttttgatttttcttgtatgagtggcttgctcaatgatccagcaataagagagatggcagagcaaattgcaagtgacccagtgttcaaccagatggctgaacagcttcagaaaagtgctcagggtgctggtgaacagggtatccctgcactggatcctcaacaatacatggaaacaatgcaacaagtcatgcaaaatcctcagtttgtgtcaatggcggagcgtcttgggaatgctcttatgcaggatcctgctatgtccagtatgcttgagaacttgagtagtccagctcataaggagcagtttgaagagcgaatggctcgtatcaaggaagatccatccttgaagccaatccttgatgagatagagaatggtggtccatctgcaatgatgaagtactggaatgaccctgaggttcttaaaaagattggccaggcaatgggagttaatcttccaggagattctagtgcttccaccgaactctctggacctgaagaaactggggaaggtggttatgacgatgagtccattgttcatcacactgccagtgttggtgatgcagagggtctgaagaaagctttagatggtggagcagacaaagatgaagaggatgctgagggaagaagggccttgcattttgcatgtggctatggtgagttgaagtgtgcagaaattcttctggaggttggtgctgcggttgacgccctggataagaacaaaaacactccattgcattacgctgctgggtatggtcggaaggaatgtgtggatcttctgttaaagcacggtgctgctgtcacgctccagaatctggatggtaagacccccattgaggttgccaggctcaacaatcaggatgaggttctcaagttgctggagaaggatgctttcctataagaacccttgggctaaagcgcaccaagtcatcaaattattcgcttcagcattggttcattttggttcggtgtggttgtgcgtaacttgtgaatttgatgggttcttttcatggcgatgccctgcgtttcaactggtccatgtgtgtgtaagaagtgcccgggctttgttcgtgttcctccaaatggagcttcacagttacagaaattgtttgcaaggtaaatttgaaggccaaaaaaaaaaaaaaaaaaaa

SEQ ID NO: 5790 - protein, 322 aa, Panicum virgatum
  misc_feature: Ceres CLONE 1826402
  misc_feature: The sequence is a functional homolog of  SEQ ID NO 1839 in the  10/374,780 US patent application
  misc_feature: Useful for making plants with modulated growth and phenotype characteristics
MASDRSKTSKPEKPSAAAGASLPNPFDFSCMSGLLNDPAIREMAEQIASDPVFNQMAEQLQKSAQGAGEQGIPALDPQQYMETMQQVMQNPQFVSMAERLGNALMQDPAMSSMLENLSSPAHKEQFEERMARIKEDPSLKPILDEIENGGPSAMMKYWNDPEVLKKIGQAMGVNLPGDSSASTELSGPEETGEGGYDDESIVHHTASVGDAEGLKKALDGGADKDEEDAEGRRALHFACGYGELKCAEILLEVGAAVDALDKNKNTPLHYAAGYGRKECVDLLLKHGAAVTLQNLDGKTPIEVARLNNQDEVLKLLEKDAFL

SEQ ID NO: 5791 - DNA, 1059 bp, Panicum virgatum
  misc_feature: Ceres CLONE 1826416
  misc_feature: Encodes the peptide sequence at SEQ ID NO. 5792
tcggtcgctctcccgcgttgccaagcttctgttcttccttccaggcaagggaacctatcgatacgacatgtgcgggggagcgatcctcgccgagctcgtccccgagcgggtgcaccggccgctcacagtcgccacgctctggccggcggccgagagcggggccaccgccaccgccagcggcaaaaggaaggcggccgacgtcgacgacgagctcgaggccgtcaccgacgacgaggagttcgaggccgagttccagcttttcgtggacgacgacgagccgtctccggccgcctcgcccgaatcgtccggccgcaggtccagggtcgctgccccttctcctgcagtttcagggcgctccgtgtgcacgagcccggctccgcgcgtgaacaagtacaggggcgtccgctaccggcggtcggggaggtgggcggcggagatccgggacccgcggcaggggcggcgcgcgtggctcggcaccttctgcaccgccgaggaggccgcccgggcgtacgaccgcgaggccagccggatccgcgggaagagcgcgcggctcaacttcccgctcccggacgagggccagggcccccgccggcgccagaggcggagcacgccggcgccggccatcgacctgaacctgccggccgtctccgacgacgacaccattgatgctgacgacgattccgacgacgctcgccgtgcagcagagatgggcggtgaggcggtgcagagcgcgctggcgcggatcaaggagctgatcgcgcagggtcctcacggagagaggatcgtgtcggagctgaagatgaacggagcggccggggcgttgcagtacgcggcgctgatcgccgaatgcagccgtcagatggaggagatcgctgccctgcggagagacctcgagacacgcgagaggcagcttgtccggctggtttcaaatgttatgcttcgttgatcactataaacgtctactgatgtttaaagtgtcaggaaactttagtatgattgctggattatacatgccatggcccatgatgatgtgtgtcggaaaaaaaaaaaaaaaaaaaa

SEQ ID NO: 5792 - protein, 292 aa, Panicum virgatum
  misc_feature: Ceres CLONE 1826416
  misc_feature (2)..(65): Pfam Name: AP2 Pfam Description: AP2 domain
MCGGAILAELVPERVHRPLTVATLWPAAESGATATASGKRKAADVDDELEAVTDDEEFEAEFQLFVDDDEPSPAASPESSGRRSRVAAPSPAVSGRSVCTSPAPRVNKYRGVRYRRSGRWAAEIRDPRQGRRAWLGTFCTAEEAARAYDREASRIRGKSARLNFPLPDEGQGPRRRQRRSTPAPAIDLNLPAVSDDDTIDADDDSDDARRAAEMGGEAVQSALARIKELIAQGPHGERIVSELKMNGAAGALQYAALIAECSRQMEEIAALRRDLETRERQLVRLVSNVMLR

SEQ ID NO: 5793 - DNA, 1193 bp, Panicum virgatum
  misc_feature: Ceres CLONE 1826506
  misc_feature: Encodes the peptide sequence at SEQ ID NO. 5794
atagcaacacaaacagctaccctcctcttcccgcgcttcgcaaggcttcgtctatcctctcgtcctctctccctcccctcccctcccctccgtctcccatcaatctcaccctcgccccgagatattttcccctgccaccggcccccgttatatatacagcctggccgcccccgccgctttcccttcttcgtcgccatcgccatcagctccgccaccattcattcccggtagaacctgccgtgcagcagatgctctagcaccagctcgcgaggacacgagggggaggaggaaagaggccgaagcgcccagagtcgtgtgatttggcaaggataagcttaggtttgggcgggcgatgagcggggcgcaggggagcaggatgcagccgccggcgaggtcctcgtactacgccgtgctcggcgtccgccctggcgcctccgccgccgagatacgcgccgcctaccaccgcctggccatgaagtggcacccggacaagatcgccagcggccgcgcggcggcggacccggcgcgcgcggaggatgccaagaccaggttccagcagatacacgaggcctaccaagtgctgtcggacgagaagaggagggcgctctacgactccgggatgtacgacccgctcgacgacgaccaggaggacgtggagggattccacgactttctccaagagatgatctcgctcatggccaccgttggcagagaggagcccgtgtacagcctgggcgagctccagtccatgctggacgggatgatccaggactttgccgccccccagccggagcccagcggcttcttcgccggaggccagccgggcggcgcggagccgagcggcgcttccgcgcgcttgcatccccaggggatcggcgactcggcgtgcttcagccggacggcgttctcccggtgacggccgctctagagtcaggttcagagatccgcagaagagcagcagcttctgcacccgtgcacatccagatcgatcaacggaggagggaatgtacatggcagctcttgaaatggacggtgcagaaggtcaacgagcctgtggcgtcgtccgctcgaccaactcattttggggaaggtggaaattgttctaggagagaaaggggtagaatctcgcgccacaaatgaggcagctaataaaaggatttttgttttgtgtttaaaaaaaaaaaaaaaaaaaa

SEQ ID NO: 5794 - protein, 187 aa, Panicum virgatum
  misc_feature: Ceres CLONE 1826506
  misc_feature (1)..(67): Pfam Name: DnaJ Pfam Description: DnaJ domain
MSGAQGSRMQPPARSSYYAVLGVRPGASAAEIRAAYHRLAMKWHPDKIASGRAAADPARAEDAKTRFQQIHEAYQVLSDEKRRALYDSGMYDPLDDDQEDVEGFHDFLQEMISLMATVGREEPVYSLGELQSMLDGMIQDFAAPQPEPSGFFAGGQPGGAEPSGASARLHPQGIGDSACFSRTAFSR

SEQ ID NO: 5795 - DNA, 1587 bp, Panicum virgatum
  misc_feature: Ceres CLONE 1826514
  misc_feature: Encodes the peptide sequence at SEQ ID NO. 5796
gagcaaagcggcgaagacaagctcacgcgccgccggcgatgtatggcgcttccgaccccgccgccgcggagcgcacggcgttccggcgggcggagaagcagtacaagcgctacaagccggccaaactcaagggtaggtccaggtccaggagcaagccggccggcgttgagggaggcggcggtgacctctcggcggtggttgacttccacgcgctgcttgcggcctacggggagctgcccgccgggatctgccggagcgactgcgccgggttcgaccgccccgtgttctgcttcttggaccggccgggattctatttcattcctggtgctctatcaaccgaggaacaatgctattggattagggaaagcttgaaaacatttccacagccacctaataggactaatttgactgctatatacggttcaatttctgacttgttcattgctgctaaaaatcaaaagatcttggttgaagtggaaaattctgatgtacaagaaaaagaacagaataatggtgatgggaaaatggaatccagaaacttcaaatttgtggaggacctagagatccagaagggtgaagactgtaggtcaaccagagcaactactctcatgcggaagctccggtggagtacccttggcctgcaatttgattggtcaaaacgcaactatgatgtatcacttccacacaagaagattccagatgccctagctagtcttgcaaaaaatatggctattccagctatgccttttggagaagaattcaaaccagaagctgctatagtgaattattatggtccaagtgatatgctcggtggccatgttgatgacatggaagcagattggacaaaacctattgtaagcataagtttgggttgcaagtgcatctttcttcttggaggaaagacaagagatgaagttccaacagcaatgttcctgcgaagtggtgatatagtattgatggctggggaagcacgagaacgcttccatggtgtaccacggatcttcacagaaagcaaccaacaagaaatctctgcactggtttcacaactatctggtgaagatgactgctttatcttggactatatcaagaattccaggataaatatcaacatcagacaggtctactgaagaccatattggttgcaggcttgcccatatttgtaatcaatgctgcgttttcgctggagttaggtgcatttgcagagtacaatggttcgataagtggcatctggaatagccgaataggaatgatcagaacaattagaatatatgcatcaaactaacaacaattgtagcccccattggacaatattttttgtataatttggcaacccggggaagataaaaaggctattttttttggggaattttagaccaagtagatcttgagcaggattgccgatcaaaaggattagcaatcggtagctgatttcatgttgttccattttctgatgtttcagtctcttccacaattttgctgctactgcaagatgtttgcaaatctatttggacctatgcttgatgtttctctcaccttgagggttttaaggctttctgataatccatataaaaaaaaaaaaaaaaaaaa

SEQ ID NO: 5796 - protein, 362 aa, Panicum virgatum
  misc_feature: Ceres CLONE 1826514
  misc_feature (1)..(77): Pfam Name: 2OG-FeII_Oxy Pfam Description: 2OG-Fe(II) oxygenase superfamily
MYGASDPAAAERTAFRRAEKQYKRYKPAKLKGRSRSRSKPAGVEGGGGDLSAVVDFHALLAAYGELPAGICRSDCAGFDRPVFCFLDRPGFYFIPGALSTEEQCYWIRESLKTFPQPPNRTNLTAIYGSISDLFIAAKNQKILVEVENSDVQEKEQNNGDGKMESRNFKFVEDLEIQKGEDCRSTRATTLMRKLRWSTLGLQFDWSKRNYDVSLPHKKIPDALASLAKNMAIPAMPFGEEFKPEAAIVNYYGPSDMLGGHVDDMEADWTKPIVSISLGCKCIFLLGGKTRDEVPTAMFLRSGDIVLMAGEARERFHGVPRIFTESNQQEISALVSQLSGEDDCFILDYIKNSRININIRQVY

SEQ ID NO: 5797 - DNA, 1396 bp, Panicum virgatum
  misc_feature: Ceres CLONE 1826517
  misc_feature: Encodes the peptide sequence at SEQ ID NO. 5798
aggggccaagtgggggtggggggacagacgaaatatcctccaggcagctcctctcgtctccgttcttcctcggcgtgctcgcgggcgggcgagcgggagggagggggcgaggcggatcgggaggagggtattccggcgtcccgggcggagatggcgaagggcggcggggagaggggcgcgctgctgccgatctcggcggacgacgggaagggcaacggcgggggcggggccggcgaggacgccgcgctcttcaaggggtccgccatgacccgccgcggcgccgtcgccgcgctctcctacatggcgtgctcagtgttgctagtgatgttcaacaaagcagctctgtcttcgtataatttcccttgtgcaaatgtcatcacactccttcagatggtgtgctcaacatgtcttctttatgttctgagacggttaaagatcatctccttcacaaatagtgatacatcagtgccttctgattcactattctttgtgccgtttaggatattgttgcgcaccacacctctttctttggcttatttactctatatgctagcttcaatggaatctgtccgtggagtcaacattcctatgtacacaactcttcggcggacaacagtagtgtttaccatgaccatggagtatttcttggccaagcagaagcacactccacccataataggcagtgtggctttgatcgtattcggagcgtttgttgctggagctcgagacttgtcatttgatgctcgtgggtatgccattgtcttcgtggccaacattacaactgctgtttatcttgctactataaaccgtataggaaaatctagtggtctcaatagctttggcctgatgtggtgcaatggacttgtctgtggaccttcagtactgttcttgacatatatccagggtgacctaaagagggccatggaatttccatacctttattcccctgggtttcaggctgtgctgctattttcatgcatcctagcatttctgctgaactacaccatcttctggaatacgatcctgaattctgcactcacacaatcaatgtgtggtaacttgaaggatttcttcacagttgggatcggttgggtactctttggtggtcttccctttgatctgctcaatgttattgggcaaggcctaggcttcctgggctctggattgtatgcctactgcaagatcaaaggaaagtaggcatctcagatcaaatggaagtagatattggtgtttaattgagaggagcctgtgtgctttaaccaaaatagcgttgttcagctgtttgctcctgcatacgggagagaaattttgtaggttttcttgtatgtataaactttaagttcatgaatacaagaatgaccaaggaaatagagtataaaaaaaaaaaaaaaaaaaa

SEQ ID NO: 5798 - protein, 348 aa, Panicum virgatum
  misc_feature: Ceres CLONE 1826517
  misc_feature (1)..(143): Pfam Name: TPT Pfam Description: Triose-phosphate Transporter family
MAKGGGERGALLPISADDGKGNGGGGAGEDAALFKGSAMTRRGAVAALSYMACSVLLVMFNKAALSSYNFPCANVITLLQMVCSTCLLYVLRRLKIISFTNSDTSVPSDSLFFVPFRILLRTTPLSLAYLLYMLASMESVRGVNIPMYTTLRRTTVVFTMTMEYFLAKQKHTPPIIGSVALIVFGAFVAGARDLSFDARGYAIVFVANITTAVYLATINRIGKSSGLNSFGLMWCNGLVCGPSVLFLTYIQGDLKRAMEFPYLYSPGFQAVLLFSCILAFLLNYTIFWNTILNSALTQSMCGNLKDFFTVGIGWVLFGGLPFDLLNVIGQGLGFLGSGLYAYCKIKGK

SEQ ID NO: 5799 - DNA, 1471 bp, Panicum virgatum
  misc_feature: Ceres CLONE 1826551
  misc_feature: Encodes the peptide sequence at SEQ ID NO. 5800
agactggtagcctcaacaacaacaccacacaacccaatctactcttccattcagagagctccagcgccagctccaatggccgccagtgaaggcaagcgcgacgagacgcgcacggccagcgcggcggcaatgcacgcgtgcgccggcgtcctccggctcatctgcgtggcgtgcgcgatcgactggctgtcgaggacccggggcgccccggcggcgctggtggcggtcatggcggcggcgctggcggcgtggcggctcgcgaacgccgtccgccccccgccgccgacgccgtgcgggacgcccgggggcccgccggtgacggcgccgcgggcgcggatgcgggacgggcggtacctggcgtacgccgagtccggggtgagccgggacacggcgcgcttcaaggtggtctactcgcacggcttctccggcggccgcatggactcgccccgcgcctcccaggagctgctggaggagctgggcgtgtacatggtggcgtttgaccgcgccgggtacggcgagagcgacccggacccgcggcggtcggtccggagcgcggcgctggacgtggaggacctcgccgacgcgctgggcctcggcgacaggttccacctcgtctgctcctccctgggcagccacgccgggtgggcggccatcaggtacatcccgcaccggctggccggggtggccatgatggcgccggtgatcaactaccgctggcgcggcctgccgcgggggctggcccggcagctctaccggaggcagccggcgggcgaccggtggtcgctccgcgtcgcctactacgcgccgtggctgctgcactggtggatgagccagccgtggctgcccacctccaccgtcgtcgacggctccggcaccttccccaacgcgctcgacgagaagaaccgcgtcatggcgctctccaacggcatgttccaccaaagggcgaggcaggtgacgcagcaggggatccaggagtccttctaccgcgacatggcggtcatgttcgggaggtggccggagttcgagccgacggacctcgaggagccgccgttcccggtgcacgtgttccagggcgacgaggacggcgtcgtgtcggtgcagctgcagcgccacatatgccggcggctcggctgggtcaactaccacgagctcgccggcgtggggcacttcttgtcggcggtgccggggctcggcgacaggatcgtcagcacgctcctggcggcgccggcgccggcataacatctcgaggacggcagcgtccttcgcatcttgtactagtataagactgatctgctgtaggtacgggtcttgaagtctagaagcaaacgctgaagaaaagcatttcctgtgagctcagggacaggcttagcctctactgtatatgtacaaagaaagaaactgaagagcagaagggactttttatatatcatgaggggtatttgactgggtgtaaaaaaaaaaaaaaaaaaaa

SEQ ID NO: 5800 - protein, 387 aa, Panicum virgatum
  misc_feature: Ceres CLONE 1826551
  misc_feature (1)..(230): Pfam Name: Abhydrolase_1 Pfam Description: alpha/beta hydrolase fold
MAASEGKRDETRTASAAAMHACAGVLRLICVACAIDWLSRTRGAPAALVAVMAAALAAWRLANAVRPPPPTPCGTPGGPPVTAPRARMRDGRYLAYAESGVSRDTARFKVVYSHGFSGGRMDSPRASQELLEELGVYMVAFDRAGYGESDPDPRRSVRSAALDVEDLADALGLGDRFHLVCSSLGSHAGWAAIRYIPHRLAGVAMMAPVINYRWRGLPRGLARQLYRRQPAGDRWSLRVAYYAPWLLHWWMSQPWLPTSTVVDGSGTFPNALDEKNRVMALSNGMFHQRARQVTQQGIQESFYRDMAVMFGRWPEFEPTDLEEPPFPVHVFQGDEDGVVSVQLQRHICRRLGWVNYHELAGVGHFLSAVPGLGDRIVSTLLAAPAPA

SEQ ID NO: 5801 - DNA, 1838 bp, Panicum virgatum
  misc_feature: Ceres CLONE 1826552
  misc_feature: Encodes the peptide sequence at SEQ ID NO. 5802
catgtagccggccaaccaacggggtcattcctcgtccatgtagccggccaaccaacggatcgaagcacatggcttgcagctccggccaccaccgctccccacggcgcgccgccgccgcgccgccaccgctcctcgcactagccgccgccagcctcctcctgctgccgctgctggcgttcgaggacgaccggatcctggggctgccggggcagcccaacggcgtggcgttcggcatgtacgccggctacgtcaccgtcgacgagcaggccggccgcgcgctcttctactggctccaggaggccggccgcgacccgggcgccgcgccgctcgtcctgtggctcaacggcgggcccgggtgctcctccgtcggctccggtgcgctcgaggagctcggcgcgttccgcgtccacgccgacggcgagacgctcctgctcaacgactacgcctggaacaaagcggcgaacgtgctgttcttagagtcgccggccggcgtggggttctcttacagcaacaccagctccgacatcgtcatgggcgacaacagaacagcgcatgactcgtacacgttcctggtgaaatggttcgagagattcccgcagtacaagtaccgtgatttctacattgtcggagagagctatggaggtcactttgttcctcagctctcgcagcttgtgcacaggaacaacatcggcgtcgagaagcctgtcatcaacttcaaaggcttcatggtcgggaacggtctgatcaacgaccgcactgacctgaccggcatgttcgagtactggtggcaccacggcctcatctccgacgagaccctggagagcgggctcaaggtctgctccgagacctccttcatccacccctcgcgggagtgcctggagacatgggtcggggccctcgaggagcaaggcaacatcgacgtctacagcatctacacgccgccgtgcgacaagggtagcgcgttcgagctcagactcaagaggagccgccgccgccgcgtaagtcgccttggccaccagcttctctctagtctgaaaagagctagagagagacgatggcctgacgatgatctcgttcaggcatggatgctgccagcgtacgacccgtgcgtcgacttctacgcgaccaagtacatgaacctgcccgaggtgcagaaggccatgcacgccaacgtcaccggcagcatagagtacccatggagtttatgcagcgatcccgtatatgataactggccagagacaccccattccatgctacccatctacaaggaactcatcggagctggcctcaaggtgtgggtcttcagtggtgacacagacactgtggtgcctctgacctcgaccaggcgctctcttgccgccctgggccttcctgtcaagaccagctggtacccctggtacatggtcccatctgaggttgggggctggagcatggagtatgaaggcctgaccttcgtcaccgtccgcggcgccgggcacgcggtgccccagcaccgcccggcgcaggccctcgtcctgttccagcacttcctgcagggggaacccatgccggccgaggcaacgaatgccagcctcatcctccttcctagtgagaaggctcgctcctactgagctggggagcactagtgccagatgacggtggttgtacgacgagtcgacgatcgtcattacgtcgtctgtacgcggagaataaaatctgaaggaccatctttcttccggaacgataatatgtgtataaaccatcggcatggctatggatcgattgtttcttctgctgaagccatatatgaataatgcatgcttggattgtgccgaaatcagattcaggcatgcttgctc

SEQ ID NO: 5802 - protein, 513 aa, Panicum virgatum
  misc_feature: Ceres CLONE 1826552
  misc_feature (1)..(267): Pfam Name: Peptidase_S10 Pfam Description: Serine carboxypeptidase
  misc_feature (12)..(309): SWISSPROT Homolog: EC 3.4.16.6 Serine carboxypeptidase 2 precursor
  misc_feature (40)..(310): SWISSPROT Homolog: EC 3.4.16.6 Serine carboxypeptidase 2 precursor
MACSSGHHRSPRRAAAAPPPLLALAAASLLLLPLLAFEDDRILGLPGQPNGVAFGMYAGYVTVDEQAGRALFYWLQEAGRDPGAAPLVLWLNGGPGCSSVGSGALEELGAFRVHADGETLLLNDYAWNKAANVLFLESPAGVGFSYSNTSSDIVMGDNRTAHDSYTFLVKWFERFPQYKYRDFYIVGESYGGHFVPQLSQLVHRNNIGVEKPVINFKGFMVGNGLINDRTDLTGMFEYWWHHGLISDETLESGLKVCSETSFIHPSRECLETWVGALEEQGNIDVYSIYTPPCDKGSAFELRLKRSRRRRVSRLGHQLLSSLKRARERRWPDDDLVQAWMLPAYDPCVDFYATKYMNLPEVQKAMHANVTGSIEYPWSLCSDPVYDNWPETPHSMLPIYKELIGAGLKVWVFSGDTDTVVPLTSTRRSLAALGLPVKTSWYPWYMVPSEVGGWSMEYEGLTFVTVRGAGHAVPQHRPAQALVLFQHFLQGEPMPAEATNASLILLPSEKARSY

SEQ ID NO: 5803 - DNA, 1163 bp, Panicum virgatum
  misc_feature: Ceres CLONE 1826640
  misc_feature: Encodes the peptide sequence at SEQ ID NO. 5804
agtgaacaaacgccattgggaatttcagagatggcgctgactagggtttcgctgtcttcctcagcccgcctcctaccctcccccctgctccaatccttcctccgccctttgtcctcctcgacccgccgaagaagctctcccattgctgccgctttctctcaggcttcacaatctccccacgctgtaagggaggggcaggtgacggaggtgcccatgcccagctccaggcggccctggaagcccacgtgcttgtactacacccagggcaagtgcaccatgatgaatgatgctatgcatcttgagaagttcagtcacaatttgatgatggaccttccagtgaatgcatcagccacagataaagtgaagcctcagaaattggattatcttttaattcttgatttggagggtaaggtcgaaattcttgaattcccggtcgtgatgattgatgctcaaagcatggaatttattgattcatttcacaggtttgtgcgtccaactgcaatgaatgagcaaagaataacagaatacatagaagggaaatatggaaagtttggggttgaccgtgtttggaatgacactgctatccctttcaaggaagtactgcaagagtttgaggattggattggaaatcacaacctgtggaaaaaagagcaaggaggatcactcaaaagtgcagcatttgttacttgtggaaattgggatttgaagacgaaggtccctgagcagtgtaaagtttcaaacataaagcttcctccttattttatggagtggattaatttgaaggatatctacctcaacttctatagcagaagagcaactggaatgatgacaatgatgaggcagcttcaaatgccaactgttggaagccaccatctcgggatagacgattcaaaaaatatagcgagagtggttcagcgcatgcttgctgatggtgctatgatgcaaattactgcaaagaggcagtcgactactggcgatgtgaaatttcttttcaaggaccgaattaggtgattgaaatgtgtaatgttttatcacagcgctgctgtattgactggccaagtggccatcaattttgacgttgagaactgctctgatgatattctaaattttatggaactcaatggcatgtcaaagttctggagcaaaaaaaaaaaaaaaaaaaa

SEQ ID NO: 5804 - protein, 326 aa, Panicum virgatum
  misc_feature: Ceres CLONE 1826640
  misc_feature (2)..(176): Pfam Name: Exonuc_X-T Pfam Description: Exonuclease
MALTRVSLSSSARLLPSPLLQSFLRPLSSSTRRRSSPIAAAFSQASQSPHAVREGQVTEVPMPSSRRPWKPTCLYYTQGKCTMMNDAMHLEKFSHNLMMDLPVNASATDKVKPQKLDYLLILDLEGKVEILEFPVVMIDAQSMEFIDSFHRFVRPTAMNEQRITEYIEGKYGKFGVDRVWNDTAIPFKEVLQEFEDWIGNHNLWKKEQGGSLKSAAFVTCGNWDLKTKVPEQCKVSNIKLPPYFMEWINLKDIYLNFYSRRATGMMTMMRQLQMPTVGSHHLGIDDSKNIARVVQRMLADGAMMQITAKRQSTTGDVKFLFKDRIR

SEQ ID NO: 5805 - DNA, 1103 bp, Panicum virgatum
  misc_feature: Ceres CLONE 1826654
  misc_feature: Encodes the peptide sequence at SEQ ID NO. 5806
aaggcattgactttgcacgggcgcgtggcgtggcgtggcgatggacgcggcgggcatggcagcgggcgcgcccttactgccgccggacgcgtccccgccgccggccgccgggcagggcgcggcgttcccgatcgccatcgtcatcgccatcgggttcatggtcaccacgctcatcctcatcagctactacttcatcgtcgtccgctgctggctccgcggcggcggcggcggcggggggcccgggtccgggctgctccaccgcgcgcgccgcgaggagctcgtggagcgggtgtccacggtcttcttcgccaacctcgaggccgccgagcaccccggcgggctcgacccggacgtcgtcgccgcgctccccgtcgtcaagtaccgccgggcccggggcgcgtcggcggcgctcgagtgcgccgtgtgcctcgccgagttcgcgccgggcgagcggctcaagcagctgcccagctgctcccacgccttccacatcgactgcatcgacacctggctccaccacaacgtcagctgcccgctctgccgcaccgtcgtcacgggcggcgtcgcgctcccgctcgcccgcgacgagcacgaggcgtcctgccgcgagctgcagctcggcaacggccgcatcatcggcgacgccgcgaggacggggtacgggagatcctgcaggttcccgaccaagagcggcgccgcgcaggagcccatcacgcgctccttctccatggactgcttcgcgggcggcctcggccggaagccacagaaggagcctgctggcagctcggaggccgggccgagcagcgccgccgccgcctccgaccgcagcagcggcagtaacgtcgtcgcctaccgcggcgccggcgagacgagcgggcgggtccgtcggttgctctcgtcgttcgggctcggccggagctcgcggagcacggagctgccgatccacctggacccgtgacggcggcgacgggttcgtgccctcgtcgctccattaacccgtttctttaattggatggttggttgagtcgtgtcgtgtgcatgaagtgtacagcaatagcagagactttaagttggaaatttttttatcacaatagcttgtgttc

SEQ ID NO: 5806 - protein, 305 aa, Panicum virgatum
  misc_feature: Ceres CLONE 1826654
  misc_feature (1)..(42): Pfam Name: zf-C3HC4 Pfam Description: Zinc finger, C3HC4 type (RING finger)
MDAAGMAAGAPLLPPDASPPPAAGQGAAFPIAIVIAIGFMVTTLILISYYFIVVRCWLRGGGGGGGPGSGLLHRARREELVERVSTVFFANLEAAEHPGGLDPDVVAALPVVKYRRARGASAALECAVCLAEFAPGERLKQLPSCSHAFHIDCIDTWLHHNVSCPLCRTVVTGGVALPLARDEHEASCRELQLGNGRIIGDAARTGYGRSCRFPTKSGAAQEPITRSFSMDCFAGGLGRKPQKEPAGSSEAGPSSAAAASDRSSGSNVVAYRGAGETSGRVRRLLSSFGLGRSSRSTELPIHLDP

SEQ ID NO: 5807 - DNA, 1166 bp, Panicum virgatum
  misc_feature: Ceres CLONE 1826678
  misc_feature: Encodes the peptide sequence at SEQ ID NO. 5808
aagtcgtctactacaagtcttcatccattccattccacgcactagtgttgttattagcacccaagtcccatccctaatcaccgtctaatcaggctccccaaccatggcggcggcggcggcggcggtggcggtggaggtcccagtgtcggcgccggtgagaacagtgaaggtcacaaacgtctcacttactgcaactgtacaagacattaaggagttcttttccttttcaggagatattgaacatgtggagatgcaaagtggtgatgagtggtctcaagttgcatatgtgactttcaaagatgcacaaggtgcagagactgcacttcttctttcgggtgccacaatagttgatctttctgtcatcattgcacctgctccagaatatcagccaccccctactgcctctgctccaccaatgagtggaaccagagttccagttggtggagacaacaacgttgtccataaggccgaggatgtcgtcagcactatgcttgctaagggttttgtcctaggcaaagatgcagttggcaaggccaaagcttttgatgagaagcacggcttcacatccacagctggtgctaaggtggcttccattgacaagaaaatcggcctgagcgagaagatcaccacaggcacttccatggtgagtgggaaggtgaaggagatggaccagaagttccaggtctcagacaagaccaagtccgctttcgctgctgctgagcagaaggtgagcagcgctggatcggccatcatgaagaacaggtatgtcttcaccagcgcatcgtgggtcaccaacgcattcaacaaagtcgccaaggctgccacggatgttgggacgatgaccaaggagaagatggctgctgaggagcagcacaagacttcagggccttcttctggggggcactcgtatacgcccatccaatgattctttggctttggtcttgtgtgcctcctttggcgtgttgtattattggtggatgtaaaacatagatatagaacagatcaggcctcctgccatatgttcatcgttccatgtgttaaatttcatactgcaggaattttgtttttgtagaccagaaaagtatgaatgatggtggtaccaatgcattggcttatatgaatccatgttcaggctggttctggttgaaaaaaaaaaaaaaaaaaaa

SEQ ID NO: 5808 - protein, 273 aa, Panicum virgatum
  misc_feature: Ceres CLONE 1826678
  misc_feature: Great-hit functional homolog of the protein sequence given in SEQ ID NO 9441
  misc_feature: Useful for making plants with altered Lignin content
MAAAAAAVAVEVPVSAPVRTVKVTNVSLTATVQDIKEFFSFSGDIEHVEMQSGDEWSQVAYVTFKDAQGAETALLLSGATIVDLSVIIAPAPEYQPPPTASAPPMSGTRVPVGGDNNVVHKAEDVVSTMLAKGFVLGKDAVGKAKAFDEKHGFTSTAGAKVASIDKKIGLSEKITTGTSMVSGKVKEMDQKFQVSDKTKSAFAAAEQKVSSAGSAIMKNRYVFTSASWVTNAFNKVAKAATDVGTMTKEKMAAEEQHKTSGPSSGGHSYTPIQ

SEQ ID NO: 5809 - DNA, 1074 bp, Panicum virgatum
  misc_feature: Ceres CLONE 1826727
  misc_feature: Encodes the peptide sequence at SEQ ID NO. 5810
aaaccagcaaggcagcaaccgtatccccagcagaggtggcggcggccgcactaggaagccgcgggggtgctcgggacggccatggcgatgcggtccgccgcgaagcacgccctggtcacaccaccgctagcccccggcatctccggggccttattccggggccggttttcaccgcgcaaccccggggcgcggccgtgccgagcggcgagctcctcccccgcgccggcagcggggaagcacctccctccattgttcagcgtcgcgccgatgatggactggacggacaaccactaccggacgctcgcgcggctcatctcgcggcacgcgtggctctacacggagatggtcgtcgccgagactattgtgcaccagaaggataacttggataggtttctagcatttcctgaggaccaacatcctattgtgctgcaaatcggtggaagtaatctggaaaatctggcaaaggcaactaaacttgcaaatgcttattcatacgatgagatcaacctaaattgtggctgccccagcggcaaagttgctggtcatggttgctttggtgctcgactaatgcttgatccagagtttgtaggggatgctatgtcagctattgcagccaactgcgatgtccctgtaagcgttaaatgcagaattggtgttgatgatcatgactcttatgaagaactatgtgagtttgtagataaagttgtgtcaaaatcaccaactaggcatttcatcattcatgctcggaaggcattgcttaacggcctcagtcctgcagaaaatcggaaagttcctccattgaaatataagtactattttgcattgctgcgggacttcccacaagtaaagtttactctaaatggaggtatcactaccattgatgaagtaagcttttgtcttaccattgaatgctccatttagctgcagaagagtcggtcactgtgaaattcactctctggtgttgcttcaattctttcaagttactacttccaagaccagtggcagagccaggaaaagtatttaggtggggtgaactccagcgacaagttaaatcaaaaaaaaaaaaaaaaaaaa

SEQ ID NO: 5810 - protein, 279 aa, Panicum virgatum
  misc_feature: Ceres CLONE 1826727
  misc_feature (1)..(183): Pfam Name: Dus Pfam Description: Dihydrouridine synthase (Dus)
MAMRSAAKHALVTPPLAPGISGALFRGRFSPRNPGARPCRAASSSPAPAAGKHLPPLFSVAPMMDWTDNHYRTLARLISRHAWLYTEMVVAETIVHQKDNLDRFLAFPEDQHPIVLQIGGSNLENLAKATKLANAYSYDEINLNCGCPSGKVAGHGCFGARLMLDPEFVGDAMSAIAANCDVPVSVKCRIGVDDHDSYEELCEFVDKVVSKSPTRHFIIHARKALLNGLSPAENRKVPPLKYKYYFALLRDFPQVKFTLNGGITTIDEVSFCLTIECSI

SEQ ID NO: 5811 - DNA, 1177 bp, Panicum virgatum
  misc_feature: Ceres CLONE 1826728
  misc_feature: Encodes the peptide sequence at SEQ ID NO. 5812
acgggttctacttccttccccccgaccactccgccgcccgctccgatggcgctgtccccggcggcgccggccaactcctcctgcttccacgcccgcgccaccgctaaccagacatcatctctcagcgtgggcaccagggtcttcatcgggctcagggcgcagaccaagctaggttcgtcggagtcgtcgtgcccgaatgtcagcgcggggttctacaccgccgtcaaccggaggatctctctcgggttgtcaaacaagagggctaccagagcccgcatttcgatgatgcctataggtactccacgtgtgccttacagaacccctggtgaaggaacctggcaatggcttgacatatggaatgctctgtatcgtgaaaggattatcttcattggggacaatatagatgaagaattcagcaaccaagtgttggcaagcatgctgtaccttgacagcattgataatacaaaaaagattcttctatacattaatggaccaggaggagatcttactccgtgtatgacactatatgataccatgctgagcctgaagagtccaattggtacacactgcttgggatttgcattcaatttggcaggatttattcttgcagctggtgaaaagggttcacgtactggtatgcccctatgtcggatttcacttcagtcacctgctggagctgctcgaggccaggctgatgatattgaaaatgaagcaaatgagcttattcgtatcaagaactatctgtatggcaaactcgcggagcacacaggtcactctgtcgaaaagattcatgaggacttgtctagggtgaagcgctttgatgctgaaggggctctcgaatacggggtcattgaccgcattgtcaggccttctcggatcaagaaagaggggtccactgctcaaaggaaggacatgcgaaatctgggacttggctagtagatgctatgttattgtatcagagctgtgtactgtgttggtttgcattaccctgaacttcagtttacggaactctaggatttactagttagcaagataagcagtcatgctggctgaagtgtaatgtagcagctagtcttccatttcattatatgtatcggacgcagcatgcgctctactttttcccgagaaccttctatttgaagagaaatgtactctccaaaaaaaaaaaaaaaaaaaa

SEQ ID NO: 5812 - protein, 296 aa, Panicum virgatum
  misc_feature: Ceres CLONE 1826728
  misc_feature: Great-hit functional homolog of the protein sequence given in SEQ ID NO 9636
  misc_feature (1)..(184): Pfam Name: CLP_protease Pfam Description: Clp protease
  misc_feature (81)..(273): SWISSPROT Homolog: EC 3.4.21.92 ATP-dependent Clp protease proteolytic subunit 2
  misc_feature: Useful for biocontainment applications
  misc_feature: The leaves start out wild- type green and gradually turn yellow-green in color, while the cotyledons stay wild-type green.
MALSPAAPANSSCFHARATANQTSSLSVGTRVFIGLRAQTKLGSSESSCPNVSAGFYTAVNRRISLGLSNKRATRARISMMPIGTPRVPYRTPGEGTWQWLDIWNALYRERIIFIGDNIDEEFSNQVLASMLYLDSIDNTKKILLYINGPGGDLTPCMTLYDTMLSLKSPIGTHCLGFAFNLAGFILAAGEKGSRTGMPLCRISLQSPAGAARGQADDIENEANELIRIKNYLYGKLAEHTGHSVEKIHEDLSRVKRFDAEGALEYGVIDRIVRPSRIKKEGSTAQRKDMRNLGLG

SEQ ID NO: 5813 - DNA, 1354 bp, Panicum virgatum
  misc_feature: Ceres CLONE 1826734
  misc_feature: Encodes the peptide sequence at SEQ ID NO. 5814
gtggtgtgtcctagtgtcgtgaaaagctttgtctaccgcgacaagaaacgtcaaacaatcagctcgttcaccaatcaccactcacaactactccccagttcccatccacactcgccatggatccgagctcggaagtcatactggactgtccgttcttccgcatctacagcgaccggcgcatcgaccgcctgatcggcaccaccaccgtgccgcccagcttcgacggcagcaccggcgtcacgtcgaaggatgtcgtcatcgacggcgacactggcctctacgttcgcctctacctcccggacacggcctcccagtccgacgccgacagcaagaagctccccgtgctggtctacttccacggcggcggcttcgtcacccagtcggcggcgtctccggtgtaccagcgcttcctcaactccctggccgcgagggccggcctgctcgtcgtctccgtcaactaccgcctcgcgcccgagcaccctctgccggccggctacgaggactcgctccgcgagttcaagtgggcggtctctgacggcggggatccctggctgtcgcagcacggcgacctcggccgcctcttcctggccggcgacagcgccggcgggaacatcgtccacaacgtcgcgatgatggccgcggccgaaggcgaggcgggctcggcggcgggggcgcggatcgagggcgcggtcctgctccacgcggggttcggcgggagggagcccatcgacggggagacgccggagtgggcggcgttctcggagaagctgtgggcgttcgcgttccccgaggcgacggacggcgcggacgatccgcggatgaaccccttggtcgccgcggcgccgagcctgcggaaccttccgtgcaagagggtcctcgtctgcgcggcggagcaggacttggtgcggccgagggactgggcgtactacgaggccctcgcggcgagcgagtggagcggctcggtggagtggttcgagtccaagggccaggagcatgtcttcttcctcttcaagcccggctgcgatgacaccgtggtgctcatggaccggctcgtcgctttcttcgccgggaaatgagtgcgtcgtcatgcgtgacaacggccacattggtcgagaccaatggaacaagaagccaagatgcgcacctgattgctgaattcaataatcagatatgttgtgctatcgcctatcgcttttgccttagttcgtggcagtcagtttttttttcttcttcttctccacacgtatcatttggttttcaaagggtcggaggcggcgttctggaacgcagggtaagtataatgtcgatgactcgatggcgaaaggaacgaatccaaaaaaaaaaaaaaaaaaaa

SEQ ID NO: 5814 - protein, 319 aa, Panicum virgatum
  misc_feature: Ceres CLONE 1826734
  misc_feature (1)..(219): Pfam Name: Abhydrolase_3 Pfam Description: alpha/beta hydrolase fold
MDPSSEVILDCPFFRIYSDRRIDRLIGTTTVPPSFDGSTGVTSKDVVIDGDTGLYVRLYLPDTASQSDADSKKLPVLVYFHGGGFVTQSAASPVYQRFLNSLAARAGLLVVSVNYRLAPEHPLPAGYEDSLREFKWAVSDGGDPWLSQHGDLGRLFLAGDSAGGNIVHNVAMMAAAEGEAGSAAGARIEGAVLLHAGFGGREPIDGETPEWAAFSEKLWAFAFPEATDGADDPRMNPLVAAAPSLRNLPCKRVLVCAAEQDLVRPRDWAYYEALAASEWSGSVEWFESKGQEHVFFLFKPGCDDTVVLMDRLVAFFAGK

SEQ ID NO: 5815 - DNA, 1098 bp, Panicum virgatum
  misc_feature: Ceres CLONE 1826754
  misc_feature: Encodes the peptide sequence at SEQ ID NO. 5816
aagaagattccgtctcatccagatcacacgccaccaaacccgcgccccagatgacgaggtagccgccagtgccactgccagtccgcgctcgtgctctcggatctcggacggaagccgtcgctccagtagcccagcgagtgagcccgcgcggcggaatccccgacccgagcgatccgccatgcggccgcggctggtgcttttcggcgactccatcaccgagcagtccttccagtccggcggatggggggccgcgctcaccgatctcttcgcccgccaggcggacgtggtgctgcgcggcctcagcgggtacaacacgcggtgggcgctcaaggtgctgccgcgggccatggagggcgcggcggacccggcggccgtcaccgtcttcttcggcgccaacgacgcctcgctgcccgaccaggtgcaggcgcaccagaacgtgccgctcgacgagtaccagaccaatctccgcgccatctgcggctacttcaaggagcgatggccctccactgctatcatactcatcactccgccaccgatttatgagccagcgagaatccgagacatttatggagttgatgatccttcacgacaagctgaaagaaccaacgaggctgctggctcttatgcacaggcatgcatggctgttgccaaagaattgggtcatccagttatagacatctggacaaagatgcaggaatttccagattggcaaacatctgcattaagtgatggtcttcacttcaccccaactgggaacaagatcctgtttgacgaggtggtgaagacgctagcaagcatcggtttcagcaaggagagcctcccatctgacctccccctctaccatgacattgaccccaaagaccccatgcaagcttttggagcatgaagaagacaccttagtgcatgattagattagtgatgcttgctggtttcaaatgatgtgtccgaagtcaggctctattctgtatggcaacgcttgtgcggcttttccttctggagatggtttttgtgcttgtgcattaataatatgcatatgtattaacgatgccaccacataaacagcaaaatctaataaaagactttttgtctctatttttc

SEQ ID NO: 5816 - protein, 235 aa, Panicum virgatum
  misc_feature: Ceres CLONE 1826754
  misc_feature (1)..(197): Pfam Name: Lipase_GDSL Pfam Description: GDSL-like Lipase/Acylhydrolase
MRPRLVLFGDSITEQSFQSGGWGAALTDLFARQADVVLRGLSGYNTRWALKVLPRAMEGAADPAAVTVFFGANDASLPDQVQAHQNVPLDEYQTNLRAICGYFKERWPSTAIILITPPPIYEPARIRDIYGVDDPSRQAERTNEAAGSYAQACMAVAKELGHPVIDIWTKMQEFPDWQTSALSDGLHFTPTGNKILFDEVVKTLASIGFSKESLPSDLPLYHDIDPKDPMQAFGA

SEQ ID NO: 5817 - DNA, 1685 bp, Panicum virgatum
  misc_feature: Ceres CLONE 1826760
  misc_feature: Encodes the peptide sequence at SEQ ID NO. 5818
ggcgacatgtgagccctggagcaacgtagtgctggacgtttccggggatagaatccggggaggaagagaagagacgagagcagcttaaatagccctgcacccctcgcgtttccctgccttggtcgcaacaaacttctcacaggctttggcttggcttggatcttcgttcctccggtgtgcagctcacgccataccactgtgctgctgttctgtgcagtgctcgcggcacggcacccatctccagctcggggcctttatatccgagcctttttctggccccgtgataattttagagagagaagggaggacagagagggagagggatcagagctgagaaggcatggccatggagagcgaggagggcgccgcactttgtggccatcaagaatcggcggcggcggcggcggccgtgaagggaggaggagggggcggcaagaggaggaagggacagaggagagggggagaagcaggcggggagaggaagaagtacaagctggtgagctaccacgagctgccggactacatgaaggagaacgagttcatcctcaactactaccgctccgagtggcccatcctcaatgccgtccttagcctcttctcctggcacaacgagaccatcaacatctggacgcatctccttgggttcgtgctgttcttcggtctcaccctggtgcatctcggccagtacttcccccaggttgctgatctgattgggcacctttcctggccaatctcaaaggttgctgaaaatgtctccagcaatattggggatgtcttatcgggtgcggcgatgttcatccagacgaacccgaccctggcctcgtacggcatggcggtgacctcgcagacgacgcggtggcccttcttcgtgttcctcgccggcgccatgttctgcctgctgagcagcagcgcgtgccacctgctgtcgtgccactcgcaccggctgaacctgttcctgatccggctcgactacacgggcatcgccgtcatgatcgtggtgtccttcttcccgcccatctactacatcttccagtgcgagccgcactggcaggtggcgtacctgtcggcgatcacggcggcgggcgtgggcacggtgtacgcgctcatgtcgccgcggctgagcgccgcccggtaccgcgcccaccgcgcgctgctgttcgtggggatgggcctgtcgggggtggtgccggcggcgcacgcggccgccgtgaactggcacgagcccgcgcggaacgtgacgctggcgtacgagggcgccatggcggtggcgtacctgacgggcacggccttctacctcacccgggtgcccgagcggtggaggcccggggcgttcgacctcgccggccacagccaccagatcttccacgcgctcgtcatcgccggcgcgctcgcgcactacggcgccgccatcgtgttcctcaaggcccgcgacgagatgggctgcccggcgtagcgccgccgccgccggaagagatcgttttctttcttttacagcttcactacttacagcagcagcagcagcagcagcaagtgtgcaatattgaaattattaccgtcttccgatgagtgacatttgattgtcgttacagattcgttctcaatttgtacatagaagaagatcatgaatcatgattattaagttgttcatcgattctttctcggcttgaaaaaaaaaaaaaaaaaaa

SEQ ID NO: 5818 - protein, 370 aa, Panicum virgatum
  misc_feature: Ceres CLONE 1826760
  misc_feature (1)..(275): Pfam Name: HlyIII Pfam Description: Haemolysin-III related
MAMESEEGAALCGHQESAAAAAAVKGGGGGGKRRKGQRRGGEAGGERKKYKLVSYHELPDYMKENEFILNYYRSEWPILNAVLSLFSWHNETINIWTHLLGFVLFFGLTLVHLGQYFPQVADLIGHLSWPISKVAENVSSNIGDVLSGAAMFIQTNPTLASYGMAVTSQTTRWPFFVFLAGAMFCLLSSSACHLLSCHSHRLNLFLIRLDYTGIAVMIVVSFFPPIYYIFQCEPHWQVAYLSAITAAGVGTVYALMSPRLSAARYRAHRALLFVGMGLSGVVPAAHAAAVNWHEPARNVTLAYEGAMAVAYLTGTAFYLTRVPERWRPGAFDLAGHSHQIFHALVIAGALAHYGAAIVFLKARDEMGCPA

SEQ ID NO: 5819 - DNA, 1131 bp, Panicum virgatum
  misc_feature: Ceres CLONE 1826762
  misc_feature: Encodes the peptide sequence at SEQ ID NO. 5820
gcggcggcggcgacgacgaatctaggcgcgacgaaagcggcggctatggcggcggcagttgaaagcgtggtggtggtccacaacgtggcgaagcggcacaacgtggggacgctggcgcggagcgcgacggcgttcggcgtcgcggaggtggtcgtcgtcggccgccgcgacgtcagcgccttcggcagccacggcgccacctcgcacctccgcttccgccacttcgcctcgctcgccctcgcccgtgcctacctcaaggatgaaagagggtgtgacatttgcggtgttgagatcactgacgacgcccagccggtgactgctcacccgttccgtcggagcaccgccttcctattcggcaatgagggtacaggactctcacaaaaagagtgtgagatctgcgacttctttgtctacatccctcaatatggtgatggaacagcatctctcaatgttacagttgcagcttcaatcgttctccaccactttgcagtctgggctggctttcctgaacgaggcagagagggcaacaaattcattgtagctgatagaccacaagggtactcgagggggctttactgtacggactcaattgaagcagtgattgaagagcgtaaaatgcgaaaagaaaatgcatgtgatatactagaggaaaatggaagcagccatccccaagaatcaaatggcctagatttgatgtttacagactaggcttatgactggacgacattgttacatcatggttgttgaatcaagtcccgggttggggttgatggagcaaatttgcgatactgcaacgcataacagaaatgtctttccaaggccgagagtagaacatgcatgttttttcaaccttggcatggagcagaaaaggatgcactgagcttttgggaagccagggggtgagtgtaccttgaaacagagggcgtggacgaagctctgtttcgctccgattgtttgccttttatgttgtacaaaacaaggtgtggtgcctgctatcagaattcctcagttgtaatgtagccatgaaggtggttgatacctcattcctgacatagaactacctcacattgcacgaagttggatggtagacttcaatggtatttttttcattaaaaaaaaaaaaaaaaaaaa

SEQ ID NO: 5820 - protein, 220 aa, Panicum virgatum
  misc_feature: Ceres CLONE 1826762
  misc_feature (1)..(140): Pfam Name: SpoU_methylase Pfam Description: SpoU rRNA Methylase family
MAAAVESVVVVHNVAKRHNVGTLARSATAFGVAEVVVVGRRDVSAFGSHGATSHLRFRHFASLALARAYLKDERGCDICGVEITDDAQPVTAHPFRRSTAFLFGNEGTGLSQKECEICDFFVYIPQYGDGTASLNVTVAASIVLHHFAVWAGFPERGREGNKFIVADRPQGYSRGLYCTDSIEAVIEERKMRKENACDILEENGSSHPQESNGLDLMFTD

SEQ ID NO: 5821 - DNA, 1499 bp, Panicum virgatum
  misc_feature: Ceres CLONE 1826796
  misc_feature: Encodes the peptide sequence at SEQ ID NO. 5822
gtctcatcgaatccaagaaaccaaagaactctccctccctccacaaagggtagtagcaggctagctagccacgcacacgatcggccatgtcgccctcccccgacctctcccgcgtgcttccccgcgtgctcatcgtctcccgccgcaccgtccgcaagaacaagttcgtcgacttcgtcggtgagtaccacctggacctcatcgtgggctacggcgcggtgccggtgatcgtgccgcgcgtggccggcgtgcacacgctgctggactcgttcgagcccatccacggcgtgctcctctgcgatggcgaggacatcgacccggcgctctacgagtccgccgccgacgccggagccggcgcgctctcgccggagcagctcgaggccgtgcagcgcctgcacccgagcgacgccgccgtcgaccacgagaaggactcgatcgagctccgcctcgcgcgccgctgcctcgagcgcaacatcccctacctcggcatctgccgcagttcgcaggtgctcaacgtcgcctgcggcggctcgctgtaccaggacgtcgagcacgagctcggccccgcggccgccgccgtccaacacatcaactacgacgactacgacgggcaccgccacccggtgcgcgtcctgccgggcacgccgctgcacgagtggttcgcgggcgacctcgccaacgacgacggcggcgcgccggcgcagcagctgatggtgaacagctaccaccaccagggcgtgcggcggctggcgcagcggttcgtgccgatggcgctggcgccggacggcctggtggaggggttctacgacccggacgcgtacaaccccggcgagggcaagttcatcatgggcctccagttccacccggagcgcatgcgccggccgggctccgacgagttcgactaccccgggtgcgccagggcctaccaggaattcgtccgcgccgtggtcgcctaccaggagaagcaggcggccgccgccgccctccccgcgtcgccgaagctgaacaaggagatggagaggcggcgcaagatcatcttccggagcttctcgctcgccaaggacatgtacctctccggcggcggccgcgcccacacgaagccggcggagcagcgcgacctcgacgccggcgccgagttcctcgagtcgaacacggcggcgctgagcgtgcagcaggagaagcggctgaagcagatgggcgcgacggtgcggaacgcgtcggggtacctcaacagcctgaagctgaacgaggggcgggaggcggcggcgcgggcgctcatggcggagatggcggtgagccagctctcggacctcgcctccttctaccagaccatgggcaggatctgctccgaggtgctcgacgcgaagctgcaggcgctgcaccagcacgagtgagcaactcgagcgagcgtgtccggacgcgtgtccgtgtgccaacmccgggagcttgyttcgccccctcatacatgtcattactcgcctgcaaacttcgagcgtcac

SEQ ID NO: 5822 - protein, 435 aa, Panicum virgatum
  misc_feature: Ceres CLONE 1826796
  misc_feature (1)..(244): Pfam Name: Peptidase_C26 Pfam Description: Peptidase C26
MSPSPDLSRVLPRVLIVSRRTVRKNKFVDFVGEYHLDLIVGYGAVPVIVPRVAGVHTLLDSFEPIHGVLLCDGEDIDPALYESAADAGAGALSPEQLEAVQRLHPSDAAVDHEKDSIELRLARRCLERNIPYLGICRSSQVLNVACGGSLYQDVEHELGPAAAAVQHINYDDYDGHRHPVRVLPGTPLHEWFAGDLANDDGGAPAQQLMVNSYHHQGVRRLAQRFVPMALAPDGLVEGFYDPDAYNPGEGKFIMGLQFHPERMRRPGSDEFDYPGCARAYQEFVRAVVAYQEKQAAAAALPASPKLNKEMERRRKIIFRSFSLAKDMYLSGGGRAHTKPAEQRDLDAGAEFLESNTAALSVQQEKRLKQMGATVRNASGYLNSLKLNEGREAAARALMAEMAVSQLSDLASFYQTMGRICSEVLDAKLQALHQHE

SEQ ID NO: 5823 - DNA, 1364 bp, Panicum virgatum
  misc_feature: Ceres CLONE 1826802
  misc_feature: Encodes the peptide sequence at SEQ ID NO. 5824
gcaggctccagcaacttcctatctgtttcattctgttagctagagtcagctggttggcaatggctcggcctcagcttctcctcgcgctgctgtgcctcgccgcctccctgagcgcgcaggccgccgccggctccggcgggaggaagatggtcggcgtgtacgagctcaagatgggggacttctccgtcaaggtcaccaactggggcgccaggctcatgtccgtcgtcctccccgactccaaagggaacctggctgatgtcgtccttggcaaggacaccatcgcggaatacgttaacgacacctcttatttcgggccgataaccggccgcgtagcacagagaatatcccggggccggttcgtcctcgacggcaaagtctaccacctgtacaggaacgacggcaggaacacactccacggtggtggcagagggttccacaaggtcatctggacggtgaaggagtacgtcgccggcggcgactcgccgcacatcaccttctactaccgcagcttcgacggggagcagggcttcccggggaacctggacgcgtacgtgacgtaccgggtgtcgagcccctacacgctgggcgtgcacatgagcgcgacggcgctggacaaggcgacgccggtgaacctcctgctgcacacgtactggaacctgggcgggcacggcagcggcgacgtcctcggccacacgctccggctcttcgcgtcgcggcacgccgtgctggacgaggagctcctcccgtcgtcgggccgcgtcgcgccggtggccggcacgcccttggacttccgggcgccgacgcccatcggcgcgcgcatccgccaggtcatgggcggcaaggtcgtcgggtacgacgccaactacatcatcgacggggagccggagggcatgcggccggtcgcgcaggtgcgggacggcgcgtccggcagggcggtggagctgtgggcgaaccaggcgaccgtgcagatctacacggggaactggctgaacaacaccaaggggaaggatggcaaggtatacaaccagtacgcggggttcaccctggagacgatggggtacgtggacgccgtgaaccaccccgagttcccgtcgcagacgctgcagcccggccaggagtacaagcacgacatggtcttcaagttctcattctagcacacgccatgctaaagtgtgtaggagtcgtctgctagcacatattctacatggcaaacttgtcaccgccatacaccatttcagatggcgtgacactctccacgttcgaaaaaccatgtttctcatacatccataagatggctcttatgtaaaatttgtagcctttgataatatacaactttgtggttttaaaaaaaaaaaaaaaaaaaa

SEQ ID NO: 5824 - protein, 364 aa, Panicum virgatum
  misc_feature: Ceres CLONE 1826802
  misc_feature (1)..(328): Pfam Name: Aldose_epim Pfam Description: Aldose 1-epimerase
MARPQLLLALLCLAASLSAQAAAGSGGRKMVGVYELKMGDFSVKVTNWGARLMSVVLPDSKGNLADVVLGKDTIAEYVNDTSYFGPITGRVAQRISRGRFVLDGKVYHLYRNDGRNTLHGGGRGFHKVIWTVKEYVAGGDSPHITFYYRSFDGEQGFPGNLDAYVTYRVSSPYTLGVHMSATALDKATPVNLLLHTYWNLGGHGSGDVLGHTLRLFASRHAVLDEELLPSSGRVAPVAGTPLDFRAPTPIGARIRQVMGGKVVGYDANYIIDGEPEGMRPVAQVRDGASGRAVELWANQATVQIYTGNWLNNTKGKDGKVYNQYAGFTLETMGYVDAVNHPEFPSQTLQPGQEYKHDMVFKFSF

SEQ ID NO: 5825 - DNA, 1094 bp, Panicum virgatum
  misc_feature: Ceres CLONE 1826835
  misc_feature: Encodes the peptide sequence at SEQ ID NO. 5826
aactcctgtgtgccccgtcggccgcagcagctgcccgtccccgccgcctccggccgagcacgccgccgccaccgcctccggccgagcacgccgccgccaccgcctccggccgagcacgccgccgccaccgccggcgagggcgcgcgtcgacggcccgtccctttcgcatggatatgacccccgcgtccgtctcgtccaacccgcgctcggtcgaggaaatctacaaggacttctccggccgccgcgccggcctcgtccgcgccctcacctccgatgtggacgatttctacagctcctgcgacccagataaggagaatttgtgcctgtacggcctccccagcgggacctgggcggtggcgccgccagcggaggaggtgccgccggagatgccggagccggcgctcggtatcaacttcgcgcgggacggcatgcaacgccgggactggctctcactcgtcgcagtccactccgactcgtggctcatttccgtcgccttcttcttcggcgcacgcctcaacgccaacgatcggaagcgcttattcagtatggtcagtgatcttccatccgtctttgaagcattctcagacaggaaacacggcagagataggtctggcgttgatagcagcggcaagtctagacactcgtcaaagagaggaagcgacggccacgtgaagaattctagagcagcagctcctgctgccaaacagtacgatgatgatgatgacgaagacgacgaggagcacaccgagaccttttgcgggacctgcggtggcctgtacaattcgaacgagttctggatcggctgcgacatctgcgagaggtggttccatggcaagtgcgtgcggattacccccgctcgagcggaccacataaagcactacaagtgcccggactgcagctcgaagaaaatgaggcagtagtagtgggggggcgtctgatctgatcaaaaccatactcctgttgtctgtccgcagctagcagatgtgaattcgttttagaaacgttgttgtggtgttgtgtggtggtgataggaagaggcagaggacagaatagatacatgctcgttgctcgttcaaaaaaaaaaaaaaaaaaaa

SEQ ID NO: 5826 - protein, 250 aa, Panicum virgatum
  misc_feature: Ceres CLONE 1826835
  misc_feature: Great-hit functional homolog of the protein sequence given in SEQ ID NO 9331
  misc_feature: Useful for making plants with altered Lignin content
  misc_feature: Useful for making plants with modulated flowering time
MDMTPASVSSNPRSVEEIYKDFSGRRAGLVRALTSDVDDFYSSCDPDKENLCLYGLPSGTWAVAPPAEEVPPEMPEPALGINFARDGMQRRDWLSLVAVHSDSWLISVAFFFGARLNANDRKRLFSMVSDLPSVFEAFSDRKHGRDRSGVDSSGKSRHSSKRGSDGHVKNSRAAAPAAKQYDDDDDEDDEEHTETFCGTCGGLYNSNEFWIGCDICERWFHGKCVRITPARADHIKHYKCPDCSSKKMRQ

SEQ ID NO: 5827 - DNA, 1246 bp, Panicum virgatum
  misc_feature: Ceres CLONE 1826875
  misc_feature: Encodes the peptide sequence at SEQ ID NO. 5828
cgaagcggccggtgtgcgcgtcagtgtgtcagtgcgtgtgcgcagggtgaggcggaggagatggcgaggcacttcgtgctcaacaccggcgccgagatcccttcggtggggctcggcacctggcagtccaagcctgacgacgtaggcgactccgtctacgccgctgtcaaggcagggtaccggcacatcgtttgtgccagggcttaccgcaacgagaaggagattggtttggctctgcaaaagctgttcgaagagggtgtagtgaagcgtgaagacttgtttatcacctctaagctatggcatgatcatcatgctccagaagatgtgccagagtcgctaggcaaaagcctgaacgacttgcagcttgagtacttggatctttaccttatccattggccatttagactcaagaaggggactgactggagtaaccctgaaaactttgtcccacctgacatccctgctacttggggagcaatggaaaagttatatgatactggcaaagctcgtgcaatcggtgtgagtaacttctcaacaaagaaactgggtgaccttcttgctgtagctcgtataccaccagctgttaatcaggtggaatgccatccgggttggcagcaaactaagctccataacttctgtcagtcagctggtgttcatctttctgcgtactcaccactaggttcacctggttcagcttggatcaacagtaatgtccttaaagaaccagtcgttacctcaatagcagataaacttgggaaaactcctgcacaggtggccctgcgctggaacattcagatgggtcacagtgtactaccaaagagcctgaatgagcgaaggataaagcaaaatcttgatgtttatgattggtctattccagatgacttgcttgcagagttctctgagattaagcaggttaggctgatcagaggcgacttcactgttcacccgcagagcgtttacaagaccctcgaggagctctgggatgaggaaatttaggaatgaaattggagttcatcctgagcagagagcaacatatgtaggatccgggcacttcatatatgctcctaccaccatatttgctggtttagtgggcgattcaatcactagtgtcaccctagatgttagttctctgttcagagttgtttgtgcagttaaagtatctggcagcattttatcctgtgctactattaccagcgtgtatctaaaccagagaattggcaccattcaaaaaaaaaaaaaaaaaaaa

SEQ ID NO: 5828 - protein, 311 aa, Panicum virgatum
  misc_feature: Ceres CLONE 1826875
  misc_feature (1)..(278): Pfam Name: Aldo_ket_red Pfam Description: Aldo/keto reductase family
MARHFVLNTGAEIPSVGLGTWQSKPDDVGDSVYAAVKAGYRHIVCARAYRNEKEIGLALQKLFEEGVVKREDLFITSKLWHDHHAPEDVPESLGKSLNDLQLEYLDLYLIHWPFRLKKGTDWSNPENFVPPDIPATWGAMEKLYDTGKARAIGVSNFSTKKLGDLLAVARIPPAVNQVECHPGWQQTKLHNFCQSAGVHLSAYSPLGSPGSAWINSNVLKEPVVTSIADKLGKTPAQVALRWNIQMGHSVLPKSLNERRIKQNLDVYDWSIPDDLLAEFSEIKQVRLIRGDFTVHPQSVYKTLEELWDEEI

SEQ ID NO: 5829 - DNA, 1270 bp, Panicum virgatum
  misc_feature: Ceres CLONE 1826917
  misc_feature: Encodes the peptide sequence at SEQ ID NO. 5830
gcaaccagcaacaggtccccatcgcggcagcatctcacctcaccccccagctcccgctgttccatggcggacggagacggagcggcggcgtcgagaaatctcacggagcactccgccagcgccgccgagaaggggctccccaggaggggcaagtcttcttcaggaaggacattaaataccgcacagattccgcttgtcgcaagccatccagaggtgtatgagccatgtgatgattcttttgccctcgttgatgcactgctctcagacaaagcacaacttttggcgctgcagccaaggttatgtatggaggtagggtgtggcagtggttatgtcatcacctctcttgcgatcatgctcaggcaattagcctctggaacccaatacctagcaactgacatcaacaaacatgctgcggagacaactcaagcaacccttgaagcccatggcgtgcatgcagatgtgatggttactgatattgtatctggtcttgagaagcgtctagctggtatggttgatgtggtagtcattaaccctccttacgtgccaactccggaggaagaaattggatgcaaaggcattgcctcgtcttgggctggagggttgaacgggcgccaggtgatagacaggatccttcctgctgtgcgggagatcctatcagaaagagggtggctgtacatggtgaccctcgaagataatgatcctttggatatatgtcatctgatgagcgagatggggtatgcttcacgcattgtcttgaaaagatgtactgaggaggagagcctttttgttctcaagttttggcgagatccgcacactgctacgaatgcgtctcctaaatctcctaaatctgagtcgtggttctctcagttgcctttcaaatccctttggcacaagggttcctagcagttcatggcttcatcaatctggaatcttcagttctgaaaaggagcaagaaatcctttgcaaatttgagatggcagcatatttttagacactcaaagtacaagaatcagcctaacctgattggtttagatctcaaaccaaacaggtccttagaccagaaattactgaacttttttatttttgtagcttaaattgttatcttatgttctcctcgtgtgtatatatgctaccatggattcttatcttactgcttttgggatctgtgttttccggatggattattctgtttaattgatcatttcaagatgagaggaaaagaagatttgggcagtttcttgtgcccttacaaaaaaaaaaaaaaaaaaaa

SEQ ID NO: 5830 - protein, 279 aa, Panicum virgatum
  misc_feature: Ceres CLONE 1826917
  misc_feature (1)..(204): Pfam Name: MTS Pfam Description: Methyltransferase small domain
  misc_feature (1)..(76): Pfam Name: Methyltransf_12 Pfam Description: Methyltransferase domain
MADGDGAAASRNLTEHSASAAEKGLPRRGKSSSGRTLNTAQIPLVASHPEVYEPCDDSFALVDALLSDKAQLLALQPRLCMEVGCGSGYVITSLAIMLRQLASGTQYLATDINKHAAETTQATLEAHGVHADVMVTDIVSGLEKRLAGMVDVVVINPPYVPTPEEEIGCKGIASSWAGGLNGRQVIDRILPAVREILSERGWLYMVTLEDNDPLDICHLMSEMGYASRIVLKRCTEEESLFVLKFWRDPHTATNASPKSPKSESWFSQLPFKSLWHKGS

SEQ ID NO: 5831 - DNA, 1510 bp, Panicum virgatum
  misc_feature: Ceres CLONE 1826949
  misc_feature: Encodes the peptide sequence at SEQ ID NO. 5832
ccggcccgcatcgcgcagcccgccacctgacagcgtccccctcgcagcctcgcctgcaacccgcagcgcaggcgcagcggcgaccggcggcggcgagcacccccaccacctgccggcggccagtcgtcggcgagcggcgttcaagcttggattccttaatcttatggcttccttcctttggagattgtaatttagcaagcgttgaattgaatttgtgaaaacagagatgagttctctgaagaaatccgacaagaaagctgccttggattttgcagcatggagtttcaatgttactacatcagttggaatcatcatgatcaacaaagctttaatggctactcatggatttagttttgccacaactttaactgggcttcatttcgttactaccaccttgatgactatcgtatttcggtggttaggcctgagccagccttcccacttgccgctagcagatcttatcaaatttgtcatattttcaaacttgtcgattgttgggatgaacgtgagcttgatgtggaactctgtgggcttttatcagatagcaaagctgtgcatgatacctgcatcatgtcttctggaggttgtctttgaccatgtacattattcccgggacacaaagctgagcataatggttgtgcttataggagttgcagtctgcacagtcactgatgtcagcgtgaatgcaagaggtctgattgcggctgttatagctgtttggagcacagctttgcaacaatattacgttcattttcttcagaggaagtactctctgaactcattcaacctcctgggccacactgctccagcccaggcaggatccctcctgctagtgggacctttcgtagatttcttgttgacaggcaaaagggtggatcacttcaatttttcatctcttgctctgtttttccttacgctctcatgtttcattgccattggcgtcaatctgagccaattcatctgcattggccggttttctgctgtatccttccaagtcctgggccacatgaagactgttcttgttctgtcccttgggtttctcttctttggcaaggagggtctgaatcttcaggtggttcttgggatggtccttgctgttcttggaatgatatggtacgggaacgcgtcggctaaaccaggtggcaaagagcggcgtagcgtactgccagtaaggtctgcaagtctcaagggaagttcagaagaaaagggcggtgctgagaaatagtcttgctgtctcactccattagagaggaccatttttcctttgaggttaagtttctggtggagggagtatcacagaagtggaaagctttaccagaagctgaattcctcctgtctagaaactcttatagttacaggtatacagtacttcattttttactttctgaatcatttgcagcgagggaaatgacaggtgtcttacaagactatacgggttttatacttttatcaaatatagtgtaattgtttgctaaacattgacttctgtatttcatatgaaatttgtgcc

SEQ ID NO: 5832 - protein, 332 aa, Panicum virgatum
  misc_feature: Ceres CLONE 1826949
  misc_feature (1)..(144): Pfam Name: TPT Pfam Description: Triose-phosphate Transporter family
MSSLKKSDKKAALDFAAWSFNVTTSVGIIMINKALMATHGFSFATTLTGLHFVTTTLMTIVFRWLGLSQPSHLPLADLIKFVIFSNLSIVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFVDFLLTGKRVDHFNFSSLALFFLTLSCFIAIGVNLSQFICIGRFSAVSFQVLGHMKTVLVLSLGFLFFGKEGLNLQVVLGMVLAVLGMIWYGNASAKPGGKERRSVLPVRSASLKGSSEEKGGAEK

SEQ ID NO: 5833 - DNA, 1460 bp, Panicum virgatum
  misc_feature: Ceres CLONE 1826979
  misc_feature: Encodes the peptide sequence at SEQ ID NO. 5834
acacaaactcatcagcagcagcttattactaagcaacactcaactcaagagagcgagtgtgggtgtgtgtgagagagtgtgggtgtgtgtgagagagagacggagagagatcgagcgagagcaaccgagatggaagctaccagcagcacgctctccttcccggtgatcaacatggagaagctccagaccgaggagaagccggcggccatggaggtcatccgcgacgcctgcgagaactggggcttcttcgagctgcttaaccatggcatctcccacgagctgatggacgaggtggagcggctgaccaaggcgcactacaccagctgccgcgagcccaagttccaggagttcgcggcgcggaagctggaggccggcgagaagggcgccgacgtcaaggacgtggactgggagagcaccttcttcgtccgccacctccccgcctccaacatcgccgacctccccgacctcgacgaccactacaggcaagtgatgaagcaattcgcgtcggagatacagaagctgtcggagaagctgctggagctgctgtgcgagaacctgggcctggagcaggggtacctgaagcaggccttcgctgggtcgaacggcccgacgttcggcaccaaggtgagcgcgtacccgccgtgcccgcggccggacctcgtcgacggcctccgcgcgcacaccgacgccggcggcatcatcctgctgttccaggacgaccaggtgagcggcctgcagctgctcaaggacggcgagtgggtggacgtgccgcccgtgcgccacgccatcgtcgtcaacgtcggcgaccagctggaggtgatcaccaacggccggtacaagagcgtgatgcaccgggtgcttacgcggcccgacggcaaccgcatgtccatcgcgtccttctacaaccccggcgccgacgccgtcatcttcccggcgcccgcgctcgtcgccgccgccgccgacgacgaggagcgcgccgaggcggcgtacccgaggttcgtgttcgaggactacatgaacctgtacgtgcgccacaagttcgaggccaaggagccccggttcgaggccatgaagtccgccatcgccaccgcttgacttgactagcatcgtggtggccggctgcaagcttgcgtgagctggacatcgtggcaagcattctcgttctcgacatgtgtattgtgtacggtagtagataggcacgtaatctgtgcttataggcgtggcacggtgcgagtgtatcgttgagtaatgtacgtattgcttgcgtctcagataagtatatacgtatatatatttgtactgtagagtttgtaccaccgtctattgtacgagcagcgtgcgccgccaggagttgatgtgttgaaagtagcttcatctttgtggcagtcagctatgtatgtgatctgcttgtcagaacaaaatcaagtgaaacgttcttattaaagagagcggaattcatc

SEQ ID NO: 5834 - protein, 321 aa, Panicum virgatum
  misc_feature: Ceres CLONE 1826979
  misc_feature: Great-hit functional homolog of the protein sequence given in SEQ ID NO 9258
  misc_feature (1)..(101): Pfam Name: 2OG-FeII_Oxy Pfam Description: 2OG-Fe(II) oxygenase superfamily
  misc_feature (7)..(316): SWISSPROT Homolog: EC 1.14.17.4 1-aminocyclopropane-1-carboxylate oxidase 1
  misc_feature (9)..(316): SWISSPROT Homolog: EC 1.14.17.4 1-aminocyclopropane-1-carboxylate oxidase 2
  misc_feature: Useful for making plants with modulated heat sensitivity
MEATSSTLSFPVINMEKLQTEEKPAAMEVIRDACENWGFFELLNHGISHELMDEVERLTKAHYTSCREPKFQEFAARKLEAGEKGADVKDVDWESTFFVRHLPASNIADLPDLDDHYRQVMKQFASEIQKLSEKLLELLCENLGLEQGYLKQAFAGSNGPTFGTKVSAYPPCPRPDLVDGLRAHTDAGGIILLFQDDQVSGLQLLKDGEWVDVPPVRHAIVVNVGDQLEVITNGRYKSVMHRVLTRPDGNRMSIASFYNPGADAVIFPAPALVAAAADDEERAEAAYPRFVFEDYMNLYVRHKFEAKEPRFEAMKSAIATA

SEQ ID NO: 5835 - DNA, 1271 bp, Panicum virgatum
  misc_feature: Ceres CLONE 1827147
  misc_feature: Encodes the peptide sequence at SEQ ID NO. 5836
acgcccgtccctccttcattcctcacggagcgaaggcgcgcgccggccgccggcgccagccatgaagcaggccacctcgtcgcacgggctccacggcgcgtccctctgcacgccgtacctcctcctcgtgccgctcggcctgctcgccgtgctgctcgtgctcccgagcctcggctcctccaacgcccgctccgacggcctcggcgtgctctgcggcggcgcgggcaccgacgggtactccgtctcgtctggggccgtcgacagccaggccggcgccggggcggcgccgccgacgcgaggggcggaggagttcagcctgctcgtcggcgtcctgaccatgccgagccggcgggagcggcgggacatcgtgcggatggcctacgcgctgcagccgccgccgccgcccggcgtggcgcgcgtggacgtccgcttcgtgttctgcaacgtgaccgacccggtggaggcggcgctggtggcggtggaggcccggcggcacggcgacatcctggtgctcaactgcgccgagaacatgaacgacggcaagacgcacgcgtacctctcctccgtgccgcggctcttcgcgtcggcgccctacgactacgtgatgaagaccgacgacgacacgtacctgcgcgtggcggcgctcgccgaggagctccgcggcaaaccccgcgacgacgtctacctcggccacggcttcgccgtcggcgacgaccccatgccgttcatgcacgggatggggtacgtcgtatcgtgggacgtggcgcggtgggtgtccaccaagcaggagatcctgcgccacaacgacacgcacggccccgaggacctgctcgtcggcaagtggctcaacatcggcggcaaggggaggaaccggtacagcctcaagccccggatgtacgacctcaactggttcatggacaacttccggccggacaccatcgccgtgcacatgctcaaggacaaccgccgctgggcggcggcgttccggtacttcaacgtcaccgccgggatcacgccctccgacctgtaccatctgcagtgaccgagcagctaagctgtttaattttgttccatttttggtgtatttcctattttcctgaggtgacgttggttgattgtaccaaaggtggcccagggagttcacattcaattcatttcgtgtatttgttgttattatattggtcgtaacgagcccgcccaagctgagcaattagctcgaggctctcccaagtggaatgccgtgttgatactaaaaaaaaaaaaaaaaaaaa

SEQ ID NO: 5836 - protein, 326 aa, Panicum virgatum
  misc_feature: Ceres CLONE 1827147
  misc_feature (1)..(178): Pfam Name: Galactosyl_T Pfam Description: Galactosyltransferase
MKQATSSHGLHGASLCTPYLLLVPLGLLAVLLVLPSLGSSNARSDGLGVLCGGAGTDGYSVSSGAVDSQAGAGAAPPTRGAEEFSLLVGVLTMPSRRERRDIVRMAYALQPPPPPGVARVDVRFVFCNVTDPVEAALVAVEARRHGDILVLNCAENMNDGKTHAYLSSVPRLFASAPYDYVMKTDDDTYLRVAALAEELRGKPRDDVYLGHGFAVGDDPMPFMHGMGYVVSWDVARWVSTKQEILRHNDTHGPEDLLVGKWLNIGGKGRNRYSLKPRMYDLNWFMDNFRPDTIAVHMLKDNRRWAAAFRYFNVTAGITPSDLYHLQ

SEQ ID NO: 5837 - DNA, 1369 bp, Panicum virgatum
  misc_feature: Ceres CLONE 1827193
  misc_feature: Encodes the peptide sequence at SEQ ID NO. 5838
ttggagctgcactgcacgcagcctcctggccaagatcacgacgcagctcatctgtcgcaggctcgcagcgtcagacttacctcgaccgcaggaaaacttgatccaatccaacgccatgggcggcctctccatgggccaggccttcgtgcaggcccccgagcaccgccccaagcccaccgtcaccgaggccaccggcatcccgctcatcgacctctcgccgctcaccaccggcgaggccgccgccgtggacgcgctggccgccgaggtgggcgcggcgagccgcgagtggggcttcttcgtggtggtgggccacggcgtgccggcggaggccgtggcgcgcgcgacggaggcgcagcgcgcgttcttcgcgctcccggccgagcgcaaggccgccgtgcggaggagcgaggcggagccgctcgggtactacgagtcggagcacaccaagaacgtcagggactggaaggaggtgttcgacctcgtcccgcgcgagccgcagcggccggcagccgtggccgacggcgagctcgtgttcgccaacaagtggcctcaagacctgccgggattcagagaggcgctggaggagtacgcggaagcaatggaggagctggcgttcaagatactggagctgatcgcccggagcctgaacctgaggcccgaccggcagcacggcttcttcagggaccagaccaccttcatccggctcaaccactaccccccccccccctgcccgagccccgacctcgccctcggcgtggggcggcacaaggacgccggagccctgaccgtcctgtaccaggacgacgtcggcgggctcgacgtccggcggcgctccgacggggagtgggtccgcgtcaagcctgtccccaactccttcatcatcaacgtcggcgacatcatccaggtgtggagcaacgacaggtacgagagcgcggagcaccgggtgtcggtgaactcggccagggagcggttctccatgccctacttcttcaacccggcgagctacaccatggtggagcccgtggaggagctggtgagcgaggaggccccgccccggtacaacgcctacaactggggcgacttcttcagcaccaggaagaacagcaactacaagaagctggacgtggagaacatccagatcgcccatttcaagaagagcgtcgccgccgcctaggacatgaaggcatcacctagctacctcgccgcctaagaaagaaataatgtgcgtgtgcgcttgtaataatcgtggtgtgagatgtgacgagtactctgacgtgtttgaaaataacagccctgtgttggcctggttatctgcaaaaatcaaaactttcttgaagaaagtttcttctaaaaaaaaaaaaaaaaaaaa

SEQ ID NO: 5838 - protein, 352 aa, Panicum virgatum
  misc_feature: Ceres CLONE 1827193
  misc_feature (1)..(102): Pfam Name: 2OG-FeII_Oxy Pfam Description: 2OG-Fe(II) oxygenase superfamily
MGGLSMGQAFVQAPEHRPKPTVTEATGIPLIDLSPLTTGEAAAVDALAAEVGAASREWGFFVVVGHGVPAEAVARATEAQRAFFALPAERKAAVRRSEAEPLGYYESEHTKNVRDWKEVFDLVPREPQRPAAVADGELVFANKWPQDLPGFREALEEYAEAMEELAFKILELIARSLNLRPDRQHGFFRDQTTFIRLNHYPPPPCPSPDLALGVGRHKDAGALTVLYQDDVGGLDVRRRSDGEWVRVKPVPNSFIINVGDIIQVWSNDRYESAEHRVSVNSARERFSMPYFFNPASYTMVEPVEELVSEEAPPRYNAYNWGDFFSTRKNSNYKKLDVENIQIAHFKKSVAAA

SEQ ID NO: 5839 - DNA, 1430 bp, Panicum virgatum
  misc_feature: Ceres CLONE 1827310
  misc_feature: Encodes the peptide sequence at SEQ ID NO. 5840
atgcgctagctttgctgctctcgccaaaccaaacaccaatggccgcacccgcccagccgtccaccgtcctcaatgagctccgccgggcgcagcgtgccaatggccccgccgccgtgctagccatcggcacggcggttccggcgaactgcgtgtgccaggatgagttcaccgactggtacttccgtgtcaccaagagcgaccacctgaccgagctcaaggccaagatgaagagaatgtgtgacaagtcaagcatcaagaagcgctatttccaccacaccgaggagatgatcggcgggcacccggagttcctggaccgcgcggcgccatcgctcggcgcgcggctgcgcatctccgcggacgccgtgcccgagctcgccgccgcggcggcggagcgggcgatcgcggagtggggccggcaggcggccgccatcacgcaccttgtcgtcgccaccaactccggcgccggcgagccgggcgcggacctccgcctggcacgtctcctgggcctccgcccgaccgtgcgccgcaccctgctgtacctccacgggtgctcggcgagcttcgtcgcgatccggctcgccaaggacatcgccgagaacaaccgctgcgcgcgcgtgctcgtggcctgcgcccacgccaccatcctccccttcggtgcccccgacgaggcccagctcgacgcccttgtcgccatggccctcttcagcgacggcgccggcgcagccatcgtcggcgccgacccgacgagccccgtcgagcgccccgtcttccacatcgtgtcgtcgtcgcaggcgacgctgccggggacagggcacgccctggggatcgatctcggcgagggtggagtccggtaccgcatggccgctgaggtgccggagcttgtccgcggcaacatagagcggtgcctggtggactcgctggcgccgctcggccaggcggccgcgagtggcggcggcggcgacggctggaacggccttttctgggcggtgcaccctggcagccgcccgctgttggacagctacgaggccgccctaggtctggaggcagggaagctcgcggccagcaggagcgtgctgagcgagtacggcaacatgttggccgcgaccatcatcttcgtcctccacgagatgcggcggcgccgccaagatggcgaggaggaaggggacgactcgcaatgggggatcatgtcggggctcgggccagggctcacaatcgagacaatagttttgcatgcctctactagctgcttagagcagcttcactaaaggatacggaaccaggcaagaaacgggaaatctccaacacctatgaggaaagatgtgtaattcaaaaaattaggtgcaataagtgtaagatggaaattgtctttcagtgaacaatcaaataaaccacactattcgcatgggcatcaaaaaaaaaaaaaaaaaaaa

SEQ ID NO: 5840 - protein, 408 aa, Panicum virgatum
  misc_feature: Ceres CLONE 1827310
  misc_feature (1)..(213): Pfam Name: Chal_sti_synt_N Pfam Description: Chalcone and stilbene synthases, N-terminal domain
  misc_feature (11)..(399): SWISSPROT Homolog: EC 2.3.1.74 Chalcone synthase 4
  misc_feature (8)..(399): SWISSPROT Homolog: EC 2.3.1.74 Chalcone synthase
MAAPAQPSTVLNELRRAQRANGPAAVLAIGTAVPANCVCQDEFTDWYFRVTKSDHLTELKAKMKRMCDKSSIKKRYFHHTEEMIGGHPEFLDRAAPSLGARLRISADAVPELAAAAAERAIAEWGRQAAAITHLVVATNSGAGEPGADLRLARLLGLRPTVRRTLLYLHGCSASFVAIRLAKDIAENNRCARVLVACAHATILPFGAPDEAQLDALVAMALFSDGAGAAIVGADPTSPVERPVFHIVSSSQATLPGTGHALGIDLGEGGVRYRMAAEVPELVRGNIERCLVDSLAPLGQAAASGGGGDGWNGLFWAVHPGSRPLLDSYEAALGLEAGKLAASRSVLSEYGNMLAATIIFVLHEMRRRRQDGEEEGDDSQWGIMSGLGPGLTIETIVLHASTSCLEQLH

SEQ ID NO: 5841 - DNA, 994 bp, Panicum virgatum
  misc_feature: Ceres CLONE 1827342
  misc_feature: Encodes the peptide sequence at SEQ ID NO. 5842
ggagtctcttcttgcagcgcacgaagatacggaggagaactcgactcccgcggcgtgccgcggccggagctgcctttaagcaaagcgagccatcccccttccccaaccgcgcttcgcaaattcgcatcagttcatctgggatcgatccgagagcgaagcaaacaaacagcgccgcaagcgggggaggagacgagtgaatctcggagcagaggcgatggccaggttcgacccgtacgagaacaacggcggcacgtgcgtggccgtcgccggcgccgactactgcgtggtcgccgccgacacccgcctctccgtcggatacagcatcttgtcccgcgaccactccaagatcgcccagctggcagacaaatgtgttttggcctcatctggcttccaaggtgatatcaaagctttgcagaagaatctggctgccaaggaattggtttatgagcacaatcataacaagaagatgagctgccctgcaatggcgcaactgctgtcgaacacgctctactacaagagattcttcccatactacgtgttcaatgtattgggtggactggacagccaaggtaaaggatgtgtctttacatacgatgctgttgggtcttatgagaggacaggttatagtgctcagggaacgggtgcagcattgatgatgcctgttcttgacaatcagttgaaatctcctagtcctctactactgccagctagggatgcagtgacgcccttgtctgaatctgaggcggttgatctggtgaaggacgttttcgcatcagctacagaacgagacatatacactggagatagattggaaattgtggtcatcaacagctccggcacacaccgagagtacattgaacttaggaaggactagtgcattgttcctgtgaaatggcactaccattgttaagcataaggacatttgcttctgttgtcagatgtttgaatttcctctgaaaagaaagatattttagaaaaaaaaaaaaaaaaaaaa

SEQ ID NO: 5842 - protein, 219 aa, Panicum virgatum
  misc_feature: Ceres CLONE 1827342
  misc_feature (7)..(219): SWISSPROT Homolog: EC 3.4.25.1 Proteasome subunit beta type 1
MARFDPYENNGGTCVAVAGADYCVVAADTRLSVGYSILSRDHSKIAQLADKCVLASSGFQGDIKALQKNLAAKELVYEHNHNKKMSCPAMAQLLSNTLYYKRFFPYYVFNVLGGLDSQGKGCVFTYDAVGSYERTGYSAQGTGAALMMPVLDNQLKSPSPLLLPARDAVTPLSESEAVDLVKDVFASATERDIYTGDRLEIVVINSSGTHREYIELRKD

SEQ ID NO: 5843 - DNA, 1356 bp, Panicum virgatum
  misc_feature: Ceres CLONE 1827344
  misc_feature: Encodes the peptide sequence at SEQ ID NO. 5844
acccctacccaccatcaccgactcaccgagctctcttcctacctctctgctatctctctcggcacgcacgcgcgcgagctctccttcctcgtcgaggtgcattgatggcgaccgaagtggctgaggctccggtgccgctggcggaggcggcccccgacgccgcagcggaggcccccgccgcggccgcggccgccggcgacgcgaagccggccaaggccaagaagcccgccgcgccgcggaagcgcgcgaacccgacccacccaccctacgctgagatgatctcggaggcgatcacgtcgctcaaggagaggacggggtcgagccagtacgcgatcgccaagttcgtggaggacaagcagaaggccaagctgcctcccaacttccgcaagctgctgctcgtgcagctgaagaagctcgtcgccgccggcaagctcaccaaggtcaagaactcgtacaagctgccggcggggcgcgccccggccgccgacaagcccaaggccaagcccaaggctaagcctgctgccgccaagcccaaggccaagccgaagcctgccgcgaagaagcccaaggccgctgccaagcccaaggctaaggcgcccgccaaggctaagcccgccgcgaagccgaagccggccgccaagcccgcggccaagccgaaggcagtcgctgcgaagccgaagccagccgccaagccggctgccaagcccaagccagccgccaagcctaaggccaaggcggccgccaagcccaaggccaaggctgctgctgccaagcccaagcccgcggccaagacgaaggccccagccacgccgtcccggacgacccgccccgccaaggccgccaagacgtcggccaaggacactccggggaagaaggcggctccggcggccaagaagcccgcggcggcagccaagaagtcccctgccaagaagcctgctccggcgaagaaggccccggccccggcgaggaaggtgccggcccggaaggcgaagaagtagagcggtcggcgtcagtggaaatgtggaatctaggctttcgttctcgtttggtttttctagacctttctctgtttttttttcctcctccactgtccacagcgataggaggaaatgaaggagtaaatctattgtttggcactgtagatgtactgtttgtcactgtagacaaagagggcgtgggaaacgaggcaaaagcaaatttttgctcttgccattgtggacagctttagtcccgcggatgtcaggggtactagcttgtaaatttgatatggaggcgggggtgcagtggccattccgtacccatggtgaaaagaaagaatggaggcgacgacgatgacaaaaaaaaaaaaaaaaaaaa

SEQ ID NO: 5844 - protein, 297 aa, Panicum virgatum
  misc_feature: Ceres CLONE 1827344
  misc_feature: Great-hit functional homolog of the protein sequence given in SEQ ID NO 9327
  misc_feature: Useful for making plants with modulated nitrogen use efficiency
  misc_feature: Useful for making plants with modulated oxidative stress sensitivity
MATEVAEAPVPLAEAAPDAAAEAPAAAAAAGDAKPAKAKKPAAPRKRANPTHPPYAEMISEAITSLKERTGSSQYAIAKFVEDKQKAKLPPNFRKLLLVQLKKLVAAGKLTKVKNSYKLPAGRAPAADKPKAKPKAKPAAAKPKAKPKPAAKKPKAAAKPKAKAPAKAKPAAKPKPAAKPAAKPKAVAAKPKPAAKPAAKPKPAAKPKAKAAAKPKAKAAAAKPKPAAKTKAPATPSRTTRPAKAAKTSAKDTPGKKAAPAAKKPAAAAKKSPAKKPAPAKKAPAPARKVPARKAKK

SEQ ID NO: 5845 - DNA, 1907 bp, Panicum virgatum
  misc_feature: Ceres CLONE 1827389
  misc_feature: Encodes the peptide sequence at SEQ ID NO. 5846
aggagcgagcgatcgagcggattggagcagtagatctcactccgccggcgctttgcttgcgtttaactcctccctccggcgaaaccccagtccaacgcccgagccgccgggattccgccgccggccgaagccggccacctgccccgccagcggagcggtgaggattgggggtggggcggagtcgcggagatgcagagcgccacgcggctgacgctgctgctgtgcgcggcgtgggcggccacggtgctctacggcgagatgggcgcctactgggcctcctacctcgcgtgctcgtggccctcgccgtcgctgtcctcctcgccgccgagtaaccatgtgaagattgctgttgttgctgatccacagcttatggacagcacctcccttggtcttccttcaagctcaattgctctccaagctgctgagttttacacagatttgaacatgagaaggtcctttcagtctgccatactgccattcgaacctgatatggtcttatttcttggtgatcactttgatggaggcccatacatgtccgatgaagagtggcatgaatcattgtttcgatttaagcatatattcagcatgaatgaacagagaagaaagccacatataccaatctattacctgtccggaaatcatgatattggttattcagcatttttctccgctcatcctgaggtgctgagtcggtatgaaaaagaatttggatcaagaaactaccaattttctgctgggaaggtcgactttgttgtcattgatgctcaaacacttgatggagctaaaaagagcaaagaaaggtcctcctcttgggagttcattaaaactctatccccaggtaacacatcgaacccaaaggttctactaacacatattccactctaccgacctgataacactcattgtggcccacatcgctcttcaccttctataaatcagagggtatcctatgctgcattcgaccaaggaatcacctaccagaattatctcactaaagagacttctgaacttttgctaagcttgttgaaaccggtccttgtgctctcaggtcatgaccatgaccaatgcacagtcatccactccactccttttgggccagtaacagagcacacgctggggacaataagttggcagcaaggaaatctctatccatcatttatgctgctatctgctgggcccaagctgtcacagaattcaactgatctgaaacatgaagtcataacgaacctttgttttctgcctaaacaaacccatatttatatctggtatatctgccagtttgcagtgaccatccttctgctagtcttttggccaaccaatggtctgagctctgttccttacatgaatacatttgtgagcttcatgaggtcggtaggtgctgaactgttctcaagaaccaaagaaaaagatgatgaggaagatggtgaatatgaaatggtttttgatgcggaagggtccatgcacctcgttaaaaaggctgtagcaaaagccccaagtgcttgctcagactccagaactgtaggacgtggaagtattgtcgcaagggcgacagccggaaaacaccaattggagcccgattcatctattcttgtcgagatgggttccgaggtgacatcagaagatggggcgaagttggcgcgccctagcaaatcgaaagtaaggaaggtgctccaacggctgttccgcgtcattcagtccatagttgtgattgccgctctgaatgttcccctgtacatgatgcttctgttcaaaggctggattgaccattgaagtacatcagagcctagtccttccagtatttgattgatatctctagagtaactgcacacgcgaaaactaatttggtttttgctagggcggcaaataatatatctatttaatctgggcaaaaaaaaaaaaaaaaaaaa

SEQ ID NO: 5846 - protein, 526 aa, Panicum virgatum
  misc_feature: Ceres CLONE 1827389
  misc_feature (1)..(243): Pfam Name: Metallophos Pfam Description: Calcineurin-like phosphoesterase
MQSATRLTLLLCAAWAATVLYGEMGAYWASYLACSWPSPSLSSSPPSNHVKIAVVADPQLMDSTSLGLPSSSIALQAAEFYTDLNMRRSFQSAILPFEPDMVLFLGDHFDGGPYMSDEEWHESLFRFKHIFSMNEQRRKPHIPIYYLSGNHDIGYSAFFSAHPEVLSRYEKEFGSRNYQFSAGKVDFVVIDAQTLDGAKKSKERSSSWEFIKTLSPGNTSNPKVLLTHIPLYRPDNTHCGPHRSSPSINQRVSYAAFDQGITYQNYLTKETSELLLSLLKPVLVLSGHDHDQCTVIHSTPFGPVTEHTLGTISWQQGNLYPSFMLLSAGPKLSQNSTDLKHEVITNLCFLPKQTHIYIWYICQFAVTILLLVFWPTNGLSSVPYMNTFVSFMRSVGAELFSRTKEKDDEEDGEYEMVFDAEGSMHLVKKAVAKAPSACSDSRTVGRGSIVARATAGKHQLEPDSSILVEMGSEVTSEDGAKLARPSKSKVRKVLQRLFRVIQSIVVIAALNVPLYMMLLFKGWIDH

SEQ ID NO: 5847 - DNA, 1477 bp, Panicum virgatum
  misc_feature: Ceres CLONE 1827397
  misc_feature: Encodes the peptide sequence at SEQ ID NO. 5848
acaggcggagccatctcatcggcggcggcggatagccggaaaccagccggaacctaccgaacaggggcaccaccgatgctaaaaccccagacggcgtggacggcttccctccctctcttcctcttccgtcgctgctcgagatccgcgcccaaccccttccctcccgccggcggccgccggcttccctgtctcccggtttgcaagcggcggatgagcacgcaggcgcaccccaggttcgcccccctccccacggagcaatctgaatcccaaaccgatgccggggcttcagggtaccagttccggctggtctcctacaacattttggcccaggtttatgttaagagcgcatttttcccgcattctccatctgcatgcctcaagtggaaatctcgatccaaagctgttctaacagaactcaagagttttgatgctgacctcatgtgtatacaggagttggatgagtacgataccttctacaagaaaaacatggaaaattctggatattcaagtatttacattcagcggtctggagataaacgggatggctgtggtatattctataaacccaaaagtgcggaactggtgcagaaagaaggaatacattacaatgatttagtggaaaaatatgttcatagtgatcatgtacatagtgccccgccaaataattcttcaccagaagacacgactgcaaagccagataatagcaagcgtggagatccaaatgatccatgtgtaagattgaagcgtgactgtgttggtttactcgcagctttcaagctcagtgatccttgtgatcacattttaatcgtggcgaatacacatatttattgggacccagaatggattgatgtaaagttggctcaggcaaaatatcttctttcgagagtctctcagttcgagcaactcatctcaaataaatttaattgtaaaccttcagtgatcattactggcgacttcaattcaaccccaggtgacaaggtatacaattatcttctatcagccaacttagaatctacagatgaagctccgatcaaattatgcagcctttatgctgcgaatggaggggagccagagttcacaaactacactcctggttttactggaacactggactacatattcttgtcaaacagtagttcaataaaacctactagcctactttgtttgccacgaggggattctgcggatgttcaaggaggcctgcccaactttcaacatcctagtgatcatttaccaattggtgctgattttcttgtagttagtagatagtacacaggcttgttgcttttccaactgcaatagaaagtggctttgaatatttgatttgtttgcacagttcaggcttcagatttaatgtgtaatatctcaaggcgcatttcctttttcttccttgtggaaccaataacaattaataccaattattattttgttatttatagtttaatatgcgtgctataaaaaaaaaaaaaaaaaaaaa

SEQ ID NO: 5848 - protein, 397 aa, Panicum virgatum
  misc_feature: Ceres CLONE 1827397
  misc_feature (1)..(319): Pfam Name: Exo_endo_phos Pfam Description: Endonuclease/Exonuclease/phosphatase family
MLKPQTAWTASLPLFLFRRCSRSAPNPFPPAGGRRLPCLPVCKRRMSTQAHPRFAPLPTEQSESQTDAGASGYQFRLVSYNILAQVYVKSAFFPHSPSACLKWKSRSKAVLTELKSFDADLMCIQELDEYDTFYKKNMENSGYSSIYIQRSGDKRDGCGIFYKPKSAELVQKEGIHYNDLVEKYVHSDHVHSAPPNNSSPEDTTAKPDNSKRGDPNDPCVRLKRDCVGLLAAFKLSDPCDHILIVANTHIYWDPEWIDVKLAQAKYLLSRVSQFEQLISNKFNCKPSVIITGDFNSTPGDKVYNYLLSANLESTDEAPIKLCSLYAANGGEPEFTNYTPGFTGTLDYIFLSNSSSIKPTSLLCLPRGDSADVQGGLPNFQHPSDHLPIGADFLVVSR

SEQ ID NO: 5849 - DNA, 1092 bp, Panicum virgatum
  misc_feature: Ceres CLONE 1827472
  misc_feature: Encodes the peptide sequence at SEQ ID NO. 5850
gagcaaacttaacccaactccaaacaactgaatcgaaccagtactaccagaccagagatcaccacagctcctgcagttctgcatcggctccgctccgcttacctcaccggcctagggtttttgccgcggctcatctcgcccgctccgccatggccgccgctcaagagtgctccgccgccgccgccggcgaggccccgaccaccggggagcaccggatggggactaccatcgtcggggtctgctacgacggcggcgtcatcctcggcgccgactccaggaccagcaccggaatgtatgtggcaaaccgtgcttctgacaagattactcaactgacggacaatgtgtatgtctgccgctctggatctgctgctgatacacaagtcatttcagactatgtacgttatttccttcaccaacacacaatccagcttgggcaaccagctactgtcaaagttgcagcaaacttgattaggttgctagcctatcagaacaagaacatgttgcaagctggcatgataattggaggatgggacaagtatgaaggaggccaaattttctccgttccccttggtggaacgattctgagacagccatttgcaattggaggttcgggttcaagttacctatatgcgctgcttgatcatgaatggagagagggaatgagccaggaggaggcggagaaatttgtggtgaaggtagtttcccttgctatggcccgtgatggtgctagtggaggggttgttcgtacagttactataaatgctgatggtgtgaagaggaacttttaccccggcgacaagctgccactgtggcacgaagagatggaaccccacaactcgttgcttgatattctagctgctggaaaccctgatccaatggtgcagtgaatttgcacaccagccatggccctttctttgtgaacttccctactgtatctgacttctagatttcaactaaagaactcgaaaccattcctgccaaattatgccacaccaatgtatttacgttttcttgttatcgttgtttcagtttagcactatgattgatgtttcaaagcaatggttatcacagtaaaaaaaaaaaaaaaaaaaa

SEQ ID NO: 5850 - protein, 245 aa, Panicum virgatum
  misc_feature: Ceres CLONE 1827472
  misc_feature (21)..(243): SWISSPROT Homolog: EC 3.4.25.1 Proteasome subunit beta type 6 precursor
MAAAQECSAAAAGEAPTTGEHRMGTTIVGVCYDGGVILGADSRTSTGMYVANRASDKITQLTDNVYVCRSGSAADTQVISDYVRYFLHQHTIQLGQPATVKVAANLIRLLAYQNKNMLQAGMIIGGWDKYEGGQIFSVPLGGTILRQPFAIGGSGSSYLYALLDHEWREGMSQEEAEKFVVKVVSLAMARDGASGGVVRTVTINADGVKRNFYPGDKLPLWHEEMEPHNSLLDILAAGNPDPMVQ

SEQ ID NO: 5851 - DNA, 1543 bp, Panicum virgatum
  misc_feature: Ceres CLONE 1827484
  misc_feature: Encodes the peptide sequence at SEQ ID NO. 5852
atattgatctccgaacactccccgactcccacagccgccccaccgtcgggcgtcgtcgctccattattcccagttaccactcaacacgtactagtatcgatgggaacgatgatgcttccgcctagcaatggccgcttccatcgcctcttcttccttctcgcgctcgccgtcgctgatctcacggtggtgcgggggcagtcgacgccgaacggcgacatgcgctacgccaccaacttcagcccgtccatggccatcgtcatcgtcgtgctcatcgtggccttcttcttcctcggcttcttctccatctacgtccgccactgctacggcgacggcccgagcggctcctcctccgcgggcccggctcccaacggcggcgccgcgcgctcgcggcgccagcgcgggctcgacgcggcggtgctcgagaccttccccaccatggcgtacgccgacgtgaaggcgcacaaggccggcaagggcgcgctcgagtgcgcggtgtgcctcagcgagttcgacgacgacgagacgctgcggctgctgcccaagtgctcccacgtcttccacccggactgcatcgacacctggctcgcctcgcacgtcacctgccccgtctgccgcgccaacctcgtcccggaccccaacgccaccgccggcgacgagcccgcggagctgccggctcctggtccagagcaggagttgccgtcgcccacgtccgcgccggcggtggtcattgacgtggaggagacggaggagcagaggatcatcagggaagaggccgacgagctgatgcgcatcggcagcgtcaagcgcgcgctgcgcttcaagtccggccgcgcgcccgcgccgttcccgcgctcgcactcgacggggcactcgctcgcggcggcggcgcccggcaccgccgccgccgccaccgacaggttcacgctgcggctgcccgaccacatgctccgggacctcgccgcggcggggaagctgcagcgcaccaggagcctcgtcgcgttccgcgccagccgcgggggcagcacgcgccgcggcgccggcgtcaggcccggcgaaggcagcagccgcggcggcgcgaggagcatccggctgggccagtccgggcggtggccgtcgttcctggctcggacgttctccacgtgggggtcgcggtcgacgcggaggggcgccgaggccgacgggtccagcaggggcggcagggcggccggcgccgccgccggcgcaggcgcaggcgcgaagtcagtggaatgcgacgaccaggcgtgcgcggctgggcaacgtgtttgacgcggcttcctctgtcgtggtcaatcggtggctgctaggaaactctccgtgctttcgtcgccgtcgtggtggtagacacaattttttggcacttgaattttggacggaaacagcttggtcgctccttctagacgcgtgttgtattcattttttttgtacacaaaaatcttgtacagaaaatggtagtacttaaaatatcatggagcggagaaaaaccctcctgtcctgtacaaatgaaatgaattcatcttatttc

SEQ ID NO: 5852 - protein, 395 aa, Panicum virgatum
  misc_feature: Ceres CLONE 1827484
  misc_feature: Great-hit functional homolog of the protein sequence given in SEQ ID NO 9641
  misc_feature (1)..(42): Pfam Name: zf-C3HC4 Pfam Description: Zinc finger, C3HC4 type (RING finger)
  misc_feature: The sequence is a functional homolog of  SEQ ID NO 1131 in the  10/666,642 US patent application
  misc_feature: The sequence is a functional homolog of  SEQ ID NO 1133 in the  10/666,642 US patent application
  misc_feature: The sequence is a functional homolog of  SEQ ID NO 380 in the  10/666,642 US patent application
  misc_feature: Useful for making plants with modulated nitrogen use efficiency
  misc_feature: Useful for making plants with modulated growth and phenotype characteristics
MGTMMLPPSNGRFHRLFFLLALAVADLTVVRGQSTPNGDMRYATNFSPSMAIVIVVLIVAFFFLGFFSIYVRHCYGDGPSGSSSAGPAPNGGAARSRRQRGLDAAVLETFPTMAYADVKAHKAGKGALECAVCLSEFDDDETLRLLPKCSHVFHPDCIDTWLASHVTCPVCRANLVPDPNATAGDEPAELPAPGPEQELPSPTSAPAVVIDVEETEEQRIIREEADELMRIGSVKRALRFKSGRAPAPFPRSHSTGHSLAAAAPGTAAAATDRFTLRLPDHMLRDLAAAGKLQRTRSLVAFRASRGGSTRRGAGVRPGEGSSRGGARSIRLGQSGRWPSFLARTFSTWGSRSTRRGAEADGSSRGGRAAGAAAGAGAGAKSVECDDQACAAGQRV

SEQ ID NO: 5853 - DNA, 1131 bp, Panicum virgatum
  misc_feature: Ceres CLONE 1827499
  misc_feature: Encodes the peptide sequence at SEQ ID NO. 5854
ggaaaaaaaaccacaagtcttcttgccagctcgcaaccacaaaccctagtagctcctcgcgacccagacgacgggctcgattcgttcctgtgttccgttggcttcgctcaagcctgtatcttttacggcaacactatgaactcccccggtgctggaaggcggattccgaagaggcgacggacggctaagttgctttcacagccttttgtttcacggccttttgaccttaactgcccccctgctgaaggggctggtgaggggggttcaactttgagcattatgcctgtctcacacacccaagcttcaagcagtatgcctgtctcacacagccaggcttccagtagcatgccacctgctactaatgagccacatgctggcatgcatagttgccccattgatgtggaagccattgatgatgatgttgttatccattcttcaagatcactccctcagtttcaggcaagacaacagtcgaccaggacggaacgtattactgtgataatagatgatgattctgaaacgaacccagaaccagcaggggatgctcttgatgagcatgtgaacacactgctatccctgggcataaaccgcaggtatcagcctctaagagcaactagcacttgccctgtaataagtttagtggacacaccagaagtcaacttcttcaaggcaccccctgaacctgtgaaggaggttccgaaggaaccaaagttcacctgccctatatgcatgaatgagctgacagaagcaacatccactgtctgcggtcacattttctgccagaagtgcatcaaggctgccattcaagctcagaagaagtgccctacctgccgaaagagccttaataaaaaccagcaccaccgggtatacctcccgacaacggagtaatccgatagtcattttggagcaagctctgcagcacctgatcttcaccacattgtggcgattgtatgtcggagctatttagagaggcttatcgatagcatagagtagtactgcgatttaacaagtggttttgccctcgcatttgggacatcataccaagctgtagcctcggtaaagtagtatcatcttgatttgggtgttattatgttcaacgcagtatcttatcaaaaaaaaaaaaaaaaaaaa

SEQ ID NO: 5854 - protein, 250 aa, Panicum virgatum
  misc_feature: Ceres CLONE 1827499
  misc_feature (1)..(38): Pfam Name: zf-C3HC4 Pfam Description: Zinc finger, C3HC4 type (RING finger)
  misc_feature: The sequence is a functional homolog of  SEQ ID NO 2446 in the  10/374,780 US patent application
  misc_feature: The sequence is a functional homolog of  SEQ ID NO 736 in the  10/225,066 US patent application
  misc_feature: Useful for making plants with modulated growth and phenotype characteristics
MNSPGAGRRIPKRRRTAKLLSQPFVSRPFDLNCPPAEGAGEGGSTLSIMPVSHTQASSSMPVSHSQASSSMPPATNEPHAGMHSCPIDVEAIDDDVVIHSSRSLPQFQARQQSTRTERITVIIDDDSETNPEPAGDALDEHVNTLLSLGINRRYQPLRATSTCPVISLVDTPEVNFFKAPPEPVKEVPKEPKFTCPICMNELTEATSTVCGHIFCQKCIKAAIQAQKKCPTCRKSLNKNQHHRVYLPTTE

SEQ ID NO: 5855 - DNA, 1353 bp, Panicum virgatum
  misc_feature: Ceres CLONE 1827510
  misc_feature: Encodes the peptide sequence at SEQ ID NO. 5856
aagcgaagcgagcggaaagccgaggcggcgagagtggagccaaaaagcgggcggcaccgcaccgcaccgcccgccaccaccgcaggaggagccgagcctttcggtgtgggggtgggggtggtggagccttgtcgcggtccagcggctagccggctaggggtggggttcctccgcgcctgctcgctactacttcattccatggcggccgggccggctgaaccctgacagcggcggcgggcggtgtggaggcgcgagaacaagccacggcgaggcggagatggtggtgtgctccatgcgcaagtcgtcgttcaaggactcgctcaaggtgctcgaggccgacatccaccacgccaacaccctggcagctgatttctccagggactacgatggggcctgcctccagatgcggatgtcctacagccccgccgcgcacttcttcctcttcctcgtgcagtggaccgattgcagcctcgccggcgcgctcgggctgctcaggatcctaatctacaaggtttatgtggatgggagtaccactatgtccacacatgagaggaaagcaagcatcagagaattttatgctgttatatttccatccctcatgcaactgcccaaggggatcagcgacctcgatgaccggaggcagaaggcggtctgcacagagagatacaggaggagagaccaggacgagagcaagaggccagtttctgagattgatgtcgagagggaggaggaatgtggcatttgcatggagatgaacagcaaggtggtgctgcccacctgcagccatgctatgtgcatcaagtgctaccgccaatggcgctccagatcccagtcctgccccttctgtcgtgacagcctcaagcgagtaaattccggtgacctgtggatgttcactgactgccgagacgtagttgacatggctacggtgagcagagagaacatcaggcgcctgtttatgtacatcgagaagctgcctctggtcatgccggaaaacatcttctacgcctatgattctcatgtaaaatagctcgagctgcacatgatgacttgctcaccattgttttctgagagtgatgacgcatggcttattgattcatgcagaggatgttcctcgtcctaggatgtggctaatcttggagcagcctgtggactctgacaagagaccttgagagctctgactgggtgtagagtcttgttcaggtttttgtaaatgtgctgtacatatttatggtgcaatgaaaaatctttagggaaaaagcgttgtgttccaagtagggaagctctggctgagatacacttggtgcatgtattgggttcgattttaagcttgaaatgctctgtagtttaaactgg

SEQ ID NO: 5856 - protein, 249 aa, Panicum virgatum
  misc_feature: Ceres CLONE 1827510
  misc_feature: Great-hit functional homolog of the protein sequence given in SEQ ID NO 9719
  misc_feature (1)..(38): Pfam Name: zf-C3HC4 Pfam Description: Zinc finger, C3HC4 type (RING finger)
  misc_feature: Useful for making plants with altered Lignin content
MVVCSMRKSSFKDSLKVLEADIHHANTLAADFSRDYDGACLQMRMSYSPAAHFFLFLVQWTDCSLAGALGLLRILIYKVYVDGSTTMSTHERKASIREFYAVIFPSLMQLPKGISDLDDRRQKAVCTERYRRRDQDESKRPVSEIDVEREEECGICMEMNSKVVLPTCSHAMCIKCYRQWRSRSQSCPFCRDSLKRVNSGDLWMFTDCRDVVDMATVSRENIRRLFMYIEKLPLVMPENIFYAYDSHVK

SEQ ID NO: 5857 - DNA, 1450 bp, Panicum virgatum
  misc_feature: Ceres CLONE 1827532
  misc_feature: Encodes the peptide sequence at SEQ ID NO. 5858
agatttgccggtttctaaggagaaagctcccaaggctaggctctgccgctccctgcagcagagtcgtaggctgcagcagcgccaaaatggcgagcaaggtggtggacctccggtcggacacggtcaccaagccctcggaggccatgcgggccgccatggccgcggccgacgtcgacgacgacgtcgtgggcgtcgacccgaccgcgcagcgcttccaggcggagatggccgcgctcatgggcaaggaggccgcgctctttgtgccctcgggcaccatgggcaacctcatctccgtcctcgtgcactgcgacgtcaggggcagcgaggccatcctcggcgacaactcgcacatccacgtctacgagaacgggggcatctccaccatcggcggcgtgcaccccaagaccgtgcccaacaactccgacggcaccatggacatcgacaagatcgtcgcggccatcaggcacccggatctgcattacccgaccaccaggctcatctgcctggagaacacacatgggaattctggtggaaaatgtttatctgtagaatacactaacaaggtcggtgaaattgcaacgagccatggcctcaagcttcatattgatggagctcgcatttttaacgcctctgtggcgcttggagtccctgtagatagactcgtgaaagctgctgattcagtttcggtatgcctatctaaagggttaggcgcccccgttgggtcggttattgttggttcgaaggacttcattgagaaggccaaaattcttaggaagaccctaggtggtggcatgaggcaggttggagttctctgtgctgctgctcaagttgccgtccgtgacactgtgggaaagcttgcagatgaccataggaaggctagagctttggcagaggggctgaagaaaattaaacatattacagtcgatccagcttccgttgagaccaatatggtattcttcgatatcgtcgatccaagaatatcacctgacaatctatgccaagtcttggaacagcacaatgtgcttacaatgccagcgagttcaaaaagtatcaggttcgtcctccattaccaaatttcagacagcgacgttcaatacgcagtgacatgtgttgagaaagcttttgaagagctactgaaaggtggtacaaacttggagctcttgacaaatggtactacaagaagttcgtacgggcactagatcacttccctttggaccgccccaatgtacaagctcggtgaccagcaatgttttctttaaaccagcaggagcgctgcttaattatttaagaaggggaagcacgtgaaggttgacgatagattctgtttagttatgaagaactgttggtgtttgtgacggtgacctttgctgaataactgatggttaatcgtgaccgcaccttggctgaataaactgctcctgttcactctcaaaaaaaaaaaaaaaaaaaa

SEQ ID NO: 5858 - protein, 370 aa, Panicum virgatum
  misc_feature: Ceres CLONE 1827532
  misc_feature (1)..(290): Pfam Name: Beta_elim_lyase Pfam Description: Beta-eliminating lyase
MASKVVDLRSDTVTKPSEAMRAAMAAADVDDDVVGVDPTAQRFQAEMAALMGKEAALFVPSGTMGNLISVLVHCDVRGSEAILGDNSHIHVYENGGISTIGGVHPKTVPNNSDGTMDIDKIVAAIRHPDLHYPTTRLICLENTHGNSGGKCLSVEYTNKVGEIATSHGLKLHIDGARIFNASVALGVPVDRLVKAADSVSVCLSKGLGAPVGSVIVGSKDFIEKAKILRKTLGGGMRQVGVLCAAAQVAVRDTVGKLADDHRKARALAEGLKKIKHITVDPASVETNMVFFDIVDPRISPDNLCQVLEQHNVLTMPASSKSIRFVLHYQISDSDVQYAVTCVEKAFEELLKGGTNLELLTNGTTRSSYGH

SEQ ID NO: 5859 - DNA, 1238 bp, Panicum virgatum
  misc_feature: Ceres CLONE 1827544
  misc_feature: Encodes the peptide sequence at SEQ ID NO. 5860
actaatcagtgtcttcttcccttcagagcacacgcaacacatagagggttgagctccaatgcagaaggccatggagaaacggagaagatgcagtaacttgctcgccgtcgcagcgctggccctggtggcagcaatgctgccgccgtccggcgaggcgaagctgtccccggactactaccggtcgacgtgcccggacgtcgaggcgatcgtgcgggcggtggtggccaagaaggtcaaggagaccttcgtcacggtcccggccacgctcaggctcttcttccacgactgcttcgtcgagggctgtgacgcatctgtcatcatcgcgtcccgcgacaacgacgccgagaaggacgccccggacaacgtgtccctcgccggcgacggcttcgacaccgtggtgcgcgccaaggccgaggtcgagaaggagtgccccggcgtggtctcgtgcgcggacatcctcgccatcgccgccagggacgtcgtcgccatgtcttccggcccgcactgggccgtcgagctcggccggctggacggcctcgtctccaaggccggcggcgtcgcgggcaggttgccggggccggacatgcgcgtcgcggacctcgccgccctgttcgccaggcacaacctcaccacgctcgacatggtcgcgctctcgggtgcgcacaccgtcgggttcgcgcactgcacccgcttcacgggccgcctctaccgccacggcgccgtcggcgccggcgcacacgcggtggacccgtcgtacgaccccgcgtacgcgcggcagctcatggcggcgtgcccgccggacgtcggcgagaccatcgccgtcgacatggacccggtcaccccgaccgccttcgacaacgcctactacggcaacctcgcccgcgggatgggcctgttcacctccgaccaggcgctgcacaccgacggcgcgtcgcggccggcggtgagggacttcgccgggaaccagacgcgcttcttcgaggcgttcaaggacgccatggtcaagctgggcagagttggggtgaagaccggcaggcatggggagatcaggagagactgcaccgcattcaacaagaagatcgaggcatcgagcaggagattgcataattaatatagcgcgtctacgcaattgaaaatctccaacgttattaggccaagttcgtgttacagaacaaaaagaaattgcatatgcaaaatttgtcaaatagttaagtttagaaaaaaaaaaaaaaaaaaaa

SEQ ID NO: 5860 - protein, 350 aa, Panicum virgatum
  misc_feature: Ceres CLONE 1827544
  misc_feature: Great-hit functional homolog of the protein sequence encoded by LOCUS At5g67400
  misc_feature (1)..(247): Pfam Name: peroxidase Pfam Description: Peroxidase
  misc_feature (13)..(338): SWISSPROT Homolog: EC 1.11.1.7 Peroxidase 35 precursor
  misc_feature (13)..(338): SWISSPROT Homolog: EC 1.11.1.7 Peroxidase 73 precursor
  misc_feature: Useful for making plants with altered cell wall content and/or composition
MQKAMEKRRRCSNLLAVAALALVAAMLPPSGEAKLSPDYYRSTCPDVEAIVRAVVAKKVKETFVTVPATLRLFFHDCFVEGCDASVIIASRDNDAEKDAPDNVSLAGDGFDTVVRAKAEVEKECPGVVSCADILAIAARDVVAMSSGPHWAVELGRLDGLVSKAGGVAGRLPGPDMRVADLAALFARHNLTTLDMVALSGAHTVGFAHCTRFTGRLYRHGAVGAGAHAVDPSYDPAYARQLMAACPPDVGETIAVDMDPVTPTAFDNAYYGNLARGMGLFTSDQALHTDGASRPAVRDFAGNQTRFFEAFKDAMVKLGRVGVKTGRHGEIRRDCTAFNKKIEASSRRLHN

SEQ ID NO: 5861 - DNA, 1269 bp, Panicum virgatum
  misc_feature: Ceres CLONE 1827566
  misc_feature: Encodes the peptide sequence at SEQ ID NO. 5862
aggagaggagcccagtccaggactccagattcgtcagctccggcccgagcgctcgccacgcaagctgcccaaccatggccgcgctgctcctcgctccccttctcctcctcctcctcgccgcctcgccgccgctctccgcggcgggcggcgcgcacccgggctactcgtccggcgagggcacctgcacggtgggcgccggcgccggcgccgcgccagggggcccgctgctggagcgcggcccggggcgcgtcatcgacatcacgcacgcgtacgtgccggacctgccggcgttcgcgcagggggcggtggcggggcccgtggtgcggctcaagcactccatggcggacggctccgagtacaacctctcggagctgcggatggagtgccacaccggcacccacgtcgacgcgccggggcacatcaaccagggccacttcgccgccggcctcgacgtcgacacgctcgacctcgacctcctcaacggacctgcattactggttgatgttccgaggaatacaaatataacagctgaagcaatggaattcctaaagatcccaaaaggagttcgccgagttctattcaggacactgaacactgacaggaagctgatgtggaagaaagaaggtgaccttagttatgttggatttacagaggatggtgcccagtggttagttgacaacactgacatcaagctagttggggttgactatctctcagttgcatcatttgatcacttgatctctgcccatgtcgtctttttcaaaaaaccggacataatcccagtggaaggtctgaaactagacgatgtcccggtgggagtatacaatctccattgcttacctctgaggctggttggagccgagggttcgccagtcagatgcatccttatcaagtgatcgctcatcgctccctggtgttgctgaaggacaaactgtatcatgccacgtgagatgcttcatcctggcttttggacttttggtatctcggtgcatactgagccggaaatgctgcaggccatgtagacatgtagttgtctggacatttccaaaagaaacaataaaaaaagcagcagcaatatttccatcgtgataatgtgaaagtaggtcatgggtcggtggtgcaggaacagttggctcaaatttttccacttttttttttgtcaacatgtaattttgaacagaaaccgaacgacggacatactcccgtttgagcttatgtgcggccggccagccatggcggcctcgtctccaaaaaaaaaaaaaaaaaaaa

SEQ ID NO: 5862 - protein, 273 aa, Panicum virgatum
  misc_feature: Ceres CLONE 1827566
  misc_feature (1)..(201): Pfam Name: Cyclase Pfam Description: Putative cyclase
MAALLLAPLLLLLLAASPPLSAAGGAHPGYSSGEGTCTVGAGAGAAPGGPLLERGPGRVIDITHAYVPDLPAFAQGAVAGPVVRLKHSMADGSEYNLSELRMECHTGTHVDAPGHINQGHFAAGLDVDTLDLDLLNGPALLVDVPRNTNITAEAMEFLKIPKGVRRVLFRTLNTDRKLMWKKEGDLSYVGFTEDGAQWLVDNTDIKLVGVDYLSVASFDHLISAHVVFFKKPDIIPVEGLKLDDVPVGVYNLHCLPLRLVGAEGSPVRCILIK

SEQ ID NO: 5863 - DNA, 1359 bp, Panicum virgatum
  misc_feature: Ceres CLONE 1827579
  misc_feature: Encodes the peptide sequence at SEQ ID NO. 5864
gaggcccaaaccctcccggccccgtcgccttgccgccggccgcgcgctgcctccctccgacgagccctccgcctcctcccccgacgccgcctccccaggcccgcggcgccgcgcatccggtccggtgcggggtgtgagatccgccccggccgcgagtcggttcctcctcgcgtcggaaagtttttgtgtgcttcatccatgacgagctaaggatatcgcatgaacagtgccagttagtctgcctttgctctgtcttgatcctggctgagttgtgctttgccttgcaaagaaaggaatcatgacttctgttgttcacagtgtttcaggcgaccacagagctgaggatcaacatcaacagcagaagcaagctgaaccagaggaccagcaagaagccccagttactagttcagatagtcaaccaacggtgggcacaccatcagctgattatgtggctccatatgcccctcatgacatgggccatgccctgggtcaatatgcctacccaaatattgatccatactatggaagcctatatgcggcttacggtggacagccaatgatgcatccaccgttggtcggaatgcatccgactggcttacctttgcctactgatgcaattgaagagcctgtgtatgtaaatgcaaaacaatacaatgccattttaaggcgacgccaatctcgggctaaagctgaatcagaaaggaagcttgtcaagggccgtaagccctatctccatgagtcacgtcatcagcatgccttgaaaagggccaggggagctggaggcaggtttctcaattccaagtcagatgacaaggaagagaactctgactcgagtcacaaagagaaacaaaatggagttgcgccccacaagagtggccaaccgtcaacccctccatctccaaacggtgcatcttcagctaatcaggcagactgtcgccaatgaggcttcgagaactcacagcaaagagagttaagcccctgacgctagatgtggcaacagttatgtacagcaagtgctagtgggcaacatcaaggatggtgtcggttggttgtggtaggacatgttccatagaaaaacatagacgagtcagacaggttttgcagtttggtttgttcctcagtttattcacctttctgtacaattcgagtagcattgtgtcctcatggatagctcagtcagttcttcagaaagcctttgtagcatatcatcccattgtttgttgcttggagatttgggagtggagttcataacctgctgtcctgcatggcacagaataatcgctggctgtgtatgttgatgacaataaaccctaatgtaggacatgtgagcacctcatctaaaaaaaaaaaaaaaaaaaa

SEQ ID NO: 5864 - protein, 214 aa, Panicum virgatum
  misc_feature: Ceres CLONE 1827579
  misc_feature (1)..(57): Pfam Name: CBFB_NFYA Pfam Description: CCAAT-binding transcription factor (CBF-B/ NF-YA) subunit B
  misc_feature: The sequence is a functional homolog of  SEQ ID NO 2852 in the  10/374,780 US patent application
  misc_feature: The sequence is a functional homolog of  SEQ ID NO 696 in the  10/225,066 US patent application
  misc_feature: Useful for making plants with modulated growth and phenotype characteristics
MTSVVHSVSGDHRAEDQHQQQKQAEPEDQQEAPVTSSDSQPTVGTPSADYVAPYAPHDMGHALGQYAYPNIDPYYGSLYAAYGGQPMMHPPLVGMHPTGLPLPTDAIEEPVYVNAKQYNAILRRRQSRAKAESERKLVKGRKPYLHESRHQHALKRARGAGGRFLNSKSDDKEENSDSSHKEKQNGVAPHKSGQPSTPPSPNGASSANQADCRQ

SEQ ID NO: 5865 - DNA, 1493 bp, Panicum virgatum
  misc_feature: Ceres CLONE 1827595
  misc_feature: Encodes the peptide sequence at SEQ ID NO. 5866
gtctccgaactagtcagaacaggaacgcgcaggaggagtgcgcgactcgccttctccatccagttctcggccccttcctcacgcctggactggactgaagccggggagggagggagaagaaaaatctccccagagccggcaggtcgccggtctcgccggccttctcagaccacccgcattgcccttgcccgcccagctttaagtactcgccgggcaaggcggccactcatccaatccccatctcatccatctcggagcagaggcaacccaaggcgcttctttccctgttgggaacggagttgcaggagaaggaatcgttggggcgctcttgctctttcctgggtccagtggtggcagctgctgctgaggtaaagattcaagctttgaggtgttgccgggcggagcgaggatggcattcgcggtcaccgacgagctgctgggcacattcgtgccgattgcggtgtactggctctactcggggttctacatcgtgcttgacgggctgggcatggacgactaccggctccaccccaagtgggaggaggtcaagaacattgtttctaagtggacagtcgtcaggggcgtcctcgtccagcaggcgttccaaattgccgtctctctactcctattcacggttcttagtgatgagagtggaactgtgaggaagcaaccttccgctctggtaatagctttgcaatttatcattgctatgtttgttatggacacatggcaatacttcatgcacagatacatgcacatcaacaaatttctgtacaagcacgtccactcgaagcatcatactcttgttgtcccatatgcctttggagctctctacaaccaccccctggagggactcatcctggacaccattgggggtgcgctctcgttcctcatctccggcatgtccccaaggacaggcatattctttttctcctttgcgaccatcaagaccgtcgatgaccactgcggtctgtggctccctgggaacatcctccatgtctttttcagcaacaacagcgcttaccatgacatccaccaccagctctatggcaacaagtacaacttctcgcagcccttcttcgtcatgtgggacaagatcctcggaacatacatgccttacaccctcgagacccgcaagggaggcgggtatgaggcgcgcccggtcaagctcaaccaagcacagcagaccaaggctgattaagctgtgcggcttctcctgttttctcctacttgccctgatcttttttttttcttttttctgacttcacttgtgttgtataagaattttccctgtccatatagtaaaatcctttaggcagatgccatcttgtaccaagatatagcaaataaaacatcgtgttaaaggaaatcccctcaggcttgtttccctctagattgtctctgaatatgataagaatagctgatgttggcaggggatgtatgcaacagtgagctggccgtcacactctgaacaaaaaaaaaaaaaaaaaaaa

SEQ ID NO: 5866 - protein, 263 aa, Panicum virgatum
  misc_feature: Ceres CLONE 1827595
  misc_feature (1)..(207): Pfam Name: Sterol_desat Pfam Description: Sterol desaturase
MAFAVTDELLGTFVPIAVYWLYSGFYIVLDGLGMDDYRLHPKWEEVKNIVSKWTVVRGVLVQQAFQIAVSLLLFTVLSDESGTVRKQPSALVIALQFIIAMFVMDTWQYFMHRYMHINKFLYKHVHSKHHTLVVPYAFGALYNHPLEGLILDTIGGALSFLISGMSPRTGIFFFSFATIKTVDDHCGLWLPGNILHVFFSNNSAYHDIHHQLYGNKYNFSQPFFVMWDKILGTYMPYTLETRKGGGYEARPVKLNQAQQTKAD

SEQ ID NO: 5867 - DNA, 1308 bp, Panicum virgatum
  misc_feature: Ceres CLONE 1827735
  misc_feature: Encodes the peptide sequence at SEQ ID NO. 5868
gggaacagagagcatcttcttcggaaccaagctgcggaggaggagatggccatgcccaccttccacctcgctcccgacctgccaccgggacgatgacgatgggggagcagagcggggcgcggggctcgctgcgcctactcgacgccgccttcgacgccggggtcaacttcttcgactccgccgagatgtacccggtcccgcagcgaagcgagacccacgggcgcagcgaggagctcctcggccgctggctgcgggcccgtcgggccccgcgcgaccaagtcgtcgtcgccaccaaggtcgccgggccgtccggccagatgacgtggatccgcggcgggccgacgtctctcgattcgcacaacatcacggaggcaattgacgggagtatgcgcaggctgggtgtggattacatcgacctctaccagatacactggcccgatcggtatgttcctatgtttggggaaacagagtatgacccgagcttccagtacacgtctgttccaatggaagaacaactcgaggcccttggaagagccatagatgctggaaagatcaggtacattggccttagtaacgagactccatacggcctgatgaagtttcttcagctgagcaaggactttcagttgcgttccaagctactgacagtgcagaactcatataacttgctgtgccgaaattttgattctggattggcagaatgctgccatcacgagagaatcagcttgctggcctacagcccaatggcaatgggtatactttccggaaagtatcactcatctgatgactctggtccaccagaggcaaggatgaatcttttcaaagggagatattctgaaggccaatcccgatacaaacttcagtctcctaaagtgaaattagctgtgaaggaatacacacagattgctgcgaagtatggaatttctccagcaaccttagctatagcatttgtattgaggcacccacttgtggcatcagctgtttttggtgctactaaattatggcagctttatgaggttctccaggcagctagaatccatctccccgaggaaattccttttgagatcaatgatgttcatgcaagatatccgaacccttgtccataaaattcttagtagggatcatttttgtttgctgattgcaaatgtcagtatgattaggaacttaggatggagcaattttgttagagctgagttagccatctacttatcatattcgttctctctagcttcgtcaatgttggcatggattgtcaaagacatgaaataaattttgttattttcatattaaaaaaaaagaaaaaaaaaa

SEQ ID NO: 5868 - protein, 337 aa, Panicum virgatum
  misc_feature: Ceres CLONE 1827735
  misc_feature (17)..(346): Pfam Name: Aldo_ket_red Pfam Description: Aldo/keto reductase family
MTMGEQSGARGSLRLLDAAFDAGVNFFDSAEMYPVPQRSETHGRSEELLGRWLRARRAPRDQVVVATKVAGPSGQMTWIRGGPTSLDSHNITEAIDGSMRRLGVDYIDLYQIHWPDRYVPMFGETEYDPSFQYTSVPMEEQLEALGRAIDAGKIRYIGLSNETPYGLMKFLQLSKDFQLRSKLLTVQNSYNLLCRNFDSGLAECCHHERISLLAYSPMAMGILSGKYHSSDDSGPPEARMNLFKGRYSEGQSRYKLQSPKVKLAVKEYTQIAAKYGISPATLAIAFVLRHPLVASAVFGATKLWQLYEVLQAARIHLPEEIPFEINDVHARYPNPCP

SEQ ID NO: 5869 - DNA, 1975 bp, Panicum virgatum
  misc_feature: Ceres CLONE 1827772
  misc_feature: Encodes the peptide sequence at SEQ ID NO. 5870
gcccagcctcgccgccgtcccttgctctgctctccctgttcatagcagcctagcagggctccatccaatcggccgcctggttttcgctctgagcacgctcgtctcaccatctggtcaaagacgacctcgtcgtcgtcttctccttctccacccttctcaagctctccgcctccccggggcccggggtgtacaatacccccagcccagtccactcatctcaccgaacccaaacccttgccacggttcctctgctccgacccagacccaccagagcaggcgacggaggggcgcggatcgccaaaatgccctccgcgctctaccttcccctgctcctgctgctcgccgcctcggccgctgccggcgcggcggcggcggctgcagatgccgcggacccgtcggcgcacgaggcgctgttcgacgcgtggtgcgcggagcacggcagggcctacgccacgcccgaggagcgcgcggcgcggctcgcggtgttcgcggacaacgcggccttcgtggcggcgcacaacgcccgcgccaacgccaacgccgcgggcggcgggccggccccgtcctacacgctcgcgctcaacgccttcgcggacctcacgcacgacgagttccgcgccgcgcgcctcggccgcctcgcggccggccgggccggggcgacgctccggagcgccgccgcgcccgtgtacgggggcctcggcggcggcgtcgccgcggtgcccgatgcggtggactggaggaagagcggggccgtcaccaaggtcaaggaccagggcagctgcggagcctgttggagcttttcggctacaggtgctattgaaggaataaacaaaatcaagacaggctcactggtcagtctttctgaacaggaactaattgactgtgacagatcatataatagcggctgtggtggtggcctcatggactatgcttttaagtttgtggttaaaaatggtggaattgacacagaggaggattatccctttcgtgaagtggatggaacatgcaacaagaacaagctgaaaaggcgagttgtgacaattgatggttactctgatgttccttccaacaaagaagacttgttgctccaggctgttgcccagcaaccagttagtgtgggaatatgtggcagcgccagagcattccagctatactcccagggtatctttgatggtccatgtccaacatctcttgatcatgctgtgctaatcgtgggttatggctccgaaggtggcaaggactactggattgtgaaaaattcttggggtgaaagttggggaatgaagggctacatgcatatgcatcggaacactggtgattccagtggtatctgtggtataaacatgatgccatcatttcctaccaaaacaagcccgaatcctcctccttcaccaggccctggcccaaccaaatgcagtctgcttacctactgtcctgaaggatcaacttgttgttgctcatggcgcatcttgggcttttgcctttcttggagctgctgtggactggacaatgcagtttgctgcaaggataaccgttactgctgccctcatgactatcctatttgcgatacagttcgcgcccagtgtttcaggggcaatggcaacttttctggtatagaaggaatcaagaagcagcagtctttctctaaaattccctcttggaatggttggttggaactgatggatcaatgaacatagtgtcagttatggatggaagagcaagctcttgtgcgagcagtaggtctaggctagctggcttcttctggtgcccttccaaattcttacatgctctgtattgatgatgaaccatactctggtgtgaaattccacgattgtacatgtcagacttgtattagagagcccctgcacggatgatttattccagtccatctgtactgcagttgaggaccatgccaaataaagagatacttgtaccatgttttgtggttatgttacaaaaaaaaaaaaaaaaaaaa

SEQ ID NO: 5870 - protein, 462 aa, Panicum virgatum
  misc_feature: Ceres CLONE 1827772
  misc_feature (1)..(216): Pfam Name: Peptidase_C1 Pfam Description: Papain family cysteine protease
MPSALYLPLLLLLAASAAAGAAAAAADAADPSAHEALFDAWCAEHGRAYATPEERAARLAVFADNAAFVAAHNARANANAAGGGPAPSYTLALNAFADLTHDEFRAARLGRLAAGRAGATLRSAAAPVYGGLGGGVAAVPDAVDWRKSGAVTKVKDQGSCGACWSFSATGAIEGINKIKTGSLVSLSEQELIDCDRSYNSGCGGGLMDYAFKFVVKNGGIDTEEDYPFREVDGTCNKNKLKRRVVTIDGYSDVPSNKEDLLLQAVAQQPVSVGICGSARAFQLYSQGIFDGPCPTSLDHAVLIVGYGSEGGKDYWIVKNSWGESWGMKGYMHMHRNTGDSSGICGINMMPSFPTKTSPNPPPSPGPGPTKCSLLTYCPEGSTCCCSWRILGFCLSWSCCGLDNAVCCKDNRYCCPHDYPICDTVRAQCFRGNGNFSGIEGIKKQQSFSKIPSWNGWLELMDQ

SEQ ID NO: 5871 - DNA, 1550 bp, Panicum virgatum
  misc_feature: Ceres CLONE 1827778
  misc_feature: Encodes the peptide sequence at SEQ ID NO. 5872
atctcgcgagcctcacacatccaactcaactcgcaccccgagagagaagagagggggaaaaacgagcccaggcagcaaaaccctagcccgctccccgacgccgcgccaccgccggctgatggtttcgatgagcacgacgcccaagccgctcgactccgccgccgccgccgtcgcgggcgggggcggggatgatgggggcgggggcgggggcgggaagcagccgcagcggatgcggggggcggccgtgatggcgccgccgccgatggcggtgccggccccggcgcccgcggcgggggaggaggtgcgcaaggtcaggaagccctacaccatcagcaagtcgcgggagagctggacggagccggagcacgacaagttcctcgaggcccttcagcttttcgatcgtgattggaaaaagattgaagcatatgtgggctcaaagactgttatacagattacgagccatgcacagaagtacttcttaaaagttcagaagaatggtacaggcgagcatcttcctccaccccggccaaaacgaaaggcagctcatccatatccacagaaggcatctaaaactgtttctcaagctgttttgtctcaacaactccctcagagggagcaaagctcagttatgtctatggatacatctactgctgttagaaatgcaaatgcaaattcagcaatggcttcctgggacaatactcctgttcaacctctcagtgcaagtcatgtgcatggtaccgttgcaacaaataactgctctagtagcatagagagcccatctggaacatggccaacttctgaagcagttgaacaagaaaatgtggtcccaccactccgtgccatgccagattttgctcgagtatacagcttcctgggaagcatatttgatccagataccaatgggcatttgcagaggttaaaagcgatggatccaattgatgttgaaacggtactactgcttatgagaaatctatcaacaaaccttactagtcccgactttgaagaacatcggaagttgctatcatcatatagttatggcagcgatgactacattaaatctgaaggcatggaaaatcttggatctcctcagagttgccatctcccattcatggtaacaagtgaatgagagaacactgcccatttgcggtcgaagcttcagttgtttccaagaggcgttcttgtgtgctctctgtgctggagttgtggacggctgatctggcagtttatgaatgctagagacggattatggtagtgacatctgtatatcttccaataatatggtctaaccctaggatagttttgctctttatgttcatgtagatagccagttttgtgcgctcatgcaatttttttcctgggtggggcctagatcgatatgctttttgttttacacacctgtgtgtgcatgtatgtaaatatgtgtgaccatgtaatgtttgaggtactactggggagtctttgatcaagacaaacataacatataccgaataatcatggttggtacggtgatcaccctcgtcggctatataatgaaagattttcaattgcgg

SEQ ID NO: 5872 - protein, 335 aa, Panicum virgatum
  misc_feature: Ceres CLONE 1827778
  misc_feature (1)..(46): Pfam Name: Myb_DNA-binding Pfam Description: Myb-like DNA-binding domain
MVSMSTTPKPLDSAAAAVAGGGGDDGGGGGGGKQPQRMRGAAVMAPPPMAVPAPAPAAGEEVRKVRKPYTISKSRESWTEPEHDKFLEALQLFDRDWKKIEAYVGSKTVIQITSHAQKYFLKVQKNGTGEHLPPPRPKRKAAHPYPQKASKTVSQAVLSQQLPQREQSSVMSMDTSTAVRNANANSAMASWDNTPVQPLSASHVHGTVATNNCSSSIESPSGTWPTSEAVEQENVVPPLRAMPDFARVYSFLGSIFDPDTNGHLQRLKAMDPIDVETVLLLMRNLSTNLTSPDFEEHRKLLSSYSYGSDDYIKSEGMENLGSPQSCHLPFMVTSE

SEQ ID NO: 5873 - DNA, 1431 bp, Panicum virgatum
  misc_feature: Ceres CLONE 1827792
  misc_feature: Encodes the peptide sequence at SEQ ID NO. 5874
gcaacctcgcttagcaagcagcagcacccacctaatcgctcgcggttagcgcgcaaattgccccgtgcgatctcgtcgcggggggtataagagcgcaccgcccccacataccgttccacgctaagaccgggccggcctgctaggaggagtagtagcgacttttaacacttttcctccgcaacaccattgaccggatcagcgagctcggagctgacccgcgcgccgcggcccccgtggagagagcgatcgatcgtcgatcggtagctgcggcaggggaggagaaggagccgaggatgaaggtgcagtgcgacgtgtgcgcggcggaggcggcgtcggtgttctgctgcgccgacgaggccgcgctgtgcgccgcgtgcgaccaccgcgtgcaccgcgccaacaagctcgccggcaagcaccgccgcttctcgctgctcggcccggcgccgccgtcctcgtcgccgggtcagcagcagcagccgccgccgctctgcgacatctgccaggagaagaggggcctcctgttctgcaaggaggaccgggcgatcctgtgccgggactgcgacgtgtcggtgcacacggccagcgagctggccatgcgccacacccggttcctcctcaccggcgtgcgcctctccgccgagccggccacctgcccgtccccgccgtcggacgagaacagcagcgacagcctctgctgcagcgccggcggcgcggccccgccgcccgcgcccgccaccagccacggcagcgacagcagcagcatctccgagtacctcaccaagacactccccggctggcacgtcgaggacttcctggtggacgaggccaccgccgccgccgccgccaacatcgccgtctccgcggacgcctcctatcagggaggggtagctcgggtcggcggcgtgccggacggcggctacgcggcctggatggcgcaggagcagctcttcggcgacagcacggccgccggcggcggcgcgcgggccagccgggagcggtgggtgccgcagatgatgtacggcggcccggaggtggccgtggccggcagcaagcgctccagaaccgccgcgtccccggcggcgtactcgtactggtgatcccatcgaccggcggcggaagacccgcagcgaccgactcgccgtcgccgtgccgccgtccgtattaagcaccggctggtgcactagcgtactcgctgtttaactgtaactgaagttgtttccgggctcattttaccgccgcaacctttttttacgctcttccgggcgtcgtcgatcggatggatgcccgggagcgttcgtgcctttttggcggggtgccggagggaagcctcctcctgcacctctgtatctgtcctcttttttgctcggtgcaacttcaatcggagcctatggctgtccacgttctcctcaaaaaaaaaaaaaaaaaaaa

SEQ ID NO: 5874 - protein, 268 aa, Panicum virgatum
  misc_feature: Ceres CLONE 1827792
  misc_feature (1)..(47): Pfam Name: zf-B_box Pfam Description: B-box zinc finger
  misc_feature: The sequence is a functional homolog of  SEQ ID NO 234 in the  10/666,642 US patent application
  misc_feature: The sequence is a functional homolog of  SEQ ID NO 288 in the  10/374,780 US patent application
  misc_feature: The sequence is a functional homolog of  SEQ ID NO 582 in the  10/225,066 US patent application
  misc_feature: The sequence is a functional homolog of  SEQ ID NO 662 in the  11/435,388 US patent application
  misc_feature: The sequence is a functional homolog of  SEQ ID NO 906 in the  10/412,699 US patent application
  misc_feature: Useful for making plants with modulated growth and phenotype characteristics
MKVQCDVCAAEAASVFCCADEAALCAACDHRVHRANKLAGKHRRFSLLGPAPPSSSPGQQQQPPPLCDICQEKRGLLFCKEDRAILCRDCDVSVHTASELAMRHTRFLLTGVRLSAEPATCPSPPSDENSSDSLCCSAGGAAPPPAPATSHGSDSSSISEYLTKTLPGWHVEDFLVDEATAAAAANIAVSADASYQGGVARVGGVPDGGYAAWMAQEQLFGDSTAAGGGARASRERWVPQMMYGGPEVAVAGSKRSRTAASPAAYSYW

SEQ ID NO: 5875 - DNA, 1202 bp, Panicum virgatum
  misc_feature: Ceres CLONE 1827836
  misc_feature: Encodes the peptide sequence at SEQ ID NO. 5876
actcctcctccacgcacgcacgagcgcggcagcactaccacgccccgccacgccaccactgagctccgctccggtccgcagcccaccggcggctccaactaagatcgacgcgacgatgggcttccccgtggggtacccggagatgctgctcccgcgcgcgctgctgcaggcgctcctcctcctgggccacctccaccgcttcctcctctgggccttccacgccgtggggctcggcgacctcatcgacctcggctgcaacgactactactaccccgcgccgccctccgcggcggcggagcgaacaaccgggcgcgacgcggccgcgccgccgctgcagcaccggcggccggagttcaggcccgtccccgcggtgctcgtcgaggaggcgctccccgtggtgcggttcgaggagctggcggccccggcgtgcgggggcggcgactgcgcggtgtgcctgagcggcatcggcgccgccgacgaggtgcaccggctcagcaactgccgccacgccttccaccgcggctgcctcgaccgctggatggcgcacgaccagcgcacctgcccgctctgccgcgcgccgctcatcccgggatccgccgccgcgggggaccccggctgggcagccgccgccgcgccgtgggccgacgctgccaccgactacgacatgtcctacccgtcgtcgctgccgtcgacgccgctgctgatggtgcccaccccgacgctgctgcggccgcacgagctgctgctcaccggcctgggcggcttccagtgagccgctgccgctgcgtggctggcagactggcaggtcacgcgggatccgtggcgaggcaaaccgcgtcgtcgtcatgtgcggcccgcaccgcccggtcggtcagacgggtgaccgccgccaaagctggtcacccaccgcccaagcccgctgcagcagcacacggttggcctcgtgccgtgtcatcgtcttccacgacggcctcggcccgtcggccggcgaaaccaacggcaaaggagaccgccccggtttttacagcggctccggcaaaaggattgaaaaaaaagaaaatttaggaaattaattacgcaagtaggttgccgtgtaggatgattccatcttccaagccagtggagttgcgaatctttatgtagatgatatgaaatttgctgaacatgaactctggaagtttcaaaaaaaaaaaaaaaaaaaa

SEQ ID NO: 5876 - protein, 218 aa, Panicum virgatum
  misc_feature: Ceres CLONE 1827836
  misc_feature: Great-hit functional homolog of the protein sequence given in SEQ ID NO 9356
  misc_feature: Great-hit functional homolog of the protein sequence given in SEQ ID NO 9699
  misc_feature (1)..(43): Pfam Name: zf-C3HC4 Pfam Description: Zinc finger, C3HC4 type (RING finger)
  misc_feature: Useful for making plants with altered alkaloid content
  misc_feature: Useful for making plants with modulated nitrogen use efficiency
MGFPVGYPEMLLPRALLQALLLLGHLHRFLLWAFHAVGLGDLIDLGCNDYYYPAPPSAAAERTTGRDAAAPPLQHRRPEFRPVPAVLVEEALPVVRFEELAAPACGGGDCAVCLSGIGAADEVHRLSNCRHAFHRGCLDRWMAHDQRTCPLCRAPLIPGSAAAGDPGWAAAAAPWADAATDYDMSYPSSLPSTPLLMVPTPTLLRPHELLLTGLGGFQ

SEQ ID NO: 5877 - DNA, 1414 bp, Panicum virgatum
  misc_feature: Ceres CLONE 1827846
  misc_feature: Encodes the peptide sequence at SEQ ID NO. 5878
aaatggcgacgcctcccaccatccgcctccaccaccagccatcctcctgccgccgactgcccgctcccaccaaccatcagttccacgccgcggcgagatgccggtggcggcggcttcctcccgtcgcggcggctccttccctccgcctccgcgccacgggcgccgctcagtcgttggataacaacggctcgttgcctggcgcggttgaggtcgaggaaagggaggaacagcagccgcgcctcaagatcgccgtggttgggttcggcaactacggccagttcctggcgcgcacgctggtggcgcagggccacaccgtcctagcccactcccgctccgactactccgccgccgccgcggccctcggcgcgcggttcttccccgacccgcacgacctctgcgagtgccacccagacgtgatgctcctggccacctccatcctctccgccgagtccgtcgtccgctcgctccccgtgcaccgcctccgccgcgacaccctcttcgccgacgtgctctccgtcaaggagttccccaagaacctcctcctcggcgcgctcccggaggagttcgacatcatctgcacgcaccccatgttcggcccggagtcggcgcgcgacggctgggccggcctccccttcgtcttcgacagggtccgcgtcggcgactgccccgcccgccgcgcccgcgccgaggccttcctcggcgtgttcgcccgcgaggggtgccgcatggtggagatgtcctgcgcggagcacgacgcgcacgccgccgggacgcagttcctgacgcacaccgtggggcggacgctggcgctgctggagctccggcagacgccgatcagcaccagggggtacgagacgctgctccggctggtggacaacacctgcagcgacagcttcgacctctacaacggcctcttcatgtacaacaagaactccaccgagctgctcaaccgcctcgagtgggccatggacgccgtcaagaagaagctcttcgacggcctgcacgacgtgctccggaagcagctcttcgacgttgaggcatcgccggccgccgatcccaccgaggtgctggtggtgggtggcgatctggacacccacgacgacgaggacgccgtcgacggcgacgagtcgggatcggaggggaataattgattggtcgcgccgatcggattggcatagtggcacgtcaatttctcgcggtcccctgcggggcacggcttgcatgttgatcttatcctggcagacagtgtggcgatgaactctcctgatcgatcgaacgcggcattcttgtcttcacgccgttttcagtggcttatagaccttgtttgtttggctccaggactttttttttaagtccctatcacattaaaagaaatcttactattttatagtattaaaaaaaaaaaaaaaaaaaa

SEQ ID NO: 5878 - protein, 382 aa, Panicum virgatum
  misc_feature: Ceres CLONE 1827846
  misc_feature (1)..(62): Pfam Name: F420_oxidored Pfam Description: NADP oxidoreductase coenzyme F420-dependent
  misc_feature (36)..(378): SWISSPROT Homolog: EC 1.3.1.78 Arogenate dehydrogenase 2, chloroplast precursor
  misc_feature (45)..(346): SWISSPROT Homolog: EC 1.3.1.78 Arogenate dehydrogenase 1, chloroplast precursor
MATPPTIRLHHQPSSCRRLPAPTNHQFHAAARCRWRRLPPVAAAPSLRLRATGAAQSLDNNGSLPGAVEVEEREEQQPRLKIAVVGFGNYGQFLARTLVAQGHTVLAHSRSDYSAAAAALGARFFPDPHDLCECHPDVMLLATSILSAESVVRSLPVHRLRRDTLFADVLSVKEFPKNLLLGALPEEFDIICTHPMFGPESARDGWAGLPFVFDRVRVGDCPARRARAEAFLGVFAREGCRMVEMSCAEHDAHAAGTQFLTHTVGRTLALLELRQTPISTRGYETLLRLVDNTCSDSFDLYNGLFMYNKNSTELLNRLEWAMDAVKKKLFDGLHDVLRKQLFDVEASPAADPTEVLVVGGDLDTHDDEDAVDGDESGSEGNN

SEQ ID NO: 5879 - DNA, 1275 bp, Panicum virgatum
  misc_feature: Ceres CLONE 1827870
  misc_feature: Encodes the peptide sequence at SEQ ID NO. 5880
aggcatcatccatccatcgttcatcatcattcatcgatcaagcgcacgcacacacacaaccacaaccacaaccacaacgagagagtttaattagttttctggagaggaagctagctaagggatcggagggcgtacacgatgatgagcagcaagcagcagcagcagcagcaggcggcgccgaataataagcggcgggcgtacgtgacgttcctggccggcgacggcgactactggaagggcgtggtggggcttgccaagggcctgcgccgggtgcggtcggcctacccgctggtggtggccgtgctccccgacgtgccggaggagcaccgccgcaagctgcgcggccagggctgcgtcgtccgcgagatccagccggtgtacccgcccgagagccagacgcagttcgccatggcctactacgtcatcaactactcaaagctaagaatatgggagttggtggagtacgagcgcatggtgtaccttgacgctgacatccaggtgttggacaacatcgaccacctgttggacctggacaagggccgcttctacgcggtgatggactgcttctgcgagaagacgtggagccacaccccgcagtacaagatcggctactgccagcagtgcccggagcgcgtgccctggccggagcagcagctcggccccccgccgccgccctacttcaacgccggcatgttcgtgcacgagccgagcctgggcacggccaaggagctcctggacgcgctggtggcgacgccgccgacgcccttcgcggagcaggacttcctcaacatgttcttccgcgacgtgtacacgcccatcccgccggtcaacctggtgctggccatgctgtggaggcaccccgacaaggtggagccgctcgccgaggtcaaggtggtgcactactgcgccgcggggtccaagccgtggaggttcacggggcaggagcccaacatggagcgccaggacatcaagatgctcgtcgccaggtggtgggacgtcttcaacgacgacagcctcgactacaagggcgacgacgccgaccagccgctgctgcgccaggctctggcggaggccggcgccgccaactacttcccggcgccctcggcggcctaataagtaggagtatatattattagggggtaccggtctggtccacatacagacatactttactacagggttttggtattttacatctagatcatgagtacgcgcgtagtgtactcgtctgaagtattgatctgcaggtttcgccaaaaaaaaaaaaaaaaaaaa

SEQ ID NO: 5880 - protein, 324 aa, Panicum virgatum
  misc_feature: Ceres CLONE 1827870
  misc_feature (1)..(246): Pfam Name: Glyco_transf_8 Pfam Description: Glycosyl transferase family 8
MMSSKQQQQQQAAPNNKRRAYVTFLAGDGDYWKGVVGLAKGLRRVRSAYPLVVAVLPDVPEEHRRKLRGQGCVVREIQPVYPPESQTQFAMAYYVINYSKLRIWELVEYERMVYLDADIQVLDNIDHLLDLDKGRFYAVMDCFCEKTWSHTPQYKIGYCQQCPERVPWPEQQLGPPPPPYFNAGMFVHEPSLGTAKELLDALVATPPTPFAEQDFLNMFFRDVYTPIPPVNLVLAMLWRHPDKVEPLAEVKVVHYCAAGSKPWRFTGQEPNMERQDIKMLVARWWDVFNDDSLDYKGDDADQPLLRQALAEAGAANYFPAPSAA

SEQ ID NO: 5881 - DNA, 1390 bp, Panicum virgatum
  misc_feature: Ceres CLONE 1827901
  misc_feature: Encodes the peptide sequence at SEQ ID NO. 5882
ctgaagactcctccagttaccccgcgcggctctgctgtgctgtgcagccgccgccgccgccgcctactcctccagacgactcctccagttcccccggtggtcatggcggatcaagcccctctcgttccccgcgtcaagctcggctcccagggattggaggtgtccaagctggggttcggctgcatggggctgacgggcgcctacaactccccgctggacgacgaggccggcatcgccgtcatcacgcacgccttccgccgcggggtcaccttcttcgacacctccgacgtctacgggccacgcaccaacgaaatcctcctcagcaaggcgctgaagcagctgcccagggatcaggtgcaggtagccaccaagttcgggatacagcgggacgggagcggcgtggccaccgtgtgcgggaagcccgaatacgtgcgcgcctgctgcgatgccagcctgcgccgcctcggcatcgactgcatcgacctctactaccagcaccgcgtcgacaccaccatccccattgaggacacgattggtgagctcaaaaaactggtcgagcaggggaaggtcaagtacatcgggttgtcagaggcaagccccgacacgattaggcgtgcacacgccgtgcatccgatcacagctgtgcagatggagtggtctctctggtctcgtgacatcgagcccgagattgtgccgctgtgcagagaattgggcattggaattgttccttatagtccgattggtcgtggttttttcggtggaagaggagtgacagagcaagtggctgctgaatctaatctgcatgggcatccaaggtttgcggcagaaaatttggagaagaacaagcaaatttatctgaaaatggaagaactggccaataagcaccagtgcagccctgctcagctagctttggcatgggttctgcatcaaggggatgatgtcgttcctataccaggaacaaccaaaatcaagaatctagatgccaacattgatgccttgaaggtgaagctgacagatgaggacttgaaagaaattggcatccagatccgcgaagaagatgttgctggtggaagacaatacacttcctttgcacataccacctggaagtacgcagatacaccaaagaaacagagctaaataaagaacttagcagcggtcatagtatgcgatttcctgcaaatgtgctcagtattatggctgatatgtctttgggattgctgtgtgctagataatatacgacagaagaagaataaagcgtcctgctatccgaaatatgagcaaacacttgattttgtgtatgtttatactagacaagactgatattgtcgcatggaatgtctgaacctataataaagttacagtatgtgtgcaaaaaaaaaaaaaaaaaaaa

SEQ ID NO: 5882 - protein, 344 aa, Panicum virgatum
  misc_feature: Ceres CLONE 1827901
  misc_feature (1)..(303): Pfam Name: Aldo_ket_red Pfam Description: Aldo/keto reductase family
MADQAPLVPRVKLGSQGLEVSKLGFGCMGLTGAYNSPLDDEAGIAVITHAFRRGVTFFDTSDVYGPRTNEILLSKALKQLPRDQVQVATKFGIQRDGSGVATVCGKPEYVRACCDASLRRLGIDCIDLYYQHRVDTTIPIEDTIGELKKLVEQGKVKYIGLSEASPDTIRRAHAVHPITAVQMEWSLWSRDIEPEIVPLCRELGIGIVPYSPIGRGFFGGRGVTEQVAAESNLHGHPRFAAENLEKNKQIYLKMEELANKHQCSPAQLALAWVLHQGDDVVPIPGTTKIKNLDANIDALKVKLTDEDLKEIGIQIREEDVAGGRQYTSFAHTTWKYADTPKKQS

SEQ ID NO: 5883 - DNA, 1284 bp, Panicum virgatum
  misc_feature: Ceres CLONE 1827902
  misc_feature: Encodes the peptide sequence at SEQ ID NO. 5884
aaaattttccccaaaatccaccaccaccatctgcatctgcatccgcctcgtcgccgatccaactcgcctccacatcgatacagcgagcgccgtgtccccgatccaaccacaccacgagtcggcgcggccccgcgatcccctctccatcttccttcctcagattcgcggcgatctagccggcgggcgcgatggcggggcagaaccagcggctcaacgtcgtgccgaccgtgacgatgctcggcgccatgaaggcccgcctcgtcggcgccacccgcggccacgcgctgctcaagaagaagtccgacgcgctcaccgtccacttccgcgccatcctcaagaagatcgtcgccgccaaggagtccatgggcgagacgatgcgcgcctcctccttctccctcgccgaggccaagtacgtcgccggcgacggcgtccgccacgtcgtcctccagtccgtccgcgccgcctccgtccgcgtcaaatcccaccaggagaacgtcgccggggtcaagctccccaagttcacccacttcgtcgaccccgccgcggcctccgggggcccctccaacgcgtccccgagcctcacgggcctcgcccgcggcgggcagcaggtcaccgcctgccgcgccgcgcacgtcaaggccatcgaggtgctcgtcgagctcgcatcgctccagacctccttcctcacgctcgacgaggccatcaagaccaccaaccgccgcgtcaacgcgctcgagaacgtcgtcaagcccaggatcgagaacaccatcagctacatcaagggggagctcgacgagctcgagcgcgaggacttcttcaggctcaagaagatccagggatacaagaagagggagatcgagcgtcagatagccagcgccaagctattcgcggaggagcagctcgccgaggatctcgcgctcaagaggggcatctccgtgggggctgcggcaaatctgctcgttgctggaggggagaaggacgacgacatcatcttttgatcatggtcgtcgaattattcaatcgtggtggaaacaataagttaatgctggagctccagaattgtatctgtttatagagtgatggcggtttgtttcagtgatgagtagtctggagcctggtcatccaagatcctgaataatctgtactttgaaaccaaatattgccaatgaactttaaagcacggagtggttatgtgcagctggtgtagtaaattcaattgtactgtttctccccctgcgtgttcattatagttgtatttatatttaaaaaaaaaaaaaaaaaaaa

SEQ ID NO: 5884 - protein, 269 aa, Panicum virgatum
  misc_feature: Ceres CLONE 1827902
  misc_feature (1)..(206): Pfam Name: ATP-synt_D Pfam Description: ATP synthase subunit D
  misc_feature (1)..(269): SWISSPROT Homolog: EC 3.6.3.14 Vacuolar ATP synthase subunit D
MAGQNQRLNVVPTVTMLGAMKARLVGATRGHALLKKKSDALTVHFRAILKKIVAAKESMGETMRASSFSLAEAKYVAGDGVRHVVLQSVRAASVRVKSHQENVAGVKLPKFTHFVDPAAASGGPSNASPSLTGLARGGQQVTACRAAHVKAIEVLVELASLQTSFLTLDEAIKTTNRRVNALENVVKPRIENTISYIKGELDELEREDFFRLKKIQGYKKREIERQIASAKLFAEEQLAEDLALKRGISVGAAANLLVAGGEKDDDIIF

SEQ ID NO: 5885 - DNA, 1362 bp, Panicum virgatum
  misc_feature: Ceres CLONE 1827906
  misc_feature: Encodes the peptide sequence at SEQ ID NO. 5886
gtctcgccagctaccagctgccaccattccgcctgctgctgtacccgcagctagtgtgccaccaccagacgctctgcccatggcggcggcctccgacaagctgctgcccgcgctcgccgccgccttgctctgctgcgccctggcgcgggtcgcccaatgcgccccgcagaactacacctccatgttcagcttcggcgactcgctcacagacaccggcaactttctcgtgtccagcccgctctccaaccacatcgtcggccgctacccctacggcatcacctacttccaccgccctaccggccgctgctccgacggccgcctcgtcgtcgacttcctagcgcaagcgttcggcctgccgctgctgccgccgtacctgcaggccaaggggaaggatctccgccggggcgtcaacttctccgtcggcggcgccaccgccatggatccgcccttcttccaggagatcggcgcgtctgacaagctctggaccaacctctccctcagcgtccagctcggatggttcgagcagctcaagccgtcgctctgcagctcaccaaagaagtgcaaggagtacttcagcaagtccctgttcctcgtcggagagattggggggaacgactacaactacgcgttcttcaagggcaagaccctggacgacgccaaaacttacgttcccacggtggccggcgcggtcaccgatgccactgagaggctgatcaaggctggcgcgacgcacctggtggtgccggggaacctgccgatgggctgctcgtcggcgtacctgactctgcaccccggccggaacagcagcgactacgactccgccggctgcctcaagacgtacaacgacttcgcgcagcaccacaacgccgtgctccagcagaagctgcagccgctccgggccaagtacccgcaggccaggatcatgtacgccgactactacggcgccgccatgtccttcgccaagaaccccaagcagttcgggttcacgcaaggtccactgcggacgtgctgcggcggcggcgggccgtacaacttcaacccgaaggcgagctgcggcgtgcgggggtcgagcgtgtgcacggacccgtcggcgtacgccaactgggacggcgtgcacctgacggaggccgcctaccacgccatcgccgacagcatcctcaacggcccctacaccagccccaggctcctctgatcgtcccttcccaaggctagtgatcgacatgatcagcaactgatctgttgtgccaagactgtgactagtagtggtgattgaactgttctgcgtactgccgtaacactcagtgggtaactcgtaattaaaatggtggagtttggggttctgaaaaaaaaaaaaaaaaaaaa

SEQ ID NO: 5886 - protein, 370 aa, Panicum virgatum
  misc_feature: Ceres CLONE 1827906
  misc_feature (1)..(324): Pfam Name: Lipase_GDSL Pfam Description: GDSL-like Lipase/Acylhydrolase
MAAASDKLLPALAAALLCCALARVAQCAPQNYTSMFSFGDSLTDTGNFLVSSPLSNHIVGRYPYGITYFHRPTGRCSDGRLVVDFLAQAFGLPLLPPYLQAKGKDLRRGVNFSVGGATAMDPPFFQEIGASDKLWTNLSLSVQLGWFEQLKPSLCSSPKKCKEYFSKSLFLVGEIGGNDYNYAFFKGKTLDDAKTYVPTVAGAVTDATERLIKAGATHLVVPGNLPMGCSSAYLTLHPGRNSSDYDSAGCLKTYNDFAQHHNAVLQQKLQPLRAKYPQARIMYADYYGAAMSFAKNPKQFGFTQGPLRTCCGGGGPYNFNPKASCGVRGSSVCTDPSAYANWDGVHLTEAAYHAIADSILNGPYTSPRLL

SEQ ID NO: 5887 - DNA, 1497 bp, Panicum virgatum
  misc_feature: Ceres CLONE 1827912
  misc_feature: Encodes the peptide sequence at SEQ ID NO. 5888
agtcccaaccggattagctcggttcagcttcagcgagccccatcccatggccatggctccaccgctccccgccctcgtcctcctcctcgtcgccatcccactctcagccgcggcagtggtattccccacagaagccctgccgacgaaatcgggctacctccctatctcgcccgccaacgcctcggcctcgctcttcttcgcctactacgaggccacccacccgctcacgccgccggcctccacgccgctcctcctctggctgcagggcggacccggctgctccggcctcatcggcaacttcttcgagctcggcccctacttcgtcacccccgacagcgtctccctctcgcccaacccctttgcgtggaaccgccgcttcgggctcctcttcatcgacagcccgctcggcaccggcttcagcgccgcgccgtcccccgccgacatccccaccaaccagtccgtcgtcgccgcgcacatcctcgccgcgctgcagtcgttcctcgccctggagcccagcttccgcgcgcggccgttcttcatcaccggcgagagctacgccggcaagtacgtccccgcggcgggggcgcacatcctggacgtgaaccccacgctgccggaggcgctgcgcgtcaacctccgtggcgtggccatcggcaacgggctcacgcaccccgtcgcgcaggtggccacgcacgcggacgcggcctacttctcgggcctcatcaacgcgcggcagaagcgggagctggaggcgctgcaggcggaggcggtggcgctgacgcgcgcggagcggtggcgcgaggcggcggacgcgcgggggcgggtgctgtcgcggctgcagaacatgaccggcctggccacgctgtacgacacggcgaagcagcggccgtaccggacggaccccgtgggcgcgttcctgaaccggccggaggccaaggcggcgctgggcgcgcgcggtgacgtggtgtgggaggagtgcggcgacgcggtggacgcggcgatgcacgcggacgtgatgaggagcgtggtgccgcaggtggaatcgctgctgcggcgcacgcgcgtgctgctgtaccagggcatccgcgacctcagggacggcgtcgtgtccacggaggcgtggctcggcgaggtgcgctgggacgggctggtcgccttcctcgacgccgaccgcgccgtgtggcggacgcgcgacggggacctcgcgggctacgtgcaacgttccggcgcgctctcgcacgtggtggtgtacggggctgggcacctggtgccggcggacaacggccgcgccgcgcaggagatgatcgaggactgggtgctgcaggcggggccattcgggcgccgcggtggtgtcgtggcgacggcttgaggagcgccacctgatggcctgcccgcgccaacgagtttgtcgcaggctcgcagctcacaactgtgcaccgataatcatatttgtatcactgagtaataatgcttattggaatagaatacactttctga

SEQ ID NO: 5888 - protein, 440 aa, Panicum virgatum
  misc_feature: Ceres CLONE 1827912
  misc_feature (2)..(398): Pfam Name: Peptidase_S10 Pfam Description: Serine carboxypeptidase
MAMAPPLPALVLLLVAIPLSAAAVVFPTEALPTKSGYLPISPANASASLFFAYYEATHPLTPPASTPLLLWLQGGPGCSGLIGNFFELGPYFVTPDSVSLSPNPFAWNRRFGLLFIDSPLGTGFSAAPSPADIPTNQSVVAAHILAALQSFLALEPSFRARPFFITGESYAGKYVPAAGAHILDVNPTLPEALRVNLRGVAIGNGLTHPVAQVATHADAAYFSGLINARQKRELEALQAEAVALTRAERWREAADARGRVLSRLQNMTGLATLYDTAKQRPYRTDPVGAFLNRPEAKAALGARGDVVWEECGDAVDAAMHADVMRSVVPQVESLLRRTRVLLYQGIRDLRDGVVSTEAWLGEVRWDGLVAFLDADRAVWRTRDGDLAGYVQRSGALSHVVVYGAGHLVPADNGRAAQEMIEDWVLQAGPFGRRGGVVATA

SEQ ID NO: 5889 - DNA, 1375 bp, Panicum virgatum
  misc_feature: Ceres CLONE 1827920
  misc_feature: Encodes the peptide sequence at SEQ ID NO. 5890
acctttacaaacaaaccggaccagacgcgagcgctctctcggctcttcctcttctcgtctcacgcgcgcgcgcctagctcacaggcacccgcggcgcagcaagctcttctccttgtcggcggcggccgtggagcgggcatggaggtcgagtaccacgaggagtacgtgcggagctcgaggggcgtgcagctcttcacctgcggctggctgcccgccgcggcggcgcccaaggcgctcgtcttcctctgccacggctacggcatggagtgcagtggcttcatgagagaatgcggcgtgcggctggcggcggccggttacggcgtgttcgggatcgactacgagggccacggcaagtcgatgggcgcccgctgctacatccgcagcttccgccgcctcgtcgacgactgccacaacttcttcaagtccatctgcgagcttgaggagtaccggagcaagagccggttcctgtacggcgagtccatgggcggcgcggtggcgctgctgctgcacatgaaggacccggccttctgggacggcgccgtcctcgtcgcgcccatgtgcaagatatcggagaaggtgaagccgcacccgctggtgatcacgctcctgacgcaggtggaggacgtgatccccaagtggaagatcgtgcccaccaaggacgtcatcgatgccgccttcaaggaccccgtcaagcgcgaaaagatcaggaagaacaagctcatctaccaggacaagccgcggctcaagaccgcgctggagatgctcagaaccagcatgcacatagaagacagcttgtcacaggtgaagctgccgttcttcgtcctgcacggcgaggccgacacggtgacggacccggagatcagccgcgcgctgtacgagcgcgctgccagcgcggacaagatcatcaagctctacccggagatgtggcacggcctcaccgccggcgagcctgacgagaacgtggaggccatcttctccgacatcgtcgcctggctcaacgagcgcagccgcagctggaccatggaggaccgcctcacgaagatgacgccagctcccggcaagttcgttgatggcgagaaccgcggtgaggcgccggttcgagcgcgacctcagggacagcgccgaggcttcctctgcgggcttgccggcaggacgcatcaccacgctgagatgtgaaagaactgccagcactgatcagatgtgcacttggttgaacaatggcgaaaggaagtggtgatgtgcattttgttatgtataggtctcgatatttttgtcagggttctgtatgaccaaccattcccttacttccattgcagtaaacatttgctcaataatgatcaaagcttttgccccataaaaaaaaaaaaaaaaaaaa

SEQ ID NO: 5890 - protein, 345 aa, Panicum virgatum
  misc_feature: Ceres CLONE 1827920
  misc_feature (1)..(225): Pfam Name: Abhydrolase_1 Pfam Description: alpha/beta hydrolase fold
MEVEYHEEYVRSSRGVQLFTCGWLPAAAAPKALVFLCHGYGMECSGFMRECGVRLAAAGYGVFGIDYEGHGKSMGARCYIRSFRRLVDDCHNFFKSICELEEYRSKSRFLYGESMGGAVALLLHMKDPAFWDGAVLVAPMCKISEKVKPHPLVITLLTQVEDVIPKWKIVPTKDVIDAAFKDPVKREKIRKNKLIYQDKPRLKTALEMLRTSMHIEDSLSQVKLPFFVLHGEADTVTDPEISRALYERAASADKIIKLYPEMWHGLTAGEPDENVEAIFSDIVAWLNERSRSWTMEDRLTKMTPAPGKFVDGENRGEAPVRARPQGQRRGFLCGLAGRTHHHAEM

SEQ ID NO: 5891 - DNA, 1127 bp, Panicum virgatum
  misc_feature: Ceres CLONE 1827922
  misc_feature: Encodes the peptide sequence at SEQ ID NO. 5892
ccaaccgacccagcatacccaccaccccctcaccgccgcgcgcacccccaaaccctagcgcaggcaccatggcggcggcggcggcgcagcagaagatccggtggggcgagctcgaggaggacgacggcggcgacctcgacttcctcctcccgccgcgcgtcgtcgtcgggcccgacgagaacggcctcaagaaggtcatcgagtaccgttttgacgacgacggcaacaaggtcaaggtcaccaccaccacccgcgtccgcaagctcgccaaggcccgcctctcccgcagcgccatcgagcgccgccagtggcccaagttcggcgacgccgtcaaggaggacgccggctccaggctcaccatggtctccaccgaggagatcctcctcgagcgcccccgggccccagggagcaaagctgatgagccagctgcttctggtgacccactggctatggcaagcaagggaggtgctgttctcatggtttgcagaacctgtggcaagaagggcgaccattggacctcaaagtgtccctacaaggacctggcaccgccgactgaaagtttcacggacaggcctccgacgtcggatggccctcctgcagcaggcggtcctgttaagggagcgtacgttcccccaaccatgagaggtggcgctgataggaccggcggagatgtgatgcgccgcaggaacgacgagaactctgtccgtgtgaccaacctctcggaggacacccgcgagcccgacctcctcgagctgtttcgctcgttcggccctgtcagccgtgtctacgtcgcggtggaccagaagactgggtcgagcagagggttcggcttcgtcaactttgtgcacagagaggacgcggagaaggcgatcagcaagctcaatggttatggttatgataaccttatcctccgcgtcgagtgggcgacgccaaggcccaactagttttttttgccgctacttactagagccgcatattttggcaaaaaagttctatattgctatgtctggaatagtacctgtatcatgcgcatatgctgtgtcgtaaaaacctgctgttatgtgttaatttttgttggacgagaataattatactcactgttgttttaaaaaaaaaaaaaaaaaaaa

SEQ ID NO: 5892 - protein, 291 aa, Panicum virgatum
  misc_feature: Ceres CLONE 1827922
  misc_feature: Great-hit functional homolog of the protein sequence given in SEQ ID NO 9552
  misc_feature: Useful for making plants with altered alkaloid content
MAAAAAQQKIRWGELEEDDGGDLDFLLPPRVVVGPDENGLKKVIEYRFDDDGNKVKVTTTTRVRKLAKARLSRSAIERRQWPKFGDAVKEDAGSRLTMVSTEEILLERPRAPGSKADEPAASGDPLAMASKGGAVLMVCRTCGKKGDHWTSKCPYKDLAPPTESFTDRPPTSDGPPAAGGPVKGAYVPPTMRGGADRTGGDVMRRRNDENSVRVTNLSEDTREPDLLELFRSFGPVSRVYVAVDQKTGSSRGFGFVNFVHREDAEKAISKLNGYGYDNLILRVEWATPRPN

SEQ ID NO: 5893 - DNA, 1863 bp, Panicum virgatum
  misc_feature: Ceres CLONE 1827994
  misc_feature: Encodes the peptide sequence at SEQ ID NO. 5894
aaccgtcgcctcgccattccccgcctgaatccctaacgcccatggcctccgtctcccccgccgccgccgcagccgccgtctccggcccccaccacgcccgcctcctcctcccctcctcattgcgccgcctcgcgcggccccgcccgcgccctcgcccgcgactccgcctcgccgcctgccacgcggacacgctgctcccctcctcctcctcctcatcggaggtccgcgcgccgccggcccccgcagtggggccctccgccgaatctgccacggactgtttcgtcgactggctgcgcgcgcgcgggttgaccccgggcaaagtggatatccgggagcggccggtgccctgcctgcgcgagggcaaggaccccccgctgcgctacgtcgctgccggcgacgccctccaggcgggggatgtggcgttcgaagtgcccatgtcgctcgtcgtcacgctggagcgggtgctcggggacgaatcagtagctgagttgttgacgaacaacaagttgtctgagttggcatgcttggctttgtatctcatgtatgagaaaaagcaaggaaaggattcatattggtacccctacattaaggagcttgaccgacaccgaggaaggggacaactagctgttgaatcaccacttttatggactgaaagtgaacttgattacctgactggaagcccattaaaggatgaagttgttgctagagatgaggcggtaaggagagagtataatgagcttgacacattgtggttcatggcaggttcactgtttcagcaatacccttttgatatacctactgaggcttttccgtttgagatattcaagcaagcttttgttgccgtacagtcttgtgtggttcatctgcagaaagttagtttagctcgaagattcgcgctagttcctttggggccaccactattgacctacaagagcaactgcaaagctatgttgacagctgatggtgattctgttcggttggtggtggatcgcccatataaagccggagaaccaataatcgtctggtgtggaccacaaacaaactccaggctggttctgaactatggttttgttgatgaggacaatccctttgatcggatagcaattgaggcatccttaaatacagaagatcctcaataccaagaaaagagaatggttgctcagaggaaaggaaagcttgctatccaaaattttaatgtctatgtaggtaaagagaaagaaactgttgcagaaatactgccttacctgagattaggatacatttcagatccggatgaaatgcagtccatactctcttctgaaggagatacttgtccagttagtccatgtactgagcgagctgttcttgatcaacttgttggttacctggaatctcgattggctggttatccaacaactttggatgaggatgaagttatgttggcagatggcaatttggaaccaaagaaggaagttgctacaaggcttgtaaggttggagaagaagatgctccatgcctgtctccaggctgctaatgagtttataaatgacttgcctgatcacacagtatcaccttgccctgctccatatgcccctgaactgaaatgagatggtcatatcatcaggactttcaagaattgggcaacacgcagaaaagcatcctctatatgagatcattatatgttgcaagggattcacaaatctggccgttcaggtgcaatcgtgcaggcctcagcagatgtggtagttagttgcaatgcacagaagtgtgcgtgaatgttctctttttgttaatctagcaggttttgtattcacgaagtagattctgtatctctattttctgatgagcatgggttcggagtgccaaaaaaaaaaaaaaaaaaaa

SEQ ID NO: 5894 - protein, 514 aa, Panicum virgatum
  misc_feature: Ceres CLONE 1827994
  misc_feature: Great-hit functional homolog of the protein sequence given in SEQ ID NO 9335
  misc_feature: Useful for making plants with modulated UV sensitivity
  misc_feature: Useful for making plants with modulated low light sensitivity
  misc_feature: Useful for making plants with modulated oxidative stress sensitivity
MASVSPAAAAAAVSGPHHARLLLPSSLRRLARPRPRPRPRLRLAACHADTLLPSSSSSSEVRAPPAPAVGPSAESATDCFVDWLRARGLTPGKVDIRERPVPCLREGKDPPLRYVAAGDALQAGDVAFEVPMSLVVTLERVLGDESVAELLTNNKLSELACLALYLMYEKKQGKDSYWYPYIKELDRHRGRGQLAVESPLLWTESELDYLTGSPLKDEVVARDEAVRREYNELDTLWFMAGSLFQQYPFDIPTEAFPFEIFKQAFVAVQSCVVHLQKVSLARRFALVPLGPPLLTYKSNCKAMLTADGDSVRLVVDRPYKAGEPIIVWCGPQTNSRLVLNYGFVDEDNPFDRIAIEASLNTEDPQYQEKRMVAQRKGKLAIQNFNVYVGKEKETVAEILPYLRLGYISDPDEMQSILSSEGDTCPVSPCTERAVLDQLVGYLESRLAGYPTTLDEDEVMLADGNLEPKKEVATRLVRLEKKMLHACLQAANEFINDLPDHTVSPCPAPYAPELK

SEQ ID NO: 5895 - DNA, 1206 bp, Panicum virgatum
  misc_feature: Ceres CLONE 1828009
  misc_feature: Encodes the peptide sequence at SEQ ID NO. 5896
accacgagcactatggcgctcaccacgagcactaaccaagccctgctcgacgctcagctcgagctctggcacaacaccttcggctacatcaagtccatggcgctcaaatccgctctggacctccgcattgccgatgccatccacagccatggcggcggcgccaccctcccgcaggtagtcgccgctgtcaagctccacccatccaagattccctgcttgcgtcgcctcatgcgcgtgctcgccgccaccggcgtcctcagcgccgaccagagcccgccgggcggcggcgaacccgtgtacgcgctgacgccggtgtcccgcctcctcgtcggctcccagcagaaccttgcacctttcaccgccatgatactcgatccagccttcgtatctccgttcctcgagctcggcacatggtttcagaaggagctgccggagccgtgcgtcttcaagcacacgcacggcctgaccgtgtgggagcacgccggccgtgacgccaccttcgacgcgctcgtcaacgactcgatggtctcggacagccacttcaccatggacatcgccatcaaggagtacccaggtgccttcctggggataagctccctagtggacgtcggcgggggcctcggcgcggcggcgcaggccatctccaaggcgttccctggtgtgaaatgtagtgtgctggatttggaccacgtcgtcgccaaggctccgagcgacaccggcgtgcagtacatcgccggcgacatgtttgagagcgtcccaccggcggatgctatgttcctcaagtgggttttgcatgactggggcaacgaggagtgtgtcaagatactgaagaactgcaagaaagctattccaccgagagaggagggaggaaaggtgataatcatagatatcgtggtagaagaaggatcatcaaacttgaagcaaagggagatgcaggccttgttcgatctatatatgacacttgtaaatggtatcgagcgagatgagcaagagtggaaaagcatattttttgaagctggattcagcgactacaagatatcgccagtgttaggcgctagatccatcatcgaggtctacccgtaaaatgtcttgcgagcaaatggttaaaatggtatggattgagtgggtttgtaattcccagtaaatttgctgccctgttgtggtgttaattcgtaataatgtgcttaaaaaaaaaaaaaaaaaaaa

SEQ ID NO: 5896 - protein, 356 aa, Panicum virgatum
  misc_feature: Ceres CLONE 1828009
  misc_feature: Great-hit functional homolog of the protein sequence encoded by LOCUS At4g35160
  misc_feature (1)..(253): Pfam Name: Methyltransf_2 Pfam Description: O-methyltransferase
  misc_feature: Useful for making plants with altered cell wall content and/or composition
MALTTSTNQALLDAQLELWHNTFGYIKSMALKSALDLRIADAIHSHGGGATLPQVVAAVKLHPSKIPCLRRLMRVLAATGVLSADQSPPGGGEPVYALTPVSRLLVGSQQNLAPFTAMILDPAFVSPFLELGTWFQKELPEPCVFKHTHGLTVWEHAGRDATFDALVNDSMVSDSHFTMDIAIKEYPGAFLGISSLVDVGGGLGAAAQAISKAFPGVKCSVLDLDHVVAKAPSDTGVQYIAGDMFESVPPADAMFLKWVLHDWGNEECVKILKNCKKAIPPREEGGKVIIIDIVVEEGSSNLKQREMQALFDLYMTLVNGIERDEQEWKSIFFEAGFSDYKISPVLGARSIIEVYP

SEQ ID NO: 5897 - DNA, 1153 bp, Panicum virgatum
  misc_feature: Ceres CLONE 1828025
  misc_feature: Encodes the peptide sequence at SEQ ID NO. 5898
aggccgctcgctgctgggccacacaaaggaaacaggggagaggagatccaaaataacaagaaactccagcagattgcgaaacccatctgcgcctcctcctcctcgatcgagagagggagctcgctcatctcatctcatctcatctctctccgcccccgccggccggtcttctcgcccggggcccttcctccggatcctggatcgatcgcctgttcggcacatggcggctcccactgccaacggcaattccactgtcagctctcttgcaacaactgttccggttcaggcagtcctgtttgatattgatggaactctctgcgattcagaccctctccatcatgcggctttccaggaattgctcctcgagattgggtacaacaacggcgtgcccataaatgatgagttcttcatcaaaaatattgctggaaggagtgatgttgaggctgcccagaatttgttcccggactgggaccttgaaaaggggctcaagttcctagacgagaaggaagctaaatacagaagtttggcaaaagagcgcttggaacctgtgaaaggccttgggaaagttgttcagtgggtcaaggatcacggctacaagcgtgcagcagtgaccaacgcccctaggattaacgcagagctcatgatctcactccttggcctctcggacttcttccaggccattattatcggaggtgaatgtgagcagccgaagcctgccccatacccgtacctgaaggccatcaaggagcttcaggtgtctgcagaacacaccttcatcttcgaggattctgcttctggcatacgtgctggtgttgcagctggaatgcctgtcgtcgccgtggcaacgaggaaccctgagaaatcccttctcgaagcaggagccagcttgctgatcaaggactatgaggaccccaagctctgggctgcgcttgaggagatcgacagagaggaagctaagctaaagaaggccagcgaatgagatgacaatgaacaattgattagatttattagcaaattaaatttaccctgtgttgcagctgaaggaacggcaaagggctcaattgggtatattttgagcttctagtttggtattatttcccttttctcgatgaactgaaaccaaataagaactcaaaaaaaaaaaaaaaaaaaa

SEQ ID NO: 5898 - protein, 252 aa, Panicum virgatum
  misc_feature: Ceres CLONE 1828025
  misc_feature (1)..(190): Pfam Name: Hydrolase Pfam Description: haloacid dehalogenase-like hydrolase
MAAPTANGNSTVSSLATTVPVQAVLFDIDGTLCDSDPLHHAAFQELLLEIGYNNGVPINDEFFIKNIAGRSDVEAAQNLFPDWDLEKGLKFLDEKEAKYRSLAKERLEPVKGLGKVVQWVKDHGYKRAAVTNAPRINAELMISLLGLSDFFQAIIIGGECEQPKPAPYPYLKAIKELQVSAEHTFIFEDSASGIRAGVAAGMPVVAVATRNPEKSLLEAGASLLIKDYEDPKLWAALEEIDREEAKLKKASE

SEQ ID NO: 5899 - DNA, 1664 bp, Panicum virgatum
  misc_feature: Ceres CLONE 1828036
  misc_feature: Encodes the peptide sequence at SEQ ID NO. 5900
acatacaaatacaacctgggcttttgcttttgcatcttcgccgccgccgtggatcgcccgaccgcgtgtgatggcgatgcgcgcgcgcgtggccaccgcgtgacgcggcgacactgacgcgcgggcccagcccacgagcctccacagtccacacttggcttcccttccctctcctctcctcccctcccctcccctcgccttcccttccctcctaggcggggcgacgatctcgaccgcatccgcatcccacttggcttttggcttccctagaaaacctccccaaatccggtgatcctattcccgttccccaattcccccggaactttctagaaggcccggacgaccctgcctcggagctgccggcggcgagatccagggagcctcccgccatggtgaaggagagcgcctactacgacgtcctcggggtcagcgtcgacgcgtcccccgctgagatcaagaaggcgtactacctcaaggcgaagctggtgcatccggacaagaatcctgggaaccccgacgccgcgcagaaattccaggaacttggggaggcctatcaagtcctaagtgatcctgggaaaaaggaggcttatgataagtatggaaaggagggtattccccaggataacatggtagatcctgctgctgtatttgggatgctttttggaagtgactactttgaagattatgttggccagcttgctctagcatctatagcttcagtggaagttgatgaaaactcaaacagtcaagaggccagagcaaaggttcaagaaaagataaaggaattacaaaaagaaagagaacaaaagctcactcagagcctaaaggaccgtcttcaaccatatgtagatgggagaaaggatgaatttgtgagctgggctagtgcagaaggccggcgtttatcccaggcagcatttggtgaggctatgcttcacactattggatatatttatgtgcggcaagcagcaagagaacttggaaagagtaaaatttatatgggtgtaccgtttatagctgagtgggttcgggacaaaggtcaccatattaaatcacaggttaatgccgcttcaggtgctatctctctgatacaactccaagaaggaatgaaaaggatggagggaagtgagaacaatgaagaggagcttatgaagagtttcgaggagaaaaaggaggccatgcttagttcactatggaagattaatgtggttgatattgagtcgacactttcacgtgtctgtcaagcggttctgaaagatagcacggtccccaaagaggttctgaagttgcgagccaaagccttgaaaaaacttgggacaatattccagggtgcaaagtctctctaccgtcgtgacaacagcctgcgcgtcgaaacgagcatagatcaacaggcaactccatcacagtgagacccggaaacgcccatgtaactagagattctggtgattcgttttgtaccttgttagggtttcgcctctctgtttgctaacgttcagacagcgcactgattaaaaaaattcagacaggcagaccattcctgatattgccggtgggtgtacgaactttttttttattctttttctgtagaaaaatgtgagtggtgagcacgaagcagtgaactgcggttaatgcagcgttacaagttgtaaaaaaaaaaaaaaaaaaaa

SEQ ID NO: 5900 - protein, 338 aa, Panicum virgatum
  misc_feature: Ceres CLONE 1828036
  misc_feature (1)..(63): Pfam Name: DnaJ Pfam Description: DnaJ domain
MVKESAYYDVLGVSVDASPAEIKKAYYLKAKLVHPDKNPGNPDAAQKFQELGEAYQVLSDPGKKEAYDKYGKEGIPQDNMVDPAAVFGMLFGSDYFEDYVGQLALASIASVEVDENSNSQEARAKVQEKIKELQKEREQKLTQSLKDRLQPYVDGRKDEFVSWASAEGRRLSQAAFGEAMLHTIGYIYVRQAARELGKSKIYMGVPFIAEWVRDKGHHIKSQVNAASGAISLIQLQEGMKRMEGSENNEEELMKSFEEKKEAMLSSLWKINVVDIESTLSRVCQAVLKDSTVPKEVLKLRAKALKKLGTIFQGAKSLYRRDNSLRVETSIDQQATPSQ

SEQ ID NO: 5901 - DNA, 1297 bp, Panicum virgatum
  misc_feature: Ceres CLONE 1828038
  misc_feature: Encodes the peptide sequence at SEQ ID NO. 5902
ctccccaatttcaaaatccagctcccttgctagggtttgcctttgcggcgcggcgcagcccccctcttctcgccatccaagggaaaaggcgatggagctcaacatcgtggacaagtacgagaagctggagaaggtgggggagggcacctacggcaaggtgtacaaggcgcaggacaaggccacgggccagctcgtcgccctcaagaagacccgcctcgagatggacgaggagggcatcccgcccaccgcgctccgcgagatctccctcctcaacctcctctcccactccatctacgtcgtccgccttctcgccgtcgagcaggccgccaagaacggcaagcccatcctctacctcgtcttcgagttcctcgacaccgacctcaagaagtacctcgacgtctaccgcaaggggcccaaccccaggccgctacccccgcacctcgtcaagaattttctgtttcagttatgcaaaggagttgctcactgccatggccatggtgtccttcaccgggatttaaagccgcaaaacctgctggttgacaaggagaaggggatactgaagattgccgatcttgggcttggtagagctttcactgtgccaatgaaaagctacacccatgagattgtgacactttggtatagggcccctgaagttttgcttggagcaacacattactcaactggtgttgatatgtggtctgttggatgtatctttgctgaaatggtcagaagacaagctctctttcccggtgactctgagttgcaacagttgcttcacattttcaggttattgggaactcctactgaggagcagtggcctggagtcagtggtttgagggattggcacgagtttccacaatggaagccccagagtttggcccgtgctgtcccaacgctggaacctgagggcattgatctgctatcaaaaatgcttcagcttgatcctgcaaacaggatatcagccatcgccgcgatggaccatccctactttaacagccttgacaaatcccagttctagtttgaagctgctactatcaagaagtgagctttccgatggagctatgaatttcagttgccatctaggcagctgtttcatagtctattagtgacgtgttaccgagtaaaattggcgtgcctatcttttcgtgtcacgtgtgactcgataaactatattcttccatgtaccaaaagctgttgtcttgtagcataacacaagttatttgttgggcaccgttttttttccgccctgtgagggtgagtatttgttatctgtgccgaaaaaaaaaaaaaaaaaaaa

SEQ ID NO: 5902 - protein, 308 aa, Panicum virgatum
  misc_feature: Ceres CLONE 1828038
  misc_feature (6)..(308): SWISSPROT Homolog: EC 2.7.11.22 Cell division control protein 2 homolog B
  misc_feature (6)..(308): SWISSPROT Homolog: EC 2.7.11.22 Cell division control protein 2 homolog C
MELNIVDKYEKLEKVGEGTYGKVYKAQDKATGQLVALKKTRLEMDEEGIPPTALREISLLNLLSHSIYVVRLLAVEQAAKNGKPILYLVFEFLDTDLKKYLDVYRKGPNPRPLPPHLVKNFLFQLCKGVAHCHGHGVLHRDLKPQNLLVDKEKGILKIADLGLGRAFTVPMKSYTHEIVTLWYRAPEVLLGATHYSTGVDMWSVGCIFAEMVRRQALFPGDSELQQLLHIFRLLGTPTEEQWPGVSGLRDWHEFPQWKPQSLARAVPTLEPEGIDLLSKMLQLDPANRISAIAAMDHPYFNSLDKSQF

SEQ ID NO: 5903 - DNA, 1406 bp, Panicum virgatum
  misc_feature: Ceres CLONE 1828054
  misc_feature: Encodes the peptide sequence at SEQ ID NO. 5904
cgtggctgctggtattgagtcgtgtcaccctgtggacaccgcgggcacctcgcgcgtgacgccccccttgccggaacacgccaacacgccgtgccgccgccgacattggtggcgccacctgcttgccggcacgggcgcgcgggggcgtgtcgcccgccccgacgcaccgggtgacgggagcgcgctccatgattggtcctagccgcgccagagcagagcagagcagacgctgccgccatgccgtcgcgaccccgaaccgacctcgctcgctcgccgccagcaatggcgggcagcccaaccccatgcgccgcgtcgcccgcagtgcatgcgcgcggccgctcccctctatataaagccacgcgggcagccatggcgatcccgatcaccagcccagatcagaccgcgaccttgcgatggtgaggccgtcgatcgtgctgttcggggactccatcacggaggaggcgttcggggagggcgggtggggcgcgtcgctggcgaaccactactcccgctccgccgacgtcgtcctccgcggctacagcggctacaacacgcgctgggcggcgcgggtcgccggccgcgccgtggccaccgtcgccggcgccgtcgccgccgtcaccgtcttcttcggcgccaacgacgccgcgctgcccgaccgcgccagcgcggcgcagcacgtgcccgtcgccgagtacgccgacaacctccgcgccatctgcgcgatgctccaccggcgctggcccggggtcgtcgtcatcctcgtcacgccgccgcccgtcgacgaggacggccgccgccggtacccgtacgcgcacgactactccggcctgccggagcgcaccaacgcggcggcgggggtgtacgcgcgggcgtgcgtggaggtggcgcggcagtgcggggtcagggccatcgacatctggtccaggatgcagaagttccccggctgggagaagtccttcctcagggacgggctgcacctgacgccgcgcgggaaccgggtgctgttcgaggaggtggtgttcgcgctcaaggacgccaacctcagcctggaggcgctgccggccgacctgccgctcttcggcgacatggaccccgacaacccggccaagtcgttcgaggacgaagacgagtgggccgagcgctgacgaggagatggcaaactccagtttcgagactggcattgagcgcgtcatcacaattaatgttgggaacagggttcttttctgcagcatcatggcttgttctcttcctcccgagcgcaagcagggatgtctagagtcgtaatccaattcatgcaactgtactttgttgtaataagttcatttttctcaggttcattcttttttaacataaaaaatgtccaataaatacccacgggtttgttccaaaaaaaaaaaaaaaaaaaa

SEQ ID NO: 5904 - protein, 243 aa, Panicum virgatum
  misc_feature: Ceres CLONE 1828054
  misc_feature (1)..(200): Pfam Name: Lipase_GDSL Pfam Description: GDSL-like Lipase/Acylhydrolase
MVRPSIVLFGDSITEEAFGEGGWGASLANHYSRSADVVLRGYSGYNTRWAARVAGRAVATVAGAVAAVTVFFGANDAALPDRASAAQHVPVAEYADNLRAICAMLHRRWPGVVVILVTPPPVDEDGRRRYPYAHDYSGLPERTNAAAGVYARACVEVARQCGVRAIDIWSRMQKFPGWEKSFLRDGLHLTPRGNRVLFEEVVFALKDANLSLEALPADLPLFGDMDPDNPAKSFEDEDEWAER

SEQ ID NO: 5905 - DNA, 1132 bp, Panicum virgatum
  misc_feature: Ceres CLONE 1828119
  misc_feature: Encodes the peptide sequence at SEQ ID NO. 5906
acacccagcccgtcctcccatcgcccaagcaactgcccgagcagaacccgatggccggcgcgtcggcgaccactactatcccctgcgtcacgctcaacacgggccacgcgatgcccgtgctgggcttcgggaccggctccaacagcacgccggcggacctgtcggccatcatcgtcgacgccgtccgcctcggctaccgccacatcgacacggcctcgctctacggcacggagggcgcggtcggcgccgccgtggccgccgccgtccgcgccggggccgtcgcctcgcgaggggacctcttcgtcacgtccaagctcggcgtcgccgacgcgcacccggaccgcgtgctccccgcgctccgcgagtcgctggcccgcctcggcctcggctacctcgacctcttcctcatccactggcccgtcgccgccggcgagaacaggaagctcgtgcccttcgacatggagggcgtctggcgcgccatggaggagtgccaccgcctgggcctcgcgaggtccgtcggcgtcagcaacttctcgtccgaaaagatgtgcaggctgctctccttcgccgccgttccgccggccgtgaaccaggtggagttgaacgtcgcctggcgccaggagaagctaagggaggtctgcgccaggaacggcgtcgtcgtcacagccttctcgccgctcggcgcgttcggcgcggcttggggatccaacgccgtcatggagagcggcgccctgcgcgatgtcgccgccaggagaggcaagacggttgctcaggtggcgctgaggtggctgcacgaacaggggttgtccttcgtggtgaggagcttcaacatggagagactaaagcagaacatggagcttttcgactgggagttgagcgaggacgacaaggagctgatcatgcaaattccacagcggagagcatgccgtggggaattctttttgtcaccagacgggcaatacaagtctctggaggagctgtgggatggagagatatgagaagtcatgttcccagataagaaatcccgtagcttctttagtaaaagtgaacttcggaaacgaatatgttgtctcttgtgcttattggttttatttaagtttttattgacctacaaaaaaaaaaaaaaaaaaaa

SEQ ID NO: 5906 - protein, 315 aa, Panicum virgatum
  misc_feature: Ceres CLONE 1828119
  misc_feature (1)..(286): Pfam Name: Aldo_ket_red Pfam Description: Aldo/keto reductase family
MAGASATTTIPCVTLNTGHAMPVLGFGTGSNSTPADLSAIIVDAVRLGYRHIDTASLYGTEGAVGAAVAAAVRAGAVASRGDLFVTSKLGVADAHPDRVLPALRESLARLGLGYLDLFLIHWPVAAGENRKLVPFDMEGVWRAMEECHRLGLARSVGVSNFSSEKMCRLLSFAAVPPAVNQVELNVAWRQEKLREVCARNGVVVTAFSPLGAFGAAWGSNAVMESGALRDVAARRGKTVAQVALRWLHEQGLSFVVRSFNMERLKQNMELFDWELSEDDKELIMQIPQRRACRGEFFLSPDGQYKSLEELWDGEI

SEQ ID NO: 5907 - DNA, 1318 bp, Panicum virgatum
  misc_feature: Ceres CLONE 1828221
  misc_feature: Encodes the peptide sequence at SEQ ID NO. 5908
acgtacccaccaccggattcgcgcccccttcaaaagccgccggcccgccggcgacacggtcggaagacgacaccaccagtccaaccacgccggagccaggaaggcagcagcagggggaagagagcgcggccggcaccagcagccaacggcgcgccggcggacggagatgaagaagtgcccgtcggagctgcagtgggaggcgttcatccgggaaagcgccggcggcgcggagagcaagcccggaacaggacccagcgagcccggcgggagcgccgtgttctcgcccggcggcgtcggcttcggcgactcgaacaccatggatggaagcagctggtggtacgggagcatccgccccgcgaacccagtcgtgtcgcagacggcgtccgtctccgcagctagccccagagcaaccacctcagctaatcatgctcttgagagcgagtcggattccgacagcgaatcattgtatgaggtagagggaggttcatgtgagcgaggcaccaaatctatggaaacaaagcgaataaggaggatggtgtccaacagggagtctgctcgacgatccaggcggagaaagcaggcacaactatctgaactcgagtcacaggtcgaacaacttaaaggtgaaaatgcaactctgttcaagcaactttcagaggccaacctgcagttcaccactgcagtcacagacaacagaatcctcaaatcggatgtagaagccttaagagtaaaggtaaagatggcagaggatatggtagcgagaagcgcaatgtcctgcggcctaggtgaccttggtctggcaccatatctgaattcaagaaagatgggccaagctttgaatatgctcacagccacaggattggatttgctagggagtgaggcattcagaggtccaaccgcagctcgacaagttcagaactcaccagtacaaagcactgcaagcctagagagtctggataaccggaagtccagcgaggtgaccagctgtgcggcagacatgtggccttgatattcaggacactgatcagattcaaagcctgcaaggcagaaatcgcaccagttcattacctcaaacatttggtgactctgccttctggagcatagcttctgtcaaatttccttgaaccatgtttctacagaaggctttacactataacactatgcatcgctcgtttgatgtagctgtctgatacttctccagtgggaaagataccatttactgaaagctgtcatggcaaacaatgaatgtggcaaacctcaactatagtttcaagtagaaaatgaacttgtctttgtagaaaaaaaaaaaaaaaaaaaa

SEQ ID NO: 5908 - protein, 280 aa, Panicum virgatum
  misc_feature: Ceres CLONE 1828221
  misc_feature (1)..(62): Pfam Name: bZIP_1 Pfam Description: bZIP transcription factor
  misc_feature (2)..(51): Pfam Name: bZIP_2 Pfam Description: Basic region leucine zipper
MKKCPSELQWEAFIRESAGGAESKPGTGPSEPGGSAVFSPGGVGFGDSNTMDGSSWWYGSIRPANPVVSQTASVSAASPRATTSANHALESESDSDSESLYEVEGGSCERGTKSMETKRIRRMVSNRESARRSRRRKQAQLSELESQVEQLKGENATLFKQLSEANLQFTTAVTDNRILKSDVEALRVKVKMAEDMVARSAMSCGLGDLGLAPYLNSRKMGQALNMLTATGLDLLGSEAFRGPTAARQVQNSPVQSTASLESLDNRKSSEVTSCAADMWP

SEQ ID NO: 5909 - DNA, 1295 bp, Panicum virgatum
  misc_feature: Ceres CLONE 1828282
  misc_feature: Encodes the peptide sequence at SEQ ID NO. 5910
gccttctcccgtctccctccacaccccatccggtcgtcgtcgtcgcggcgcgagcgagcgaggggggaaaacccaaaaccctagcgcccccgtccccgccggcagcgagcggggagatggcggtggacgaggtcacctcggtatacgtcggcggcctgccctacgaggccaacgaggacttactccgcgacgccttccagtactacggcaccatcgtctccgtcaaggtgataaatgatcattctgtcaaaggcaagtgctatggttttgttactttcactcaccccaaagctgctgaggatgcaattgcaggcatggatggcaagaaaatagccaatcgcattgttagagtaaatgaagtgcgtacaagaggtccccgagattttggtcgtgagggttttagacgagatcctagaaggtatggtagagatccatactgggacagaagggatagggaacggagctatgatcgcgaaagagatccctaccatgacagggatagtgatcgatctcgtgagcatgacagagacagagattatgagcatggtggcttcaatcgagatattgattatcccatggatcgtgatcatgaagtagacgagaggcgtcctagagagcatgatcgtgcgccagaaatgcataacatggattcagaaaatgacagagacaaggagcacgggtcaagaaaaagattcagccgtccaaaaggtcgtgatagcagagacttatcgagttccagtgatggtcttcaaaatgatgaaaagaatcacttggacaaggccgttcagatgcgtgaggaccttgaaaatgaggttcaccagatgaaagataaaattgcagcaaaagaacagcacattgcagacttgcagaagaaagctcagaaattagaggatgaactggttgctgcacgcaaagtgtcttcagaacgacaattagctgttacagacttgtacaaacattttcttcaacttcaagactacaatgacagagtcaagactgctgaacagaggcttcagtctcttgtcaatgctgcgatggtcgagcttgacatgggcgaagatgctacaaccagagatggctcgatttatgagaatggcgtggtttgaacttctgggcgccgccaactgtatggtttctcagtaactaatttattagactttaagcttgttgctatgtaatagaactgtaagaggaaagtatcgagcaatgttatgtaaggatcagtagacgtgtggctgctcatttgctgctattgtggtccagacttatctttcaaaaaaaaaaaaaaaaaaaaa

SEQ ID NO: 5910 - protein, 329 aa, Panicum virgatum
  misc_feature: Ceres CLONE 1828282
  misc_feature: Great-hit functional homolog of the protein sequence given in SEQ ID NO 9375
  misc_feature: Useful for making plants with modulated biomass
  misc_feature: The plant is abnormally small.
MAVDEVTSVYVGGLPYEANEDLLRDAFQYYGTIVSVKVINDHSVKGKCYGFVTFTHPKAAEDAIAGMDGKKIANRIVRVNEVRTRGPRDFGREGFRRDPRRYGRDPYWDRRDRERSYDRERDPYHDRDSDRSREHDRDRDYEHGGFNRDIDYPMDRDHEVDERRPREHDRAPEMHNMDSENDRDKEHGSRKRFSRPKGRDSRDLSSSSDGLQNDEKNHLDKAVQMREDLENEVHQMKDKIAAKEQHIADLQKKAQKLEDELVAARKVSSERQLAVTDLYKHFLQLQDYNDRVKTAEQRLQSLVNAAMVELDMGEDATTRDGSIYENGVV

SEQ ID NO: 5911 - DNA, 1440 bp, Panicum virgatum
  misc_feature: Ceres CLONE 1828291
  misc_feature: Encodes the peptide sequence at SEQ ID NO. 5912
aaagccgcgggccttcgcgaaggtcttcctcccggtgctcccgccgccgcccctcatcactgctcccgtcttcccgcggttgctggccgacgacacgagccgcgggcgcggcggcgatgtcggcagcggcgacgccgccggcgcaggcaccgaggaagtgggaggggctggtggacgaagcgctggagcgggaggtgctgggcgcgtgcctgggccaggcccccgagcgccgccgcgtccgcgaggcattcaaggacgtgcagctcagcatcgaccattgcctcttcaagggacaatatagtggcattggaacaaaggagtcatatgagcggaactctaggggcgtggagattttctcgaaatgttggttcccagagaatcattgcatgaaagcaattgtttgtctctgccatggttatggagacacctgtaccttcttccttgatggggtagctaggaagattgcttcagctggatatggagtatttgcacttgactaccctggctttggtctttcggaaggacttcatggatatattccaagttttgatactcttgttgacgacgtagctgaacacttcgctaaggttaaaggaaatcctgaacatagtggtctgccgagctttctatttggtcaatctatgggcggagcagttgcattgaaggttcacttcaagcaaccaaatgattggaatggtgcaatactagttgcacccatgtgcaagattgcagatgatgtggttccaccttggcctgttcggcaagttctaatttttatggccaaacttttgcccaaagaaaagcttgttcctcaaaaggatttagctgagttggcattcaaagagaagaagaaacaggagcagtgttcattcaatgtgatcgcctacaaggataaaccaaggctccggacagctttggagatgctgaatacgacacaagaaatagaaagacgtctggaagaagtttctctgcccatgataatattacacggcgaggctgatttggttactgacccggccgtgagtaaagctctgtatgagaaagcaaagagcctagacaagaagctgtgcctctacaaaggtgcataccacgccatattggaaggtgagccagatgatacaattttccaagttctcaatgatataatctcttggctggatcagcatgcaacaaaaggtcaaggttcgtcgtgaatcacgcagttggccgtccatcaggattaggtgaatttctttggcattgctgtaccccttcctgtcagggatccccagatccaacgatcgagaattacatttttgtgacaaccatgtaaaattcttagttctgattattaatttgtccatcatgtatctgagcgatgtacataactgatccacgtgtatttaattaccatgaattatttaagataaatttcagttgcaaaaaaaaaaaaaaaaaaaa

SEQ ID NO: 5912 - protein, 358 aa, Panicum virgatum
  misc_feature: Ceres CLONE 1828291
  misc_feature (1)..(222): Pfam Name: Abhydrolase_1 Pfam Description: alpha/beta hydrolase fold
MSAAATPPAQAPRKWEGLVDEALEREVLGACLGQAPERRRVREAFKDVQLSIDHCLFKGQYSGIGTKESYERNSRGVEIFSKCWFPENHCMKAIVCLCHGYGDTCTFFLDGVARKIASAGYGVFALDYPGFGLSEGLHGYIPSFDTLVDDVAEHFAKVKGNPEHSGLPSFLFGQSMGGAVALKVHFKQPNDWNGAILVAPMCKIADDVVPPWPVRQVLIFMAKLLPKEKLVPQKDLAELAFKEKKKQEQCSFNVIAYKDKPRLRTALEMLNTTQEIERRLEEVSLPMIILHGEADLVTDPAVSKALYEKAKSLDKKLCLYKGAYHAILEGEPDDTIFQVLNDIISWLDQHATKGQGSS

SEQ ID NO: 5913 - DNA, 1113 bp, Panicum virgatum
  misc_feature: Ceres CLONE 1828312
  misc_feature: Encodes the peptide sequence at SEQ ID NO. 5914
gagcgagcgcaccggcacaccgccccccatccatctggtcaccatctctcctcctcgccactcgctgcagcagccgccgcctgatccgcctcgccgcaagcccgcagcgccaccatgagcgcctccaggaagctgttccaggccgccgccaggtccctcctctccgcctcccagcgctcctcccccgccgccctcctcgccgccgagggccgcaccgccgcgctcgccacgctcaccaacctgggcaggaagaccctccccaccgcctacgcctaccacaagcagggatcccaccacgcctcctcgggatggggagccttcgccgccgccgtccccgctgcagtttacatgctccaggaccaggaggctcacgccgcagaggtaaacgccgcagagttggagcgcaccttcattgccatcaagcctgacggcgtccaaagaggcctgatttcggagatcgtatctcgatttgagagaaaaggttacaagcttgttgccatcaagttgattgttccatccaaagaattcgcccagaagcactatcatgatctcaaagacagacctttcttcaatggactgtgtgattttctcagctctggccctgtacttgccatggtttgggaaggagagggtgttatcaagtatgggagaaaactaattggtgccacagacccacagaaatctgaaccaggaaccatcaggggtgatcttgccattgttgttgtaagaaacatcattcacggaagtgatggcccagagacagcaaaggatgagattgctctgtggtttgagcccaaggagctggtctcttacaccagcaacgcggagaagtggatctacggggtgaactaaccagcgaatcattttgtttctattctgctcaccattttcacataattgccaatagaccaaggcaggatgtactaataaagttgcgaccgtcacttttgagttggattgtgaccttctggtgcagtaaggcacaaggaaggaaggagatgtaccttgaaatatagagcgtgcactgagtagtcgcgatgttcaaatcatagaaatcaaactatgtatcaccttcagtagaggcgtgtgatccaagatggtgatgcagatgtt

SEQ ID NO: 5914 - protein, 245 aa, Panicum virgatum
  misc_feature: Ceres CLONE 1828312
  misc_feature (1)..(135): Pfam Name: NDK Pfam Description: Nucleoside diphosphate kinase
  misc_feature (11)..(245): SWISSPROT Homolog: EC 2.7.4.6 Nucleoside diphosphate kinase 4, chloroplast precursor
  misc_feature (11)..(245): SWISSPROT Homolog: EC 2.7.4.6 Nucleoside diphosphate kinase IV, chloroplast/mitochondrial precursor
MSASRKLFQAAARSLLSASQRSSPAALLAAEGRTAALATLTNLGRKTLPTAYAYHKQGSHHASSGWGAFAAAVPAAVYMLQDQEAHAAEVNAAELERTFIAIKPDGVQRGLISEIVSRFERKGYKLVAIKLIVPSKEFAQKHYHDLKDRPFFNGLCDFLSSGPVLAMVWEGEGVIKYGRKLIGATDPQKSEPGTIRGDLAIVVVRNIIHGSDGPETAKDEIALWFEPKELVSYTSNAEKWIYGVN

SEQ ID NO: 5915 - DNA, 1600 bp, Panicum virgatum
  misc_feature: Ceres CLONE 1828345
  misc_feature: Encodes the peptide sequence at SEQ ID NO. 5916
tctcccccgaccctccgcctcatcggcgagcgaactaaccaaccgcgccgcaaccgaaccgagccaaaccatggccgccgcgccgccgcccctcctgctcgcgggcctcgccctcgccgtcatcgccgccgcgggatggcccccggcggtgacggcggcgctggaggaccccgcggggctcctgcggcgggccaaggagccggcgttcgcggactggatggtcggggtgcggcggcgcatccacgagaacccggagctggggtacgaggagttcgagaccagcgagctcgtgcgccgggagctcgaggccatggggatcccctacaggcaccccttcgccgtcaccggagtggtcgccacagtcggcaccggcggcccgcccttcgtcgcgctgcgggcggatatggacgcgctacccttgcaggaaagcgtggaatgggagcacaagagcaaagttcctgggaaaatgcatggatgtggacatgatgctcatgttgctatgctcttgggatctgccaagattcttcaagagcatcgtgatgagttgaagggcacagttgtccttgttttccaaccagctgaggaaggtggtggtggggcccagaaaatgatagaagctggagctgtggaaaacatagaagccatttttgggcttcatgtagctgactctgtgcctattggtgtactggcatccagaccagggcctattatggctgggagtggattctttgaggctgtaataagtggaaagggagggcatgctgcacttcctcatcacactattgatccgatattggctgcctcaaatgttattgtgagccttcagcagcttgtttctcgggaagccgatcccttggattcacaggttgtaacagttggaaaatttcaaggaggtggtgccttcaatgttatcccagattcagtaacaattggtggcaccttccgagcctttttgaaggatagttttaatcaattgaagcagcgaattgaagaggtcattgtctctcaagcatccgtgcagcggtgcagtgctactgtggacttccaaaccaaggaccgccctttcttccccccaaccagcaacagccccaaactccacgatttcttcgtgaatgtggctagtgagatggttggctccaagaatgtgagggacaggcagccgctgatgggtgctgaggacttcgccttctacgctgatgcgatcccctccacctactactactttgtgggaatgtacaacgagacccgtggactgcaggcgccccatcattccccctatttcaccatcaacgaggatgccctcccctatggcgcggctgctcatgcagcgttggctgctcgctatctgctcgagcaccaggagcctgctgctaccccggataaggcgaaatcccatgacgagctgtagatagttactgtctgaattctggtgagatgcaaatgatagcgaaaaatgggtgcaattagattgagccattgaagctgaattttcggctggttggctttatctttcgccaagttattcagaagatgtacaaaaaaaaaacgagacgaagaggcagaccgcttccccgcatttcaaaaaaaaaaaaaaaaaaaa

SEQ ID NO: 5916 - protein, 445 aa, Panicum virgatum
  misc_feature: Ceres CLONE 1828345
  misc_feature (1)..(318): Pfam Name: Peptidase_M20 Pfam Description: Peptidase family M20/M25/M40
MAAAPPPLLLAGLALAVIAAAGWPPAVTAALEDPAGLLRRAKEPAFADWMVGVRRRIHENPELGYEEFETSELVRRELEAMGIPYRHPFAVTGVVATVGTGGPPFVALRADMDALPLQESVEWEHKSKVPGKMHGCGHDAHVAMLLGSAKILQEHRDELKGTVVLVFQPAEEGGGGAQKMIEAGAVENIEAIFGLHVADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKDSFNQLKQRIEEVIVSQASVQRCSATVDFQTKDRPFFPPTSNSPKLHDFFVNVASEMVGSKNVRDRQPLMGAEDFAFYADAIPSTYYYFVGMYNETRGLQAPHHSPYFTINEDALPYGAAAHAALAARYLLEHQEPAATPDKAKSHDEL

SEQ ID NO: 5917 - DNA, 1301 bp, Panicum virgatum
  misc_feature: Ceres CLONE 1828369
  misc_feature: Encodes the peptide sequence at SEQ ID NO. 5918
ggcggccagacaccgacacccggaacggccctccatggctctcgctcccacgccgccgcagcagcggccgacgatgcgccactcctcggcgttcctcctcccgccgccgtccgcgtcgccggccaccgacgccgccaccgtcgcgctcgtcgtcctcaaccagccgctgccccgcttcgcgcccctcctctggtcccgcgcggcgctgcgggtgtgcgcggacggcggcgccaaccgcgtcttcgacggcatgccggagctgctcccaggccaggacgccggcgaggtccgcgcgaggtacaagccagatgtaatcaaaggggatatggactcagtaagaccacaagtgaaggaatattatgccaacttgggtaccaaaatagttgatgagtcacatgatcaggacaccactgatttacacaagtgtatctcttttatagctaagaattcaactgttgcagacaaatctaatctctgcatccttgtccttggtgcgttaggaggaaggtttgatcatgagatgggaaatatcaatgtacttcatatattcccaaacatcaatatcatcctcctatcgaatgattgtctgatctttctcctcccaagaacacacaaccacgagatccacgttgagcagtcgatcgaaggcccccactgtgggttgatcccgattgggatgccgtcaactagcaccacgaccactggactccggtggaatttagacaataccagcatgagctatggaggattgatcagcacgtcaaacatcgtggaagatgacaaggtgacggtcacctcggagtctgaccttatctggacaatatcgctccagaactgaatctgcagagtaccattatctgtaccaatgcaaggttcctattttgtctcgcgtattctgcaccacggagatgtacctgattaccaccagaagaaaggacaatatattccgttgcccttgatgttgcaaacctgatagaaagctattatatgtaatttggtggttctgattaagagatatatggctatgtgctcgcaaaaagttcaactatgtgtaatgggctattgaagtatcaattgttgtgccaagaaccagtttcccaaattctcttccaagcaaacctctcttcttcacagaagcgacttaacaactgctgcgctagactgccagagatagattttcagatcaacactatatgttatgatgatctggtctgatctgaaaatcaataattacatttttgcgctgggaaatttctcaaataatattttaattactcttagaaaaaaaaaaaaaaaaaaaa

SEQ ID NO: 5918 - protein, 267 aa, Panicum virgatum
  misc_feature: Ceres CLONE 1828369
  misc_feature (1)..(141): Pfam Name: TPK_catalytic Pfam Description: Thiamin pyrophosphokinase, catalytic domain
MALAPTPPQQRPTMRHSSAFLLPPPSASPATDAATVALVVLNQPLPRFAPLLWSRAALRVCADGGANRVFDGMPELLPGQDAGEVRARYKPDVIKGDMDSVRPQVKEYYANLGTKIVDESHDQDTTDLHKCISFIAKNSTVADKSNLCILVLGALGGRFDHEMGNINVLHIFPNINIILLSNDCLIFLLPRTHNHEIHVEQSIEGPHCGLIPIGMPSTSTTTTGLRWNLDNTSMSYGGLISTSNIVEDDKVTVTSESDLIWTISLQN

SEQ ID NO: 5919 - DNA, 1357 bp, Panicum virgatum
  misc_feature: Ceres CLONE 1828374
  misc_feature: Encodes the peptide sequence at SEQ ID NO. 5920
ttcctctgctacgctggccgcggaggggggcttttggtgaggcgatttctagatttcgcagcaatttcgttgattcgcacagattgaacttctttctgaggtctatgcaggtggagaagaccatgtcattcctggcacagttctgagcattgaagtggtgcttatattgactttaaggaagggttgtattctagggaagcagaggaagattgcaaagtactacaagaagcaagagaatctactgaaggatttcagcgagatggagaccatgaatgaacttggtggcttagatcagaatggtccttccgaggaagagctaaggcaactggcaaagagcgaaagatttgctattaacctgtcgaatataatcaatctcatcctttttgttacgaaagtcgttgcttctgccgaaagtttatccatggcagtaatagcatcgacgctggactctctactggaccttctgtcaggtttcattctttggtttacagcgcatgctatgaaaaagccaaacaagtacaactacccaattgggaagaggcgcatgcagccagtgggcataatagtcttcgcatcagtgatgggcacacttggcttccaagtgctgatcgaatcagggcgccagctcatcacgcaggagcatgcgaatttcaagcgcaagcaggagctctggatggtgggcagcatgtcctcggttgcggtcgtgaagttcttcctcatgctctactgtcggaccttcaagaacgagatcgtgagggcttacgcccaggaccacttcttcgacgtgatcaccaactcggtcggcctggtcgcggcgttgctcgccgtcaggtacaaatggtggatggatcccgttggtgccatattgatcgcgctgtacacgatcacgacgtgggcgcggacggtgctggagaacgtgggcacgctgatcggcaagtcggcgccggcggagtacctgacgaagctgacgtacctcatctggaaccaccacgaggagatccggcacatcgacacggtgcgtgcctacaccttcggcacccactacttcgtggaggtggacatcgtgctcccgggggccatgccgctcagccaggcacacgacatcggcgagtcgctgcaggagaagctggagcagctgccagaggtcgagcgcgcccttgtccacgtggacttcgagttcacgcaccggcccgagcacaaggccgaggtctgaccagttgtagagctacttccctcggagcccagaccagttgtagagctgccgcagatctgatgacataagtacttgtaagacgaagtgcaacatcatttcttaagccctcaactcttaaaaggacaaaaaaaaaaaaaaaaaaaa

SEQ ID NO: 5920 - protein, 317 aa, Panicum virgatum
  misc_feature: Ceres CLONE 1828374
  misc_feature (1)..(280): Pfam Name: Cation_efflux Pfam Description: Cation efflux family
METMNELGGLDQNGPSEEELRQLAKSERFAINLSNIINLILFVTKVVASAESLSMAVIASTLDSLLDLLSGFILWFTAHAMKKPNKYNYPIGKRRMQPVGIIVFASVMGTLGFQVLIESGRQLITQEHANFKRKQELWMVGSMSSVAVVKFFLMLYCRTFKNEIVRAYAQDHFFDVITNSVGLVAALLAVRYKWWMDPVGAILIALYTITTWARTVLENVGTLIGKSAPAEYLTKLTYLIWNHHEEIRHIDTVRAYTFGTHYFVEVDIVLPGAMPLSQAHDIGESLQEKLEQLPEVERALVHVDFEFTHRPEHKAEV

SEQ ID NO: 5921 - DNA, 1022 bp, Panicum virgatum
  misc_feature: Ceres CLONE 1828377
  misc_feature: Encodes the peptide sequence at SEQ ID NO. 5922
ctagatagctcgcccgctctcgccggctcaccgcgcgctctctctctctctctgactctcccggcgctagctccagcccgttctctctctagctagtgttcctttccttcctctttgctgggcgcgcttctttgcttccgaggcggttcggatgctgtcccacgtcgagatggcccccgtggccggcgggttcaagctcttcggcaaggtcatcacgcagtgcgccgagagcgccccgccggtgccggtgcagccgccggcgaggggcgcgcgggagagggacgacccggacgagcgggaccagcccatggtcaagcgggaggcggcggcggatcacgactccgccgagaagcagcagcactccggcgccggcggggagagcaaagggctgcagccgcgcccgcggcagcagcagcagccgcagcaccaggacaccgcggaggcgcgcgcggcctcgtcggcgccgccgctgccgtgcccgcgctgccggagccggaacaccaagttctgctacttcaacaactacaacgtcaaccagccgcgccacttctgcaaggactgccaccgctactggaccgccggcggcgcgctccgcaacgtccccgtcggcgccggccgccgcaagaaccggcccctcggccccgtcgccggcgccggcgccgtgcccgcccacctgcaccaccagcaccgcgtcgccgccgcgggcttcgtcctcggcttccccggcggccagcacccttcctccccgacctccccgtcgccggtctacgccgaccggtggccggtctgccccgaccgccggttctgacgtgacgacgatccgccatccgatcagcctcgcgggcccccggctgggtttgacctgcgtaacttgctgctgaggtgggggaggctgcgcctctgcttgccttgcctccttgttgtacgtgcgcccttgcacaatcaccaaaagggtatggatggaatggatggatggatgggaggaggaggacatggaaaaatggcctttttgtttcttctcc

SEQ ID NO: 5922 - protein, 218 aa, Panicum virgatum
  misc_feature: Ceres CLONE 1828377
  misc_feature (1)..(63): Pfam Name: zf-Dof Pfam Description: Dof domain, zinc finger
  misc_feature: The sequence is a functional homolog of  SEQ ID NO 1122 in the  10/374,780 US patent application
  misc_feature: The sequence is a functional homolog of  SEQ ID NO 1145 in the  10/666,642 US patent application
  misc_feature: The sequence is a functional homolog of  SEQ ID NO 1322 in the  10/412,699 US patent application
  misc_feature: Useful for making plants with modulated growth and phenotype characteristics
MLSHVEMAPVAGGFKLFGKVITQCAESAPPVPVQPPARGARERDDPDERDQPMVKREAAADHDSAEKQQHSGAGGESKGLQPRPRQQQQPQHQDTAEARAASSAPPLPCPRCRSRNTKFCYFNNYNVNQPRHFCKDCHRYWTAGGALRNVPVGAGRRKNRPLGPVAGAGAVPAHLHHQHRVAAAGFVLGFPGGQHPSSPTSPSPVYADRWPVCPDRRF

SEQ ID NO: 5923 - DNA, 1364 bp, Panicum virgatum
  misc_feature: Ceres CLONE 1828447
  misc_feature: Encodes the peptide sequence at SEQ ID NO. 5924
agtcacgctgctttccccactccccactgcgccccccactagccacaccacccgacctctccgcgttccgccaccgccggcgcggcatcccgccatggccccgcctcccgccggccgccccctggcgctcttcctcctcatccttctcccgctgctagccgcggccgatcccgtcctcgaggacggctacgcggtcaccaccttctccgacctcaacccgctcccggcctcggggccccacccctacgcggtcctcccgcggccccgcgcgggggacctcctcctcctcgactccgccggcgccgcgctctacacgctcgccctccccgcccccggcgagccgcgcgggctcgccgccgccttcgaccgcccgcgcagcgtcgccgtcgacgccgccgacaacgtctacgtcgcggaccgcgcccgcgtcgccagccacctccacggcgtcgtccgcaaggtcgcacccgacggtcatactactacgattgccggaggactgtcatcagggtctggtcgcagggatggaccggcacagaatgctaccttctcaacagattttgagctcgtttatgtccccaaaatatgtgcattgttagttgctgacagagggaaccgattgattagacaaatcaatctgaagccagaagactgtgcacatgacactcattcaggcttgggtacagcatcggtgtcggtcattgccatattatgtgcactacttggttcagtaatcgggtttttagttcgccatttttaccacatcaatgaaatctccatcaaccgctttttcagcaggatgcagaagcaataccagagaacccagaggaaggcaactctgatcagcttctgcgacataaaaagcgcagttgctagctccatggcctacaccctactgcttaaactggtcaaagttagtcgtggctatcttgccgtggcgttccctagtgttaggttacagcaagaagatccccgtaagctttatcgccatcatgagctacgccgtactagcacttcccctaacattggtatttgcaacaaagctcctcttgctcctactgagcaacagggggatctgataagctttgctggagatgatgatgataaggaggatagtagtaatgccaatagtcagggggctaagaagccatcctttgactactacttgatggggcttgtctacaccccacaggttagcactaataagatagatcacatgatcgaggccaacctgtcaggcttttcagatcatgaggaacgttgtagcttaactgttagtagttacagtgtaagcaggagggtggtgcatggagataaataaggttctctgagcctaagattgccaaaaaaaaaaaaaaaaaaaa

SEQ ID NO: 5924 - protein, 408 aa, Panicum virgatum
  misc_feature: Ceres CLONE 1828447
  misc_feature: Great-hit functional homolog of the protein sequence given in SEQ ID NO 9392
  misc_feature: Useful for making plants with altered alkaloid content
MAPPPAGRPLALFLLILLPLLAAADPVLEDGYAVTTFSDLNPLPASGPHPYAVLPRPRAGDLLLLDSAGAALYTLALPAPGEPRGLAAAFDRPRSVAVDAADNVYVADRARVASHLHGVVRKVAPDGHTTTIAGGLSSGSGRRDGPAQNATFSTDFELVYVPKICALLVADRGNRLIRQINLKPEDCAHDTHSGLGTASVSVIAILCALLGSVIGFLVRHFYHINEISINRFFSRMQKQYQRTQRKATLISFCDIKSAVASSMAYTLLLKLVKVSRGYLAVAFPSVRLQQEDPRKLYRHHELRRTSTSPNIGICNKAPLAPTEQQGDLISFAGDDDDKEDSSNANSQGAKKPSFDYYLMGLVYTPQVSTNKIDHMIEANLSGFSDHEERCSLTVSSYSVSRRVVHGDK

SEQ ID NO: 5925 - DNA, 2018 bp, Panicum virgatum
  misc_feature: Ceres CLONE 1828481
  misc_feature: Encodes the peptide sequence at SEQ ID NO. 5926
gtgctagctgcagccacagctaatcgatcgcctccggcgggcatccccggcatcggcgatcggagagttgaagacggccggggataatggaggcgccgccgggtcttgcgctgctcctgttcttcggcacgttgctggtgctgccgcagtcgtcgcacggcgcgaccagatactacaccttcaatgtgacgatgcagaacgtgacgcggctgtgcaccacccgcgccatcccaacggtgaacggcaagttccccggccccaagatcgtcaccagggagggcgatcgcgtcgtcgtcaaggtggttaacaatgtcaaggacaacgtgaccatccactggcacggcgttcggcagctgcggacggggtggtcggacgggccggcgtacgtgacgcagtgcccgatccggacggggcagagctacgtgtacaacttcaccatcacggggcagcggggcaccctcttgtggcacgcgcacgtctcctggatgcgcgccacgctctacgggcccatcgtcatcctccccaagcgcggcgtgccctaccccttcccggttaagccctacaaggaagtacccatcatcttcggagagtggtttaaaacggatcccgaggcaattatcgcacaggccctgaagacgggagcaggcccaaacgtttcagatgccttcaccatcaacgggcttccaggcccgttgtacaactgctcaagcaaagacacgttcaagctgaaggtgcagcccggcaagtggtacctgctccggctcatcaacgccgcgctcaacgaagatctcttcttctccatcgccaaccacacgctcaccgtcgtcgacgtcgacgccgcctacgtcaagcccttccacgcggacgtcgtcctcatcacgccgggtcagaccaccaacgtgctcctccgcgccgagccggacgcgggctgccccgcggccacgcacctcatgctggcgcgcccctacagcaccggccagccgggcaccttcgacaacaccaccgtcgccgccgtgctcgagtacgcgccgccgggccacatcaagagcctcccgctcctccgccccccgctccccacgctcaacgacacggcgttcgcggcgaactacagcgccaagctccggagcctggccaccccggagtacccggccaacgtgccccggggcgtggaccgctccttcttcttcaccgtggggctcggcacgaacccgtgcccggcgaaccggacgtgccagggccccaacgggagcatgttcacggcctccatgaacaacgtgtccttcggcatgcccaccaccgcgctcctgcaggcgcactacagcaacatcgccggcgtgtacgccaccgacttccccgccgcgccgctggaggcgttcaactacacgggcacgccgcccaacaacacacacgtctccaacgggaccaaggtggtggagctgcagtacaacacgagcgtggaggtggtgctgcagggcacgagcatcctcggcgccgagagccacccgctgcacctgcacggcttcgacttcttcgtggtcgggcaaggcttcgggaactacgactcgtccaaggacccggccaagttcaacctcgtcgacccggtgcagcggaacaccgttggcgtgccggccgctggctgggtggccatcaggttctttgctgacaatcccggtgtgtggttcatgcattgccatctggaggtgcacacgagctgggggttgaagatggcatgggtggtcaacgacggcccgttgcctgagcagaagttgatgcctccgccagctgatcttcccaagtgttgaagatcgatcgggcatagacattgactaagattgtgattgtttctttcttatgattcgcatacacttatcagtgcagatacaatgtctcgtacatagcgtacacaataggtcaaggagacctgtaattttcctatacattcttctaaagattaaaaggggttgtggtttgtgacgggaagtcatttacgtcctttttaaaaaaaaaaaaaaaaaaaa

SEQ ID NO: 5926 - protein, 571 aa, Panicum virgatum
  misc_feature: Ceres CLONE 1828481
  misc_feature (1)..(135): Pfam Name: Cu-oxidase_2 Pfam Description: Multicopper oxidase
  misc_feature (1)..(154): Pfam Name: Cu-oxidase Pfam Description: Multicopper oxidase
  misc_feature (1)..(117): Pfam Name: Cu-oxidase_3 Pfam Description: Multicopper oxidase
  misc_feature (7)..(571): SWISSPROT Homolog: EC 1.10.3.2 Laccase-2 precursor
  misc_feature (9)..(571): SWISSPROT Homolog: EC 1.10.3.2 Laccase-17 precursor
MEAPPGLALLLFFGTLLVLPQSSHGATRYYTFNVTMQNVTRLCTTRAIPTVNGKFPGPKIVTREGDRVVVKVVNNVKDNVTIHWHGVRQLRTGWSDGPAYVTQCPIRTGQSYVYNFTITGQRGTLLWHAHVSWMRATLYGPIVILPKRGVPYPFPVKPYKEVPIIFGEWFKTDPEAIIAQALKTGAGPNVSDAFTINGLPGPLYNCSSKDTFKLKVQPGKWYLLRLINAALNEDLFFSIANHTLTVVDVDAAYVKPFHADVVLITPGQTTNVLLRAEPDAGCPAATHLMLARPYSTGQPGTFDNTTVAAVLEYAPPGHIKSLPLLRPPLPTLNDTAFAANYSAKLRSLATPEYPANVPRGVDRSFFFTVGLGTNPCPANRTCQGPNGSMFTASMNNVSFGMPTTALLQAHYSNIAGVYATDFPAAPLEAFNYTGTPPNNTHVSNGTKVVELQYNTSVEVVLQGTSILGAESHPLHLHGFDFFVVGQGFGNYDSSKDPAKFNLVDPVQRNTVGVPAAGWVAIRFFADNPGVWFMHCHLEVHTSWGLKMAWVVNDGPLPEQKLMPPPADLPKC

SEQ ID NO: 5927 - DNA, 1023 bp, Panicum virgatum
  misc_feature: Ceres CLONE 1828548
  misc_feature: Encodes the peptide sequence at SEQ ID NO. 5928
ggagctgactccactgctactactgctacaagtctactagaagtaggtagcttgttagagccagattggcaaagcttcggccgggcagcgacagcgagctgagaactcgcgctccgcgtcggtcggcgcgatcggccgggcgcgttcggcctcgaggagatggagcgggagtgccagctcgtggtggcgccgccgcggccgcgccatggccagtacgaggagggcccgttcgcgcaccaggtgatggtggccggggacatcgaccccgccggcgcggggagaggcggtggcggcggggagaggaagcggcggttcacggaggagcaggtgcggtcgctggagacgacgttccacgcgcggcgcgccaagctggagccccgggagaaggcggagctggcgcgggagctgggcctgcagccgcgccaggtggccatctggttccagaacaagcgcgcgcggtggcgctccaagcagctcgagcacgactacgccgcgctccgcgcgcagtacgacgcgctccacgcccgcgtcgagtcgctcaggcaggagaagctcgcgctcgccgcccaggtggacgagctgaaggggaggttgagcgggcggcaagaccaggcgagtggcagcagctgcgaggtaaacggcggcgcggaggcggccgacgacaggaggaacagcgccagctgcgtggcggaggacgacggcgccgtgacgcccgcggtggccgcctcggaggaatcggcggcggcggcggccgagtactgctacgaccacgccgcgtacggagggggcctgcccgagccgttctgcaccaccccggagctgtgggacacatggccgctgctggagtggaacgcggttgcatgagcaaagcaaccccccaccaccaccatcacgacgggggagaatgaatatagcatccgtgtactctactcgtgtctctgtagtctgtatgatagcgtacgcgtggattcatgttgctctctagctagctatagcttgcactaaaaaaaaaaaaaaaaaaaa

SEQ ID NO: 5928 - protein, 234 aa, Panicum virgatum
  misc_feature: Ceres CLONE 1828548
  misc_feature (1)..(56): Pfam Name: Homeobox Pfam Description: Homeobox domain
MERECQLVVAPPRPRHGQYEEGPFAHQVMVAGDIDPAGAGRGGGGGERKRRFTEEQVRSLETTFHARRAKLEPREKAELARELGLQPRQVAIWFQNKRARWRSKQLEHDYAALRAQYDALHARVESLRQEKLALAAQVDELKGRLSGRQDQASGSSCEVNGGAEAADDRRNSASCVAEDDGAVTPAVAASEESAAAAAEYCYDHAAYGGGLPEPFCTTPELWDTWPLLEWNAVA

SEQ ID NO: 5929 - DNA, 1698 bp, Panicum virgatum
  misc_feature: Ceres CLONE 1828585
  misc_feature: Encodes the peptide sequence at SEQ ID NO. 5930
atacctgaacctgaagtttctgaacctttccctgcaacctcatgccctcccattaatccttcaaggctccctcccactccatctgaaagagccaccaaccctgtgctgacttgtcccagtgacgtgaacccatcgcctgcgatcggccaagatcggcggcgagcagggcgccgggtcattgactcgtcgtctccgagttcgcagccttggaaaagagcaggatgcaagaggggcacggcgagaccgtcaactacagggtgttcgccggcacgtggaacgtcggcggcgaggcgccgccggatgatcttgacctggaggattggctggacaccaaggccggctcccacgacatctacgttctcgggtagtccgctattgatcctgctgatccatccatcatgatctatcaccagcagtgtcgtcgtcaagttgctgcagtgaagattgatttgcacgtacggtgcaggttccaggagatggtgccgctgaatgcgaggagcgtgctcggccccaagcagagatcggcggccatgaagtggcagcggctgatcggggacgcactgaacggcgggaggaggagcgtgatggatggagaagacgcggcgatggatcacggacagggcgcgttcaggtgcgtcgtgagcaagcagatggtcggcatcttcgtcgccgtgtggacgaggagcggcctccgccggcacgtccgccaccccggcgtctccgccgtcggcgccggcatcctcggccggctcggcaacaagggcgcggtgtcggtccggttcttgctgcacggcacgagcttctgcttcgtctgctgccacctggcctccggcggcggcggcggcggcgacgcgctacgccggaacgccgacgcggcgtacatcctcgcgaggacgagcttcctcaactccggctgcgcgccggcgccggcaccggaggagctgcccaggaagattcttgaccatgatcgggtggtgttgctcggcgacctcaactaccggatcgccatggacgacgccgaggcgcggcagctggtgagggccaggaaatggagcatgctgctggagaacgacgagctgctgctcgagctcgccgagggccggcggttcgacggctggcgtgagggcctcgtcaccttcgccccgacctacaagtaccaccgcaactccgaccagttctgctggtgcgccgatggcggcgccgccgccggccgcggcaagcagcaccgcgcgccggcatggtgcgaccggatcctttggcgagggaaggggatgaggcagatccggtacgagtggtgcggtggctacaggctctccgatcaccggccggtgagggccgtgttccacgctgtgtgtgaggtggtggaaaccaaagcatgttaactaagctgaaggcttctgtcctctgaaacagttaacaaacgagatgctgtaaattttacagaaattcaacaacagcttggtttcctgcatccgttttcaaaaatagggcctcgatgatttacctgaggatgaaaggctcttgttttcgcctttgtatctgcaggtgaaaattcatgtaaatttcctgttcttttcccctgctgaagaaatggaatccggggatcattgtccagtcgattcatgtaccattaggatgcaacctttttatggattgaatcgatgatattttttcttacaaaaaaaaaaaaaaaaaaaa

SEQ ID NO: 5930 - protein, 327 aa, Panicum virgatum
  misc_feature: Ceres CLONE 1828585
  misc_feature (31)..(336): Pfam Name: Exo_endo_phos Pfam Description: Endonuclease/Exonuclease/phosphatase family
MIYHQQCRRQVAAVKIDLHVRCRFQEMVPLNARSVLGPKQRSAAMKWQRLIGDALNGGRRSVMDGEDAAMDHGQGAFRCVVSKQMVGIFVAVWTRSGLRRHVRHPGVSAVGAGILGRLGNKGAVSVRFLLHGTSFCFVCCHLASGGGGGGDALRRNADAAYILARTSFLNSGCAPAPAPEELPRKILDHDRVVLLGDLNYRIAMDDAEARQLVRARKWSMLLENDELLLELAEGRRFDGWREGLVTFAPTYKYHRNSDQFCWCADGGAAAGRGKQHRAPAWCDRILWRGKGMRQIRYEWCGGYRLSDHRPVRAVFHAVCEVVETKAC

SEQ ID NO: 5931 - DNA, 1177 bp, Panicum virgatum
  misc_feature: Ceres CLONE 1828604
  misc_feature: Encodes the peptide sequence at SEQ ID NO. 5932
gggggggcgtcgctgccagtggaaagtggcagtggcagcagagaagtaagaacaagcaagaaaggggagagaaaaagccgagggactttttccttgtattggatccttcgcttttggggaggaagaaggagtagaaggcccggtcgctccactttctgttgttgaggagagcagcaggagggacagaggaggaggagatgttcccgcctggtctgatccaccaccgcccagacggccccgcgcccggcgatggggcaccgcgctccggcgccggcggcggcccgggcgggccgagcctggtgttgacggcagaccccaagccgagactgcgttggacggccgacctgcacgagcgctttgtcgacgccgtcgctcagctcggcgggcctgagaaagcgacaccgaaaactatcttgagaacaatgggtgtcaaggggcttacgctattccacctaaagagtcatcttcagaaatacagattaggcaaacaatctggtaaagagggtccagagcaatctaaagatggatcctatcttctagatgctcaaactggaatgagtgtatcccctagagttcctgcccaggatgtgaaagaaagtcaagaagtcaaagaagcgctgagagcacagatggaagtgcaacggagactgcatgagcaagtggaggtccagaagcgtgtgcagatcagaatggaagcacttcagaagtacatcgatagtattctagagagtgcatgtaagatggttaccgagcagtttgcctcaagcggtttcagcatctccgaccccgatctcccggagatatcccctggtggggttctgtgtggttccacggagacattgagctcctctgtctttaatcagctctctgtcagctcgattgactcgcacagtccaggaggcaagccttccccctcgggcattgaaggctcactaatgctcctccagaagtcacctgagctcaaacggaggtcctcttgagctgtttagacaaattctcagggtatttctggcttccttgtctttggtagtaatgtggacaagaacatcgaacatcgtagtgacatgagaaattatggtccaatgttgtagtagctgacttgttctcttgctattgactgccaggtagcagggtctgaacttctatttgatcaatcaaaagaaacctatgttcatag

SEQ ID NO: 5932 - protein, 260 aa, Panicum virgatum
  misc_feature: Ceres CLONE 1828604
  misc_feature (1)..(52): Pfam Name: Myb_DNA-binding Pfam Description: Myb-like DNA-binding domain
  misc_feature: The sequence is a functional homolog of  SEQ ID NO 1062 in the  10/225,066 US patent application
  misc_feature: The sequence is a functional homolog of  SEQ ID NO 2788 in the  10/374,780 US patent application
  misc_feature: Useful for making plants with modulated growth and phenotype characteristics
MFPPGLIHHRPDGPAPGDGAPRSGAGGGPGGPSLVLTADPKPRLRWTADLHERFVDAVAQLGGPEKATPKTILRTMGVKGLTLFHLKSHLQKYRLGKQSGKEGPEQSKDGSYLLDAQTGMSVSPRVPAQDVKESQEVKEALRAQMEVQRRLHEQVEVQKRVQIRMEALQKYIDSILESACKMVTEQFASSGFSISDPDLPEISPGGVLCGSTETLSSSVFNQLSVSSIDSHSPGGKPSPSGIEGSLMLLQKSPELKRRSS

SEQ ID NO: 5933 - DNA, 1409 bp, Panicum virgatum
  misc_feature: Ceres CLONE 1828649
  misc_feature: Encodes the peptide sequence at SEQ ID NO. 5934
acccgcagcccgggagaccttggaaggaaacgattcatcagctgccgcccagctaacgggggctgaggctgaggcagagacgagcacggaggacaagaagaccaagtgattaccacacccaccatcacccagaagatagcacacctctcagcagcaccggccttgtttcttccagcgggcgcgaacatttctttgctgaactggacgctggactagccttgctgagacgctgaccataagatgtgtaacagggtgaacagtcacacactataaccgttaccgatttcagtttgttcttagcaaccgttactaggcgatatgcttgtttgattggtttttgtataaaagaagcaatcatccatcagcaatggcggtcgcgagccgccggaggctaggcaccatgctggccctcgcggcggccctcctctccctcctcgccggcccggccgcggcgacggggaagacggggcaggtgaccgtgttctggggccggaacaaggcggagggctccctccgcgaggcctgcgacaccggcacctacaccttcgtcatcatttccttcctcaacgttttcggccacggcaagaccagcctggacctctccggccaccccatcggccccgtcggcgccgacatcaagcactgccagtccaagagcatcctcgtcttcctctcgatcggcggccccggcggccagtactcgctccccagcgcccaggccgcgacggacctcgccgaccacctctggttcgcgtacctcgccggccgccgcgccggcgtgcgccgcccgttcggcgacgcggagctcgacggcatcgacctcttcatcgaccagggcgcccccgaccactacgacgtgctggcggcgcggctgtggagctacaacaaggagttccgcggccggacgccggcgcagctgtcggcgacgccgcggtgccggtacccggacccccggctggagcgggcgctcgccacgggggtcgtcacccgcatcaacgtcaggttctacggcgacgggtactgcgccgcctactggcaggcggagtgggacaagtggacggcggcgtaccccaactccgggatctacgtcggcctgccggcgtcggagcaggtcgtcggctacgtgcaccccaagaacctctactacggcgtcgtcccggtggtgcagaaggcggccaactacggcggcatcatggtctgggagcgctacgccgacaagcagaccaactacagcagctacgccatccaatgggcttagatctatcgggctcccctccatcatcatgatctgtgtatccgttgcttgtcattgtctctcctcactagcgtgcttgtgcaagaataaagtggggccagtggaagaataaacggttaattataatcggtttgaaaaaaaaaaaaaaaaaaaa

SEQ ID NO: 5934 - protein, 296 aa, Panicum virgatum
  misc_feature: Ceres CLONE 1828649
  misc_feature (1)..(258): Pfam Name: Glyco_hydro_18 Pfam Description: Glycosyl hydrolases family 18
MAVASRRRLGTMLALAAALLSLLAGPAAATGKTGQVTVFWGRNKAEGSLREACDTGTYTFVIISFLNVFGHGKTSLDLSGHPIGPVGADIKHCQSKSILVFLSIGGPGGQYSLPSAQAATDLADHLWFAYLAGRRAGVRRPFGDAELDGIDLFIDQGAPDHYDVLAARLWSYNKEFRGRTPAQLSATPRCRYPDPRLERALATGVVTRINVRFYGDGYCAAYWQAEWDKWTAAYPNSGIYVGLPASEQVVGYVHPKNLYYGVVPVVQKAANYGGIMVWERYADKQTNYSSYAIQWA

SEQ ID NO: 5935 - DNA, 1226 bp, Panicum virgatum
  misc_feature: Ceres CLONE 1828819
  misc_feature: Encodes the peptide sequence at SEQ ID NO. 5936
atacggcgacgcaggcaccggtaggtactgcaggtaggggcaggtagcagccatggaagctggtgctgcgggtctgctgcttgctgcgctgatggtggtggtcggctggccggcggcggcggcgtcgctggacacgtcgccggtgccgttccaagccgggtacatgccgctgttcggcggcgacaaccttgtccggtcgcccggcggccgctccgtccgcctgaaactcgatcgccgcaccggctccgggttcgtatccaagtcggcgtaccaccatggatacttcagcgcctccatcaagctgcccgacgaccacaccgccggcgtcgtcgtcgccttctacctgtcgaacgccgacgtgtacccccgcaaccacgacgaggtggacttcgagctgctgggcaaccggcggggccacgagtggcgcgtccagaccaacgtctacggcaacggcagcacctcccgcggccgcgaggagcgctacctcctccccttcgaccccaccctccgcccgcacgcctacgccgtcgcctggacccccaccgccgtcgtcttctacgtcgacggggcgcccatccgcgaggtggtccgcgcgccggccatgggcggtgacttcccctccaagcccatgtccgtctacgccaccatctgggacggctccgcctgggccaccgagggtggacgctacaaggtcgactacgcccacgcgcccttcgccgccgacttctcgcggctcgtcctcgccggctgtccccccgccggcggcggcgcgaggtgcgcggtggcggtgataacggcggagttcgcggtgatgacccccgccaaacgcgccgccatgcgccggttccggcggcggcacctcctctacaccgtgtgccacgaccggtaccggtacaacggcaccgtcttccccgagtgcgacgacgccgagcgcgacgactttcacaagtggggcgagtccaagcgcgtgtcgccgggccgccgcgggtacaggcggcagcagcagccgcgcgcggacaaggccgccgccggcggccggcccagcacgtggccgacgatcggaaccctacgtgcagactagctagtaattttaagtgacggtcgatgtgtgtggtgcgtgccattaggagattgctgatgaattagttatatagcactgtatgtgtgcaggtgtttcttactctgcattttcaaggtgcagaaacatacagtcggtacatactgtc

SEQ ID NO: 5936 - protein, 342 aa, Panicum virgatum
  misc_feature: Ceres CLONE 1828819
  misc_feature (1)..(184): Pfam Name: Glyco_hydro_16 Pfam Description: Glycosyl hydrolases family 16
MEAGAAGLLLAALMVVVGWPAAAASLDTSPVPFQAGYMPLFGGDNLVRSPGGRSVRLKLDRRTGSGFVSKSAYHHGYFSASIKLPDDHTAGVVVAFYLSNADVYPRNHDEVDFELLGNRRGHEWRVQTNVYGNGSTSRGREERYLLPFDPTLRPHAYAVAWTPTAVVFYVDGAPIREVVRAPAMGGDFPSKPMSVYATIWDGSAWATEGGRYKVDYAHAPFAADFSRLVLAGCPPAGGGARCAVAVITAEFAVMTPAKRAAMRRFRRRHLLYTVCHDRYRYNGTVFPECDDAERDDFHKWGESKRVSPGRRGYRRQQQPRADKAAAGGRPSTWPTIGTLRAD

SEQ ID NO: 5937 - DNA, 1288 bp, Panicum virgatum
  misc_feature: Ceres CLONE 1828823
  misc_feature: Encodes the peptide sequence at SEQ ID NO. 5938
accactcccggtctcgcatcccctccgcctcatctgtctctggccgccccgtcgccgaccttccgctctgggtccccgactcgcaggtcagctttggtaattggctgcccccctcattatcacaatggcagggtcacttattgcttgctctcctgaagtggatccgaagatagagaagcctgatgagatggttaatgctggtgttcttgcaagtcttcagaaattcctacgcaagtgcctcatagctgtcatctcatatggcccaatgcccaagcacatagcctttattatggacggtaaccgcagatatgctacattcagaagcatccagcaaggagctggtcacagggtgggtttctctgctcttattgcaaatctgctgtactgctatgaaatgggtgtgaggtacatcacggtgtatgcatttagcattgacaattttaaaagggacccaagtgaggtgcagtccttgatgcagttaatggaggaaaaaatcaatgagttattagacagccggagtgtgatcaacaggattaactgcaagatcaacttctggggaaatttggacctgttagctgagccagtgaggttagcagctcagaagctgatggcaagcacggctgcaaacacaggtttagttctctctgtctgcatgccatataactcgacttctgagattgtcaatgctgctaatgaggtctgcgcagaaaggagggagatgctgcagagagaacatgccagcgactctaatggtcaggctgcaaataacagtgtgcattcagagatttcagtggccgatttggatcgccatatgtatagcgctggttgcccggatcctgacattgtgattcggacttcaggtgagactcggctgagcaatttcctcctgtggcagacgacgttcagtcatctgcagaacccagaccccctctggcctgaattctcgttcaggcatcttgtttgggctatattaaagtaccaaagagcctacccttatctggcgcagaacaaaaatgtggcaaagaagcaactctgatttggtgttgtttgcagggggatacctcatacttagggtgattatagctatatcacatctagcatatgccaaaatgaaaatagcttacggagatgtttcaggtcataatgtacctgccattctactgattgtgtaactgatttgagcttgtacacatatttgtgattcctggatttgtactgtatgaataccctttttttttagcagctgtatgaatacctttactaaaaacaaaaaaaaaaaaaaaaaaaa

SEQ ID NO: 5938 - protein, 303 aa, Panicum virgatum
  misc_feature: Ceres CLONE 1828823
  misc_feature (1)..(236): Pfam Name: Prenyltransf Pfam Description: Putative undecaprenyl diphosphate synthase
MAGSLIACSPEVDPKIEKPDEMVNAGVLASLQKFLRKCLIAVISYGPMPKHIAFIMDGNRRYATFRSIQQGAGHRVGFSALIANLLYCYEMGVRYITVYAFSIDNFKRDPSEVQSLMQLMEEKINELLDSRSVINRINCKINFWGNLDLLAEPVRLAAQKLMASTAANTGLVLSVCMPYNSTSEIVNAANEVCAERREMLQREHASDSNGQAANNSVHSEISVADLDRHMYSAGCPDPDIVIRTSGETRLSNFLLWQTTFSHLQNPDPLWPEFSFRHLVWAILKYQRAYPYLAQNKNVAKKQL

SEQ ID NO: 5939 - DNA, 1224 bp, Panicum virgatum
  misc_feature: Ceres CLONE 1828859
  misc_feature: Encodes the peptide sequence at SEQ ID NO. 5940
acgcgcacacacacaagctctcatcgcgcagcacagcttcgactcgttaatctcgagctagctagagatagtagttttcgtcaccaactcgtcttcttggatcggaggagggctggccggcgagagattaatttacggtcgaggaggatcggaggaggagatggaggtcgccgccgccgccgccgccgcagcgagctacgtggccgacgacgttgaccgctgcctcaaggcgaccgagctgaggctcggcctgccgggcaccgagctagagacggcgccggccgccgcggcgctgccgacgccgccgtccacgccccggggcaagaagcgcgacgggaacaccgccggcgccgaggaggcagccaagaccgcgccgccggccgccaaggctcaggtggtggggtggccgccggtgaggtcctacaggaagagctgcttccagcagtccagcagcagcgccgccaagagcaagccggcggcgccgccggaggagaaggccccggccccggcccctgtcgccgccggtggcaacgccaacgcggcgatgttcgtcaaggtgagcatggacggggccccctacctgaggaaggtcgacctcaagatgtacaagggctaccgcgagctcagggaggccctggaggccatgttcctctgcttctccggcggcgctgacgcgccggcggccgtgaacccctccgacttcgccgtcacctacgaggacaaggacggcgacctcatgctcgtcggcgacgtccccttcgacatgttcatcagcacctgcaagaggttgaggatcatgaaggggtctgaagccagaggcctgggctcagtgaagaacaactgaggttgcaggatttgcatgtcttgtgcacgagcagattcttttgttcttttgggctgcttggagtctccaaggcatggacatgttttcaccatctccccttgtctgactcgactcgatcttcgacacaacatggagacaagacaaaggcaaagcatgcaattgcaaggtcgagggaagaggagtgagtcaagcttgcaaggagagacagctttgtgcatcaaagtgcatgcatgcgtggatgtgtggtcactttgtttccatttttctctcttttttttttttactgctactgctaggtgttagcaacacaaaaggagtggagattcgagttgacatctccatgtgtgtttgtacaaagccaaagatcactttcaagtttt

SEQ ID NO: 5940 - protein, 227 aa, Panicum virgatum
  misc_feature: Ceres CLONE 1828859
  misc_feature (2)..(194): Pfam Name: AUX_IAA Pfam Description: AUX/IAA family
  misc_feature: The sequence is a functional homolog of  SEQ ID NO 636 in the  11/479,226 US patent application
  misc_feature: Useful for making plants with modulated growth and phenotype characteristics
MEVAAAAAAAASYVADDVDRCLKATELRLGLPGTELETAPAAAALPTPPSTPRGKKRDGNTAGAEEAAKTAPPAAKAQVVGWPPVRSYRKSCFQQSSSSAAKSKPAAPPEEKAPAPAPVAAGGNANAAMFVKVSMDGAPYLRKVDLKMYKGYRELREALEAMFLCFSGGADAPAAVNPSDFAVTYEDKDGDLMLVGDVPFDMFISTCKRLRIMKGSEARGLGSVKNN

SEQ ID NO: 5941 - DNA, 1248 bp, Panicum virgatum
  misc_feature: Ceres CLONE 1828879
  misc_feature: Encodes the peptide sequence at SEQ ID NO. 5942
ccgggttattctattgggttccctattcttttcccattcccaccccgcctcctcatcgtcgcgctcacgcacgctcccgcatccccgctgccgcgccacaccagcaccagcaccgcactccaccgccaccgcgcgcgtcgctgtcgctcgtcatcgacgccttcgcttccccagcacgggacctcgagcgggcagcgcgcgcgctataaggcgaaggcacaccccgcggccatggcgcccgcaccggcatcgctctcggccccccgcgccctctccctgctcgcacccgccgccagagtctcgcccgggaggtggagcggcctgtcggtctccgtcgcggcccggcccgtgaccggggtggtggtgtccgcgcagcggcggctggtcgcggcggcggcggcgacggagatggcgcccgcggcgagcggggaggagggcgggaagccgttcgtggaggagatgcgggcggtcgccatgaagctgcacaccaaggaccaggcgcgggagggggagaaggagccgcaggggccgcccgtcgccaagtgggagccgtccgtcgagggctatctccgcttcctcgtcgacagcaggctcgtcttccagacgctcgaggacatcgtcgaccgcgccgccgtcccgtggtatgctgaattctggaatactgggttggagagatcagaggcactcaagaaggacctggagtggttcaaggaacagggccacacaattccagaaccatcgcctcctggcactacctacgcttcccttcttgaagagttgtctgagaaggaccctcaggcatttatctgccatttctataatgtgtactttgctcatactgctggaggccgaatgattgggaaaaaggtttccgagaagattctgaacaagaaggagctggagttctacaagtgggagggcaatctctcccagctgctgcaggacgtccgcaacaagcttaaccaagttgcatccagctggtctcgggaggagaaggaccactgcctggaggagacggagaagtccttctcctactctggggcgcttctccgccacatattcacctgatttagcattgccctctgatccaatcacaaacgctgtaaatacattatccatgactgttacgactttgttactggggagatggtggaatctcctccacctggtacgatgtaccttcagacaaaatgccaaagtgttaaataaaccacagccccattctcccaaaaaaaaaaaaaaaaaaaa

SEQ ID NO: 5942 - protein, 278 aa, Panicum virgatum
  misc_feature: Ceres CLONE 1828879
  misc_feature (1)..(199): Pfam Name: Heme_oxygenase Pfam Description: Heme oxygenase
MAPAPASLSAPRALSLLAPAARVSPGRWSGLSVSVAARPVTGVVVSAQRRLVAAAAATEMAPAASGEEGGKPFVEEMRAVAMKLHTKDQAREGEKEPQGPPVAKWEPSVEGYLRFLVDSRLVFQTLEDIVDRAAVPWYAEFWNTGLERSEALKKDLEWFKEQGHTIPEPSPPGTTYASLLEELSEKDPQAFICHFYNVYFAHTAGGRMIGKKVSEKILNKKELEFYKWEGNLSQLLQDVRNKLNQVASSWSREEKDHCLEETEKSFSYSGALLRHIFT

SEQ ID NO: 5943 - DNA, 1248 bp, Panicum virgatum
  misc_feature: Ceres CLONE 1828887
  misc_feature: Encodes the peptide sequence at SEQ ID NO. 5944
cccggtctacaaagacctcagctttcctacccccacttctttcttccaaagcctcgcctttttcctctccctcgtcttccctcgctcgcctcccctctccaaatcccatcccctttttttttttgggaacaatcagcttatccccttgcgcagcacacgacgaacggcaagaggaggagggagaaggcagaggcgaagcgagccaattggggaggagatggagccgatgccctcctcccgctccgtgctctcctcctgcaatcggatggttgttcttgctccgtccgggagggtatccgcgagtgcgaagcggaaggagaagggagtagtatgtattttgggtggtgagaggaaggacgtggaagaagggaggatccggaggagagcagcattttccttgctgctggcttcgccggtgctttcagtggcgttctcagcctatgcgaagagtaaaagcatgaacccttatgacgaaaggcggctgcttcagcagaataagaagattcaggaagctaaccgtgcccccgaagatttcccaaacttcattagagaaggttttgaggtcaaagtagtgacatcggacaactacataacacgggactctggactaatgtatgaggacataaaagttggtacaggcaactctccaaaggatggtcagcagattatattccattatgtgggctacaacgaagcgggtcgaaggatagatagcacctatattcaaggttcccctgcaaaaattcggttagggaatggaacactggttccaggttttgaagaaggcatacgggacatgaaaccaggtggtaagagaaggattataatacctccagagcttggtcctcctgtcgggccgtcgacattcttcagcgcgaagcagttcgaggtgttcgacgtcgagctcctggcggtgcaagactgccaacggaggacgatagccttttattctgatgttgtgtgcagctgagcatctgctgatatcccatcaatgcctcaccgagcagcacgtttacatcactttcctgctgacaggatttttgctggtactcttcaaaaaaattttttgctcgtggtcgggttgtgtaattgtatagccacccgttgtttctgcgacagtaaaggttactgatccatgacagtggtagactggtagtgtattagctcttcatttttgtcttgaatatcatgatagtggcatatgcgcgcatttggtgcgtcttttcagaaaaaaaaaaaaaaaaaaaa

SEQ ID NO: 5944 - protein, 250 aa, Panicum virgatum
  misc_feature: Ceres CLONE 1828887
  misc_feature (1)..(71): Pfam Name: FKBP_C Pfam Description: FKBP-type peptidyl-prolyl cis-trans isomerase
MEPMPSSRSVLSSCNRMVVLAPSGRVSASAKRKEKGVVCILGGERKDVEEGRIRRRAAFSLLLASPVLSVAFSAYAKSKSMNPYDERRLLQQNKKIQEANRAPEDFPNFIREGFEVKVVTSDNYITRDSGLMYEDIKVGTGNSPKDGQQIIFHYVGYNEAGRRIDSTYIQGSPAKIRLGNGTLVPGFEEGIRDMKPGGKRRIIIPPELGPPVGPSTFFSAKQFEVFDVELLAVQDCQRRTIAFYSDVVCS

SEQ ID NO: 5945 - DNA, 1449 bp, Panicum virgatum
  misc_feature: Ceres CLONE 1828897
  misc_feature: Encodes the peptide sequence at SEQ ID NO. 5946
gcgcgcgctccctcccctcccctcctcccaccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcatctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcacgcgtccccgtcgcgcccatcggctcggaggccgcggccgccgccgtggaggccatgctgttcgggaccggcgagccggccgcgtccgaggccgaggagccgcagaacgcggcggccgggcacaaccaccagcacgcgctgaacctcaacgtggaggccaaggacatgaagctggactacctcttttccgacctggacccctacctcagcgtcgatatcccgcgcttccagcacgccgacagcgtcgtccccagcggcgtcggcgccggagcagccggcgccgtcgagctggacttcacgtgcggcatcggcgtcgagccctccgggggggggggggggggggggacatccctcgcccacagcggctcctcttctgaggtcggcgtggtgccagaggccttctgcggcgggggggggagcttcgagctcgacttcacaaggcccaagcctcaagcctacatgccgtacaccgcgactcctcagagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagatgcggccgcggatcaagggccggttcgccaagcgcgccgaccacgacgccgacgccgacgacgccgaggccgaggccgaggccgccgtgccgtcgccggcgtcgtacgtgctcgacttcggctacggcgtcgtgcccagcttctgatcgacgacgatcgtctcgctcgttccacgcgcggcgcgcttgacccggcaccggcgcgcgcgccttgtacttgtatcgatgcatgtataggggaggaatagtaatcccatgtactctcgtcttggagctgcgctagccctgcgtacgtacgctagtgatgtataatttgtacaacccagtattttgccctgtacccgctc

SEQ ID NO: 5946 - protein, 366 aa, Panicum virgatum
  misc_feature: Ceres CLONE 1828897
  misc_feature (1)..(48): Pfam Name: zf-B_box Pfam Description: B-box zinc finger
MELHKYWGVGGRRCGGCEAAPAAVHCRSCPAGGAFLCTACDARPGHAHLGHERVWMCEVCELAPAAVTCKADAAVLCAACDADIHDANPLARRHARVPVAPIGSEAAAAAVEAMLFGTGEPAASEAEEPQNAAAGHNHQHALNLNVEAKDMKLDYLFSDLDPYLSVDIPRFQHADSVVPSGVGAGAAGAVELDFTCGIGVEPSGGGGGGGTSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAEMRPRIKGRFAKRADHDADADDAEAEAEAAVPSPASYVLDFGYGVVPSF

SEQ ID NO: 5947 - DNA, 1298 bp, Panicum virgatum
  misc_feature: Ceres CLONE 1828905
  misc_feature: Encodes the peptide sequence at SEQ ID NO. 5948
gattcggtttcggcggcggggcaccctgctcgtagttatcagccgatcccgccagatcgagggagccagagagggggagggatcagccagccatggagttgtcgagttccatggcgtccacggcggcgcaggcgcggctgctccggccgctgtcgtgttgccggcctggccccggcccggcagggttcgtggcttgtaggggtaatgctgggagaagcaaaatgatgatgagggcagtgcctccaatctgtgctagcttccagctgccatttcctcagcagccaagctttcaagatgcaaataggaagaaacaaaatgttccttgctatcagagacaacaagctccacagatagaagccaagtcgatggaggaggtatatgacgctttggctgaacaccttctttctgtcttgaagaatattgaacatcttgactcaaaatacattgttggtctagctggcccacctggtgcgggcaagtccacagttgcctctgaagttgttcgacgtgttaatatgctttggtcccagaagcacgcaaagggtagtggagcactgcttcctacggaggaaattgctgcaatgcttccaatggatggtttccacctttatcgcgcccagcttgatgcaatggaggatccaaaagaagcacatgcaagaagaggagctccgtggacattcaatccatcactttttctgaaatgtctacagaccctaagaacagagggttcagtatatgctccatcatttgatcatggtgctggtgacccagttgagaatgacatatttgtaaagccacagcacaaaatagtgattgttgaagggaattatctattactggaagaagatgtctggagggacattagagatttgtttgatgagaaatggttcattaacattgacattgatgtctccatgcaaagagtgctcaagagacatattgcgacaggaaaagagccagatgtagcagcatggcggatctcatacaacgaccgtccgaatgcagagcttatcatggaatcaagaaagaatgctgatcttgtaatcagatctgtggacttctcaagctaaagtccatttctttgataggaaataggattgatgctctagtaatgttgagacgaaggcaccaataggttgtttccatggaggttcttgtacatataataagctgaatgttcatttccaacttcccaaggtgattatgtgcatgtaataagatattacttcatgatgtacagtcgagggattattaaataatttatttggcattctttttaaaaaaaaaaaaaaaaaaaa

SEQ ID NO: 5948 - protein, 325 aa, Panicum virgatum
  misc_feature: Ceres CLONE 1828905
  misc_feature (1)..(206): Pfam Name: PRK Pfam Description: Phosphoribulokinase / Uridine kinase family
MELSSSMASTAAQARLLRPLSCCRPGPGPAGFVACRGNAGRSKMMMRAVPPICASFQLPFPQQPSFQDANRKKQNVPCYQRQQAPQIEAKSMEEVYDALAEHLLSVLKNIEHLDSKYIVGLAGPPGAGKSTVASEVVRRVNMLWSQKHAKGSGALLPTEEIAAMLPMDGFHLYRAQLDAMEDPKEAHARRGAPWTFNPSLFLKCLQTLRTEGSVYAPSFDHGAGDPVENDIFVKPQHKIVIVEGNYLLLEEDVWRDIRDLFDEKWFINIDIDVSMQRVLKRHIATGKEPDVAAWRISYNDRPNAELIMESRKNADLVIRSVDFSS

SEQ ID NO: 5949 - DNA, 1384 bp, Panicum virgatum
  misc_feature: Ceres CLONE 1828908
  misc_feature: Encodes the peptide sequence at SEQ ID NO. 5950
actcgtggccactcctgcatcgtcatccacggcgacacagtcatcagtgagaggtagcttgctcgcctggccagagggcgtcgagaatggagaggatgctggcgaggctcatgcggaggaggtcgtcgctcctccaccagggagcagtagcagcagctcccatctcgttggccggctcgtcgtcgtctctcttctccacgcagcagctgcaagcggatccgggcgtcctgcccgggctcaagatcagggactccgcgtcccagctgattgggaggacaccgatggtctacctgaacaaggtcaccgagggatgcggcgcccggatcgcggccaagctcgagttcctgcagccgtccttcagcgtcaaagacaggccagcaatttcaatgttggaagatgctgaaaagaaggggttgatcacaccaggaaagacgacactgatcgagcccacatctgggaacatgggcattggcttggctttcatggctgccctaaaagggtatgaactcattcttacaatgccatcatacaccagtcttgaaaggagggtgaccatgagggcctttggtgcaaatctggtccttaccgacccaacaaaagggatgggtggaacagtgagaaaagcaacagagctttatgataaacatccaagtgcatacatgcttcaacagtttcagaatcctgctaatgtcaagatacattatgagacaactggtccagaaatatgggaggacacacttggacaggttgatatttttgtcatggggatcgggagtggtggcactgtcacaggtgtcgggaagtacctcaaggagaagaacccaaacgcaaagatctatggagttgaacccgctgaagcaaatgttctgaatggtggaaagccaggaccacacctcatcactggaaatggagtaggcttcaagccagatattttggatatggatgtaatggaaaaggttcttgaggtgaaaagtgaggatgctgttaagatggctcgagaattagcagttaaggagggtcttttggttgggatatcatcaggagcaaacactgttgctgctcttgaactagcaaagaaaccggaaaacaaaggaaaactcattgtgactgttcttccaagccttggggagcggtacttgtcgtctgcactgtttgatgagttgagaaaggaggctgaagccatggaaccagtgccagtagactaatctagtatatggtaaatcaaatagaggactggataatcggtgcataatgaatatcctagcaaccatgttgcaacttcaagttgtatttcaattcctctcatcaaagttgtaccttcagtttgtcatctgtggaccttgtgggaaaaacaaaaataacaattaaaatgttcaaaaaagcg

SEQ ID NO: 5950 - protein, 372 aa, Panicum virgatum
  misc_feature: Ceres CLONE 1828908
  misc_feature (31)..(368): SWISSPROT Homolog: EC 2.5.1.47 Cysteine synthase, chloroplast/chromoplast precursor
MERMLARLMRRRSSLLHQGAVAAAPISLAGSSSSLFSTQQLQADPGVLPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGANLVLTDPTKGMGGTVRKATELYDKHPSAYMLQQFQNPANVKIHYETTGPEIWEDTLGQVDIFVMGIGSGGTVTGVGKYLKEKNPNAKIYGVEPAEANVLNGGKPGPHLITGNGVGFKPDILDMDVMEKVLEVKSEDAVKMARELAVKEGLLVGISSGANTVAALELAKKPENKGKLIVTVLPSLGERYLSSALFDELRKEAEAMEPVPVD

SEQ ID NO: 5951 - DNA, 1685 bp, Panicum virgatum
  misc_feature: Ceres CLONE 1828956
  misc_feature: Encodes the peptide sequence at SEQ ID NO. 5952
atcgcagctgctcacgaggctcccgagcgcccccgccccaacgagccagggaaaggactcgggtgccttcaaaagcaacccccccggccagccgaggagagcgcgcgcgcggagtcagacatggcgtcaactgttaccttcacctcagttagtgctcaggcggggctgatccaaaagccaaggaacaatggtgtcacaagctactctggtttaaagacatcatcatcatcatctgtaagctttggattggagtcgtcattcctcggcaggaatgcatccctccgggcatctgtcgctccaaggattgtgccgaaagtggcgtctgggtctcagatatctcctcaggcatcttacaaagtggccgtgcttggtgctgccggtggaatcggacaacccctaggccttttgatcaagatgtcccctctcgtgtcagagctgcatctgtatgatattgcaaatgtcaagggtgttgccgcggatcttagccattgcaacacacctgctcaggttctggacttcactggcccctcggaattggcaaactgcttgaaaggtgtggatgttgttgtcatccccgctggagtcccaaggaagccgggcatgactcgtgatgacctctttaacatcaatgcaagcatagtcaagtcacttgtcgaggctgttgcggacaactgcccagatgcgttcatccatatcatcagcaacccagtgaactccacagtgccaattgctgctgaggttctgaagcagaagggtgtctacaaccccaagaagctttttggagttaccaccctggatgttgtcagggccaatacatttgtggcacagaagaagaatctcaagctcattgatgttgatgtcccagttgtcggtggccatgctggaatcacaattcttccgttattgtcgaagaccaggccatctgtcaccttcacaggcgaggaaactgaggagctgacgaagagggtacagaatgccgggacagaggtggtggaggccaaggctggtgcagggtctgctaccctgtccatggcctacgctgctgctagatttgtcgagtcatctctccgtgcactggctggtgatccagatgtttatgagtgcacattcatccagtccgaggttactgatctgcctttctttgcatcaagagtcaagctcgggaagaatggtgttgaatctgttgtttctgctgacctcgagggagtgactgagtatgaggccaaggcgcttgaggtgctgaaggctgagctgaagggaagcattgagaagggcattgcgttcgcgaacaaacagcaggaagctgctgcgtctgtttgaagtgggtgaaataaaaatccgcaagaagagaataaagggacaatgatccagaatccacaatggcttttagttttgcagcctagaattttttgtgtcgacagtaggaagatgctccagaagagctacaattgtggctgttgttagcttctacggagtaatgattatgattacgtaggtgggggctggatgcctcccaagttatctgtttctgaaccagtccctgttttaacacaacccataaattttgctccttttctattgtggttgtgtctgtagcttgttggagtttacaaactaccaggcagctaaaaaaaataaagcatttttacgaaagcgatttgtatcaaaaaaaaaaaaaaaaaaaa

SEQ ID NO: 5952 - protein, 399 aa, Panicum virgatum
  misc_feature: Ceres CLONE 1828956
  misc_feature (1)..(166): Pfam Name: Ldh_1_C Pfam Description: lactate/malate dehydrogenase, alpha/beta C-terminal domain
  misc_feature (17)..(398): SWISSPROT Homolog: EC 1.1.1.37 Malate dehydrogenase, chloroplast precursor
  misc_feature (50)..(390): SWISSPROT Homolog: EC 1.1.1.37 Malate dehydrogenase, mitochondrial precursor
MASTVTFTSVSAQAGLIQKPRNNGVTSYSGLKTSSSSSVSFGLESSFLGRNASLRASVAPRIVPKVASGSQISPQASYKVAVLGAAGGIGQPLGLLIKMSPLVSELHLYDIANVKGVAADLSHCNTPAQVLDFTGPSELANCLKGVDVVVIPAGVPRKPGMTRDDLFNINASIVKSLVEAVADNCPDAFIHIISNPVNSTVPIAAEVLKQKGVYNPKKLFGVTTLDVVRANTFVAQKKNLKLIDVDVPVVGGHAGITILPLLSKTRPSVTFTGEETEELTKRVQNAGTEVVEAKAGAGSATLSMAYAAARFVESSLRALAGDPDVYECTFIQSEVTDLPFFASRVKLGKNGVESVVSADLEGVTEYEAKALEVLKAELKGSIEKGIAFANKQQEAAASV

SEQ ID NO: 5953 - DNA, 1529 bp, Panicum virgatum
  misc_feature: Ceres CLONE 1828957
  misc_feature: Encodes the peptide sequence at SEQ ID NO. 5954
gttcccatccgcctcgcagctccctcccccttccaacacgcaggacagcgtagtttcaattcaatccatccattccgatggggctcgacgtcttggagatcgggatgggctccgatttgagcctggatctgaggcacttcgcctccaaggccgtccggcaggccagggatgcgccggcgtcggacgtcgacgcctgcatccgccgcctcgaggaggagcggggcaagatcgagatgttcaggcgtgagctcccgctctgcgcgcgcctcctcgccgaagtgatcgatgtcatgaaggcggaggcggggacgaagacgaagagcgatcgcaaggcggcggaggaggacggcgccgccggggacaagagcaagtggatgagcacggcgcagctctggaccggcgattccggccgggaggatgcggcatcagagaagcaagacaaggggaggagctcgccggaggccaggtcccccagcggcggcggcggcggcgctttcttgccgttcaaggctgtgggctccggcgcgccggcgttcgcgccgctgtgcttgagagcggatgacaaggccgcggacgcggggacgccggatctgtccttgctgtctccgccggcgatcaagagcgctccggctgctgctgccggcgccgcccaggaaagccgtcgccaggtcgtggggttcgcgcaggcagcggcgagggcggtcgccatggcgccggctggcccttctcttagcctccagtctcaaccgcagcagacatctcagcagcagcagcagcagcagcaggcggcgaggaaggccaggcgcacttggtcgccggagcttcaccgccagttcgtcgcagccttgaatcaactcggtggcgcccaagttgccactcccaagcaaatcagggagctgatgaaggtggatggcctgacgaacgatgaggtgaaaagccatcttcagaagtaccggctgcacaaccgaagagcgcctggatccgccgttgtaaaccagccaattgtgcttgtgggagggctctggatcccccaggagcaaagcagctcacagtctggatctccccagggccctctccacttctcaacatcaggcatcgccgtctcatcggcggccaccgtcagctgtgaggaggaagatggccggtccgagagctatggctggaaatgatgaagaggctgctgcatcatcagtgttcagagagacagactttggtggattgcgatgctgccagttacagcttcaggtgggagccatgacatgaggagattttggtgtagtctatctgtatacaatacaggggagatcgggccttgagcgctcgagatggaactgatggtgcgtcggcgttgggttgtacatcagaaagagatgatactagttacagttttgcggcttgttaatccatgttccgggcaaagctacaattttcgccctgagagagtttatctacctatatctgttgtcgattataccattttctctttttttttttctgttgaataaatattgttttgctgttgttcatgg

SEQ ID NO: 5954 - protein, 363 aa, Panicum virgatum
  misc_feature: Ceres CLONE 1828957
  misc_feature (1)..(52): Pfam Name: Myb_DNA-binding Pfam Description: Myb-like DNA-binding domain
MGLDVLEIGMGSDLSLDLRHFASKAVRQARDAPASDVDACIRRLEEERGKIEMFRRELPLCARLLAEVIDVMKAEAGTKTKSDRKAAEEDGAAGDKSKWMSTAQLWTGDSGREDAASEKQDKGRSSPEARSPSGGGGGAFLPFKAVGSGAPAFAPLCLRADDKAADAGTPDLSLLSPPAIKSAPAAAAGAAQESRRQVVGFAQAAARAVAMAPAGPSLSLQSQPQQTSQQQQQQQQAARKARRTWSPELHRQFVAALNQLGGAQVATPKQIRELMKVDGLTNDEVKSHLQKYRLHNRRAPGSAVVNQPIVLVGGLWIPQEQSSSQSGSPQGPLHFSTSGIAVSSAATVSCEEEDGRSESYGWK

SEQ ID NO: 5955 - DNA, 1596 bp, Panicum virgatum
  misc_feature: Ceres CLONE 1829026
  misc_feature: Encodes the peptide sequence at SEQ ID NO. 5956
ggcggctcagcgcggaccccaacagtgtcctccccctcctcgtcgcctcccccggttgcgctagggctttgcccccatcccccctcgaaaccctacccgcaccatgcgcgatcgatcggtcgatcgcgaattccccagccgcgagcgtggggatcggccgccgcccgggatgctgggccctccgcgccgcgggccggcgtacaagacgaagctgtgcgcgctgtggcagcgcggcggctgctcccgcgacacctgcagcttcgcgcacgggcacgccgagctccgccggttccccggctcgcgcacctcgttcccgccccgcgccgggagaagagattatagaggcggtgacttcagagaaaggtttgataggaggcgttcgcctcacaggaggcattcccctgatagagattccagggatcatcgtcctcttcatgaacaaagaccaacttctcaagaaagggaatctagctattcacgatcccccagcaggaagagcgataggaggcatgagaagaaccctgatgatggagaaaccaactcatccaggagcttgagtgtctctgacaaaaatgatgatagaaaaaaggagacactcagtgttgatgataaagaggatcaagaaatacagctgaaacaaataaggcaggatatggaacttctgcgtgaggataaatctaacttggagatcattttggatgagaagaacgctgaagtacgcaagatttctagcagggtaaatgatcttgacctgcagataaggaaggaaaaagaggaatgccacaggatgacctcaaaaataaagaagttcattaaagctcatgctcgctttttgaaagcacaggaagaattgaaaaggtcacaagctcgttttgagagacttggtgatttgcttgcttcagatattctgaagcgtggtgctaacgaagaagtttccagtgtcaatgttgatgaagatccaaatgggccttatgaaaggagcccaaatgctgctacaactaagaagagatcaatcccttactcaacaagtgaagaagcaaaagccgtaaagaaaaggagagatcgtgattcagaatttgataaatcaagcaaggggactgagccaacaaaagctttatatttgaaaaagaaattgtgggaagatgaaaaggataaaataggcacctcggccaacactgacaaggtcaaagattctccagtcaaacatgttttaccctccactggtatggctgctcatgctgtggatgatctatttgaagctgttgaactggaggataggcatggtccaataaacgcatcagtagaaaatggtgctggtgacgaaactaggtcgcctgctatgccatcacagccaccaccagtggttaatgcttacgagcagtatgagggtgatgatgaggaagtcgacgtggagtaagtggatgtaaagtcaaatgtatttggtcttgttgggagtttgccttatataaaaacatctttggtggcaacctatagtggatgcagttttaagctgtttgttatgtgcagctaaacatttttcatgaatgtgaccctaaatatcctgttacctgtacctaaaaaaaaaaaaaaaaaaaa

SEQ ID NO: 5956 - protein, 437 aa, Panicum virgatum
  misc_feature: Ceres CLONE 1829026
  misc_feature (1)..(25): Pfam Name: zf-CCCH Pfam Description: Zinc finger C-x8-C-x5-C-x3-H type (and similar)
MRDRSVDREFPSRERGDRPPPGMLGPPRRGPAYKTKLCALWQRGGCSRDTCSFAHGHAELRRFPGSRTSFPPRAGRRDYRGGDFRERFDRRRSPHRRHSPDRDSRDHRPLHEQRPTSQERESSYSRSPSRKSDRRHEKNPDDGETNSSRSLSVSDKNDDRKKETLSVDDKEDQEIQLKQIRQDMELLREDKSNLEIILDEKNAEVRKISSRVNDLDLQIRKEKEECHRMTSKIKKFIKAHARFLKAQEELKRSQARFERLGDLLASDILKRGANEEVSSVNVDEDPNGPYERSPNAATTKKRSIPYSTSEEAKAVKKRRDRDSEFDKSSKGTEPTKALYLKKKLWEDEKDKIGTSANTDKVKDSPVKHVLPSTGMAAHAVDDLFEAVELEDRHGPINASVENGAGDETRSPAMPSQPPPVVNAYEQYEGDDEEVDVE

SEQ ID NO: 5957 - DNA, 1660 bp, Panicum virgatum
  misc_feature: Ceres CLONE 1829071
  misc_feature: Encodes the peptide sequence at SEQ ID NO. 5958
gtcgcttcccttcatctctcgatgcctcgctgcgcttggtcccctgtcctccgtcctcccgagtcctgtcgctgtccccgctcataaaccgggcaacgactatggcgcggatggggatttcccgtttcgattgcccttcctctgactgcatctggtgtaggaattatttatttaagctttcttgcaccctcgtttctaccctctccatttttcttgttcctccagccttcttggtgctgcgtgcgctgggcgtgctcccgccggcgaggccaaggtcaagttggcgccttctgttgcttctgacggtgatctttatagccggggggccacatggataggcggaggcgcgccgtcgaatcggcggcgccggcggcggttatggtgctcttgctgctgtccatcgctcctcctgggagagcaaggagagattggggtttccgttccccctcttcatctgtcggttttactgagcccaacacaaaacccgatgtcaagagcaatggacagagttttgtttttaactatactctggccaaggctattgtggaatatgcttcagctgtatatatgacagacctaacggctttatatacatggacatgctcaagatgcaatgacttgactcgaggctttgagatgacatgtataattgttgatgtacagaattgtttgcaggcattcgtcggtgtcgatcacaaactcaatgctatcatcgttgcgataaggggaactcaagagaacagcatacagaattggattaaggacatgatatggaagcaagttaatgttaattatccaaatgtgcccaatgctaaggtccacgccgggttttactcttcttacaataatacacttttacgttcagccatcgcggatgcagttcgcaaggcaaggaagttacatggagctagtgacataattgtaacagggcactcgatgggaggagcaattgcttctttttgtgcgcttgatcttgctatccactttggaagtaacaatgttcatctgatgacctttgggcagccacgtgttggcaatgctgtttttgcctcctactttgccaaatatgtgccaaacacaatcagaattacacatgaacgtgatattgtgcctcatttgcccccttatttcttcttcctcccacaactgacataccggcacttccctagagaggtgtgggaacataaagttaatggcaacacaacttttcaagtctgcgatggcagtggtgaagatccaaactgttgcaggagcgtgtttgtgctgttttggagcgcttctgaccatttgacctatatgggagttaatatagcggcagacgactggagcacctgcagaattgttctggggcaaagcgctgagcaactccaaatgaatcttgccagcaacatttttacgtctgggcactccgtcgacgttgtcattgcagatgatagcgtgcaggttgattgatgcagttcaggctagtcatgcatatatataagctgttgcctttttcagagcaaaggaaatattcgtcccatcttgctctgtggttctcatgtataggttgtgaatgtaatccctgtacagaaaactgaatgcctgaagttctgcaagtgtactgtacactgtgcctcagatgtcaccacccgtctgtcaaaaaaaaaaaaaaaaaaaa

SEQ ID NO: 5958 - protein, 373 aa, Panicum virgatum
  misc_feature: Ceres CLONE 1829071
  misc_feature (1)..(140): Pfam Name: Lipase_3 Pfam Description: Lipase (class 3)
MDRRRRAVESAAPAAVMVLLLLSIAPPGRARRDWGFRSPSSSVGFTEPNTKPDVKSNGQSFVFNYTLAKAIVEYASAVYMTDLTALYTWTCSRCNDLTRGFEMTCIIVDVQNCLQAFVGVDHKLNAIIVAIRGTQENSIQNWIKDMIWKQVNVNYPNVPNAKVHAGFYSSYNNTLLRSAIADAVRKARKLHGASDIIVTGHSMGGAIASFCALDLAIHFGSNNVHLMTFGQPRVGNAVFASYFAKYVPNTIRITHERDIVPHLPPYFFFLPQLTYRHFPREVWEHKVNGNTTFQVCDGSGEDPNCCRSVFVLFWSASDHLTYMGVNIAADDWSTCRIVLGQSAEQLQMNLASNIFTSGHSVDVVIADDSVQVD

SEQ ID NO: 5959 - DNA, 1270 bp, Panicum virgatum
  misc_feature: Ceres CLONE 1829089
  misc_feature: Encodes the peptide sequence at SEQ ID NO. 5960
acctcaaggcacagccggtagtggttgcgctctctctctctctctctccccgcagtccggcagcaggaaagatttgtctgaagagcgcgatcggcagtagtgatggtgagccgtgagcacagccacagctacgagcacctcgtgctcgacccggcggtgctgggcggctccgcctgcagctgggccgagccgccggccgggctggagatcatcccgccgcagctcctcgccacgctgggggagtacctctccgccggccgcggcgggggcggggacggggacgccgccgaggcggaggcggacgacgagttcatgatgtacgagttcaaggtgcggcggtgcgcgcgcgcgcggagccacgactggacggcgtgcccctacgcgcacccgggcgaggccgcgcgccgccgggacccgcgccgcgtcgcctacgcgggggagccctgcccggacttccggcgccgcccgggcgccgcgtgcccgcgcgggaccgcctgccccttcgcgcacggcaccttcgagctgtggctccacccgtcccggtaccgcacccgcccctgccgcgcgggcgccgcctgcaggcgccgtgtctgcttcttcgcgcacgccgcggccgagctccgcgccgcgcccaaggacgacggtggcgcgctctcgctctcgctctcgcccaagtcgacgctggcgtcgctctgggagtcgccgccggtgtcgcccgtcgaggggcggatgaggtggctcgacgccatcgacgagccgtccgacgcggacgcggaggtggaggagctcatgctcgcaatgcgggagctcagcttcaggaaggccgcggcgtcgtcggcgccggtgctgccccccgtcacggaggaggacgggccggacttggggtgggtgtcggagctggtgatgtgagcatgcatgccggcgcccctcccggcccaaggtcgacgccatctccgccgccgccggcaagaggcgcctcgcgcgccattcggaacagcttcattattaagcaatattattgttaattctagcattttctcgaattgcatcattcttctgtggataaacaaaaacatggtgcaagtatccatacagcgatcttgtaagcgtggcgaggccgcgtgtgttcccctcttctttttgtcggagatcttgggcgttagtgtgcgtgccaagccgccacccacggtttctccgattaccaagtgtatgtactagtagataccaccgagtacgaagtgtaattggccaaaaaaaaaaaaaaaaaaaa

SEQ ID NO: 5960 - protein, 268 aa, Panicum virgatum
  misc_feature: Ceres CLONE 1829089
  misc_feature (1)..(29): Pfam Name: zf-CCCH Pfam Description: Zinc finger C-x8-C-x5-C-x3-H type (and similar)
MVSREHSHSYEHLVLDPAVLGGSACSWAEPPAGLEIIPPQLLATLGEYLSAGRGGGGDGDAAEAEADDEFMMYEFKVRRCARARSHDWTACPYAHPGEAARRRDPRRVAYAGEPCPDFRRRPGAACPRGTACPFAHGTFELWLHPSRYRTRPCRAGAACRRRVCFFAHAAAELRAAPKDDGGALSLSLSPKSTLASLWESPPVSPVEGRMRWLDAIDEPSDADAEVEELMLAMRELSFRKAAASSAPVLPPVTEEDGPDLGWVSELVM

SEQ ID NO: 5961 - DNA, 1055 bp, Panicum virgatum
  misc_feature: Ceres CLONE 1829106
  misc_feature: Encodes the peptide sequence at SEQ ID NO. 5962
gctggctctttcctcaaccttcgcttccgtgctgatctttactggagtactaccttgcctggtgtcgagaggaagccccggagtacgggagggccggtaggccggagagcttctcgaggagcgagagggcggccatgaggatccagtgcgacgcgtgccagggcgcggctgccacggtggtgtgctgcgcggacgaggcggcgctctgcgcgcgctgcgacgtcgagatccacgccgccaacaagctcgccggcaagcaccagcgcctcccgctcggcggaggcagcgggggcgtcccgcgctgcgacgtctgccaggagaagccggccttcatcttctgcgtcgaggacagggcgctcttctgccgcgactgcgacgagcccatccacgtccccggcacgctctcggggaaccaccagcgctacctcgccaccggcatccgcgtcggcttcagctccgtctgcggcgccgacgccgacgccctcccgccgcccaagggcggcgcctccaagcccgcggctgccgccggggccgccaaggcgccggccagcaagcccgcgcagccgcgggaggtgccgtcgtcgccgttcctgccgccgtccggatgggccgtggaggacctcctgcagctcaccgactacgagtccagcgacaagaaggactcgcctctcgagttcaaggagctggagtggttcgcggacatcgacctgttccacggccacgcgccggccaaggccgcgacggccgaggtccccgagctcctcgccacgccgcagccggcgagcaacgcggggttctacaggacgagcggcgcgcgccagagcaagaagccgcgggtggagctgcccgacgacgaggacgacttcttcatcgttcccgatcttggctgagatgtcaggtcttcgcatggttcccgtcatgtggtgtgtatatatgcgaagtattgtgtgtacgtgtgccgtcatgagatgcaccgatcgcttacgctgggcatatgtaattataaggcagtttggggccagtactttcagcctgaaaaaaaaaaaaaaaaaaaa

SEQ ID NO: 5962 - protein, 251 aa, Panicum virgatum
  misc_feature: Ceres CLONE 1829106
  misc_feature (3)..(48): Pfam Name: zf-B_box Pfam Description: B-box zinc finger
MRIQCDACQGAAATVVCCADEAALCARCDVEIHAANKLAGKHQRLPLGGGSGGVPRCDVCQEKPAFIFCVEDRALFCRDCDEPIHVPGTLSGNHQRYLATGIRVGFSSVCGADADALPPPKGGASKPAAAAGAAKAPASKPAQPREVPSSPFLPPSGWAVEDLLQLTDYESSDKKDSPLEFKELEWFADIDLFHGHAPAKAATAEVPELLATPQPASNAGFYRTSGARQSKKPRVELPDDEDDFFIVPDLG

SEQ ID NO: 5963 - DNA, 1186 bp, Panicum virgatum
  misc_feature: Ceres CLONE 1829111
  misc_feature: Encodes the peptide sequence at SEQ ID NO. 5964
actcatcgctggagcgcaggaggagcttgtttgtttgcgcaaacctgcgtgcgtgcccacgcagcatccagctgccatcagttcattgcaagcgcagcggtggtagtgtagctgtagcctggagctagcagaggagggaagagcagagcagggcagggcgctctgtgggaagctgggtcgatagagatagatccgtgctgcagtgctgctgccggtcatctcggtcgatagagatagagatagcaggttgagggcccggtcgagcgcgtgcgtgactgggcgatcggagggaggaggatggtgaacacggcggcgagcctcggcggcggcggcagggcgggcggcgtgctgccgctggcgtcgctgaaccacatcagcatcgtgtgccggtcggtggaggagtcgctgcgcttctacaccgacgtgctgggcttcgtccccatccgccgcccgggctccttcgacttcgacggcgcatggctgttcaactacgggatcggcatccacctgctgcagtcggagcaccccggcagcctgccggagaagagggagatcaaccccaaggacaaccacatctccttccagtgcgagagcatggcggcggtggagcggcggctcaaggagctggggatcccgtacgtgcagcggtgcgtggaggagggcggcatcaacgtcgaccagatcttcttccacgaccccgacggcttcatgatcgagatctgcaactgcgacagcctccccgtcatcccgctcgccggcgcgcccgtcctgggggcctgcaagcgcgccgccgtcgtcaagcagcaccagcagcagggcggcgcggtgccctccgctcccgcggcggcggcggccgcgcagtgcgtgccgtcgtcggccgcggcggcgcaggccatccgcgtcgccgaggaggcgcacatctcgtgcgcgtgagaagctagtagctagccacggcgtgcgcggctgcgtgcgtggtcatgtcgtcggcggcgatgcttcggagccgtacgtccgtgcgccgccgtcgatggtggtggcgactggcgaggcacgggcacggggcgcccgtgtgcggctggtgtgtcgtcgtctgtatatgcgttgagtgtagtagggttgcgtgtaagagtgaaaactccccttctaagtgaagaataataaaccatggcaggaagatttcttcctt

SEQ ID NO: 5964 - protein, 211 aa, Panicum virgatum
  misc_feature: Ceres CLONE 1829111
  misc_feature (1)..(120): Pfam Name: Glyoxalase Pfam Description: Glyoxalase/Bleomycin resistance protein/ Dioxygenase superfamily
MVNTAASLGGGGRAGGVLPLASLNHISIVCRSVEESLRFYTDVLGFVPIRRPGSFDFDGAWLFNYGIGIHLLQSEHPGSLPEKREINPKDNHISFQCESMAAVERRLKELGIPYVQRCVEEGGINVDQIFFHDPDGFMIEICNCDSLPVIPLAGAPVLGACKRAAVVKQHQQQGGAVPSAPAAAAAAQCVPSSAAAAQAIRVAEEAHISCA

SEQ ID NO: 5965 - DNA, 1368 bp, Panicum virgatum
  misc_feature: Ceres CLONE 1829141
  misc_feature: Encodes the peptide sequence at SEQ ID NO. 5966
acacagcgaagcaaggagcagccgccatggacacagacatggagaggaaggtggcggcggagaaggagatgagagagtggtgcgtcgcgctccccaaggtggagctccacgcccacctcaacggctccgtccgcaattccaccctcctggaacttgcaaaacagctaggagacaaaggagtcattgtcttcgaagatgttaaggatgtgatcatgaaggatggtagatctctcccagagtgtttcaagctttttgatttgtttcatatacttacaacggaccatgatacagtaacaaggatcgctatggaggttgtggaagattttgctgcagagaatgttgtgtatttggaaataagaacaacacctaagaacaatgaagccaaagggatgaccaagcgatcttacatgaatgctgttattaaaggtttaaaagcagttgatgcagttgatgttgttttatttgattctaagtcaagaacaaatgacacattaacttgcacacctacaattgggttggatggtgacataaagaaaaggaggatatatgtcaggctccttcttagtattgatcgccgcgaaacaacttcggctgcattggataccgttaatttggccctggaaatgaaggaccaaggtgttgttggtatcgatctttctggcaatccagttgtgggggaatgggaaacatacttgcctgccctacaacatgctaaagagcttggaatccccattacgcttcactgtggagaggtagcaaacaggaaggagattcaagcaatgctggatttctgccctcagaggctggggcatgtatgctgtctgaatgatgcagaatggaagaagctcaagtctttgatgattccagttgagatatgtttaacatcaaatgttatgacaggaggtgctccttctctagagcttcatcactttgctgacctctataatgcaaagcaccctctatccttgtgcacagatgactgtggcctgttttcaacaagcctctcaaatgagtattacctcgttgcagctacttttggtctcagcaagcctgatctgtttcacctagctcaggaagcagtgcagtttatttttgctgatgaaaatgtgaagatgtctctgaaggaggtgttcaagcatgccgagaagagattgacaatgttgtctgatattggcatgttgtctgatattggcgtgccaaactgatgtgtgtgtctcttagatcagtatgaacccaattgtgtgatatatgcaaaaaatgtataggcgtgttatttctcgtttatgtatggattatgtattttttttcaaggttaagaagaaatacagtcgaagaggtaatcagcatcaaaaaaaaaaaaaaaaaaaa

SEQ ID NO: 5966 - protein, 392 aa, Panicum virgatum
  misc_feature: Ceres CLONE 1829141
  misc_feature (1)..(344): Pfam Name: A_deaminase Pfam Description: Adenosine/AMP deaminase
MDTDMERKVAAEKEMREWCVALPKVELHAHLNGSVRNSTLLELAKQLGDKGVIVFEDVKDVIMKDGRSLPECFKLFDLFHILTTDHDTVTRIAMEVVEDFAAENVVYLEIRTTPKNNEAKGMTKRSYMNAVIKGLKAVDAVDVVLFDSKSRTNDTLTCTPTIGLDGDIKKRRIYVRLLLSIDRRETTSAALDTVNLALEMKDQGVVGIDLSGNPVVGEWETYLPALQHAKELGIPITLHCGEVANRKEIQAMLDFCPQRLGHVCCLNDAEWKKLKSLMIPVEICLTSNVMTGGAPSLELHHFADLYNAKHPLSLCTDDCGLFSTSLSNEYYLVAATFGLSKPDLFHLAQEAVQFIFADENVKMSLKEVFKHAEKRLTMLSDIGMLSDIGVPN

SEQ ID NO: 5967 - DNA, 1220 bp, Panicum virgatum
  misc_feature: Ceres CLONE 1829154
  misc_feature: Encodes the peptide sequence at SEQ ID NO. 5968
accacctcgtcccgtctccaacccacacccgccgccgcctccacctgttccccctcctgcccgcccggcggcagagatggagtccctgggcgtgctgcttctccaccccatgaacgcgtacctggagcaggagctggaccgccgctgccgcctgcaccgcttctgggaggccccgccgggggcgccccgcgacgagttcctccgcgcgcacgcgggctccatccgcgccgtcgtcggcaacgcctcctacggcgccgacgccgcgctcatcgacgcgctcccggcgctcgagatcgtcgcctccttctccgtcggcatcgaccgcgtcgacctcgccaagtgccgcgagcgcgggatccgggtcaccaacacccccgacgtcctcaccgacgacgtcgcagacctcgccgtcggcctcgccatcgccgtgctccgcaggatcccgcaggccgaccgctacgtccgcgccggccagtggaaggccaagggcgactacgcactcaccacacggttcagcgggaagagagtgggcatcatcgggcttgggcggatcggtctggccattgccaggcgagtggaggccttcgactgcccggtgaactactaccagaggacgaagcaggcgtaccccaactacagctactacccgtcggtggtggagctggcggccagcagcgacgtcctggtggtggcctgcccgctgaacgcggcaacccggcacatcgtgaaccgggaggtgatggacgccctggggcccaagggcgtgctcatcaacatcgggcgcgggccgcacgtggacgaggcggagctggtggcggcgctggcggaggggcggctgggcggcgccgggctggacgtgttcgaggacgagccgcacgtgccggaggcgctgttgggcatggacaacgtggtggtggtgccgcacgtggggagcggcacgtacgagacccggaaggcgatggcggacctggtgctgggcaacctggaggcgcacgtcctcaacaagccgctgctcaccccggtggtctgatcactgatgactgtgatacggtgtgtgtgtgtcagtgtgtgggatgaagctgcagcagagatgtgcgcctttaggatttgttgtcgatcgaatcgactcgttctgaataacaaactgcttgagccttgatgtgctcgcttctttctcgggcattgcaatgccaagtttggaaaaaaaaaaaaaaaaaaaa

SEQ ID NO: 5968 - protein, 317 aa, Panicum virgatum
  misc_feature: Ceres CLONE 1829154
  misc_feature (1)..(270): Pfam Name: 2-Hacid_dh Pfam Description: D-isomer specific 2-hydroxyacid dehydrogenase, catalytic domain
MESLGVLLLHPMNAYLEQELDRRCRLHRFWEAPPGAPRDEFLRAHAGSIRAVVGNASYGADAALIDALPALEIVASFSVGIDRVDLAKCRERGIRVTNTPDVLTDDVADLAVGLAIAVLRRIPQADRYVRAGQWKAKGDYALTTRFSGKRVGIIGLGRIGLAIARRVEAFDCPVNYYQRTKQAYPNYSYYPSVVELAASSDVLVVACPLNAATRHIVNREVMDALGPKGVLINIGRGPHVDEAELVAALAEGRLGGAGLDVFEDEPHVPEALLGMDNVVVVPHVGSGTYETRKAMADLVLGNLEAHVLNKPLLTPVV

SEQ ID NO: 5969 - DNA, 1060 bp, Panicum virgatum
  misc_feature: Ceres CLONE 1829169
  misc_feature: Encodes the peptide sequence at SEQ ID NO. 5970
acttggcagttggtaagaaaaggggagacgtctgaagcctgaagctgagcaagaatggctgggctgtacgagaagccgtcggagacgtacgccaagaagcgtccgcggtaccccaaggagtggttctccatgctggccgggctcaccgccggccaccagcgcgcttgggacgcgggctgcggcagcggccaggccgccatcagcatggcggagcactatgagagcgtggtggcgacggacgtgagcgagggccagctccggaacgccatcgcgcacccccgggtgcggtacgcccacaccccggagcacctctcggaggaggagctcgtggccctggtcggcggcgagggctccctggacctgatcgtggtggccacctccatccactggttcgacatcccgctcttctacgccgtggtgaaccgcgccctgaagaagcccggcggcgtgctcgccgtgtggggctacaactacgagatccacccgttcgaggacgcgctgcacgggcagctctacgcggccctgcggccgtaccaggacccccggaccaggctcgccatggagcggtaccggtccctgccgttcccgttcgagcccgtcggggtgggcgccgagggcgcgcccgccgacgtggacatggaggtggagatgacgctggaggacctggccgggttcgtgatgaccgggtcggtggtgaccacggcgagggagaagggcgccggcgcggagatggaggcggtggtgagggacgtgatgaagcgggtggagggggagtggggggacgcgcccaccgtgcccaggaagctcgcgttcaaggcgttcatgctcgccgggaggcccaagtgctgaactgcggatcggtggtcaggaataagcgttgcttgtcagtcagagtgagactgagagtgaaatgtcagctactacatcatataaccagccactcgagtatgtggccggagctgcttttttatgtcttcttctgtcgaataagtccgagcagatgctagtatgctacggctaataactttgaggattatcagaaaaaaaaaaaaaaaaaaaa

SEQ ID NO: 5970 - protein, 264 aa, Panicum virgatum
  misc_feature: Ceres CLONE 1829169
  misc_feature: Great-hit functional homolog of the protein sequence given in SEQ ID NO 9343
  misc_feature (1)..(96): Pfam Name: Methyltransf_12 Pfam Description: Methyltransferase domain
  misc_feature (1)..(98): Pfam Name: Methyltransf_11 Pfam Description: Methyltransferase domain
  misc_feature: Useful for making plants with modulated nitrogen use efficiency
MAGLYEKPSETYAKKRPRYPKEWFSMLAGLTAGHQRAWDAGCGSGQAAISMAEHYESVVATDVSEGQLRNAIAHPRVRYAHTPEHLSEEELVALVGGEGSLDLIVVATSIHWFDIPLFYAVVNRALKKPGGVLAVWGYNYEIHPFEDALHGQLYAALRPYQDPRTRLAMERYRSLPFPFEPVGVGAEGAPADVDMEVEMTLEDLAGFVMTGSVVTTAREKGAGAEMEAVVRDVMKRVEGEWGDAPTVPRKLAFKAFMLAGRPKC

SEQ ID NO: 5971 - DNA, 1463 bp, Panicum virgatum
  misc_feature: Ceres CLONE 1829267
  misc_feature: Encodes the peptide sequence at SEQ ID NO. 5972
acaagctagcctacaacacgtacagcacaacaaagaggtgcaaacacatacagatactgagaatcaaaagatcaccacgcactatgcatgaaagcaagatctttgtggaggatgctgtcgctgaagtcgactttgacttctccccgttcctaaaacggtacaaggatggccgaatcgagcggttgctgaggagtcctcccgtggctgcgtcggagaacccgagagccaaccgcggggtggcaacgagagatgtggtcatcgaccacagcaccggtgtgtcggcacggctgttcctcccctcccgggccgccaaggctgccggcaacaggaggctccccctcgtggtgtacatccacggtggctcctgcatggagagcgccttctgccggacctaccacggctacgccacttcactcgccgcgagcgccggggcgctcgtcgtctcggtggagtaccgcctcgcgccggagcaccccatacctgcggtctacgacgacgcatggtctgcgctcaagtgggtggcgtccttcgctgacccctggctcgccgactacgcagatcccgcgcgcacgttccttgccggcgacagtgcaggcgggaacatcgcctaccacacagcggtacgggctagccaagacgacggattggaattgggcgtcgacatcgaggggatggccattgtgcacccctacttctggggagccgagcggctgccttccgaggaggtctgggatggcgcagcggtgtttccagcgtacgaggtggactggctctggccgttcatgaccgcgggccaagccagcaacgatgaccctcggctcaaccctcctgaggaggagatcgcgtcgctgacatgccggcgggtcctcgtggccgtggccgagaaggacaccctgcgggaacgcgggtgctgcctcctcgaccgcttcagcgactactatgcgcgcactgccaccggcggcgaggcaacgctggtggagtcggagggcgaggaccacggcttccacctctacagcccgctgcgcgccaccagcaggaggctcatggagaacatcgtgcgcttcatcaaccagcctccaaaagcctatgatactaggtgtccctcgccggccgtttatggacgtatttgactatgggatgaacatgaaacgtcgttgcagtgactcgacgacgacgacctgcagcatggcgtatgcaacgtcaaaaattggaggacccaagaaaaactacgggctcttttcgggcgccgtgtggcctactaacaagcaggcctacaaggggccagcagcagcagcagcagccgccttcaccggaactcgtcatcttatcaagaacatgtggtaataatagctataggggctgtcgtcttcaccaaaatgtgatgtggatcgtgttgtgttgtataatctctcatcattaactaatatagatgtactattggacaaaaaaaaaaaaaaaaaaaa

SEQ ID NO: 5972 - protein, 348 aa, Panicum virgatum
  misc_feature: Ceres CLONE 1829267
  misc_feature (1)..(212): Pfam Name: Abhydrolase_3 Pfam Description: alpha/beta hydrolase fold
MHESKIFVEDAVAEVDFDFSPFLKRYKDGRIERLLRSPPVAASENPRANRGVATRDVVIDHSTGVSARLFLPSRAAKAAGNRRLPLVVYIHGGSCMESAFCRTYHGYATSLAASAGALVVSVEYRLAPEHPIPAVYDDAWSALKWVASFADPWLADYADPARTFLAGDSAGGNIAYHTAVRASQDDGLELGVDIEGMAIVHPYFWGAERLPSEEVWDGAAVFPAYEVDWLWPFMTAGQASNDDPRLNPPEEEIASLTCRRVLVAVAEKDTLRERGCCLLDRFSDYYARTATGGEATLVESEGEDHGFHLYSPLRATSRRLMENIVRFINQPPKAYDTRCPSPAVYGRI

SEQ ID NO: 5973 - DNA, 1629 bp, Panicum virgatum
  misc_feature: Ceres CLONE 1829299
  misc_feature: Encodes the peptide sequence at SEQ ID NO. 5974
gtcactcactcactcgcccggcaccacctcaccaaacccgcgtgggaacctcgtgctctccgccgccgccgcctccgcctcgatccctccgcccgcctcccgaggctcaggcttcccggaccttcggcggggcgccgcggcgatcctccccaggacaatgcaaagctcggcggccatcgggctagtccggccatgcgccgcccggccgctcgccgcttgccctagctaccgccgcggcggcgccggcgccggcgccggactccgcccggtcctcccggcgcgcggcctccgcctctccgcccgcgccgggctcgtcccggcctcaccgcttgaggaggaggagaagcggagatgcagggacgtggcggcgtcggcgtcggcgccggccgcggcgcagggggccggggaggaagcgggaggagggctagtgaagaccctgcagctgggggcgctcttcggcctctggtacctcttcaacatctacttcaacatctacaacaagcaggttctgaaggttttgccataccctataaacatcacaactgtgcagtttgctgttggaactgccattgctttgttcatgtggatcaccggtatccttaaaagaccaaagatttctggtgcccagcttctcgctatccttcctctggctattgtccacaccatgggcaatcttttcacaaacatgagccttggaaaggttgcagtttcatttacacatactatcaaggccatggagcctttcttctcagtcctcctttcagcaatcttccttggcgagttgcctactccttgggttgtattgtctcttgttcccatcgttggtggtgtggctttggcatctcttactgaggcttcctttaactgggctggcttttggagtgcaatggcttcaaatgtaacattccagtcaaggaatgtgctaagcaagaagcttatggtgaagaaagaggaatctctggacaatattaatcttttctcaatcattacagtcatgtcattcttcctcttggccccagtaaccttactaacagagggtgtcaaagtcagtcctgcagtcttgcagtctgctggcttgaacttaaaacagatctacacgaggtcgctgattgctgcatgctgcttccatgcgtaccagcaggtgtcatacatgatccttgcaagggtgtccccagtcacccattcagtgggcaactgcgtcaagcgtgtggtggtcattgtgacttccgttctgttcttcaggactcctgtttctcccgtcaactctctaggtaccggggttgccctcgcaggagttttcctgtactcacaactgaagaggcttaagcccaaggccaaggctgcttaatgacatatattatcagatccatccattagaactgtggaagacctgccggctgagtgactagcgagtgctgtagtttagagcgatattgcaagaagtccctctggtttgctacgacttgaagtgattgttcgtgatttaattactagtgtttttgaacggatttatggtttgttggtgtattaataattttggtgtggtgccatttttcttgtgctgtttgtacgcttctgaaactgaacttcgaggaagacagacaaaaataatagtggtggtggagatgt

SEQ ID NO: 5974 - protein, 396 aa, Panicum virgatum
  misc_feature: Ceres CLONE 1829299
  misc_feature (1)..(147): Pfam Name: TPT Pfam Description: Triose-phosphate Transporter family
MQSSAAIGLVRPCAARPLAACPSYRRGGAGAGAGLRPVLPARGLRLSARAGLVPASPLEEEEKRRCRDVAASASAPAAAQGAGEEAGGGLVKTLQLGALFGLWYLFNIYFNIYNKQVLKVLPYPINITTVQFAVGTAIALFMWITGILKRPKISGAQLLAILPLAIVHTMGNLFTNMSLGKVAVSFTHTIKAMEPFFSVLLSAIFLGELPTPWVVLSLVPIVGGVALASLTEASFNWAGFWSAMASNVTFQSRNVLSKKLMVKKEESLDNINLFSIITVMSFFLLAPVTLLTEGVKVSPAVLQSAGLNLKQIYTRSLIAACCFHAYQQVSYMILARVSPVTHSVGNCVKRVVVIVTSVLFFRTPVSPVNSLGTGVALAGVFLYSQLKRLKPKAKAA

SEQ ID NO: 5975 - DNA, 1212 bp, Panicum virgatum
  misc_feature: Ceres CLONE 1829336
  misc_feature: Encodes the peptide sequence at SEQ ID NO. 5976
aaactgattttttttataaatagacaaaaggagctccctttgtttcctgtccatttgcctctagtcgtcttccgccggcgccgccgatggcttcctccatggccgccgcctgcaccgccgccgcggcctctctctcaccggcgcagtcgacgaaccagaggacgcctgccaagggtcgcctcctcttccccggcgcgccccccagttcccgctccctccggctccaccccgccggccgccgctcgccggcgacccgctcctcgcgtcgggcggccaaggctgtggtggcagcgttggctgaccctctcaaggtcatgatagcaggagctcccgcgtcaggcaagggcacgcaatgtgagctcatcaaggccaaatttggtctggtgcacatctctgctggagatttgctacgggcggagatcgctgctgggtccgagaatgggaagcaggccaaggaattcatggagaagggccagctggtgcctgatgagattgtagtcaatatggttaaggaacgccttctgcaaccagatgctcaggaaaacggttggctattggacggttacccaagaagctattcacaggccatggcgttggaaactcttggaatccggcctgatattttcgttttgttagatgttccagaagaactccttgttgaaagggtggttggaagacgttctgatcctgtcacagggaaaatatatcatttgaagtattctccaccagagaatgaagaaattgcttcaaggcttacacaaagatttgatgacacagaagaaaaggtcaagttgaggctgcagacttattatcaaaatatcgactccttgctatcaacatatgaggatgttattgtcaaagtgaaaggagatgccaccaaggaagatgttttttctgagatcgacaagctgctgagctctagcctggacaagaaaacagaaattgtggccaacgcctgagccagtaaaatccatgcaggtcaggcatgtttatgcaagctcccttgcatgctaggaaaacttcttcatttggatgtggttgaaacatggggtttgcctggaattgtaccatgtgttgttgtacacgaatggaagtgacaggtcattcatagggatgaggacttcagagatcctttttaaccatacctgcgctgtacatggtttgtttccaacctgtacatgttatgtttctcaaaaaaaaaaaaaaaaaaaa

SEQ ID NO: 5976 - protein, 290 aa, Panicum virgatum
  misc_feature: Ceres CLONE 1829336
  misc_feature (1)..(180): Pfam Name: ADK Pfam Description: Adenylate kinase
  misc_feature (69)..(289): SWISSPROT Homolog: EC 2.7.4.3 Adenylate kinase, chloroplast
MASSMAAACTAAAASLSPAQSTNQRTPAKGRLLFPGAPPSSRSLRLHPAGRRSPATRSSRRAAKAVVAALADPLKVMIAGAPASGKGTQCELIKAKFGLVHISAGDLLRAEIAAGSENGKQAKEFMEKGQLVPDEIVVNMVKERLLQPDAQENGWLLDGYPRSYSQAMALETLGIRPDIFVLLDVPEELLVERVVGRRSDPVTGKIYHLKYSPPENEEIASRLTQRFDDTEEKVKLRLQTYYQNIDSLLSTYEDVIVKVKGDATKEDVFSEIDKLLSSSLDKKTEIVANA

SEQ ID NO: 5977 - DNA, 1577 bp, Panicum virgatum
  misc_feature: Ceres CLONE 1829354
  misc_feature: Encodes the peptide sequence at SEQ ID NO. 5978
atcgcacgatcgcacagctccacctccaccgttgcccctacctctcgagcgcacccggtctgaaacgacagttaatcaagagtcatggacaaggccgtggttctgtacccgagcctcggcgtcggccacctcacgccgatgcttcagctggccaagctgttcgtccggcacggcgtcgccgtcaccgtcgccctcgtcgagccgcaggtcgtgtcgcccagcttctccgccgcggtcgccctcgccgcggccaccaacccgtccgtcaccttccacgtgctgccgccgccggctccggcggacgaagccccgcgcgacatgtccgactacctccgcctcatggacgcgccgctgcgggacttgctccgctcgctcccggcggtccgcgcgctcgtgctcgacatgttctgcgccgggtcgctggacgtcgccgccgagctcggcataccggcctacttcttcttcgcctccggcgccagcttcctcgccgtcttcctcaacctgcccagcgcggtggccggcatggacaggcggagtttcgcggagctcggagacgcgcctttccgtctccccgtcgctcctccgttcaaggctacggatcttccccaagttatcctggacagcgacgaggccagcaaggccactcttcgcatgtccgagagaatcgcggggtccagcgggattcttatcaacacgtttgagccgctggaagctcgggcggtgcgtgatctcagagacgggcggtgcatccctggccgtcccacaccgccggtctactgcattgggccgttggtcgcggaaggcggcggcaacaagcacgcgtgcctcgagtggctggacgcgcagccggacaagagcgtcacgttcctctccttcggcagcctgggcaccttctccaagaagcagatccaggagatcgccgtcggcctggagaaatcggggcagaggttcctctgggtcctgcggagcccgctcggcaacgagcagagtattggccttggccacccgctccccgaccctgagccagacctcgacgcgctcctccccgaaggattcttggagagaacgaagcatcaggggctggtcgtcaggttctgggcgccgcaggtggaggtgctcggccacagggcgacgggtgcgttcatgacccactgcgggtggaactcgacgctggaagggatcatggcggggctgccgctgctgtgttggccgctgtacgcggagcagaggttgaacaaggtgttcatcgtggaagagatgaagctcggagtggcgctgaggggctatgacgaggaggtggtgaaggcagaggaggtggaggccaaggtcaggtgggtgatggaatccgagggaggaagggccctccgggagcgcgccacggctgagaagagcaaggccgtgcaagcactgagtgaaggaggctcatcccgtgctgctttcgttgagtttctaaataatctgtagaatttgaaccttgtatggtcccgcattcgtgattcttcgatttgtacccttacagtgttgaaaaatatttgagtttcattgtttgttggtttgaaaaaaaaaaaaaaaaaaaa

SEQ ID NO: 5978 - protein, 459 aa, Panicum virgatum
  misc_feature: Ceres CLONE 1829354
  misc_feature (3)..(138): Pfam Name: UDPGT Pfam Description: UDP-glucoronosyl and UDP-glucosyl transferase
MDKAVVLYPSLGVGHLTPMLQLAKLFVRHGVAVTVALVEPQVVSPSFSAAVALAAATNPSVTFHVLPPPAPADEAPRDMSDYLRLMDAPLRDLLRSLPAVRALVLDMFCAGSLDVAAELGIPAYFFFASGASFLAVFLNLPSAVAGMDRRSFAELGDAPFRLPVAPPFKATDLPQVILDSDEASKATLRMSERIAGSSGILINTFEPLEARAVRDLRDGRCIPGRPTPPVYCIGPLVAEGGGNKHACLEWLDAQPDKSVTFLSFGSLGTFSKKQIQEIAVGLEKSGQRFLWVLRSPLGNEQSIGLGHPLPDPEPDLDALLPEGFLERTKHQGLVVRFWAPQVEVLGHRATGAFMTHCGWNSTLEGIMAGLPLLCWPLYAEQRLNKVFIVEEMKLGVALRGYDEEVVKAEEVEAKVRWVMESEGGRALRERATAEKSKAVQALSEGGSSRAAFVEFLNNL

SEQ ID NO: 5979 - DNA, 1288 bp, Panicum virgatum
  misc_feature: Ceres CLONE 1829378
  misc_feature: Encodes the peptide sequence at SEQ ID NO. 5980
tccatccacaaggaatagccccggccccggccccggccccggccccggcatacagcaccatctgcatctccgatcacaaatccccaaccaccgcagctggtttcagcaatatacgagccgtcaacattgattttcaggagctcgcccaatggccagttggaggactttgggtagcttttgatcttttgagattgggtagcttttgatttggcgtcaagcaaagccgacgccaactcgcaaccaccatcaacatcaaaggaggcactttcctgtctgcaagccgcggcgccgagccagtcatgcgtatcttcgtgctctccggccagagcaacatggccggccgcggcggcgtgcaccgccggcgctgggacggcgtggtgccgccggagggcgcgccggacccgtccatccagcgcctctccgcggcgctggactgggaggaggcgcgggagccgctccacgccgacatcgacaccgccaagacctgcggcgtcgggcccgggatggtcttcgcccgcgccgtgctcccgtgcctgcaggagggcacctccgtcgagggggcccgggccgggaccgggattgggatcgggctcgtgccgtgcgccgtcggcgggacggccatccgggagtgggctcgcggggagcgcctgtacgagcagatggtgtgccgggcgcgcgtcgcggcccggtacggcgagatcgaggccgtgctgtggtaccagggggagagcgacgccgagtccgacgccgcagcggcggcgtaccgcgggaacatcgagaggctcatcgccaatgtcagggcggatcttgggatgccgcagttgccttttattcaggttgctcttgcatccggcgataaaaggaacattgagaaagtaagaagcgctcaatttagggttaacctacccaatgttgtaactgttgatgcaatgggtcttgcgttgaacgaagataacttgcatcttaccactgagtcacaagtaaagcttggtaacatgcttgcagaagcctacatcaagaacttcttaacaacgacttgttaggtgactgccattaggctgttccttcttcaatccacagtgaatatgtttgacaaaggcactgcagaacaagacagcaagacaattatgtgctcaagatcctaatcaaatgatattcgggaattcaccctagaggctcaaaactaatgtattaagtgtataatatttcaaattcagttcataacatttccctccatatataaagtaattgctacccgttgagtttctaaaaaaaaaaaaaaaaaaaa

SEQ ID NO: 5980 - protein, 247 aa, Panicum virgatum
  misc_feature: Ceres CLONE 1829378
  misc_feature: Great-hit functional homolog of the protein sequence encoded by LOCUS At4g34215
  misc_feature: Useful for making plants with altered cell wall content and/or composition
MRIFVLSGQSNMAGRGGVHRRRWDGVVPPEGAPDPSIQRLSAALDWEEAREPLHADIDTAKTCGVGPGMVFARAVLPCLQEGTSVEGARAGTGIGIGLVPCAVGGTAIREWARGERLYEQMVCRARVAARYGEIEAVLWYQGESDAESDAAAAAYRGNIERLIANVRADLGMPQLPFIQVALASGDKRNIEKVRSAQFRVNLPNVVTVDAMGLALNEDNLHLTTESQVKLGNMLAEAYIKNFLTTTC

SEQ ID NO: 5981 - DNA, 1242 bp, Panicum virgatum
  misc_feature: Ceres CLONE 1829391
  misc_feature: Encodes the peptide sequence at SEQ ID NO. 5982
aaaaatatctgaacgcgcggctgcgacgccgagccagtggtggtggcctatcatctccccgcgcgcgcgaacgttcccagctccaggagtccctccgagatggcgcccgcgcccgcggctgtcgcggcggcgcgcccgttgtctctcccttgcgcgtcgtccccgcggcagggacgccagggtcgcgcgtgctcgttccaccgcgccgcgccgagcgcgcgccccgccacactcgcgtcctctgaaccgggccgctgctcccggctccggcggcggccgctctgcagccaggccgaagtggcggcgggcgccaccgtcgacgacgacgaggcgtgcgagctggtgagcgggtcggacctcgtcatcggcgagggcgacgacagcgtccgcgcgcacctcttcagggccgtcaagaacaacaacggcacgggcatcctgctcctctccgacgtcttcggcttcgaggactccgccacgcgggacttcgcctaccgcgtcgcctgcaacggctacaatgtgctggtgccggacctgttccggggcgacccgtggaagccgagcgccccgttcgacgagggcggcttcgcgcggtggctggccgggcaggccccggcgcgggtgtcgggcgacatcgacgcgtgcacgaggtggctggtggacgaattcaaggcggcgggggtgtcgaggaggctgggcgtcgtcgggttctgctacggcggcgcccgcctcgtggaggcgctggcgcgcgacgcggacgccggcgagggcggccgctgcttcagcgcgggggtctgcttctacgggtcccggatggacgcgtccctgagcgcccgcctcgcggcgcccgtgctgttcgtgtgcggcgacggcgacccgctgtgccccgtggagacggtgcgggagctggagaggcgcgccgggggcgccatggccgcggtgtacgccggcaggggccacgggttcgcgcaccggccgcagtccgtggaggaggacgccgacgccgaggacgcgttcaacgccatgcgggggtggctgcacgaccacctgctcgcctgatcagccggcggtgcgtacatactaggtttgtcgaagatcggaatcaagcatgcgcgtaagagtttgcgagagtttttatttgtgtactgacgccgcaaaactgtagagtattgctaaaaaaacggtaaagacttcattgtagccagccgtaaatttgttcacctgcaaaaaaaaaaaaaaaaaaaa

SEQ ID NO: 5982 - protein, 318 aa, Panicum virgatum
  misc_feature: Ceres CLONE 1829391
  misc_feature (1)..(215): Pfam Name: DLH Pfam Description: Dienelactone hydrolase family
MAPAPAAVAAARPLSLPCASSPRQGRQGRACSFHRAAPSARPATLASSEPGRCSRLRRRPLCSQAEVAAGATVDDDEACELVSGSDLVIGEGDDSVRAHLFRAVKNNNGTGILLLSDVFGFEDSATRDFAYRVACNGYNVLVPDLFRGDPWKPSAPFDEGGFARWLAGQAPARVSGDIDACTRWLVDEFKAAGVSRRLGVVGFCYGGARLVEALARDADAGEGGRCFSAGVCFYGSRMDASLSARLAAPVLFVCGDGDPLCPVETVRELERRAGGAMAAVYAGRGHGFAHRPQSVEEDADAEDAFNAMRGWLHDHLLA

SEQ ID NO: 5983 - DNA, 1370 bp, Panicum virgatum
  misc_feature: Ceres CLONE 1829478
  misc_feature: Encodes the peptide sequence at SEQ ID NO. 5984
gcgccacaacttcgccgcgccttctcctttttttttttttaggattgccgcgccttctcctcccccgtcacatactcacatccctacggcaagcgcacgccgcgtcgaccactctgtccccgtcgtcacggcgtcacactcgaacgcctccggctcgctccccctgactgggatatataggtgcgtgcgagctcgatcgagagtgcccgcttgatccatcgacgagcaccaccgcttgccagccgtgccaacccgggggttcagttcggtcaagcaacatggcgcatgattccgaccaaggcgccgcgcgcccgtcgcggcggagcggcggcgacgtcgccgacgacgctcccgcgccgcccaagtcggccgcggcgggcgccatgacgctcggcagcatcttcaccgtggcgggcatcctcctggtcttcgtcgtctttgcaatcgtcctcctctcgctccagtactgcttcaacgcctgggacagaggggagctctcggaagacgcgccgagcgcgcggcggcggcggcgccatggcggtagtggtcgtgggatccgggcgaggaccaggggcggcgtcgacccggagctgctgcgctcgctgccggtcacagtgtaccgcgcggcggctgcgggttccaagggggcggaggaggagggcgcggtggagtgcgccgtgtgcctcgcggagctcgaggacggcgaggcggcgcggttcctgccccgctgcggacacggcttccacgccgagtgcgtcgacacgtggctcgcgtcccacaccacctgcccgctctgccgcctcaccgtcgccaagcccgacgcgccgccgtgctcggcgcttctccctccggtgccgccggagcccgcgagctacgccgcttcgaccctgcccgccagcgtgctcctcggggtgcccgaccaaggcgcgggcaccatggccaccgacggggacgcgggcgcctccaccggcgccacgggagtcctggtgatccagatcccggagccggccgtgccggcgcctgctccgcccaacgccgccaagtcgccgggctcagctaggctgagatcgtcgttcaggaggctgtggagcttcggaaggcaaggggcgggggcgagctcctcctgctcatgcgccggtgccggcgaaggagccgacctggagcagggcgtcagcgttaccaccgaccggcaggagagccgcaccaatcttcagagctctctgtaatagcgcacatgtatattcagcatagcatttcttttagttttagaatatgtaaattcttttttatttattcttagatttcacgcttccttccgatgaattgttcatcgttctccgttcatccgtcaaaaaaaaaaaaaaaaaaaa

SEQ ID NO: 5984 - protein, 315 aa, Panicum virgatum
  misc_feature: Ceres CLONE 1829478
  misc_feature (1)..(42): Pfam Name: zf-C3HC4 Pfam Description: Zinc finger, C3HC4 type (RING finger)
MAHDSDQGAARPSRRSGGDVADDAPAPPKSAAAGAMTLGSIFTVAGILLVFVVFAIVLLSLQYCFNAWDRGELSEDAPSARRRRRHGGSGRGIRARTRGGVDPELLRSLPVTVYRAAAAGSKGAEEEGAVECAVCLAELEDGEAARFLPRCGHGFHAECVDTWLASHTTCPLCRLTVAKPDAPPCSALLPPVPPEPASYAASTLPASVLLGVPDQGAGTMATDGDAGASTGATGVLVIQIPEPAVPAPAPPNAAKSPGSARLRSSFRRLWSFGRQGAGASSSCSCAGAGEGADLEQGVSVTTDRQESRTNLQSSL

SEQ ID NO: 5985 - DNA, 1365 bp, Panicum virgatum
  misc_feature: Ceres CLONE 1829483
  misc_feature: Encodes the peptide sequence at SEQ ID NO. 5986
gtaccgcgccactccactgctccgccgcgccaggttccaggcttccagccgccgggaagcgtcgagccatgacctccgccgccgcgaaagtcgccgtcattggtggcggaatttcgggcgccgtgtgcgcgtcgctcctcgccgggcgcggcgtggccgtgacgctcttcgactccggccgaggcgccggcgggcgcatggcgcagcggagggaggtgatggaggacggcacggagcttcgcttcgaccacggtgcgccctacttcaccgtgaccaacgatgaggttgcccaggtcgtgggtgggtgggaggcgcgagggatcgtcgccgagtggaaggccatgttcgcatgctttgatcgggctaccggcaaattcactgacttcgagaaggagggatcaactaagaagtatgttggagtgccaggcatgaactcgatatgcaaatcactctgttcagaggatggtgtggtggccaaatttggtgtcactgttggcaagatggactggcttcaagataggagttcatggtcactagctagcttggatggaaaagatcttggcaatttcgattatgttgttgccaccgataagaatgtgggatcaccaagattttcggggttgactggaagaccaccgcctcttgacttgtcgctatttccacggctgtctgtaatggttcaagatatcccagttcgtccctgttttgctcttatggtagcattctcagagcctttggctatggtacctgttcatggtttctctttcaacaattctgattctctgagttgggccttttgtgatagtagtaagccagggcgtgcttgtgttcctcctaacagacaatcttgggtattgcactcgacagctgaatatgcttccaaggtaataaatcatattggcccacggaaaccttcagtagatgcacttgctaaggtggcagaggaattattcagggaattccaggcaacaggattgagcattccacaaccaatattcatgaaagctcacagatggggtggtgctttcccagccattgctataggtggagatgataaatgtgtttgggacaaaagcatgaaattggcaatttgtggagatttctgtgcaagtccaagtattgaaggagcggtccttagtgccatgagaggagcttcaaaaatcatgggatgtttaaactgtccatcagggttgtgacttgtgagttgtatatttaatcaactacaaccccctgcccccttctccaactctctgtatgtaattgttatacaaaataaagaatcaagctccaagaggagccctattgttttgttgaatgttttgttacaaaataataaataaaggcacatgaatctttctttgtcgg

SEQ ID NO: 5986 - protein, 375 aa, Panicum virgatum
  misc_feature: Ceres CLONE 1829483
  misc_feature (1)..(36): Pfam Name: Pyr_redox_2 Pfam Description: Pyridine nucleotide-disulphide oxidoreductase
  misc_feature (1)..(66): Pfam Name: Amino_oxidase Pfam Description: Flavin containing amine oxidoreductase
MTSAAAKVAVIGGGISGAVCASLLAGRGVAVTLFDSGRGAGGRMAQRREVMEDGTELRFDHGAPYFTVTNDEVAQVVGGWEARGIVAEWKAMFACFDRATGKFTDFEKEGSTKKYVGVPGMNSICKSLCSEDGVVAKFGVTVGKMDWLQDRSSWSLASLDGKDLGNFDYVVATDKNVGSPRFSGLTGRPPPLDLSLFPRLSVMVQDIPVRPCFALMVAFSEPLAMVPVHGFSFNNSDSLSWAFCDSSKPGRACVPPNRQSWVLHSTAEYASKVINHIGPRKPSVDALAKVAEELFREFQATGLSIPQPIFMKAHRWGGAFPAIAIGGDDKCVWDKSMKLAICGDFCASPSIEGAVLSAMRGASKIMGCLNCPSGL

SEQ ID NO: 5987 - DNA, 1359 bp, Panicum virgatum
  misc_feature: Ceres CLONE 1829495
  misc_feature: Encodes the peptide sequence at SEQ ID NO. 5988
acctcagacctcacaccgaacctgtcacgccgcccctccagcttcccccgctcgccgcgaagcccggggccggccgtggcaacggcggcggcaccgcaatggccacgccgcgcgcacgattcttggcctgcattgccgtggcgctcctcgcgccgccgtgcggggtggcggggcactcgcgcgggctgcggccggggcgcggcggcgcggcggcgccgttcccggtgaacgcgacgcgggcggagatgatcgagcggcagttcgtggagtgggtgcggtacatgggcggcctccggcacagcacgttccagcacgcgctcgcccgcgccttcccgtcctactcgctcgtcgtcgacaagaacccggcgttcggcgacttcacgaccatccaggccgccatcgactcgctcccggccatcaacctcgtccgcgtcgtcatcagggtcaaccccggcacctacacggagaaggtgaccgtctcgccgatgcgcgcgttcatcaccctggagggcgccggcgcggaaagcacgatcgtgcagtggggcgacaccgcggactcgccgacagggcccaaggggcggcccctcggcacgttcaactcggcgacgttcgccgtgaacgcgcagtacttcctcgccaggaacatcactttcaagaacacggcgccggtgccccaacctggcgcgacggggaagcaggcggtggcgctgcgggtgtcggcggacaacgcggcgttcgtggggtgcaagttcctgggcgcgcaggacacgctctacgaccactcgggccggcactactacaaggagtgctacatcgaaggctccgtcgacttcatcttcggcaacgcactctcgctgtacgaggactgccacgtgcacgcgatcgcgcgggactacggggcgctgacggcgcagaaccggcagagcacgctggaggacacggggttctcgttcgtcaactgccgggtgacgggctccggcgcgctctacctcggccgcgcctggggcagcttctcccgcgtcgtcttcgcctacacctacatggacaacatcatcatcccgcgcggctggtacaactggggcgaccccaaccgcgagatgacggtgttctacgggcagtacaagtgcacgggcccgggcgcgagctacgccggccgggtggcgtggtcgcacgagctcactgacgacgaggccaagccgttcatctcgctcagcttcatcgacggcaccgagtgggtcaggctgtaatcctagcttcgctgtagctcacggcacgcgacacccatgtaaaaaaaacagagggaggaagtatacaaatttagttgccattcgtcaactccaaaaaaaaaaaaaaaaaaaa

SEQ ID NO: 5988 - protein, 382 aa, Panicum virgatum
  misc_feature: Ceres CLONE 1829495
  misc_feature: Great-hit functional homolog of the protein sequence encoded by LOCUS At5g19730
  misc_feature (1)..(294): Pfam Name: Pectinesterase Pfam Description: Pectinesterase
  misc_feature: Useful for making plants with altered cell wall content and/or composition
MATPRARFLACIAVALLAPPCGVAGHSRGLRPGRGGAAAPFPVNATRAEMIERQFVEWVRYMGGLRHSTFQHALARAFPSYSLVVDKNPAFGDFTTIQAAIDSLPAINLVRVVIRVNPGTYTEKVTVSPMRAFITLEGAGAESTIVQWGDTADSPTGPKGRPLGTFNSATFAVNAQYFLARNITFKNTAPVPQPGATGKQAVALRVSADNAAFVGCKFLGAQDTLYDHSGRHYYKECYIEGSVDFIFGNALSLYEDCHVHAIARDYGALTAQNRQSTLEDTGFSFVNCRVTGSGALYLGRAWGSFSRVVFAYTYMDNIIIPRGWYNWGDPNREMTVFYGQYKCTGPGASYAGRVAWSHELTDDEAKPFISLSFIDGTEWVRL

SEQ ID NO: 5989 - DNA, 1097 bp, Panicum virgatum
  misc_feature: Ceres CLONE 1829558
  misc_feature: Encodes the peptide sequence at SEQ ID NO. 5990
gaccgtgaggcgtgagagaggagcgttccccccaaatctgccggcagcgatgtgcaccctggagcagcgcggccgcgtgttcgtcctgaccctcacgggcgacggcgagcaccgcctgggccacgcgctcatctcctccctccgctccgccgtcgccgccgccgcggaggccgcggcccgggcggggccgggggccgcgctcgtcaccgtcggcgagggccgctttttctccaacgggctcgacatcgggtgggcgggcgcctcccgcgcgcgcctcggggagctcgtcgacgcgctccgcccgctcgccgccgacctcctcgcgctccgtatgcccaccgtcgccgccgtcacgggccacgcctccgccggcggcttcctcctcgcgctctgccacgactaccgcctcatgcgcgccgaccgcggcgtgctctacatgagcgaggtcgacatcggcctgcccctcccgccctacttcgtggccgtgctccgcgccaagatcaccgccgccaacgcgctccgcgacgtcgtgctccggggcaggaagctcagggccgcggagggcagggagatgggcgtcgtcgacgccgtctaccactccgcggccgagacggcggccgaggccttcaagtttgccgagcagctcgcggcgaggaagtgggacggggccgtgtacgcgtccataagaatgtccatgtaccctgaggcctgcaggtcggttggaattgtcgaggagggtgacgaggagaagaggaagcacttcgcttccaagctctgacgccgtgtgattgtgattcgagtgagggtttctgtggtggagatcccttcccttcacgttctgtattggtacgtcggacagccattgacactatggataaatcagacaatatgtacatttgcaaaccttgtgattgtgagtttggttgcttgaaggtgggggactaaattcatgattctctccccaccttgctggaaaaatttcaatgtgcctgctagactatatagaactagtcaggctacgcgcgcctgtacaaaaaaacgtggacctaaaatattaatagaaagatattatctgttaaaaaaaaaaaaaaaaaaaa

SEQ ID NO: 5990 - protein, 242 aa, Panicum virgatum
  misc_feature: Ceres CLONE 1829558
  misc_feature (1)..(134): Pfam Name: ECH Pfam Description: Enoyl-CoA hydratase/isomerase family
MCTLEQRGRVFVLTLTGDGEHRLGHALISSLRSAVAAAAEAAARAGPGAALVTVGEGRFFSNGLDIGWAGASRARLGELVDALRPLAADLLALRMPTVAAVTGHASAGGFLLALCHDYRLMRADRGVLYMSEVDIGLPLPPYFVAVLRAKITAANALRDVVLRGRKLRAAEGREMGVVDAVYHSAAETAAEAFKFAEQLAARKWDGAVYASIRMSMYPEACRSVGIVEEGDEEKRKHFASKL

SEQ ID NO: 5991 - DNA, 1217 bp, Panicum virgatum
  misc_feature: Ceres CLONE 1830028
  misc_feature: Encodes the peptide sequence at SEQ ID NO. 5992
ctctgctcgactgctcccgttggcttcttcttccccacctcgcttccactcgcttgccgctccctccgatcaccggctgccccgtgctgagctcttctactacgcagagcgatgaacatcttgaaccagcccatcaaccccggcggccacccggtgttcccggcggccaaggaggccggccacctcacgccggcgtcggtgcgcttcgacggcgtgccggcgcagcccagcacggtagccgcggggcgctccagcgcgcagtacccgagatggcaggcgcagacgctgcgccgggccagcagctacgtcggcgccgaccacgacggggccaccgcggccgcgggcccggagcccgccccgttcaagccgccgacgctcgacttcctgcggtcgctcctggacaggagtagctgcagcgtgagctccgccttggcgggcggcgaggccatcgccccgccgccgcagctgctcgcgctgcgggtggtcgtgtcctccgcggtggagctggacgcgcgccagaccgagctcatcgcgcgcaagatgcgccggctcaccgggttcgtgaacctcacggtcgagaacgtcgtggacccgtccctgatcgccggcttcgtcatctgctacggcaccgacgactcccacgtcatcgacctcagcgtcaagggccagctcgccgcgctcaagaaccgcgtcgactccatcgaccagaccgcccacgggcacccgcacccctgtatccctgatcaaccgaactacacctgatgctctggagcaaggcgcgccatagctacaccgtgctacaagcctatagcagcactactatccccgtgatcatgacactatttatacaaccgaacgccatgctaacaacagttttccgatctaatgttgttgtaaatcgcgagaaacttagctactccctccctgctgagcctatatacatgtttgtatgctacacgaagtgttactgtatatgaagaatgccgaaacagcggcttctacggtgtactgtgctaaatgttgcgaagttgcagtttgtaagcgaggtggaggtgggttgcagctctgcaagtgtagagctggcagaggccgatgccatgggaactataggtaaatgctactgtatccaggagcaagtaattgtatttgtgagatgcagctaaagcttttatctatattcagcgttctgcattgatcaaaaaaaaaaaaaaaaaaaa

SEQ ID NO: 5992 - protein, 216 aa, Panicum virgatum
  misc_feature: Ceres CLONE 1830028
  misc_feature (1)..(73): Pfam Name: OSCP Pfam Description: ATP synthase delta (OSCP) subunit
MNILNQPINPGGHPVFPAAKEAGHLTPASVRFDGVPAQPSTVAAGRSSAQYPRWQAQTLRRASSYVGADHDGATAAAGPEPAPFKPPTLDFLRSLLDRSSCSVSSALAGGEAIAPPPQLLALRVVVSSAVELDARQTELIARKMRRLTGFVNLTVENVVDPSLIAGFVICYGTDDSHVIDLSVKGQLAALKNRVDSIDQTAHGHPHPCIPDQPNYT

SEQ ID NO: 5993 - DNA, 1280 bp, Panicum virgatum
  misc_feature: Ceres CLONE 1830046
  misc_feature: Encodes the peptide sequence at SEQ ID NO. 5994
aacagggcactcactgctcgcacccgcggcgcggtccagctggccaactcccaccagacgaggcagcacccgcgcggacgcaggcaccagcaccaccaagcgacccagccatgtcgtcgtcgtcggagcctcacgtggtggaggactgccgcggggtggtgcaggtgctgagcgacggcacggtgcggcggagcgcgggcgcgccgccgttcgcggtggagatcccggaggacgagtgcggcgtggagtggaaggacgtggcgtggacgcgggatcacggcgggctcaacgcgcgcctgtaccgcccgcggcacctgggcgcggccaacgacgcgcggctccccgtgctggcctacttccacggcggcggcttttgcttcgggtccgggcgctggccgtgtttccacgccgtctgcctccgcctggccgccgagctgcccgccctcgtggcctccttcgactaccgcctcgcgcccgagcaccggctccccgccgcgcaggacgacggcgccgcggccgtgcgctggctgctccgcctctcccccgccagcgacccctggctcgccgacgccgccgacctctcccgcttcttcgtcgccggcgactccgccggcggcaacgtcgcgcaccacgtcgccgccgggctcggccgcggcgggggcgccgtccgcggcgcggtgctcctggctccggccatgttcggcgaggcccggacgcggtcggagcgggagtgcccgcccgacgcgttcctcaccgtcgagacctgcgagaggtacatgcgcctcgcgctgccggaggaggaagggtggacgtgggaccacccggtgatcaacccggcggggccgctggcgccggcgctggacgccgtcgcgatggcccccgtgctcgtcgtcgccgggggcagcgaccttctcagggaccggaacagggagtacgcgccccggatgaaggaggagtggggcaaggacgtggagtacgtggagatcgccggcgccgggcacggcttcttccagctggacccgtggtccgagcacgccgacgaggtcgtcaggatcgtgcgccggttcgtcgtcgaccacatggactcctccgagtaggacgggcgagcgacctgacctggtctgccacgtgggtcatcatcaataatgggctttgctttcgcttcttgccctcaattattttcttcatcagggtggattgattgcgcggatttctcaacaaacccagtgagaattattttgtgtcggccatagagatccgaaaaaaaaaaaaaaaaaaaa

SEQ ID NO: 5994 - protein, 328 aa, Panicum virgatum
  misc_feature: Ceres CLONE 1830046
  misc_feature (1)..(223): Pfam Name: Abhydrolase_3 Pfam Description: alpha/beta hydrolase fold
MSSSSEPHVVEDCRGVVQVLSDGTVRRSAGAPPFAVEIPEDECGVEWKDVAWTRDHGGLNARLYRPRHLGAANDARLPVLAYFHGGGFCFGSGRWPCFHAVCLRLAAELPALVASFDYRLAPEHRLPAAQDDGAAAVRWLLRLSPASDPWLADAADLSRFFVAGDSAGGNVAHHVAAGLGRGGGAVRGAVLLAPAMFGEARTRSERECPPDAFLTVETCERYMRLALPEEEGWTWDHPVINPAGPLAPALDAVAMAPVLVVAGGSDLLRDRNREYAPRMKEEWGKDVEYVEIAGAGHGFFQLDPWSEHADEVVRIVRRFVVDHMDSSE

SEQ ID NO: 5995 - DNA, 1239 bp, Panicum virgatum
  misc_feature: Ceres CLONE 1830065
  misc_feature: Encodes the peptide sequence at SEQ ID NO. 5996
gtcagttccaccgtgccgtagagcggaacaggtcaggccaggccaccaccatccacccaagctcccgacgaggtcgacggcgatggcgtcggacggcgatggcggcggcgacggcctcgtctgcgtgacgggcggcagcggcttcatcggctcgtggctcgtccgccgcctcctcgaccgcggctacaccgtccacgccaccgtcaagaacctccaggacgagggcgagacgaagcacctccgggccctggacggcgcgggcgcgcggctctggctgttccagatggacctcctcgacccggcctccgtgcggccggcggtcgagggcgcccgcggcgtcttccacctggcctcccccgtcatactgcaccctacgcaggaccccgagaaggagctggtggagcctgcggtggagggcacgctcggcgtcctccgcgccgccaaggactgcggcgtcggccgcgtggtcatggtgtcgtcgcagacggccatggtgcccaaccccaggtggccggcggacaaggtcgtcgacgaggattcctgggccgacgtcgacctgctcaaggaactcaagctttggtacagcgtgtccaaaacactggcagagaaggctgcgtgggacttcgctgagaagcaggggttgcagctcgcggtgctgaatccagtgctggtgttgggcccgacattgacgccgtcgattaccggtagtctccaagtatttctgcagattatgaagggccagaggttcgacatggacgagtacttccttggctgcgttgatgtccgggacgtggcgcagtctctcgtagccttgtatgagagctcgtcggcacagggacgccacttgtgcgtggagtccattgaacggatggttgatttcaccaacaaacttgccgacctttatcctgaacttccggttcaaaaaatccaagaggacaaacaggagtgggtggtcagggcaaaggacccatccaagaaactgatcgaattgggtgttcgtttcattccatccgaccaaatcatcatggacactatggattgctttaggagcaaaggactcatctagctcttcatgtcgatttcctcatggaaaaatagcccatctaggtcgaatgcgatggtggatcaaaactgctgctgttaattaaaaaaaagtgctgctgtatgtaagttttctagtcgaaaataaactggcaggacacatgagtatctctctgcgaaaaaaaaaaaaaaaaaaaa

SEQ ID NO: 5996 - protein, 327 aa, Panicum virgatum
  misc_feature: Ceres CLONE 1830065
  misc_feature (1)..(253): Pfam Name: Epimerase Pfam Description: NAD dependent epimerase/dehydratase family
MASDGDGGGDGLVCVTGGSGFIGSWLVRRLLDRGYTVHATVKNLQDEGETKHLRALDGAGARLWLFQMDLLDPASVRPAVEGARGVFHLASPVILHPTQDPEKELVEPAVEGTLGVLRAAKDCGVGRVVMVSSQTAMVPNPRWPADKVVDEDSWADVDLLKELKLWYSVSKTLAEKAAWDFAEKQGLQLAVLNPVLVLGPTLTPSITGSLQVFLQIMKGQRFDMDEYFLGCVDVRDVAQSLVALYESSSAQGRHLCVESIERMVDFTNKLADLYPELPVQKIQEDKQEWVVRAKDPSKKLIELGVRFIPSDQIIMDTMDCFRSKGLI

SEQ ID NO: 5997 - DNA, 1137 bp, Panicum virgatum
  misc_feature: Ceres CLONE 1830156
  misc_feature: Encodes the peptide sequence at SEQ ID NO. 5998
agcagaccaacaagcagcagcagtagcactgatcgagctggcagcacacacagcggcacatcccaccgaggaagaaaccatcgccgtcgcgtcagcgcaaccccaagaaaccaaagcaagcgaggcggcagctagccatggtgaagacggcggcggcgaagcacggcgcgaagaggacgtacaagggcgtgcggatgcggagctgggggtcgtgggtgtcggaggtgcgggcgccggggcagaagacgcggatatggttggggtcccactccaccgccgaggccgcggcgcgggcctacgacgccgcgctgctctgcctcaagggctccgcggccgcggcggacctcaacttcccgctccgcctcccgttcgacctgccgcccgccgccatgtcgcccaaggccatccagcgcgtcgccgccgccgccgcggccgggggcggcgcgggcttcgcggcgtgcgccgccgacaatgccgatagcgcgtgcagcggcaccaccccggcgtggagcggcggctcgcccagccgcagcgacgacgcctccgcggtcagctccctggagtccacggtgagcagcgagagcgagctgccggcggcccaccactacggcgacgccgacgccgacgccgacgcggactactacagctcgctcgccgacatcgacgccttcttccagtcgcccaagtgcatggagtacgccatgatggacccctgcagcgccttcttcgcgccggcgccggtggcggccgacgacgcctgctgggaggaggaaggcgacctcgcgctctggagcttctccactctcgactgctgaagcggcgtcagagaaatgggagccataattcagttactgaccaatcgccgatcaggtgaccaagaagaactccggtcatcgttggcacgaaaaagtatagttaaattccattatatatatatatatactatttgatcattcaaattcaatgtaaacaattgtaataagctaattatagtaattatgcattgtagggggagctctaatggagctccatgttttaaggtagcttccatggagttaacctccctacagttgcttgttatcagtattcagtaaagggcaaaaggcagctttattggaaaaaaaaaaaaaaaaaaaa

SEQ ID NO: 5998 - protein, 225 aa, Panicum virgatum
  misc_feature: Ceres CLONE 1830156
  misc_feature: Great-hit functional homolog of the protein sequence given in SEQ ID NO 9195
  misc_feature: Great-hit functional homolog of the protein sequence given in SEQ ID NO 9237
  misc_feature (1)..(66): Pfam Name: AP2 Pfam Description: AP2 domain
  misc_feature: The sequence is a functional homolog of  SEQ ID NO 182 in the  11/375,241 US patent application
  misc_feature: The sequence is a functional homolog of  SEQ ID NO 186 in the  11/375,241 US patent application
  misc_feature: The sequence is a functional homolog of  SEQ ID NO 2846 in the  10/374,780 US patent application
  misc_feature: The sequence is a functional homolog of  SEQ ID NO 96 in the  10/225,066 US patent application
  misc_feature: Useful for making plants with modulated flowering time
  misc_feature: Useful for making plants with modulated growth and phenotype characteristics
MVKTAAAKHGAKRTYKGVRMRSWGSWVSEVRAPGQKTRIWLGSHSTAEAAARAYDAALLCLKGSAAAADLNFPLRLPFDLPPAAMSPKAIQRVAAAAAAGGGAGFAACAADNADSACSGTTPAWSGGSPSRSDDASAVSSLESTVSSESELPAAHHYGDADADADADYYSSLADIDAFFQSPKCMEYAMMDPCSAFFAPAPVAADDACWEEEGDLALWSFSTLDC

SEQ ID NO: 5999 - DNA, 1500 bp, Panicum virgatum
  misc_feature: Ceres CLONE 1830164
  misc_feature: Encodes the peptide sequence at SEQ ID NO. 6000
gcccgccagcccgtccagtgcctctctgtctctgagcctcggcggcctctcaccaggcccagtaaaatatttgcccattccgccggcgagatggcccaccgccgcctgctcgtcctcgccgtcctcgccctcgcggccaccgccgccgcggccgagcccggcttcgccgagtccaacccgatccgccccgtcaccgaccgcgtggcctccgcgctcgactccaccgtcctcgccgcgctcggccgcacccgcgacgccctccgcttcgcgcgctacgccgtcaggtacggcaagagctacgagagcgtggcggaggtccacaagcggttccggatcttctccgagagcctcgagctcgtccggtccacgaaccggaagggcctcccctaccgcctcggcatcaaccgctttgcggacatgagctgggaggagttccgcgcgacccggctcggcgccgcgcagaactgctccgccacgctcgccggcaaccaccggatgcgcgccgccgccgcgctcccggagacgaaagactggagggaggatgggatcgtgagcccagtgaaaaaccagggccactgtggatcctgctggaccttcagcactactggtgcacttgaggctgcatacacccaggcaactggtaagcccatctctctttctgagcaacaacttgttgactgtgctggcgcatacaacaatttcggatgcaacggaggccttccgtcccaggcctttgaatacatcaaatacattggtggccttgacactgaggaatcttacccttacaagggtgtaaatggactctgccatttcaaggcttcaaatgttggagtcaaagttttggactcagttaacatcaccctgggtgctgaggatgaactgaaggatgctgttggtctggttcgccctgttagcgttgcctttgaggtgatcagtggtttcaggctgtacaagagcggagtttacactagtgatcactgtggaactactcctatggatgtgaaccatgctgttctggctgttggctatggtgttgaaaatggtgtcccctactggctcataaaaaactcatggggcgctgactggggtgacgagggttacttcaagatggaaatgggcaagaacatgtgcggtgttgctacttgtgcatcctaccctgttgtcgcggcatgaggcccacacggattgttgcatggtttgcttggcgtcaataacacatgtttagcctgagcatggtgatgggttatacaaataccctgttgtgaatagacaatagtgaaggaaatgaattagcccctgcttgtagccttgtacgtctctcccgtatggttgtgtatgtagattgtcagttggggctccaaactactcatacgtgtccacgctattctattgaggtgaatttgccattaaacatggtaccatatgcagattacagccgggacattgttatcatataataatgtaccatatgcagattatatatcatcatggtcatatctc

SEQ ID NO: 6000 - protein, 360 aa, Panicum virgatum
  misc_feature: Ceres CLONE 1830164
  misc_feature (1)..(216): Pfam Name: Peptidase_C1 Pfam Description: Papain family cysteine protease
  misc_feature (1)..(359): SWISSPROT Homolog: EC 3.4.22.16 Thiol protease aleurain precursor
  misc_feature (1)..(360): SWISSPROT Homolog: EC 3.4.22.16 Thiol protease aleurain precursor
MAHRRLLVLAVLALAATAAAAEPGFAESNPIRPVTDRVASALDSTVLAALGRTRDALRFARYAVRYGKSYESVAEVHKRFRIFSESLELVRSTNRKGLPYRLGINRFADMSWEEFRATRLGAAQNCSATLAGNHRMRAAAALPETKDWREDGIVSPVKNQGHCGSCWTFSTTGALEAAYTQATGKPISLSEQQLVDCAGAYNNFGCNGGLPSQAFEYIKYIGGLDTEESYPYKGVNGLCHFKASNVGVKVLDSVNITLGAEDELKDAVGLVRPVSVAFEVISGFRLYKSGVYTSDHCGTTPMDVNHAVLAVGYGVENGVPYWLIKNSWGADWGDEGYFKMEMGKNMCGVATCASYPVVAA

SEQ ID NO: 6001 - DNA, 1575 bp, Panicum virgatum
  misc_feature: Ceres CLONE 1830165
  misc_feature: Encodes the peptide sequence at SEQ ID NO. 6002
ggaggtaaaagaaatcccgggggaacacgtcggagccagcagtcgcggacgcgagcgagggaggcggaccacgctagaaccctctctgcggctctaccaacgcccccccccccctcctccgcctctccgtcggctcgtcgcctccgcccactcgacgccggccggcctaggggctcccgccgcatcgatgggggcgggcaccaatggcctggccaacggcgcggccaggggggagcgcgcgggggacgggactgcggtgttccggggcacggcctactcgccgctgccgaccgcggtggcgctcgcgctctggctcggggccatccacttcaacgccttcctcgtcctcgcctcgctcttcctcttcccgcgccgcgtcgccgcgctggtgctggccacgcagctcttcttcatgttcgtgcccgtcagtgacaggagcagattgggccgcaggatcgccaggttcataagcaggtacgtgattgggtattttcccgtcactttgcacgtggaggactacgacgccttcgatcccagcagagcttacgtgttcggttatgagcctcattctgttttgcccatcgctgtcgggatcctcggggaccttgttggattcatgccgctaccaaagacgaagattcttgcaagcagtgcggtgttctataccccattcctaaggcaaatatggacatggttggggttggctcctgcatcaaggaagagtttctactcctaccttggagctggttatagctgtattatagtgcccggaggtgtgcaggaaatacttcatatggatcacgattcagaggttgcttttcttaaatcaagaaaaggttttgttaagatagctatcgagatgggtagccctgtagtccctgtttttgctttcgggcagagttacgtatacaaatggtggagaccaggtggcaagttaattgtcaagattgccagagcaatcaaattttctccaatcatcttctggggcaaattgggaactcccatcccttttgctacaccaatgcatgtggttgttggaaggccaattgaggttgtaaagaaccctcaccctacccctgatgagataaatgaagtccacaagcaatttgtcgttgcgatgcaggagctatttgagaaatacaagaccagaactggataccccgatctccagttaagagttctatgatgacacgatgttccaaccaaaagttcttacgagcttggtttaaggcccatttttcaattcctcgtagcatttgagctataatgttttcaaccgaagatccctcatcagagttcagtagcaccaaatgtacaagtttgcaacagcagcttagctaggatgctgtgtggtattttggtgctctcgtggaatgcctcatgagacttggatgcaaagatacgcattggtttgcatctgtttactaacagaaaaacttagtagcagtatcaggttcattaaacctcgaagtctgcatgtgaagagaaaattatagttttggtaatggcatgttgacaaaagacctgaataacctgtacatatttcatttcgcacaaaaaaaaaaaaaaaaaaaa

SEQ ID NO: 6002 - protein, 332 aa, Panicum virgatum
  misc_feature: Ceres CLONE 1830165
  misc_feature (1)..(221): Pfam Name: DAGAT Pfam Description: Diacylglycerol acyltransferase
MGAGTNGLANGAARGERAGDGTAVFRGTAYSPLPTAVALALWLGAIHFNAFLVLASLFLFPRRVAALVLATQLFFMFVPVSDRSRLGRRIARFISRYVIGYFPVTLHVEDYDAFDPSRAYVFGYEPHSVLPIAVGILGDLVGFMPLPKTKILASSAVFYTPFLRQIWTWLGLAPASRKSFYSYLGAGYSCIIVPGGVQEILHMDHDSEVAFLKSRKGFVKIAIEMGSPVVPVFAFGQSYVYKWWRPGGKLIVKIARAIKFSPIIFWGKLGTPIPFATPMHVVVGRPIEVVKNPHPTPDEINEVHKQFVVAMQELFEKYKTRTGYPDLQLRVL

SEQ ID NO: 6003 - DNA, 1268 bp, Panicum virgatum
  misc_feature: Ceres CLONE 1830168
  misc_feature: Encodes the peptide sequence at SEQ ID NO. 6004
aaatctcatccccttcctcgtcactctcccttctctcccagacctccgcctccaatggcgcccatggccaccatttccgcgccgctcgccgcccgcgcctccccctccggcctcctctcgcaccggcgcaatggagccagagcaagccttggtctccgaggagtgaaatttgtatcacatggtgtttcttcagagcaggatgagaggatacgttgccattcttctctcaggcaaaacacaattgtagcttctgagaacgaaaatccaccattaatgccggcaatcatgactcctggtggccctcttgatctcgcaactgtactactgggaaatcgtgtaatctttattggtcaatatatcaactcccaggtggcacaacgtgtgatatcacagcttgtcacacttgccgctattgatgaagagggtgatattctgatctatctgaactgccctggtggaagtctctactccatcttagctatttacgactgcatgtcctgtataaaacccaaagttgggactgtgggctttggtgttgttgctagtcaagcagcaatcattcttgctggtggtgagaaggggatgcgctatgcaatgccaaatactagagtaatgattcatcaacctcaaggtggatcggagggtaatgtggaggaggtgaggcgacaggttggggaaaccatttatgctcgtgataaagttgataaaatgtttgctgccttcacggggcaaccattggatatggtgcaacagtggacagagagggatcgattcatgtcatcttcagaggccatggattttggactagttgatgccttactggaaacaagatactagcgagggtacacagacccacatcctccgaacagaacaaagacttggaaatgctgcggaattggagctggagttagatgtttgctatccactttgtttgacgactcagattcgccgtctaccactgattagagcttctgtacaatgtttagcttaggcctagatgatcctcgaggatcggagcaaactgttagcttgattgagccaagcctgtaggcgcacgcacaagtctgaggcccgccgcatacgctgtggcctgtggagccaaagcctgtaggcgcatctacacatcattcagatactgtggaacatgtggaagcaatactgtaatgctctcaatctgccagaaagctaacattggactgcataaacttggaaccagggaattttaataatgaggtactcttcttgcacaaaaaaaaaaaaaaaaaaaa

SEQ ID NO: 6004 - protein, 260 aa, Panicum virgatum
  misc_feature: Ceres CLONE 1830168
  misc_feature (1)..(180): Pfam Name: CLP_protease Pfam Description: Clp protease
MAPMATISAPLAARASPSGLLSHRRNGARASLGLRGVKFVSHGVSSEQDERIRCHSSLRQNTIVASENENPPLMPAIMTPGGPLDLATVLLGNRVIFIGQYINSQVAQRVISQLVTLAAIDEEGDILIYLNCPGGSLYSILAIYDCMSCIKPKVGTVGFGVVASQAAIILAGGEKGMRYAMPNTRVMIHQPQGGSEGNVEEVRRQVGETIYARDKVDKMFAAFTGQPLDMVQQWTERDRFMSSSEAMDFGLVDALLETRY

SEQ ID NO: 6005 - DNA, 1257 bp, Panicum virgatum
  misc_feature: Ceres CLONE 1830172
  misc_feature: Encodes the peptide sequence at SEQ ID NO. 6006
gtgcaagcgccctgctctcagtgaggctctcgctctgctctggagctccgagctgaggtgtcggattgttcgtgggtagcctgaagatgagggcggcggcggcggtgctggcggcgctgctgtgcgcgtcgtgggcggcggcggcggcggcgcagaagtacaatgccatcttcaacttcggcgactccatcaccgacaccgggaacctctgcaccaacgggaagccgtcgcagatcaccttcttccgctcgctggggctctccgacaggatctggaacaacgggcccatcagcttccagctccagtggttccagcagatcacctcctccgtctgcggacaggactgcaagagctacctgggcaactccctgttcgtgttcggcgagtttggcggcaacgactacaacgcgatgctgttcggcaactacaacacggaccaggcgagcacgtacacgccgcagatcgtgagcaccatcgccgccggcgtggagaagctggtggcgatgggggccaaggacgtggtggtgcccggggtgctccccatcggctgcttccccatctacctcaccctctacggcacctccagcagcggcgactacgacggcctcggctgcctcaagaagttcaacgacctctccaccaaccacaacagccagctcaaggcccagctcgccagcctccaggccaagtacccctccgcccgcatcatgtacgccgacttctactccggcgtctacgacatggtccggagccccggcagctacgggttcagcacggcgttccagacgtgctgcggcgccggcggcggcaagttcaactaccagaacagcgcgcggtgcgggatgtcgggcgcggcggcgtgctccaacccggcggcgcacctcagctgggacggcatccacctcaccgaggccgcctacaagcagatcaccgacggctggctcagcggcgcctactgcaacccggccatcctccacagctgaagcacgagagccgagagggagggaagggggcgatcaagatcgccccgttaaaatatttttattttttattgtcactattaattatctgcgtctgcgttgccggagaaaaaaaaggcgtctcgatcggcaacggcggcagcatgtggaataacaatctttatacaacatgttcgtcgttcctctccttgctgtaacctgtcaccggttttcaatcacaaatcgatcgaatggtataggttcagaggttcgcgttcaaaaaaaaaaaaaaaaaaaa

SEQ ID NO: 6006 - protein, 298 aa, Panicum virgatum
  misc_feature: Ceres CLONE 1830172
  misc_feature (49)..(295): Pfam Name: Lipase_GDSL Pfam Description: GDSL-like Lipase/Acylhydrolase
MRAAAAVLAALLCASWAAAAAAQKYNAIFNFGDSITDTGNLCTNGKPSQITFFRSLGLSDRIWNNGPISFQLQWFQQITSSVCGQDCKSYLGNSLFVFGEFGGNDYNAMLFGNYNTDQASTYTPQIVSTIAAGVEKLVAMGAKDVVVPGVLPIGCFPIYLTLYGTSSSGDYDGLGCLKKFNDLSTNHNSQLKAQLASLQAKYPSARIMYADFYSGVYDMVRSPGSYGFSTAFQTCCGAGGGKFNYQNSARCGMSGAAACSNPAAHLSWDGIHLTEAAYKQITDGWLSGAYCNPAILHS

SEQ ID NO: 6007 - DNA, 1462 bp, Panicum virgatum
  misc_feature: Ceres CLONE 1830231
  misc_feature: Encodes the peptide sequence at SEQ ID NO. 6008
cttggtcgcgacaaacttctcgcaggctttggcttgccttggatcttcgttcctccggtgtgcagctcacgccataccactgtgctgctgttctgtgcagtgctcacggcacggcacccatctccagctcggggcctttatatccgagagcctttttctggccccgtgataattttagagagagaagggaggacagagagggagagggagctgaggaggcatgggcatggagagtgaggagggcgccgcactttgtggccaccaagaatcggcggcggcggccgtgaagggaggaggagggggcggcaagaggaggaggaaggggcagaggagagggggagaagcaggcggggagaggaagaagtacaagctggtgagctaccacgagctgccggactacatgaaggagaacgagttcatcctcaactactaccgctccgagtggcccatcctcaatgccgtcctcagcctcttctcctggcacaacgagaccatcaacatctggacgcatctccttgggttcgtgctgttcttcggcctcaccctggtgcatctcggccagtacttcccccaggttgctgatctgattgggcacctttcctggccaatctcaaaggttgctgaaaatgtctccagcaacattggggatgtcttatcgggtgcggcgatgttcatccagacgaacccgaccctggcctcgtacggcatggcggtgacctcgcagacgacgcggtggcccttcttcgtgttcctcgccggcgccatgttctgcctgctgagcagcagcgcgtgccacctgctgtcgtgccactcgcaccggctgaacctgttcctgatccggctcgactacacgggcatcgccgtcatgatcgtggtctccttcttcccgcccatctactacatcttccagtgcgagccgcactggcaggtggcgtacctgtcggcgatcacggcggcgggcgtgggcacggtgtacgcgctcatgtcgccgcggctgagcgccgcccggtaccgcgcccaccgcgcgctgctcttcgtggggatgggcctgtcgggggtggtgccggcggcgcacgcggccgccgtgaactggcacgagcccgcgcggaacgtgacgctggcgtacgagggcgccatggcggtggcgtacctgacgggcacggccttctacctcacccgggtgcccgagcggtggaggcccggggcgttcgacctcgccggccacagccaccagatcttccacgcgctcgtcatcgccggcgcgctcgcgcactacggcgccgccatcgtgttcctcaaggcccgcgacgagatgggctgcccggcgtagcgccgccgccgccgccggaagagatcgttttctttcttttacagcttcactacttacagcagcagcagcagcagcaagtgtgcaatattgaaattattaccgtcttccgatgagtgacatttgattgtcgtt

SEQ ID NO: 6008 - protein, 369 aa, Panicum virgatum
  misc_feature: Ceres CLONE 1830231
  misc_feature (1)..(275): Pfam Name: HlyIII Pfam Description: Haemolysin-III related
MGMESEEGAALCGHQESAAAAVKGGGGGGKRRRKGQRRGGEAGGERKKYKLVSYHELPDYMKENEFILNYYRSEWPILNAVLSLFSWHNETINIWTHLLGFVLFFGLTLVHLGQYFPQVADLIGHLSWPISKVAENVSSNIGDVLSGAAMFIQTNPTLASYGMAVTSQTTRWPFFVFLAGAMFCLLSSSACHLLSCHSHRLNLFLIRLDYTGIAVMIVVSFFPPIYYIFQCEPHWQVAYLSAITAAGVGTVYALMSPRLSAARYRAHRALLFVGMGLSGVVPAAHAAAVNWHEPARNVTLAYEGAMAVAYLTGTAFYLTRVPERWRPGAFDLAGHSHQIFHALVIAGALAHYGAAIVFLKARDEMGCPA

SEQ ID NO: 6009 - DNA, 1445 bp, Panicum virgatum
  misc_feature: Ceres CLONE 1830259
  misc_feature: Encodes the peptide sequence at SEQ ID NO. 6010
aagggaaccgcacaggaccgtacgccggcggcggcgcaggaggcgcttacatgggagtagaggcgggcgggtgcgggcggagggcggtcgtcaccgggttctacgtctggggctgggagttcctaaccgccctcctgctcttctcggccgccgccgcgtcctgctagagcgccagcagctcccggccatcagcaaccttttagcttcttctttccatagatagggatggaatcggaagcggaggccgcggcggcggggcagccggcgtcgtcgaggcagagggcggccggcgggcccgcgccgttcctgaccaagacgcaccagatggtggaggaggcgtcgacggacgaggtgatctcgtgggcggagcaggggcggtccttcgtggtgtggaagcccgtggacctggcgcgcgacctcctcccgctccacttcaagcactgcaacttctcctccttcgtccgccagctcaacacctacggtttccggaaggtggtgccggaccggtgggagttcgcgaacgacaacttccggcgcggcgagcaagccctcctgtccggcatccgtcgccgcaagtccaccacgccgcagccctccaagtccggcggcggcagcgccgtcgtgaacgtcgcgttcccgccgccgctgccccccgcgtctggcaccacgtccggcggcggcaacgagcgcagctcctcctcggcgtcgtcgccgccgctggccgacctcaccagcgagaacgagcagctcaagaaggacaaccgcacgctggcgaccgagctggcgcaggcgcgccggcagtgtgaggagctgctgggcttcctctcgcggttcctcgacgtccgccagctcgaccttgggctcctcatgcaggaggacgtccgggcggcggccggggacgcgcaccaccaccaccagcagcgccgcgcggcggccgacccgctggagcgcggcggcgaggaggggaagagcgtgaagctcttcggcgttctcctccaggacgccgcgaggaagaggggccggtgcgaggaggcggcggccaccgagcggcccatcaagatgatcagggtcggcgagccgtgggtcggcgtgccgtcgtcgggcctgggccggttcggcggtgagaactaaaaagtctggcctgcaactgatgcgcgccatggccggccgtcacattgccggkyttacggcgagcgcgtgccatgtatcgtgcaagstgaggttgatggtarsggtaattccatcagatgaaccaagtaaawcttgtaaatgcagaacacaagacwccggagactcgcgtwaggcgtgttaagaattaatcatggaatgctttarggataggaagattgaaagtagtagagaagagtaaaagggctacatcgagccccgtgtgttcagaatggaacattatcatttccaaataagaaacccatgattttttgttc

SEQ ID NO: 6010 - protein, 301 aa, Panicum virgatum
  misc_feature: Ceres CLONE 1830259
  misc_feature: The sequence is a functional homolog of  SEQ ID NO 194 in the  10/412,699 US patent application
  misc_feature: The sequence is a functional homolog of  SEQ ID NO 2278 in the  10/374,780 US patent application
  misc_feature: The sequence is a functional homolog of  SEQ ID NO 409 in the  11/479,226 US patent application
  misc_feature: The sequence is a functional homolog of  SEQ ID NO 782 in the  10/225,066 US patent application
  misc_feature: Useful for making plants with modulated growth and phenotype characteristics
MESEAEAAAAGQPASSRQRAAGGPAPFLTKTHQMVEEASTDEVISWAEQGRSFVVWKPVDLARDLLPLHFKHCNFSSFVRQLNTYGFRKVVPDRWEFANDNFRRGEQALLSGIRRRKSTTPQPSKSGGGSAVVNVAFPPPLPPASGTTSGGGNERSSSSASSPPLADLTSENEQLKKDNRTLATELAQARRQCEELLGFLSRFLDVRQLDLGLLMQEDVRAAAGDAHHHHQQRRAAADPLERGGEEGKSVKLFGVLLQDAARKRGRCEEAAATERPIKMIRVGEPWVGVPSSGLGRFGGEN

SEQ ID NO: 6011 - DNA, 1390 bp, Panicum virgatum
  misc_feature: Ceres CLONE 1830266
  misc_feature: Encodes the peptide sequence at SEQ ID NO. 6012
cttccttccttccttcctaaaaccggcgccgcaacgcagaacgcgcgagggtttccaccgccaccacctgccgcgttcgccgtcgcgccgtttccctcgtcccaattccaaaagcctccattgcggacctctcgcgtcccgtcccatcccatcccatcccatctcggagcatggccaccgcgacggagccggaggacgcgccgtccgcggccgggggcgctaaaggagaggccaacaggaagcggggcaatgagcagggacagggaggcgcagggtgcggtggcagcgggcagaagcggaagaagaaggaggtcttcatctacggcaactacaagaactactacggctaccggattgatcgtaatgttggtgaagatcctcgcctagaggcattcaacaggcagtggtttgaaaacaaggattgtctcgatattggatgcaaccagggcctggtaactattggcttagccatgaaatttaaatgtcgaagaatccttggagttgatattgattcaggcttgatcgagactgctaagtggaatctgcgaaggataacgcggcaggataaggtggctacaaaaaatactaacgctcaagaatcatcaaattccccatctcagagctctctaggcgaagtggcacctgaattgtcaaatgagaacaaacacaatgatctttttaaaattgtctcttttcgacgtgaaaattttgtagaacgtttggatggatgttcagaacaatatgacacaatactttgtttaagtgtgacaaaatggatccaccttaattggggtgattatggcctagttactttattcgtaaagatctggaggcttctgagaccgggtggggtttttatcatggagcctcaaccttggacttcatacaagagaaacagattagttttagaggttgcaaaagagaacttcaacaccatctgtatatacccagagaaatttcgggagatacttctagacaaggttggatttaggtcagtagagttgattatggacaaattggtgggtaccgtcactggtttcgaccgtcctatagaagtttaccacaaatgatgagaccggatcaaggattgtggcatcccctgcccaaatgcacatgccctaaccaaatgattaggtggagctttgaaatgctctccaactgattgggtacaacaagtacaacaaatgcaagctttgcatggtgctggattgcagaaggtaataatttagaggtcaaagtatcgagatggaagggtggtggtatgatgttgtgttcactacttttggggaatttgtgagtagacctgttcttgtataaaatgtataacagatacccttgtgctgatttttttttataaaaaaggcattccttggaaaaaaaaaaaaaaaaa

SEQ ID NO: 6012 - protein, 299 aa, Panicum virgatum
  misc_feature: Ceres CLONE 1830266
  misc_feature (1)..(42): Pfam Name: Methyltransf_12 Pfam Description: Methyltransferase domain
MATATEPEDAPSAAGGAKGEANRKRGNEQGQGGAGCGGSGQKRKKKEVFIYGNYKNYYGYRIDRNVGEDPRLEAFNRQWFENKDCLDIGCNQGLVTIGLAMKFKCRRILGVDIDSGLIETAKWNLRRITRQDKVATKNTNAQESSNSPSQSSLGEVAPELSNENKHNDLFKIVSFRRENFVERLDGCSEQYDTILCLSVTKWIHLNWGDYGLVTLFVKIWRLLRPGGVFIMEPQPWTSYKRNRLVLEVAKENFNTICIYPEKFREILLDKVGFRSVELIMDKLVGTVTGFDRPIEVYHK

SEQ ID NO: 6013 - DNA, 1331 bp, Panicum virgatum
  misc_feature: Ceres CLONE 1830323
  misc_feature: Encodes the peptide sequence at SEQ ID NO. 6014
gaattgtgggaagaagagaagaggacgacacaggagggggagggacgatgagcaacagcggcgccaacgcgatccccctcctcaccccctacaagatggggaaatttgatctttcccacagggtggttctcgcaccactgacaaggcagcggtcctatggcaatgttcctcagcctcatgccatactttattatcaacagaggacgactaaaggaggccttttgattgctgaggccactggagtgtcagacactgctcaagggtacaaagatactcctggcatttggacaaacgagcaagtggaagcatggaagccaatcgtacatggggttcatgagaaaggagggatatttttctgtcagatttggcacgttggaagagtatctaattccacttttcaacctaatgagcaggctccaatttcaagcactgataagccactaaaacctcaagtgagagccaatggtgtagatgtggctactttcacacctcctagacgattagagactgatgaaatcccttctatcataagtgatttcagggttgctgctagaaatgcaattgaagctggatttgatggtgttgaaatccatggagctcacggttacttgatcgatcagtttttaaaggaccaggtcaatgatcgcacagacaaatatggtggcagcttagagaaccgctgccgttttgcattagaagtagttcaagctgtagttgatgaaattggagctgacaaggttgggataaggctgtcaccttttgccagttacgcagaagcaccagattcaaacccagaagctctaggcttatatatggcaaatgctctgaataaatttggaatcctctattgccacgtggtggagccacggatggtaaaacttggtgaaaaaattgaaacaccctacagtcttcgtccaatgagggatgctttcaaaggaacatttattgttgctggaggctacaacagggaggatggaaataatgcaatctccaccaagtatgctgatttggttgcctatgggcgcatatttttgtctaatcctgacttgcctagaaggttcgaaatagatgctcctcttaacaagtacaacagagacacattttacatccctgatcctgttactggatatactgactacccatttcttccaacagatgtgtaaatgggcccttccagcgaaattatttttagattgatgagtggcttgttgttgtactgggaatataagaggaataaatcgttcagaatacctaattttcatgtgtatggacaaagcaatgtgatcattgcaatcaatattttaaaatattaaaaaaaaaaaaaaaaaaaa

SEQ ID NO: 6014 - protein, 371 aa, Panicum virgatum
  misc_feature: Ceres CLONE 1830323
  misc_feature (1)..(333): Pfam Name: Oxidored_FMN Pfam Description: NADH:flavin oxidoreductase / NADH oxidase family
  misc_feature (1)..(367): SWISSPROT Homolog: EC 1.3.1.42 12-oxophytodienoate reductase 1
  misc_feature (1)..(367): SWISSPROT Homolog: EC 1.3.1.42 12-oxophytodienoate reductase 2
MSNSGANAIPLLTPYKMGKFDLSHRVVLAPLTRQRSYGNVPQPHAILYYQQRTTKGGLLIAEATGVSDTAQGYKDTPGIWTNEQVEAWKPIVHGVHEKGGIFFCQIWHVGRVSNSTFQPNEQAPISSTDKPLKPQVRANGVDVATFTPPRRLETDEIPSIISDFRVAARNAIEAGFDGVEIHGAHGYLIDQFLKDQVNDRTDKYGGSLENRCRFALEVVQAVVDEIGADKVGIRLSPFASYAEAPDSNPEALGLYMANALNKFGILYCHVVEPRMVKLGEKIETPYSLRPMRDAFKGTFIVAGGYNREDGNNAISTKYADLVAYGRIFLSNPDLPRRFEIDAPLNKYNRDTFYIPDPVTGYTDYPFLPTDV

SEQ ID NO: 6015 - DNA, 1835 bp, Panicum virgatum
  misc_feature: Ceres CLONE 1830326
  misc_feature: Encodes the peptide sequence at SEQ ID NO. 6016
acgccggcgtcctccgtgcccctcaccggcacgcccgcctcccacgcgccgcgtgctccttgaagtgctcggcttgtgggatgcgccacctggtcctgctcctgccccgccgcctcctctcctccctcgccatggctcgcgcttcggtctcaagctccgcggcggcggccgcagccctcctacccttaaaccccgcccgcggcgggagccgcctcccttccctgctccccgcgcgccgcctccctgcccccgagagcggcggcgcgttcggcggcatctcgctccggtgctatgcagccgccgccgccgcggtggccgagcagggccgcatcaaggtccagaaccccatcgtcgagatggacggggatgagatgacgcgggtcatttggagtatgataaaggataagctcatcttcccgtatctggagctggatgtgaagtactatgatcttggaattctcaacagggacgccacccatgatgaggtcaccgtggagagtgcagaggctacattgaagtataatgtagctgttaagtgtgcaacaatcactcctgatgagactagagtcaaagagttcaaactcaagtctatgtggcggagcccaaatggcacaataagaaatattctaaatggcactgtttttcgcgaacccatcttgtgtaaaaacataccacgtatattgtctggctggaagaaacctatctgcataggaaggcatgcatttggtgaccagtatcgagcaactgatatgattattgatggtccaggaaagctcaagatggtatttgtgcctgagggagctgaggcggtggagcttgatgtctatgattttaaaggacctggtgtggcattatcgatgtacaatgtggacgagtctattagggcttttgccgagtcatctatggctatggcactttccaaaaggtggcctctttatctcagcaccaagaacacaatcctaaagaagtacgatggcagattcaaagacatcttccaggaggtatatgaagagagctggaaggagaagtttgaggagaactcaatatggtatgagcaccggttgattgatgacatggtagcctatgctgtgaaaagtgagggtgggtatgtttgggcgtgcaaaaactatgatggagacgtccagagtgatttcctggcccaaggttttggttctctgggtctgatgacatcagtgctgctgtcttctgatgggaaaacattagaggctgaggctgctcatgggactgtcactagacatttcaggctacatcagaaggggcaggagacgagcaccaacagtattgcctcaatatttgcttggactcgtggactagaacacagagcaaagctggataaaaatgataggctgctggatttcacacacaaacttgaatctgcttgtgttgagacggtggaatctggcaatatgacgaaggacctcgcacttcttattcatggccccaaggtatcaagggagttctacctgagcaccgaggagttcatcgatgctgttgctcagcaactgcgaggaaagattcagacaccagctgcagtgtaatcttgagctgagcctgaaaccgagtgagccagtttcgctgtgcattcggcgcacattttgaatggggagacaagatggatctcaaaccattttttttgtgggttaaagtgaaagtgtgaaacatttcatggttgggtaagtaacggtccaaagatcatcaaatccaaagcagcattgaacacaatatattgctagtttagccgtcagctatgttatttccaatttccagaattttatctgaccatattcttaagcataaaaaaaaaaaaaaaaaaa

SEQ ID NO: 6016 - protein, 492 aa, Panicum virgatum
  misc_feature: Ceres CLONE 1830326
  misc_feature (1)..(390): Pfam Name: Iso_dh Pfam Description: Isocitrate/isopropylmalate dehydrogenase
  misc_feature (83)..(486): SWISSPROT Homolog: EC 1.1.1.42 Isocitrate dehydrogenase [NADP]
MRHLVLLLPRRLLSSLAMARASVSSSAAAAAALLPLNPARGGSRLPSLLPARRLPAPESGGAFGGISLRCYAAAAAAVAEQGRIKVQNPIVEMDGDEMTRVIWSMIKDKLIFPYLELDVKYYDLGILNRDATHDEVTVESAEATLKYNVAVKCATITPDETRVKEFKLKSMWRSPNGTIRNILNGTVFREPILCKNIPRILSGWKKPICIGRHAFGDQYRATDMIIDGPGKLKMVFVPEGAEAVELDVYDFKGPGVALSMYNVDESIRAFAESSMAMALSKRWPLYLSTKNTILKKYDGRFKDIFQEVYEESWKEKFEENSIWYEHRLIDDMVAYAVKSEGGYVWACKNYDGDVQSDFLAQGFGSLGLMTSVLLSSDGKTLEAEAAHGTVTRHFRLHQKGQETSTNSIASIFAWTRGLEHRAKLDKNDRLLDFTHKLESACVETVESGNMTKDLALLIHGPKVSREFYLSTEEFIDAVAQQLRGKIQTPAAV

SEQ ID NO: 6017 - DNA, 1304 bp, Panicum virgatum
  misc_feature: Ceres CLONE 1830375
  misc_feature: Encodes the peptide sequence at SEQ ID NO. 6018
aacgagcacagatagccctcttgttcttgtattctctcgccgctcgctcgcgcgcgtcctggcagggaaatggccgccgccgccgccgcgggctgcctcgttccacagctgacgcccgcggcaagatcgaggcggcgatgctggccccggcggcgtctggtgctgcggtgcgccgccgccgccgcggcagacgggaggacgacgacggtgcagagcaaggccggggacgcgctggaggtgtgccgggtggtgaacggcatgtggcaggtgagcggcgcgtcgtggggccttgcggagccggcggcggccgtggacgccatgctccggtacgccgacggcggcctcgccacgttcgacatggcggacatatatgggccagcagaggatttgtatggcatgttcatcaatagagtcaggcgggagcgcccacctgagttgcttgaagaaatcaaggggcttacaaagtgggtgccgcctcccgttaagatgacaagaagttacgttgaggataatatcaataaatctaggaagaggatggatgttgctgcattggacatgttgcagttccactggtgggattacgcaaatcctggatatttggatgcactaaagcacatcacagacctgaaggaggaaggcaagataaagaccgtagctctgacaaacttcgatacagacagactgcaaataattctagaaaacggaatcccagttgttagcaaccaggttcaacattccatcgttgatatgcgccctcagcaaagaatggcagagctttgccagttaactggagttaaacttataacgtatggcacagtgatgggtggtcttttgtctgaaaagtttcttgacaccaacgtatcaataccttttgctgggcctcctctaaataccccatctttgcagaagtataagaggatggtcgatgcttggggtggctggagcttgttccagactttgctgcaaactttaaagaaggtatcattgaaacatggtgttcctatcgcaactgttgctgtgcgatacatactgaaccagacatctgttgcgggttccatggtaggtgtgagattgggactctccgagcacatcaaagacaccaacgccatattctcacttgaattggatgaagaggacatgaacagcatcaccgaggtatcgaagaagggaagaaatttgatggatattatcggggattgtggcgatgagtacagagcttagttcatgctgctgcttggttgatatacttgttgtgacggaactgccaaattaaaacaataattaagcgtaatggccgtcatttg

SEQ ID NO: 6018 - protein, 383 aa, Panicum virgatum
  misc_feature: Ceres CLONE 1830375
  misc_feature (1)..(312): Pfam Name: Aldo_ket_red Pfam Description: Aldo/keto reductase family
MAAAAAAGCLVPQLTPAARSRRRCWPRRRLVLRCAAAAAADGRTTTVQSKAGDALEVCRVVNGMWQVSGASWGLAEPAAAVDAMLRYADGGLATFDMADIYGPAEDLYGMFINRVRRERPPELLEEIKGLTKWVPPPVKMTRSYVEDNINKSRKRMDVAALDMLQFHWWDYANPGYLDALKHITDLKEEGKIKTVALTNFDTDRLQIILENGIPVVSNQVQHSIVDMRPQQRMAELCQLTGVKLITYGTVMGGLLSEKFLDTNVSIPFAGPPLNTPSLQKYKRMVDAWGGWSLFQTLLQTLKKVSLKHGVPIATVAVRYILNQTSVAGSMVGVRLGLSEHIKDTNAIFSLELDEEDMNSITEVSKKGRNLMDIIGDCGDEYRA

SEQ ID NO: 6019 - DNA, 1057 bp, Panicum virgatum
  misc_feature: Ceres CLONE 1830401
  misc_feature: Encodes the peptide sequence at SEQ ID NO. 6020
gcttggcatcgcggctcgcaaactccccatctccgcaaggcaagcgaacccggcggaaccgtcgccgagaagagaagaggagagacaaggtggagtaggccatgtccaacgtgcccgcctccctccgcgactcctccctcaccgtcttccgcctcgccatgtccagctccgacccctggcccttctcttcctgcctctagccaccagccgcctccgcctcgatcggcttcctctccctcctcctcctcttctagagcagcaggccgccgctcctcctcgcttcggttctcggggaggggctcggccgatcgatctggcctgcctggcggcaatcatcatgcacggcaagcaccaccaccagcagcagcagcagatggcgccggccgcggtggcgcccaaggggtgcgtgacggtgcgggtgggcgcggacggggaggagcagcgccggttttttgttccgctgggccacctcaagcacccgctcttcggcgcgctgctcgaggaggccgagcgcgagtacggcttccgccaccagggcgccatcgccatcccctgccgcgtcgaccgcttcgtccaggtcgagcacctcatcggccaggacctccacggcgccggcagcagcacctgcgcgcagcacctcgtcgacctcgacagcgccgccgccgccgccccgcaccaccaccaccaccaccaccacctgcacctgccgcgcttcgtcggctgcttccgcgcctgatgatgacctgaatcagttcgatcgaggtggctcctcgtgttgcttgattattagcttttggttttggctcgccctcccttgtctatctcgcgttggtttgtgagggttgatgtcgatcggtgtgaagcttaatttgcggcgagagccagggagggcggtgcatctagatgttggcgatgatgacgaaaaattgtgatgaggatgaactcaattgtaaagatctagagagatcctgttgatctttagccttagttttcccccccttaatatatatacttaatactttgctaatatgctccgcaaaaaaaaaaaaaaaaaaaa

SEQ ID NO: 6020 - protein, 132 aa, Panicum virgatum
  misc_feature: Ceres CLONE 1830401
  misc_feature (1)..(87): Pfam Name: Auxin_inducible Pfam Description: Auxin responsive protein
MHGKHHHQQQQQMAPAAVAPKGCVTVRVGADGEEQRRFFVPLGHLKHPLFGALLEEAEREYGFRHQGAIAIPCRVDRFVQVEHLIGQDLHGAGSSTCAQHLVDLDSAAAAAPHHHHHHHHLHLPRFVGCFRA

SEQ ID NO: 6021 - DNA, 1187 bp, Panicum virgatum
  misc_feature: Ceres CLONE 1830415
  misc_feature: Encodes the peptide sequence at SEQ ID NO. 6022
agcgccgccgccgtgcgcctgaccccaagctcctgctccgggaggccgggagcaatgcgaggctcccgcccgggcggggccgctccggcgtccttggcccggagctccggctccggcttccacgccatgatctggccggcgacggcgaacaatccgagtcggatcggcctctcctccatcggagcagcccggcggcggccgtcccgcgccggcgacagggccacgggaggagtctgctacgcgagccaggcggtcgagctgctgccggccctgtgccccgagatcgtcgtccgggacgcgcggctcgaggactgctgggaagtggccgacacccactgcggctccttctttcccggctacaagttcccgctggacctcgtcctgcggatcgaccgctacattgccctgctgtccggattcacagtcccgcccgggtgcatgaggacgtgcctggtcgcggtcaattccaattctgtaaataacagcttcgacgtcgagtgtggagatgctggggatgccgattttcagaagtacgctctcagtagaggctccatagctggcatcctaacagttgacaccgtggcggactatcttccgaggaggggatccctcaaacagagaagaacaggtattgcatatatagcaaacgtcgcggtgcgaaaggaggaacggcggaaaggaatagctaaaatgttggtccaagaagcagaggcacgggcaaggagttggggatgccggtccatggcattgcactgtgatgtaaacaacatagctgccctacggctgtacaaaaaccaaggcttcaaatgcatccgtgtaccggaaggggctagatggcccgagcccaagatagctgaaggagtgcgatacagcttcatgatgaagctagtgcccaagacttgagcagtgtaagttctgatctgatcagcgatcaggaatagaaaaggtttaagtttgtagattctgcacagatgacagatgcaccatacacatgtacagcagttgttatatagtcgaggctactttgtaaatggtatataccagctacgtgttgttccaaagtggcgacaggcaagggtgaactaaaacatgttctcctgctcatgattagtaaagagggattgaattaccatattaatttggggtatcctttaagtcctcttttttaaaaaaaaaaaaaaaaaaaa

SEQ ID NO: 6022 - protein, 282 aa, Panicum virgatum
  misc_feature: Ceres CLONE 1830415
  misc_feature (3)..(96): Pfam Name: Acetyltransf_1 Pfam Description: Acetyltransferase (GNAT) family
MRGSRPGGAAPASLARSSGSGFHAMIWPATANNPSRIGLSSIGAARRRPSRAGDRATGGVCYASQAVELLPALCPEIVVRDARLEDCWEVADTHCGSFFPGYKFPLDLVLRIDRYIALLSGFTVPPGCMRTCLVAVNSNSVNNSFDVECGDAGDADFQKYALSRGSIAGILTVDTVADYLPRRGSLKQRRTGIAYIANVAVRKEERRKGIAKMLVQEAEARARSWGCRSMALHCDVNNIAALRLYKNQGFKCIRVPEGARWPEPKIAEGVRYSFMMKLVPKT

SEQ ID NO: 6023 - DNA, 1244 bp, Panicum virgatum
  misc_feature: Ceres CLONE 1830423
  misc_feature: Encodes the peptide sequence at SEQ ID NO. 6024
agcagccgcagtccaagcagcggaaggagcgagtcgtggaggggggtcggtgaagtgggaacgcgcgcggcgggagcggaggcgaggatggccgcggccgcggggaggaaggtggcggtcgccgccgtgcagttcgcctgcaccgacgtcgaggccgagaacgtcgccaccgccgagaggttgattagggaagcgcacaagaaaggtgcgaagattgtactcattcaggaattgtttgaggggcactatttctgtcaagctcaaaggatggatttctttcgtcgcgctaagccttataaaggcaacccaactatcataaggatgcaacagcttgcaaaggaattggaagttgtgatacctgtcagtttttttgaagaagcaaacaatgcccactacaattcagtggccatcattgatgctgatggcactgatcttggcctctatcgtaaatcacacattccagatggaccaggctatcaagagaaattttatttcaacccgggtgacactggctttaaggctttcaaaaccaagtatgcgacgattggtgttggaatctgctgggatcagtggttcccggagtgtgcaagagcaatggctcttcagggggctgaaatacttttctatcccactgcaattggatctgaacctcaggatggtaacctggactctcgtgaacattggaagcgtgtcatgcaaggccatgctggtgccaatttggttcctcttgttgcttccaaccggataggcagagaaactgttgagactgagcatggcaagagcgctataaccttctacgggaattccttcattgcaggaccaactggagaaatcgtgaagcttgctaacgacaaagacgaggaagtgctggtagcggagtttgacttaaacgagataaagtcaaccaggcatggttgggggatattcagggaccgccgccctgaattatataaagtgctattgacactagatggtgagaaataataacaaggtcaaactttagcgtgtgtatctatccttgaataggacgtgatgagctccacattattgggaaggcacaggctcctcgagtgttgccaccacatcgatggtagattttccctttccctgtccacatatgctttgcttgcatccgtacaagccacctgtgtgattcatgatattttaccattttcacatttcatgaataatattgtcatgcaatgcaacgcaatgttttgaccgaaaaaaaaaaaaaaaaaaaa

SEQ ID NO: 6024 - protein, 298 aa, Panicum virgatum
  misc_feature: Ceres CLONE 1830423
  misc_feature (1)..(174): Pfam Name: CN_hydrolase Pfam Description: Carbon-nitrogen hydrolase
  misc_feature (3)..(296): SWISSPROT Homolog: EC 3.5.1.53 N-carbamoylputrescine amidase
  misc_feature (5)..(298): SWISSPROT Homolog: EC 3.5.1.53 N-carbamoylputrescine amidase
MAAAAGRKVAVAAVQFACTDVEAENVATAERLIREAHKKGAKIVLIQELFEGHYFCQAQRMDFFRRAKPYKGNPTIIRMQQLAKELEVVIPVSFFEEANNAHYNSVAIIDADGTDLGLYRKSHIPDGPGYQEKFYFNPGDTGFKAFKTKYATIGVGICWDQWFPECARAMALQGAEILFYPTAIGSEPQDGNLDSREHWKRVMQGHAGANLVPLVASNRIGRETVETEHGKSAITFYGNSFIAGPTGEIVKLANDKDEEVLVAEFDLNEIKSTRHGWGIFRDRRPELYKVLLTLDGEK

SEQ ID NO: 6025 - DNA, 1640 bp, Panicum virgatum
  misc_feature: Ceres CLONE 1830468
  misc_feature: Encodes the peptide sequence at SEQ ID NO. 6026
gcgcggcctcccctccccttcgatccccgcccgtcggagcccctccctctcctctaccctcctcgtcctcgcctcctcacgcgcagacacgccaaaattctagggaacccccactaggcgcaccgccgcaccctagctaccgctctcgccctagctagatcgatacagctagctcgcggcagcggcagctagctcctgcgggtgccggccggcccagcagccgggccgcgctcaaaattcgcgcgcaccgccacgcggcgtctcgtgcccatgcggcggaccacgccggctcggcggcggacagcgggagcgccgcgccaccaccagtagcctcctgccggacacgggcgatccgccgctgcccgcgcgggcctatggatctggccgcatggcgggcttccctctaggaggcggcggaggaggagggcaccacggccgcggcggcggcgaccaccaccaccactacccccacgtcagcccttcctccggctccgactccgccgccgccgccgccgcggcatacctctacacgacggccgccgccgcgccccggggcggcgggttccagctctggccgcaccacccggtgcaggagcaccacttctacgcgcccaacatcatccgcttcgccgatgaccccgccgcgggctcctcatcctcgcgcggcgggaggggctccgcctccggcgccggcgccggcaccatcagctgccaggactgcggcaaccaggccaagaaggactgcgcccacatgcgctgccgcacctgctgcaagagccggggcttcgactgcccaacgcacgtcaagtccacctgggtgcccgccgccaagcgccgcgagcgccagcagcagcttgccaccggcgccgccgagccatccaagcgaccgcgcgacgccggcgcccagccttcgtccaccacagccacaaccacttcctcgggagagcagcagcagcagatggccatggtgggcgagcggtacccacgggaggtgagctcggaggcggtgttccgctgcgtgcgcctgggccccgtcgacgaggcctacgccgaggtcgcgtaccagaccaccgtcagcatcgccggccacgtcttcaagggcatcctgcacgacgtcggcccggacccgtccgccgcggccgccggcggcttccgccacgccgccgaggggtcctccccgagcacggccgcggcgggcgaaggcagcgtcgcggggcccgtgtcgtcatcggctgtggtcatggacccgtacccgacgcccggcccctacggcggcccgcccttcttccacggccatccgaggtgatcagacggccacacctcgattgacggctagctcttcattattccctttagacacatgttgatcgatcgccttccaatccatgtcttgatgatattattttgcttatttactagaagtattatctcatcatcatcatcacctctaaaattgtcagtagattttccttaccttcttgatcgatctcttcccgttctcaattaatgatgcataaactgatgagctggtcttcactgtttcgttactagtaggatcatactactgtagtagctatgccatcaggttactaaaagtatatataaagctttggactagctaaaaaaaaaaaaaaaaaaaa

SEQ ID NO: 6026 - protein, 305 aa, Panicum virgatum
  misc_feature: Ceres CLONE 1830468
  misc_feature: The sequence is a functional homolog of  SEQ ID NO 478 in the  10/666,642 US patent application
  misc_feature: The sequence is a functional homolog of  SEQ ID NO 972 in the  11/435,388 US patent application
  misc_feature: Useful for making plants with modulated growth and phenotype characteristics
MAGFPLGGGGGGGHHGRGGGDHHHHYPHVSPSSGSDSAAAAAAAYLYTTAAAAPRGGGFQLWPHHPVQEHHFYAPNIIRFADDPAAGSSSSRGGRGSASGAGAGTISCQDCGNQAKKDCAHMRCRTCCKSRGFDCPTHVKSTWVPAAKRRERQQQLATGAAEPSKRPRDAGAQPSSTTATTTSSGEQQQQMAMVGERYPREVSSEAVFRCVRLGPVDEAYAEVAYQTTVSIAGHVFKGILHDVGPDPSAAAAGGFRHAAEGSSPSTAAAGEGSVAGPVSSSAVVMDPYPTPGPYGGPPFFHGHPR

SEQ ID NO: 6027 - DNA, 1203 bp, Panicum virgatum
  misc_feature: Ceres CLONE 1830613
  misc_feature: Encodes the peptide sequence at SEQ ID NO. 6028
ggaacgcgtgcggcggcagagccccgcccacctgtcgagacgaggcttctccaagctgccaccgcggccgccggccgccggctgccccgcccctcttataacggattcgcccccggcgcgccagccagcgacatgtgcctcgccgcctcgtccgcctccccggcccgctgcctctcgctctcgccctcctccgccgcgctcccgcgccgcttcctccgcggcctgctcggcgcccccgcgaggccgtacccgtccccgccgccgccgccgccgacgacgacgactctgccgcggcgctgcatcccgttccaccggaaggcgcaatactggactcaaccatcactggacaagaacaaagctctggttgactacctaaaacagtatggtgccgttaggactgataaagtggctgaagtaatggaaacaattgatagagcgttatttgtgccagagggtaccccttacattgacagtcctatgccaattgggttcaatgccacaatatcagctccacacatgcatgcaacctgcttagaactactgaaggatcatttgcagccaggcatgcatgctctggatgtcgggtcaggtagtggctacttgacagcttgttttgcaatgatggttggaccagaaggccgtggggtgggaattgaacacatccctgaaattgttgcttctgctattgaaaatgtccaaaaaagtgctgcagctccactactgaaggatggatcgctctcttttcatgttgcagatggcaggcttggctttccagatgctgccccctacgatgcgatccatgtgggtgcagcggcacctgagatccctcagcctctgcttgatcagctgaagcctggtggtcggatggtcataccagtgggcacctacttgcaggacctgcaggtggtggacaagaacgccgacggatcgatcagcatccggaacgacgcctccgtgcgctacgtccctctgaccagccgctcggcccagttgcaagatccctgaaggccctactgttctagagtctagacctcgggatgtctgtatatatgatcccacattctcgctacgatgtggagcatcaagtttcttcttctgaataggtaggcagttttagttcgttgttggttaaccaataatgttgaagaacgtgtgctttctgcaataaaatgggttcccagccaaaaaaaaaaaaaaaaaaaa

SEQ ID NO: 6028 - protein, 290 aa, Panicum virgatum
  misc_feature: Ceres CLONE 1830613
  misc_feature (1)..(215): Pfam Name: PCMT Pfam Description: Protein- L-isoaspartate(D-aspartate) O-methyltransferase (PCMT)
  misc_feature (63)..(289): SWISSPROT Homolog: EC 2.1.1.77 Protein-L-isoaspartate O-methyltransferase
MCLAASSASPARCLSLSPSSAALPRRFLRGLLGAPARPYPSPPPPPPTTTTLPRRCIPFHRKAQYWTQPSLDKNKALVDYLKQYGAVRTDKVAEVMETIDRALFVPEGTPYIDSPMPIGFNATISAPHMHATCLELLKDHLQPGMHALDVGSGSGYLTACFAMMVGPEGRGVGIEHIPEIVASAIENVQKSAAAPLLKDGSLSFHVADGRLGFPDAAPYDAIHVGAAAPEIPQPLLDQLKPGGRMVIPVGTYLQDLQVVDKNADGSISIRNDASVRYVPLTSRSAQLQDP

SEQ ID NO: 6029 - DNA, 1159 bp, Panicum virgatum
  misc_feature: Ceres CLONE 1830622
  misc_feature: Encodes the peptide sequence at SEQ ID NO. 6030
agacttgtccaccatatcctcccctcccgaaccttgccgttcgttcctcccggtcccgccagaattctatctatccagagagcaccctgctttggcctccgactagcacagcctctgcttcggtctcatcgaagaaagagctccccggttggcgtgtcttggtcctggcctagctcggccggtcgtcatggtgagctacgccctcgccgtgcccaagccggtcgtcgccttctgccagctgctcggcgtcatcagggacgccttcctgctgatgctagccgtcgtggggctctggcccgtcccgcacggtgacggatcgcgcggccccgcggccgtgcccaagcccgcggaggtgaaggcccggctccccgccgtggcgtacggcgagctcgtggccgagcggttgctgtcgtcgccgccaccggtggcgtccccgggcggcgaggaggaggccgcggcggcgccgacgtgcatcgtgtgcctggagaatgtggaggcggggcacgaggtgcggcggctgggcaactgcgcgcacgccttccaccgcggctgcatcgaccggtggatcgaccagggccgggcgacgtgcccgctgtgccggtccgatctgctgccgcgcccgcgggcccgggcccggctggccagcctcctcacgcgcgtttggtgagaaggcccgcgggttcggtcctcttggtcttggagggcagttttgtcttttcgacgtacggccggaactcgatcgccgtcgcagcccatctctaggtggagccgccggaatggcgcggcgcggacaggttagcgacggcgacatggccgccgggcggtacaacggcggctctgctatcagccaaccattaatcatcaattggtggggcttaattggcagctgtttagctcgatccatctgacagttgatgatggtaatcgacctctcgaagaattatccggcaactaattaattaactcaatgaatattgtacatgcatagtgctatagtatcatcagccatatccattgtacacggacttctctctctccaccttctactattatgtatatatgtatgtaagacacgaataatatcgagggaccggacaggcgaccagaagtagattgaatgggagcctgaaattcgatccaaaaaaaaaaaaaaaaaaaa

SEQ ID NO: 6030 - protein, 159 aa, Panicum virgatum
  misc_feature: Ceres CLONE 1830622
  misc_feature (1)..(43): Pfam Name: zf-C3HC4 Pfam Description: Zinc finger, C3HC4 type (RING finger)
MVSYALAVPKPVVAFCQLLGVIRDAFLLMLAVVGLWPVPHGDGSRGPAAVPKPAEVKARLPAVAYGELVAERLLSSPPPVASPGGEEEAAAAPTCIVCLENVEAGHEVRRLGNCAHAFHRGCIDRWIDQGRATCPLCRSDLLPRPRARARLASLLTRVW

SEQ ID NO: 6031 - DNA, 1413 bp, Panicum virgatum
  misc_feature: Ceres CLONE 1830623
  misc_feature: Encodes the peptide sequence at SEQ ID NO. 6032
aacacgcttctgccaaagcagggtgcagcgtacaataccaccaccaccagcagcagcagcagcagcgagaggcggcggcgcagatgatggcccaggtgagcagcgcggtgccgttcctcccgacggcggcgccggaggcgacgctgcgcccgtcgttcgtgcgcgaggaggacgagcggcccagggtgccgcacgacagcttcagcgacgaggtgccggtgatatccctcgagggcatcgacggcggcggcggcgagcggcggggcgagatccgcgcgcgggtggccgcggcgtgcgagggctggggcatcttccaggtggtggagcacggcgtggacgccgcgctcgtggccgagatgacgcgcctggcgcgcgaattcttcgcgctgccgcccgaggagaagctccgcttcgacatgtccggcggcaagaagggcggcttcatcgtctccagccacctccagggggaggcagtgcaagactggcgtgagatcgtgacctacttctcgtacccggtggaggcccgcgactactcgcggtggcccgacaagccggcggcttggcgcgcggtggtggagcagtacagcgagcagctcatgggcctgtcctgcaagctcctgggcctgctgtccgaggcgatgggtctggacacggacgcgctggccaaggcgtgcgtggacatggaccagaaggtggtggtcaacttctaccccaagtgcccgcagccggacctcacgctgggcctcaagcgccacaccgaccccggcaccatcacgctgctgctgcaggacctcgtcggcgggctccaggccacccgcgacggcggccggacctggatcaccgtgaagcccgtcgagggcgccttcgtcgtcaacctcggcgaccacggccacttcctgagcaacggcaggttcaagaacgccgatcaccaggcggtggtgaactcggagtgcagccggctgtcgatcgcgacgttccagaacccgtcgccggacgcgacggtgtacccgctggccgtgcgggagggggaggcgcccatcatggacgagcccatcaccttcgcggagatgtacaggcgcaagatggcgcgcgacatcaagctcgccaagctcaagaagcaggccaaggccgagaagcagcagcagcagcagcagttgagcgctagcaaggagttggccgtgcccaagcccaagtctctcgacgagattcttgcctaaggcaattaaccgatccatttatctactattattggtgcgtgtgccgtgtggtgtggttcgtgtaaaagtatgtagtagctgtgagcgtatgggagtaataaggaaagggtcattttctgttgttcagactaaatataaatcctcgtatggtcatttacttacaattttgaccaatcaaaaaaaaaaaaaaaaaaaa

SEQ ID NO: 6032 - protein, 377 aa, Panicum virgatum
  misc_feature: Ceres CLONE 1830623
  misc_feature (1)..(102): Pfam Name: 2OG-FeII_Oxy Pfam Description: 2OG-Fe(II) oxygenase superfamily
  misc_feature (12)..(377): SWISSPROT Homolog: EC 1.14.11.9 Naringenin,2-oxoglutarate 3-dioxygenase
  misc_feature (2)..(377): SWISSPROT Homolog: EC 1.14.11.9 Naringenin,2-oxoglutarate 3-dioxygenase
MMAQVSSAVPFLPTAAPEATLRPSFVREEDERPRVPHDSFSDEVPVISLEGIDGGGGERRGEIRARVAAACEGWGIFQVVEHGVDAALVAEMTRLAREFFALPPEEKLRFDMSGGKKGGFIVSSHLQGEAVQDWREIVTYFSYPVEARDYSRWPDKPAAWRAVVEQYSEQLMGLSCKLLGLLSEAMGLDTDALAKACVDMDQKVVVNFYPKCPQPDLTLGLKRHTDPGTITLLLQDLVGGLQATRDGGRTWITVKPVEGAFVVNLGDHGHFLSNGRFKNADHQAVVNSECSRLSIATFQNPSPDATVYPLAVREGEAPIMDEPITFAEMYRRKMARDIKLAKLKKQAKAEKQQQQQQLSASKELAVPKPKSLDEILA

SEQ ID NO: 6033 - DNA, 1423 bp, Panicum virgatum
  misc_feature: Ceres CLONE 1830636
  misc_feature: Encodes the peptide sequence at SEQ ID NO. 6034
atcgcatcatagtccgatccagacaagaagaacgagctcttacagagtctaagccatggcgaagcgctggtgccttcgcttcgccacgctcctggcggcgctgctcccggccgccgcctgcctcgacttcggcttctacgacaggacgtgcccctccgccgaggccatcgtgcagcagaccgtcgccgccgcgttcaggaacgactccggcgtcgctccggcgctgatccgcatgcacttccacgattgcttcgtcagaggctgcgacggctcggttctgatcgactcgacgacgaatccgaacaacacggcggagaaggacgcggggcccaacaacccgagcctccggttcttcgacgtgatcgaccgcgccaaggcggccctggaggcgcagtgccccggcgtcgtctcctgcgccgacatcctcgccttcgcggcccgggacagcgtcgtcctcgccggcggcctcggctaccagctgccggccggccgccgcgacggccggatatcccgcgacacggacgcgctcaacgacctgcctccgcccttcttcaacgccacccagctggccgacagcttcgcctccaagaacctcaccgtcgaggacctggtcgtcctctccggcgcccactccatcggcgtctcgcactgcagcagcttcgccggcgtccccgacaaccccgccgaccggctctacaacttcagctcatcacctgacaagattgatccagcactgagcaaggcctacgcatttctgctcaagagcatctgcccgtccaacagcagccagttcttcccaacgacgaccacgctcatggacctcatcacgccggcgaggctcgacaacaggtactacgtcggcctgagcaacaacctgggcctcttcatatcggacgcggcgctgctgaccaacgcgacgatgaaggctctcgtcgactccttcgtgcgcagcgaggcgacatggaaggccaggttcgccaggtccatgctcaagatggggcagatcgaagtgctgaccgggacgcagggagagatcaggcgcaactgcagggtcatcaaccctagcaacgccactgccaccgctgctggcagtcaccctcaggttgccaacgaatcagcaggttcttcagggttcactggagtggctgcagaatgatgccgtccattgtgaacgatgtgtgacattgcaataagtaatgagcaggatcagccttggtagcttgcttgttacagggacagggagaaagacggcgtgatgatcactcttgcagcttgttctgagtcactttgctgttcatttgtgcatgtagcttcattgtgaggaagaagtggaataatctgtgcgactctgcgtctgtgccaaatattgttgccctatatatgctaatatgtatgctcatctcaaaaaaaaaaaaaaaaaaaa

SEQ ID NO: 6034 - protein, 366 aa, Panicum virgatum
  misc_feature: Ceres CLONE 1830636
  misc_feature (1)..(260): Pfam Name: peroxidase Pfam Description: Peroxidase
  misc_feature (21)..(335): SWISSPROT Homolog: EC 1.11.1.7 Peroxidase 39 precursor
MAKRWCLRFATLLAALLPAAACLDFGFYDRTCPSAEAIVQQTVAAAFRNDSGVAPALIRMHFHDCFVRGCDGSVLIDSTTNPNNTAEKDAGPNNPSLRFFDVIDRAKAALEAQCPGVVSCADILAFAARDSVVLAGGLGYQLPAGRRDGRISRDTDALNDLPPPFFNATQLADSFASKNLTVEDLVVLSGAHSIGVSHCSSFAGVPDNPADRLYNFSSSPDKIDPALSKAYAFLLKSICPSNSSQFFPTTTTLMDLITPARLDNRYYVGLSNNLGLFISDAALLTNATMKALVDSFVRSEATWKARFARSMLKMGQIEVLTGTQGEIRRNCRVINPSNATATAAGSHPQVANESAGSSGFTGVAAE

SEQ ID NO: 6035 - DNA, 1759 bp, Panicum virgatum
  misc_feature: Ceres CLONE 1830640
  misc_feature: Encodes the peptide sequence at SEQ ID NO. 6036
acaaaccacatcctctccattctccctagcttcctccaccaaaccttgccaagagagtacgtgacaagcaccgatctatatatcgattaattacaagtgagcatgcaagcagccccggtcatggcgagctccgatcagggttcgtccggcgccccgaagcccgtgccgggcagctacgggctgccggtgatcggcgccgtgcgggaccgcctggacttctactacttccagggccaggacaagtacttcgagtcccgcatcgagcgctacagctccaccgtcgttcgcttgaacgtgccgccgggcccgttcatggccaaggacccgcgcgtggtcgccgtcctcgacgccaagagcttccccgtgctcttcgacatggacaaggtcgagaagaagaacctcttcacgggcacctacatgccctccaccgacctcaccggcggctaccgcgtgtgctcgtacctcgacccgtccgagcccacccacaccaaggtgaagcagatgctcttcaacctcctgctctcccgcaaggacgaggtcatcccgaccttccgctccaatttctcctcgctcctcgccaccgtcgagtcggagctcgccaagtccagcaaggccgagtttaacaagctcaacgacgtcacgtccttcgacttcatcggcgaggcctacttcggcgtgcgcccctcgtccaccgacctcggcagcggcggcccggccaaggccgccaagtggctcatctggcagctccaccccctcgtcacgctcggcctccccatgatcctcgaggagccgctcctccacaccttccacctcccgcctttcctcgtcaagggcgactacaaggcgctgtacaagtactactcggccgccgggaagcaggtgctcgacatggccgagggcctgggcctgtcgcgggaggaggcctgccacaacctgctcttcgccacgacgttcaacagctacggcggcctcaaggtgctcttcccgggcctcgtggcgaacgtcgccggcgccggcgagaagctccacgagcggctggcggcggagatccgcggcgccgtggccgaggccggcggcaaggtgaccctggcggcggtggagaggatggagctgaccaagtcggtggtgtgggagtcgctgcgcctggacccgcccgtcaagttccagtacgggcacgccaagaaggacctggaggtcgcgagccacgacggcgtgttccaggtgaggaagggcgagatgctgttcgggtaccagccgtgcgccaccagggacgcccgcgtgttcggcgccacggcggggcagttcgtgcccgaccggttcgtcggcgacgagggccgcaagctgctgcagtacgtgtactggtccaacggccgcgagaccgagagccccagcgtcggcgacaagcagtgccccggcaagaacttcgtggtgctcgtcggcaggctcctcgtcgtcgagctgttcctccgctacgacaccttcaccgccaccgtcagcacggagctgctcggctccagcgtcgtcttcaccggcgtgaccaaggctacctccggccctggcagcagcgagcagtagatcgacctctcgatcggcccgcgcgcgggcggtaaatgtaaatcaatcttgctttgcttgaacccgcagtacttgcattgattggcgtggtttggaggcggcatgcaggtccctttcttaccgttcgtttgcctcctttgtatttgtaataataagattattattaaaaaaaaaaaaaaaaaaa

SEQ ID NO: 6036 - protein, 490 aa, Panicum virgatum
  misc_feature: Ceres CLONE 1830640
  misc_feature (13)..(482): SWISSPROT Homolog: EC 4.2.1.92 Cytochrome P450 74A, chloroplast precursor
  misc_feature (19)..(483): SWISSPROT Homolog: EC 4.2.1.92 Cytochrome P450 74A2
MQAAPVMASSDQGSSGAPKPVPGSYGLPVIGAVRDRLDFYYFQGQDKYFESRIERYSSTVVRLNVPPGPFMAKDPRVVAVLDAKSFPVLFDMDKVEKKNLFTGTYMPSTDLTGGYRVCSYLDPSEPTHTKVKQMLFNLLLSRKDEVIPTFRSNFSSLLATVESELAKSSKAEFNKLNDVTSFDFIGEAYFGVRPSSTDLGSGGPAKAAKWLIWQLHPLVTLGLPMILEEPLLHTFHLPPFLVKGDYKALYKYYSAAGKQVLDMAEGLGLSREEACHNLLFATTFNSYGGLKVLFPGLVANVAGAGEKLHERLAAEIRGAVAEAGGKVTLAAVERMELTKSVVWESLRLDPPVKFQYGHAKKDLEVASHDGVFQVRKGEMLFGYQPCATRDARVFGATAGQFVPDRFVGDEGRKLLQYVYWSNGRETESPSVGDKQCPGKNFVVLVGRLLVVELFLRYDTFTATVSTELLGSSVVFTGVTKATSGPGSSEQ

SEQ ID NO: 6037 - DNA, 1605 bp, Panicum virgatum
  misc_feature: Ceres CLONE 1830646
  misc_feature: Encodes the peptide sequence at SEQ ID NO. 6038
aaaccccactcgcgaatccaacaccaggacgcgtcgccactcgccacccctcgcatcacatgcgcgcataggacccggccgcaggtcgcactcaccaccatgccgcccccgctgctcgcctgtctcctccttctcctcgtctcggcgcggccgtggtccgtggcggccgaggcgccgaggcccgcggcgaggcctcgcgtgttcccgctgcgggcgcggcaggtgccggcgggggcgctgcctcggcggccgagcaagctgcggttccaccacaacgtcagcctcaccgtgtcgctcgccgtcggcacgccgccgcagaacgtcaccatggtgctcgacaccggcagcgagctgtcgtggctgctctgcgcgccgggccgccgcgcgaacgcgagcgcccccaggggcgcgtcgttccgcccgggggcctcgcgcaccttcgccgccgtgccctgcggctccgcgcagtgcagctcccgggacctgccggcgccgccgtcctgcgacggggcctcgcgccagtgccgcgtgtcgctgtcctacgcggacgggtccacctccgacggcgcgctcgccaccgacgtcttcgccgtcggcgacgcgccgccgctgcgctccgcgttcggctgcatgtcctccgcgtacgactcgtccccggacggcgtcgcgacggccgggctgctgggcatgaaccggggcacgctctccttcgtgtcgcaggccagcacgcggcgcttctcgtactgcatctccgaccgcgacgacgccggcgtgctgctgctcggccacagcgacctcccattcctgccactcaactacacgcccatgtaccagcccgccctgccgctcccctacttcgaccgcgtggcctactcggtccagctcctcggcatccgcgtcggcggcaagccgctgcccatcccggcgtcggtgctcgcgccggaccacaccggggccgggcagacgatggtggattccggcacgcagttcaccttcctgctcggggacgcctactccgccctgaaagccgagttcttgagacaaaccaagcccctcctcccggcggtcgacgaccccaacttcgcgttcgagcaagcgttcgacacctgcttccgcgtgcccgaggggcgcccgccgccgtcggcgcggctcccggcggtgtccctgctgttcaagggcgcggagatgtcggtggcgggggacaggctgctgtacaaggtccccggcgagcggcgcgggggcgacggcgtgtggtgcctcacgttcgggaacgcggacatggtgcccctgacggcgtacgtgatcgggcaccaccatcagatgaacctgtgggtggagtacgacctggagcgcggccgcgttgggctcgctcccgtcaagtgcgacgtcgccagtgagcggctcggcctgatgctgtgacgcggcttggcgagcggtcacggctctgggcctggaggaaccgtcgctgcggcgctgcttgtagtataaccttagggaaccaaacgggccctgtttggtttagagtagtactattagcacgaaaaagaatattgtatgcatgaagtactaaatgaaatttatttgtaaaaaaaaaaaaaaaaaaaa

SEQ ID NO: 6038 - protein, 439 aa, Panicum virgatum
  misc_feature: Ceres CLONE 1830646
  misc_feature (1)..(360): Pfam Name: Asp Pfam Description: Eukaryotic aspartyl protease
MPPPLLACLLLLLVSARPWSVAAEAPRPAARPRVFPLRARQVPAGALPRRPSKLRFHHNVSLTVSLAVGTPPQNVTMVLDTGSELSWLLCAPGRRANASAPRGASFRPGASRTFAAVPCGSAQCSSRDLPAPPSCDGASRQCRVSLSYADGSTSDGALATDVFAVGDAPPLRSAFGCMSSAYDSSPDGVATAGLLGMNRGTLSFVSQASTRRFSYCISDRDDAGVLLLGHSDLPFLPLNYTPMYQPALPLPYFDRVAYSVQLLGIRVGGKPLPIPASVLAPDHTGAGQTMVDSGTQFTFLLGDAYSALKAEFLRQTKPLLPAVDDPNFAFEQAFDTCFRVPEGRPPPSARLPAVSLLFKGAEMSVAGDRLLYKVPGERRGGDGVWCLTFGNADMVPLTAYVIGHHHQMNLWVEYDLERGRVGLAPVKCDVASERLGLML

SEQ ID NO: 6039 - DNA, 1464 bp, Panicum virgatum
  misc_feature: Ceres CLONE 1830716
  misc_feature: Encodes the peptide sequence at SEQ ID NO. 6040
cctgatttcttggtcttgcattggatgcatctataaatctctctagcttgccaggcagtgcaatacagtattgatcaggcaacacatggaggactcgacccagttcatgcagtgggccctgagtacgctgcagcacgagcagccgccgccgggaacgccggcgccggccgccgtcgcctacgacgatggctgcgacgacaccgtctcgtccatcccggtgctgcgatactcggcgtcggtggagagcatggtaccgggggagccaccagcacgggaaggcctgcgcgccagcaacagctggagctcagtggacaccgacagcgggagtggcggcggcagcggcggcggcgcgtccgccactgcctggtcgccgccgcagcacgcggccatgtgtgccgccacggcccccggcagctgcagtagcggcaccaaccagcagccaatgagctgggacttcaattccgcgtcggcgcagctaatcatagaagcccagccgaactctgccgccgccgcactgcaagcggagagcggggccggcggcggcggcggtgtcgccgtgccgcagttgacgcagcacggccgacgatcaccgccgacgaggagggcctctgccaagatctccgcgtcgtcttcgtcagcgccgtactcgcaggaccacatcatcgcggagcggaagcggcgggagaagatcaaccagcgtttcatcgagctctcgacagtcatccccggcctcaagaagatggacaaggcgacgatcctctccgacgcgacgaggtacgtgagggagctccaggaaaagctcagggcgctccagaaggacggcggcggcggcggcggcggcggcggccggggcatggagtcggcggtgctcggcagcaagaaggcgcgcattgcggcgccggacgacgatgaggacggcggcgcgcatcctaacgcggcaggtgggccagcggcgaccaggaacaacgcgctgccggagatcgaggtgaggatctcggagggcaacgccgtgatggtgacgatccactgccgggacgccaagggagtggtggtcaggtcgctggccgaggtcgaggggctgcacctcagcatcacgcacaccaatgtcgtgcagttctccgctgccgttctgatcataaacatcatggcaaaggtggagcagggcttcaacagcacagcagacgacattgtagggaggctcaacgcagcgctagcgtgtcacaagtagtagcccggccggaagaaacaaggaactgctagctgctaaagagctagcgccaaactttatcttcatcgaccgatctatgctgtgtgatgtcgccggtgtgtgtagcacaagtctatgatgacgagcagaccggcgtcccgtcgcatgtgtacttaattagcttccatgtatgatccaaaataaagtttcttcgttctgcacctaccacacatttggaatatacgcttgaacttctc

SEQ ID NO: 6040 - protein, 380 aa, Panicum virgatum
  misc_feature: Ceres CLONE 1830716
  misc_feature (1)..(50): Pfam Name: HLH Pfam Description: Helix-loop-helix DNA-binding domain
  misc_feature: The sequence is a functional homolog of  SEQ ID NO 1273 in the  10/666,642 US patent application
  misc_feature: The sequence is a functional homolog of  SEQ ID NO 1275 in the  10/666,642 US patent application
  misc_feature: The sequence is a functional homolog of  SEQ ID NO 1702 in the  10/374,780 US patent application
  misc_feature: The sequence is a functional homolog of  SEQ ID NO 1704 in the  10/374,780 US patent application
  misc_feature: Useful for making plants with modulated growth and phenotype characteristics
MEDSTQFMQWALSTLQHEQPPPGTPAPAAVAYDDGCDDTVSSIPVLRYSASVESMVPGEPPAREGLRASNSWSSVDTDSGSGGGSGGGASATAWSPPQHAAMCAATAPGSCSSGTNQQPMSWDFNSASAQLIIEAQPNSAAAALQAESGAGGGGGVAVPQLTQHGRRSPPTRRASAKISASSSSAPYSQDHIIAERKRREKINQRFIELSTVIPGLKKMDKATILSDATRYVRELQEKLRALQKDGGGGGGGGGRGMESAVLGSKKARIAAPDDDEDGGAHPNAAGGPAATRNNALPEIEVRISEGNAVMVTIHCRDAKGVVVRSLAEVEGLHLSITHTNVVQFSAAVLIINIMAKVEQGFNSTADDIVGRLNAALACHK

SEQ ID NO: 6041 - DNA, 1708 bp, Panicum virgatum
  misc_feature: Ceres CLONE 1830717
  misc_feature: Encodes the peptide sequence at SEQ ID NO. 6042
aatcgctgcgggggtctgcgccgccgctgccgctgtttccattgctctcctcgacctctccaccaatccccacctcgtccaaccgccgcacgcgaagatgctcgacatcaacctcttccgcaccgacaagggcggcaacccggacatcatccgcgagtcccagcgcagccggttcgcgcccgtcgagctcgtcgacgaggtcatcgccctcgacaaggcatggcgcgaaaggcagttcgagctggacaagatacgccaggagctcaacgccaccagcaggaagatcggcaagctcaaggctagcaagcaagaagaggaagcaaagaagctgatggagagcacggacgagattaagaagaggctggctgccaaggaagctgaggtgcaggaggctaagagcaccctcgacgccaagctcaccacgattggcaacatcgtgcatgcgtccgtgcccatcagcgacgacgagccacttccttatttgcaggcaaataatgccattgtacggacatggggagagaagagactggaggaaaatttgaagaatcacgtggatctttgcaggatgcttgacattgttgcattggagaagggtgctgacgtggctggtggtacgggttactatttgaaggatgaaggtgtcctcctgaacctggcattgataaatttcgggctagctttcctgagaaaacggggctttaatccaatgcaaactccttttttcatgagaaaggaaactatgggaaaatgtgcccagctggcacagttcgatgaggagctttacaaggtaacaggtgacggtgaggataaatacctcatagccacatctgaacagccattgtgtgcttatcatttaggtgaccgaatttaccctgctgagcttccaataaaatatgctggttactctacctgcttccgaaaagaagctggttcgcatggaagggacacagctggcatcttcagagtccaccaatttgaaaagattgaacagttctgtgttacaagcccaaatggcaatgattcttgggaggtgcatgaagagatgttaaaaaattcagaagatttctatcaggagattggcctaccatatcaggttgtctccattgtctctggtgcacttaatgatgctgcagctaaaaaatatgatttagaagcatggttccctgcatcgaaaacctttagagaattggtgtcctgttcaaattgcactgactttcaagcgaggaggcttggaattggttatggacagaaaaagaatgacgagcagtccaagcagtttgttcatatgctcaattctacgttgactgccactgagaggacactgtgttgtattctggaaaacttccagaaggaggatggtgttgaagtgccaaaggcgctgcaaccatacatgggtggaatagatttccttcctttcaagcaacctctggatgtcaaacaagctgctgactcgaaatcaaacaagtccaaatcaaagggaaatgctgcttgaggtggatgaggaacaagtcaaatgcatgcgatgcggaagtgatggacattgtgcatccttgtattaatttttggggagtaacagtacttatagcatgaccatgacgttgcaatttttctgtacccattttggtttcttggtttaccacaatatctgattgcgtacttgcacactgatattgcatagggtttcttgcaaaaaaaaaaaaaaaaaaaa

SEQ ID NO: 6042 - protein, 464 aa, Panicum virgatum
  misc_feature: Ceres CLONE 1830717
  misc_feature (1)..(440): SWISSPROT Homolog: EC 6.1.1.11 Seryl-tRNA synthetase
  misc_feature (1)..(459): SWISSPROT Homolog: EC 6.1.1.11 Seryl-tRNA synthetase
MLDINLFRTDKGGNPDIIRESQRSRFAPVELVDEVIALDKAWRERQFELDKIRQELNATSRKIGKLKASKQEEEAKKLMESTDEIKKRLAAKEAEVQEAKSTLDAKLTTIGNIVHASVPISDDEPLPYLQANNAIVRTWGEKRLEENLKNHVDLCRMLDIVALEKGADVAGGTGYYLKDEGVLLNLALINFGLAFLRKRGFNPMQTPFFMRKETMGKCAQLAQFDEELYKVTGDGEDKYLIATSEQPLCAYHLGDRIYPAELPIKYAGYSTCFRKEAGSHGRDTAGIFRVHQFEKIEQFCVTSPNGNDSWEVHEEMLKNSEDFYQEIGLPYQVVSIVSGALNDAAAKKYDLEAWFPASKTFRELVSCSNCTDFQARRLGIGYGQKKNDEQSKQFVHMLNSTLTATERTLCCILENFQKEDGVEVPKALQPYMGGIDFLPFKQPLDVKQAADSKSNKSKSKGNAA

SEQ ID NO: 6043 - DNA, 1174 bp, Panicum virgatum
  misc_feature: Ceres CLONE 1830758
  misc_feature: Encodes the peptide sequence at SEQ ID NO. 6044
aggcaaaggaagaacaacataatgggcggcagcgcggctgcggcggctctccttctggtggtggcagccagcgcggcggcgtgcgcggcgcagctccggcgcaactactacgcgggcgtgtgcccggaggcggagtccatcgtgcgcgacgccgtggcgaggaagtaccgggagaccttcatcaccgtgggcgccacgctgcacctcttcttccacgactgcttcgtcgagggctgcgacgcctccgtggtggtggcgtccacgcccaacaacaccgcggagaaggaccacccggtgaacctgggcctcgccggcgacggcttcgacaccgtcctccgcgccagggccgccgtcgacgccgtgccgcggtgccggggccgggtctcctgcgccgacgtcctcgccatggccgcccgtgacgccatcgcgctggccggcggcccgtcgtacgccgtggagctggggcgcctcgacgggctgcgctcggcggcgagcagcgtggacggcaagctggcgccgccgtcgttcgacctggaccagctcaccgcgctgttcgcctccaacgggctgtcgcggacggacatggtcgcgctctcggcggggcacacggtggggttcgcgcactgcggcacgttcgccgggcggatccgggggcccgcggcgccggacccggcgctgaaccggagcctggcggcgcggctgcgggcgtggtgccccgccggcgtcgacccgcgggtcgccgtgaccatggacgtggtgacgccgcgggtgttcgacaaccagtacttccggaacctgcgggacgggatgggcctgctcgcgtcggaccaggtgctatacacggacccgaggtccaggcccacggtcgaggcctgggcccagagcagcgaggcgttcagccgggccttcgtgacggccatcactaagatgggccggattggggtcaagacgggggcccaagggaacatccgccgcaactgcgcggtgctcgattgaagctgcttgccgtgtatgccaggtaggatgtaaacggatcggatacggacggatattactgatatcatatttgtttttatatttttattcgagtacggtgtcgaatatggatagtgctagtttttgccggataaaattggaatggatgtcgacattataaaaaaaaaaaaaaaaaaaa

SEQ ID NO: 6044 - protein, 324 aa, Panicum virgatum
  misc_feature: Ceres CLONE 1830758
  misc_feature: Great-hit functional homolog of the protein sequence encoded by LOCUS At4g37520
  misc_feature: Great-hit functional homolog of the protein sequence encoded by LOCUS At4g37530
  misc_feature (1)..(247): Pfam Name: peroxidase Pfam Description: Peroxidase
  misc_feature (10)..(324): SWISSPROT Homolog: EC 1.11.1.7 Peroxidase 50 precursor
  misc_feature (10)..(324): SWISSPROT Homolog: EC 1.11.1.7 Peroxidase 51 precursor
  misc_feature: Useful for making plants with altered cell wall content and/or composition
MGGSAAAAALLLVVAASAAACAAQLRRNYYAGVCPEAESIVRDAVARKYRETFITVGATLHLFFHDCFVEGCDASVVVASTPNNTAEKDHPVNLGLAGDGFDTVLRARAAVDAVPRCRGRVSCADVLAMAARDAIALAGGPSYAVELGRLDGLRSAASSVDGKLAPPSFDLDQLTALFASNGLSRTDMVALSAGHTVGFAHCGTFAGRIRGPAAPDPALNRSLAARLRAWCPAGVDPRVAVTMDVVTPRVFDNQYFRNLRDGMGLLASDQVLYTDPRSRPTVEAWAQSSEAFSRAFVTAITKMGRIGVKTGAQGNIRRNCAVLD

SEQ ID NO: 6045 - DNA, 1138 bp, Panicum virgatum
  misc_feature: Ceres CLONE 1830761
  misc_feature: Encodes the peptide sequence at SEQ ID NO. 6046
gaaggataagcaagtgatccatccagagccactgactggagcaagcaggcagaggaagctcagtcaggtactagcttctcttcatcagcaagatcctcgcgcgcgcgcgcggttgccagcccctagtccaagtcgccggccatggcagcgcagatgatgcagcctcggccccggccccgcggcagcctgatcagcaggttcaacgcccccatgtcgtcggggctgctccggccgcctcgtgccgccgcggccgccggcagcaccggctccgttcgtctgacggtgtcggatgcggagctggcgtcccgcgggttggcggtgcggcgcacggcggagggcatcgacgtggcggcgctgaacgaggtgttcgcgcgtgtggggttcccgcggcggcaggaggagcggctccggcgcgcgctggcgcacagccgcgtggtgtggctgtcggcggaggcggaggcggggcagccggtggcgttcgcgcgcgcagccggcgacggcgtgttcaacgcggtggtgtgggacgtggtggtggagccgtcgcggcaggggctggggctggggcgcgccgtcatggagcgcctcgtggacgagctgcgccgcgacggcgtcgccaacatcgtgctctacgcggagccccgggtggtgggcttctaccgcctcctcgacttcgccatggaccccgacggcatcagggggatggcatactacaggaaagcagcagccgcagcctcgtcctcggcggcggcggcccctaatactccattggcatcgctctgaaatctgaatcatcagttgaagtctgcttgcttgctcaatgctcatcatcaatcatgcatgtaccagcagtagctagtagtattaatttgtttcttggattcaggactagttcatgttgaaggcttgaagcagaagcagacatgcatgacacatctcatacatactcatgatgataagattgtatgtgataatacagtacaagcagaatagtaccaatcaaaattcacaatcacagcacacacttttgatggatggaattgtacagccagcacatttgaatttgatggatgtgatccggacattggaaataataaagcaaagcatcatcaaattaaaacaaaaaaaaaaaaaaaaaaaa

SEQ ID NO: 6046 - protein, 212 aa, Panicum virgatum
  misc_feature: Ceres CLONE 1830761
  misc_feature (1)..(77): Pfam Name: Acetyltransf_1 Pfam Description: Acetyltransferase (GNAT) family
MAAQMMQPRPRPRGSLISRFNAPMSSGLLRPPRAAAAAGSTGSVRLTVSDAELASRGLAVRRTAEGIDVAALNEVFARVGFPRRQEERLRRALAHSRVVWLSAEAEAGQPVAFARAAGDGVFNAVVWDVVVEPSRQGLGLGRAVMERLVDELRRDGVANIVLYAEPRVVGFYRLLDFAMDPDGIRGMAYYRKAAAAASSSAAAAPNTPLASL

SEQ ID NO: 6047 - DNA, 1353 bp, Panicum virgatum
  misc_feature: Ceres CLONE 1830771
  misc_feature: Encodes the peptide sequence at SEQ ID NO. 6048
atctgcagtggagtggagacttcgcagacccagaagaaaagggcggaggagatggaataaaaaaagagtgagcaggaggagcgcgcacacaccaagcaaaggaagagaagtgcagaggagaattcattcagatcaaaccaaggaatattttggtgcaacaacttgatatagagttcaagaccaaagaagcaatggaaagggaatcagctaccacatatgagccaaaaaggaacagtgaaataagggtttttgagagtttagatgagatttcaacagatctggctgagtatatcgcgcaaatttcagaaatttctgtcaaggaaaggggatactttgctattgccttatctggaggtcccctagtcagttttttggggaaactttgtgaggccccatacaacaagaccctggattggtccaaatggtacatcttctggtctgatgaacgagctgttgcaaagaaccacgcagagagcaactataagctaacaaaagaaggattcctcgccaaggtacctattcttaatggccatgtctactccatcaatgacaatgccacagtggaggatgcagcaaaagattacaagttcgtcatcaggcagctggtcaaggtccgcacaatcggcgtatcagagagcaacgactgccccaagtttgatctcatcctccttgacatgggctctgatggctatgtggcctccctgttccctaaccaccctgcccttgagctgaaagacgattgggtcacctacatcactgactccccgcagcctccacctgaaaggatcaccttcactctcccagtaatcaactcggcgtccaacatagcaatagtggctactggtgacgacaaggcgaaggccatgcacttagcagttttcgatggcactgaaggtcctgaggctcccgcattgctgcctgcaagaatggtcaagccaacagacgggaagctggtgtggttcctggacaaggctgcagcatcatcccttaaggctgacaaaggaagcgacgcctcctatgagcatcacgagtacttgccctgaagatccaaaggttatttcgccgttaacgagtggaggtatgtaacgtaagtaggcagtggtatgtaacgtaagtaggcggtgggatgtgatggaagatgcttggttgcccattttagctcgatatacttgtagtcttggcattaattttgtctgagggtctaagttccgggaaatgaaaaactgccccttggtccttttgcaatgaggttatttagagcgaagaaatgtgtatgcgatgtcgagagcaaaggatgagaacactggatttttaactgtggtcgtattgtggtaaaaaaaaaaaaaaaaaaaa

SEQ ID NO: 6048 - protein, 283 aa, Panicum virgatum
  misc_feature: Ceres CLONE 1830771
  misc_feature (1)..(240): Pfam Name: Glucosamine_iso Pfam Description: Glucosamine-6-phosphate isomerases/ 6-phosphogluconolactonase
MERESATTYEPKRNSEIRVFESLDEISTDLAEYIAQISEISVKERGYFAIALSGGPLVSFLGKLCEAPYNKTLDWSKWYIFWSDERAVAKNHAESNYKLTKEGFLAKVPILNGHVYSINDNATVEDAAKDYKFVIRQLVKVRTIGVSESNDCPKFDLILLDMGSDGYVASLFPNHPALELKDDWVTYITDSPQPPPERITFTLPVINSASNIAIVATGDDKAKAMHLAVFDGTEGPEAPALLPARMVKPTDGKLVWFLDKAAASSLKADKGSDASYEHHEYLP

SEQ ID NO: 6049 - DNA, 1333 bp, Panicum virgatum
  misc_feature: Ceres CLONE 1830811
  misc_feature: Encodes the peptide sequence at SEQ ID NO. 6050
gtgctcgcatcaccgcgcgccgccgcacgcctctcttccctctctcttcctccggatcaggaggagcaggtgggtgagtgagggatctctccgttgcaatggcggcgtgttctccatgggcaggggaccgccctcctgccctcgcgccgcggctcctcctcgtctccctcctcacgctcctcgccgaccgctgcggcgctgcccgggctggcggcaagggcagctcggtgtacccagcggccgtcgtgtacccgcaccactcgcgccagatctcctggaaacccagggtgttcctgtaccagaacttcctcagctacgacgaggccaaccacctcatctccctcgctagagcggagctcaagaggtcggcagtcgccgataacatgtctggcaagagcacgctcagcgaagtccgtaccagctccggcaccttcctcaggaaaggccaggatccaattgttgcgggtatagaggacaaaattgctgcatggacattccttccaaaagagaatggtgaagatatccaagtcctaagatataagcatggggagaagtatgaaccacactatgattacttcactgacaatgttaacactctccgtggtggtcatcgctatgctactgttcttttgtacttaactgatgtagaagaaggaggggaaacagttttccccttgggcgaggagtttgacgacgctaaagatgcaaccttgtcagagtgtgctcagaaaggcattgcagtgaaaccacgaagaggggacgccctccttttcttcaaccttagcccagatggcaccaccgattcagtgagcctccacgctggatgcccggtcataaagggcgagaaatggtcagctacaaagtggatccgcgtggcatcgtttgacaaggtacatcacacacgaggcaattgcaccgacgagaacgagagctgcgagaaatgggcagctctgggagagtgcataaagaacccagagtacatggtgggaaccgcagcgttgcccggttactgtcggaggagctgcaacgtgtgttagcaacttagcgtcaggatacgagaaagtgggctcattggaaccgtctaccttgactcaaggaacaggttacaccgagtttattcacaaggtttggcctagattctaccgttttattcttttgctgctcctgattatatactggttcttcagtggtaacgaggcaggagccgaaagacaactctttgttagtgcttaccacatagttgtatccacagtctatgctggatggagatgtattcagaacaagtttagtgcagtatgatttacttatttatcaaaaaaaaaaaaaaaaaaaa

SEQ ID NO: 6050 - protein, 312 aa, Panicum virgatum
  misc_feature: Ceres CLONE 1830811
  misc_feature (1)..(126): Pfam Name: 2OG-FeII_Oxy Pfam Description: 2OG-Fe(II) oxygenase superfamily
MAACSPWAGDRPPALAPRLLLVSLLTLLADRCGAARAGGKGSSVYPAAVVYPHHSRQISWKPRVFLYQNFLSYDEANHLISLARAELKRSAVADNMSGKSTLSEVRTSSGTFLRKGQDPIVAGIEDKIAAWTFLPKENGEDIQVLRYKHGEKYEPHYDYFTDNVNTLRGGHRYATVLLYLTDVEEGGETVFPLGEEFDDAKDATLSECAQKGIAVKPRRGDALLFFNLSPDGTTDSVSLHAGCPVIKGEKWSATKWIRVASFDKVHHTRGNCTDENESCEKWAALGECIKNPEYMVGTAALPGYCRRSCNVC

SEQ ID NO: 6051 - DNA, 1692 bp, Panicum virgatum
  misc_feature: Ceres CLONE 1830826
  misc_feature: Encodes the peptide sequence at SEQ ID NO. 6052
agtagaggcaacggggaacgcacgggcagatcgaggtaacagtcctaacccggcgctccgccgggcacaggaagcgttcgacggcatggcggaggcgcacgtgctggtgttcccatgcccggcgcagggccacatcaacagcatgctccccttcgccgcggcgctcctcgacgccggcgtctttgtcacgttcctccacacggaccacaacctccgccgcgcctcctccgtggccggctcgccgcgcctccgcttcctgtccgtcccggacggcctccccgacgaccacccgcgctcgctgggcgacatgatggagctcgaaaggtccctgcgggaggtgggcgccgtaaggtaccgcgctctgctcgcatccttgtcgtctgcaggcgcagggcgcccgagccaagacggcagcgacggcgtggatggcgaccgcagcttcccgccggtgacctgcgtcgtcgccgacggccttctaacttgggcgatggacgctgccgaggagctcggcgtgccggcgcttgccttccgcacgtccagcgcgtgcagcttcctggcctaccagaccgttcccgagcttgtcgagctcggcgagctccccttccctgaaggcggcgacctcgacgagccggtgcgcggcgttccaggcatggagagcttcctgcgccgacgggatcttccgagagtgtgccgccgtcgcggtggcaccggcggcgtcggcctcgaccccatcctgcacgtgttttccaaggcgaccgcgcatagccgcgaggtacgggcgctcgtgttcaacacgactgcctccctggagggggcggcgctcgcgcacatcgcgccacgcatgcgcaacgtgttcgccgtcggccctctccacgccatgtcggcgccggcgccggcgtccagcctgtggaccgaggacgacgggtgcctcgcgtggctcgacggccaggcagaccggtccgtcgtgtacgtgagcttggggagcctcgcggtcatcacgcacgatcagttcacggagttcctgtccggccttgccgccgccggctaccccttcctctgggtgctccggccggacatggtggcggcgagcaaagaccagcacgccactccccaggaagccatcggagcggttggagaggacaaggcccgcgtcgtggcgtgggcgccgcagcgggacgtgctgcggctccgcgccgtggggtgcttcctgacgcacgccgggtggaactcgacgctggaggccgccgtcgaggacgtgcccatggtgtgctggccgttcttcggggaccagctgatcaacagccggaacgtgggcgccgtgtgggggacggggctggacatgaaggacgtgtgcgacagggccgtcgtggagaggatggtgagggaggccatggagtccgccgcgatcaggagctcggcgcaggagctggcgcgtgtggtgaggcgggacgtcagcgatgggggatcatcggcgagggagtttgagcggctcgtcagattcatcaaggagatcaccatgggacgtgccaagtccgatcactaaaatcatggggcagggatgtacctatggtatatacgctcttggttgttcatatcccgtcgcgtgcttttgtacatatattcgtattgaactgtgcgctttatgttctttttatgataacttttaatgcgcaaaaaaaaaaaaaaaaaaaa

SEQ ID NO: 6052 - protein, 485 aa, Panicum virgatum
  misc_feature: Ceres CLONE 1830826
  misc_feature (1)..(137): Pfam Name: UDPGT Pfam Description: UDP-glucoronosyl and UDP-glucosyl transferase
MAEAHVLVFPCPAQGHINSMLPFAAALLDAGVFVTFLHTDHNLRRASSVAGSPRLRFLSVPDGLPDDHPRSLGDMMELERSLREVGAVRYRALLASLSSAGAGRPSQDGSDGVDGDRSFPPVTCVVADGLLTWAMDAAEELGVPALAFRTSSACSFLAYQTVPELVELGELPFPEGGDLDEPVRGVPGMESFLRRRDLPRVCRRRGGTGGVGLDPILHVFSKATAHSREVRALVFNTTASLEGAALAHIAPRMRNVFAVGPLHAMSAPAPASSLWTEDDGCLAWLDGQADRSVVYVSLGSLAVITHDQFTEFLSGLAAAGYPFLWVLRPDMVAASKDQHATPQEAIGAVGEDKARVVAWAPQRDVLRLRAVGCFLTHAGWNSTLEAAVEDVPMVCWPFFGDQLINSRNVGAVWGTGLDMKDVCDRAVVERMVREAMESAAIRSSAQELARVVRRDVSDGGSSAREFERLVRFIKEITMGRAKSDH

SEQ ID NO: 6053 - DNA, 1486 bp, Panicum virgatum
  misc_feature: Ceres CLONE 1830906
  misc_feature: Encodes the peptide sequence at SEQ ID NO. 6054
ttagcgggagctgggttcttcctccccgagcacgagcagccagtccggtgactccggtcccgtctctaaccctacagcgccgacgacgacgagggcatgagggggaagaagccgctcaaggatctcaagctctccgtgccggtgcaagagagccccgtcgacaagttcctgacggcgagtggtacattcaaggatggcgaactgcggcttaatcaaagcggcttgcggcttatctccgaggaaaatggggatgaagatgaatcaacaaagctgaaagtggaagatgtgcagttatcaatggatgatcttgagatgattcaagtcattggtaaaggaagtggtggtgttgtccagctagtgaggcacaaatgggtgggtacattgtatgccttaaagggtattcaaatgaacattcaggagtcagttcgcaaacaaatagtacaagagctcaaaataaaccaggcaacacaaagccctcatatagttctgtgccatcaatctttttaccacaatggtgtaatatatcttgttcttgagtacatggatcgtggatctcttgcagacatcattaagcaagtgaagacagttctggaaccataccttgcggtactctgtaagcaggtcttggagggtttattatatcttcatcatgaaaggcacgtgattcacagggacataaagccttctaacttgttagtcaaccgtaaaggggaagtcaagattactgactttggggtaagtgcggtgctagcaagctcaatgggtcagcgagatacatttgttggaacctacaactatatggcgcctgaacgtattagcggaagctcatatgactacaagagtgacatatggagtttgggcttagtaatacttgagtgtgccattgggcggttcccctatataccttcagaaggagaaggttggttaagcttttatgaactacttgaggctattgtcgatcagccaccaccttctgcacctgcagatcagttctctccagaattctgctcatttatctcctcctgcatacaaaaggatccagctcagcggatgtctgcttcggaactcttgaaccaccctttcttgaagaagttcgaggataaggatctagacctgcggggtcttgtggagaccctggaacctccaatgaatatacccgagtaaccctgtcgtcaaccttcagtgtgggtatgcgtgggcttttgttgtgttttcagggtcgtcctggcggacggccctcggcatcaggcatcagcgcatattctcctgaactgcaaccgccacgtgaacatgccagaacaccatcgtgtggtccaagtccacaggaatagagggaatcgtgcttcgttccttcttgtcgcctttattgtagctattgttgcgacgtgcgacgggccctgttattgtgaagtcgtgtgttacccttttttttttgtcttgtgagtaagggatgaattgaaatattcaaaaaaaaaaaaaaaaaaaa

SEQ ID NO: 6054 - protein, 355 aa, Panicum virgatum
  misc_feature: Ceres CLONE 1830906
  misc_feature (1)..(355): SWISSPROT Homolog: EC 2.7.12.2 Mitogen-activated protein kinase kinase 1
  misc_feature (4)..(352): SWISSPROT Homolog: EC 2.7.12.2 Mitogen-activated protein kinase kinase 6
MRGKKPLKDLKLSVPVQESPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVLEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRGLVETLEPPMNIPE

SEQ ID NO: 6055 - DNA, 1834 bp, Panicum virgatum
  misc_feature: Ceres CLONE 1830948
  misc_feature: Encodes the peptide sequence at SEQ ID NO. 6056
gcacactgtcacagtgagacaccgcgcgcagcgccagcgatggccatggacactgcgcaccgagaccacctcctcgccgcgctgcacggcgtcctcggcgccgccaccctcctcctctgcctcgccgccgagctcctcgtcttcgcgctccggcgccacgccgcgttctacctcgcccccgtggccgcgatgctcctctccggccacctccgccgccgcgccgcggcggcggagatcggcctcgtcgacttcgcgtgcctgaagccgccccggcggctgcgcatccccgtggcggggctgctggaacacttccgcctcatcggctgcttcgacgacggcagcgtcgagttcatgagcaaggtcatcgaggccagcggcatgggcaacgagacctacttcccgccgtcgctgcactacatcccgccggcggccacgcacgccggcgccgtccaggaggcgcacatgctcttcttccccgcgctcgacgacctcttcgcccggaccggcgtcccgccgtccgccgtcggggcgctcgtcgtcaactgcagcgggttctgcccggccccgtcgctcgccgccatcatcgccagccgctaccgcatgcgcggcgacgtccggaccttcaacctctccgggatgggctgcgccgctggcgtcgtcggcgtggacgtcgccaggggcgtcctgctcgcgcacgccgtcccctacgccgtcgtcgtcagcgccgagatcgtcaccgtcgggtggtacagcggcaaggaccagggcaagctgctcctcaactgctacttccgcacgggctgctccgccgcgctcctcaccagccgccgccgcggcgcggtgccggtcaagtaccggctcgcgagcctgacgcgcacgaaccagatcgccaacgaccggagctaccgctcggggtaccgcgaggaggacgacgagggcgtcaccggcttcaccctggggcagggcgtcggccgcatggtgagcgagctgctgcgcgcgcacctcgtgacgctcagcctgtccatcctcccgtggcgcgacaagctgcgctacgcgctcgcgctgctgctgctcctgctgtcatcccgccggcgccgggacggcggcggcagcaagctcgcccgcggcggccgcggcgccgtgccgctgccggacttccgcgcggcggcggaccacttctgcctgccgtcgtcggggcggccgatgatctggcggctggggcaggggctcgggctgggcgagcgggagatggaggcggcgctgatgacgttccaccggttcgggaaccagtcggcggcgtcgctgtggtaccagctggcgtacctggaggccaaggggcgggtccgcgcgggcgacacggtgtggcagctcggcgtcggcagcggcctcaaggccaacagcctggtgtggcagcgcgccgccgccggggccgacggggagcgcgacgagctggggccgtgggcggactgcatccacaggtaccctgtcacggaaacgtaaagcgcagacgcgagactcgctgctcggggtgaatcccgaatccgtcgtgcaagctgcagagctccaaaccacctcgatcgagtagtggtcttggaggtggagacgcttcgtgatgtccatttcgttcgagtttcctagtgttatgaactagtttattagtcagtaatagcagcatgtacatgtacgccttgctttgtactacgtgtttttgatttgagatgtatcaaatcatatcaactcgtgatgtgtttgttttcccatgaataaatgaacaagtttaataaataaataaataaataaataaataaatgtgtaaaaaaaaaaaaaaaaaaaa

SEQ ID NO: 6056 - protein, 486 aa, Panicum virgatum
  misc_feature: Ceres CLONE 1830948
  misc_feature (5)..(290): Pfam Name: FAE1_CUT1_RppA Pfam Description: FAE1/Type III polyketide synthase-like protein
MAMDTAHRDHLLAALHGVLGAATLLLCLAAELLVFALRRHAAFYLAPVAAMLLSGHLRRRAAAAEIGLVDFACLKPPRRLRIPVAGLLEHFRLIGCFDDGSVEFMSKVIEASGMGNETYFPPSLHYIPPAATHAGAVQEAHMLFFPALDDLFARTGVPPSAVGALVVNCSGFCPAPSLAAIIASRYRMRGDVRTFNLSGMGCAAGVVGVDVARGVLLAHAVPYAVVVSAEIVTVGWYSGKDQGKLLLNCYFRTGCSAALLTSRRRGAVPVKYRLASLTRTNQIANDRSYRSGYREEDDEGVTGFTLGQGVGRMVSELLRAHLVTLSLSILPWRDKLRYALALLLLLLSSRRRRDGGGSKLARGGRGAVPLPDFRAAADHFCLPSSGRPMIWRLGQGLGLGEREMEAALMTFHRFGNQSAASLWYQLAYLEAKGRVRAGDTVWQLGVGSGLKANSLVWQRAAAGADGERDELGPWADCIHRYPVTET

SEQ ID NO: 6057 - DNA, 1049 bp, Panicum virgatum
  misc_feature: Ceres CLONE 1830949
  misc_feature: Encodes the peptide sequence at SEQ ID NO. 6058
agaccagaccgcaccgcgtccacctcctcccgcgcttctccgccgcgctgccgagtcgagtcccgcgcgtttccgccgaggacgagcagccgcgcggcgcgtcgaggggtttgtctttctttgatcgggtagctgaggctgagcgggcaaggatgatgcgcgacacggcggcggtggccgtggcggcgccgcggtacaggggcgtgcggaagcggccgtggggccggttcgcggcggagatccgcgacccggcgaagcgcgcgcgcgtctggctcggcaccttcgactccgccgaggccgcggcgcgcgcctacgacgtcgccgcgcggaccctgcgcggcccgctcgccaggaccaacttcccctgcgccgcatcccgcctcccgctgccctcccaacaccaaggctgcggcggcggcggcctcgtcgcgccggcacccgccgcgccgacgtgcagctccggctccaccgtcgagtcctccagcgggccccgcggggcgcccagggctgctgttgctgcggtggcgcctcgaattcggaggcggtcggtgaagccgcgtccggcagcgcccgacgccgactgccatagcgactgcgcctcgtcggcctccgtcgtggacgacggcgacgacgcctccacggtccggtcccgcgcgccgttcgacctaaacgtcccggcgccggtggacgatgaccacgccctcgaactctgcacggagctgcggctctgagcgataggatccacgaacaaataacagcgaaaacagagaaggcgattttgctccggtcttcttttcctgactaaattctgatatgattgactcgtgctcgagagagctactgttctgtacgcgatatgaatggcgatagatggatgatttctgcaaaggcggctctgtagtgttcaggtcagatcgtcgagagttctcggtgtgtctttttgttcacgcctcttgtatttggatctgctaccatcttctctgcccattctatttgtacaccagataacatgtaagctgttctcgaatgaacacatatcttttcactat

SEQ ID NO: 6058 - protein, 192 aa, Panicum virgatum
  misc_feature: Ceres CLONE 1830949
  misc_feature: Great-hit functional homolog of the protein sequence given in SEQ ID NO 9191
  misc_feature: Great-hit functional homolog of the protein sequence given in SEQ ID NO 9250
  misc_feature (1)..(64): Pfam Name: AP2 Pfam Description: AP2 domain
  misc_feature: Useful for biocontainment applications
  misc_feature: Useful for making plants with altered Lignin content
  misc_feature: Useful for making plants with altered cell wall content and/or composition
  misc_feature: Useful for making plants with modulated cold sensitivity
  misc_feature: The plant produces a reduced number of seeds.
MMRDTAAVAVAAPRYRGVRKRPWGRFAAEIRDPAKRARVWLGTFDSAEAAARAYDVAARTLRGPLARTNFPCAASRLPLPSQHQGCGGGGLVAPAPAAPTCSSGSTVESSSGPRGAPRAAVAAVAPRIRRRSVKPRPAAPDADCHSDCASSASVVDDGDDASTVRSRAPFDLNVPAPVDDDHALELCTELRL

SEQ ID NO: 6059 - DNA, 1329 bp, Panicum virgatum
  misc_feature: Ceres CLONE 1830955
  misc_feature: Encodes the peptide sequence at SEQ ID NO. 6060
gcagcttacccacccaaatccaccaaattcgatcgaaattcgcagctcccaatccccaaatcggagctggtaacccgagctcgcggggcaccggaccgcggggactccggggataaactggggctgggcagctcggcggcgcttttgctctgctctcgcataggttttatctcctctcctctgcccactgcccccgacgtcaggtgatctgattccctcgcttctcgcacacggcagccggattccaaagcgcggccctgccccaggctccagccacgaaggtagtcgttgttcagcggacacactagaatgtcgtcggtgcagctctccggtgccggagtcgccgccgtggccttcacgaacaagggcctagcctcaccgccgtcggcgctcagggtctgctcgtcgaggcgctctgtccgtagcctagtcgtcagggctgcaactgttgtcgccccaaagtacacttcgctgaagcctctgggagaccgggtgcttgtgaagcttggtgcggccgaggagaagacggttggtggcattttgcttccatcaaccgcgcagactaagccacaaggaggtgaggttgtcgctgttggagcgggaaggaccatcggtgataagaaaatagaggtcggcgtacagattggggcagaagttgtgtactcaaaatatgctggaaccgaggttgaattcaatgactcgaagcatctcattctaaaagaggacgatatcatcggtattcttgagagtgatgacgcgaaggatatgaagcctctcaatgatcgtgttctcatcaaggttgcagaagctgaagacaaaactcctgggggccttatcctgactgaaacaactaaagaaaaaccatccattggaacggttgtagctgttggcccgggccctctggatgacgaaggcaagaggcagccactgtcagtgcctgctggcagcaccgtgctgtactccaagtatgcagggagtgagttcaagggtgcggacggcaccggctacatcgtgttgagagcgtccgacgtcatggctgtcctctcctgatagcctctcgttttcagtttttagcttgcaacccataggtgtgaagtggtggtatgaaatgatcgctttgcggtgattatgaccccatgcggaccctgtctgcatagaatttgtatgtccacaagttacgagccagtacgtgtgttggggggcatagacgtcgacatctgagacctgatagtgagagcactcggttggttttataaaggacattttgggggggggggggttgaaataatacccttttctgtcttcttttaaaaaaaaaaaaaaaaaaaa

SEQ ID NO: 6060 - protein, 246 aa, Panicum virgatum
  misc_feature: Ceres CLONE 1830955
  misc_feature (1)..(94): Pfam Name: Cpn10 Pfam Description: Chaperonin 10 Kd subunit
MSSVQLSGAGVAAVAFTNKGLASPPSALRVCSSRRSVRSLVVRAATVVAPKYTSLKPLGDRVLVKLGAAEEKTVGGILLPSTAQTKPQGGEVVAVGAGRTIGDKKIEVGVQIGAEVVYSKYAGTEVEFNDSKHLILKEDDIIGILESDDAKDMKPLNDRVLIKVAEAEDKTPGGLILTETTKEKPSIGTVVAVGPGPLDDEGKRQPLSVPAGSTVLYSKYAGSEFKGADGTGYIVLRASDVMAVLS

SEQ ID NO: 6061 - DNA, 1584 bp, Panicum virgatum
  misc_feature: Ceres CLONE 1830958
  misc_feature: Encodes the peptide sequence at SEQ ID NO. 6062
aacatggacagctgcccggtcgtgatcggccagcttcagatctgccgttccccgccggcctgccggcgcttatcggcgtacggctcgtcgaccacgaccagacctcctcctacttggtaggcgcgaccgcccaagcgtccaggccagtgtgctttgcgcccctcctttcaacgtcacggtctcgccgtccttcccagatctgaccacctcgtcgcatcgcatcccgcccggtccactccgacggccgccccgttccccttctttaaccccgccaccccgatgatctagccccgcactccaccaccgtccccgcaagttgagcgctagcaccagtcaacggacctcccgccgccatggccgcggcgctcctcctcctgctggtcccgcccgtcggcctcctcgccgcgctcgccttcctggcgcgcccccgcgccgcgcgcgtcccgctcaaaggccgccacgtcctcatcacgggcgggtccagcggcatcgggctcgccatggccacggccgcggcgcgggagggcgcgcgggtctccatcctggcccgcaacctcgcccgcctcgaggaggcgcgcgccgccatccagcgcgagtccggccgcggcgacgtcggcgtccacgcggccgacgtgcgggacgcggacgccgtggcgcgcgcgctccgggaggccgggcccgtcgacgtgctggtctgcaaccacggcgtgttcgtgccgcaggagctcgagcggcaggacatggaggagatcaagtggatggtggacatcaacctcatgggcaccttccacctcatcaaagccgcgctccccgccatgaaggcgcgcacccgcgagacgcgcctccctgggtccatcgcgatcatgtcctcgcaggccggccaggttggtgtctatgggtacactgcgtactcagcgagcaagtttgcgcttcggggattgggggaggcgctgcagcatgaggtcattatggacaacattcatgtctcgctgatcttccctcctgacactgagactccaggtttcgaagaggagcagaagaggaggccagaattgacgaatatcatcgcggcttcatcaggtggaatgaaggccaatgatgttgcaaagaaggctctggacggcatcaaatccgggaagtttattgtcccctgcaactttgacggcgcaatgttggctatagccactgctggtttatccccacagagctcccctgtaatggcattcctagaggtgattggtgctggactcatgaggtttgtagcgctttgtttccagtggaattggttttctaccatagagagctactatgccaagaacaagaagcgcgagtgagatcacaatacaacgtgacacacccggataccaattttgttgagttcgtcggagttgaaagactaacaaataaattgtcttgttggtaacctgatttgaatctcatgtaatgggcatgcagagtacctgtagttctgcttctcagttttagctttacctcgtttagatcatgtgtacagtgtagatttcagcaaagcaatgaaataaaggcacaaatttcgtggatttgtaaaaaaaaaaaaaaaaaaaa

SEQ ID NO: 6062 - protein, 326 aa, Panicum virgatum
  misc_feature: Ceres CLONE 1830958
  misc_feature (1)..(170): Pfam Name: adh_short Pfam Description: short chain dehydrogenase
MAAALLLLLVPPVGLLAALAFLARPRAARVPLKGRHVLITGGSSGIGLAMATAAAREGARVSILARNLARLEEARAAIQRESGRGDVGVHAADVRDADAVARALREAGPVDVLVCNHGVFVPQELERQDMEEIKWMVDINLMGTFHLIKAALPAMKARTRETRLPGSIAIMSSQAGQVGVYGYTAYSASKFALRGLGEALQHEVIMDNIHVSLIFPPDTETPGFEEEQKRRPELTNIIAASSGGMKANDVAKKALDGIKSGKFIVPCNFDGAMLAIATAGLSPQSSPVMAFLEVIGAGLMRFVALCFQWNWFSTIESYYAKNKKRE

SEQ ID NO: 6063 - DNA, 1111 bp, Panicum virgatum
  misc_feature: Ceres CLONE 1830996
  misc_feature: Encodes the peptide sequence at SEQ ID NO. 6064
gctgcaacccgagcagcagctttacttggctccagcctccaagaagctagtgatattcagattgtgagagaaattactgagcaagagccgatcgaggcgatggcgaacctgttcctgaagcaggcgaagcagtacgtggcgacgcggccgacctacccgccggagctcttcgacttcatcgcctccaagacgccccgccgcgacctcgcctgggacgtcggcaccggcaacggccaggccgcagcatcgctggcgaagctgtacaaggccgtggtgggcacggacacgagcgcgcagcagctcgcctacgcggcggcgctccccaacgtgcgctacgtgcacaccccggcggacctgccgctcgccgggatccacgccgccgtcgcggcgccggcctccgtctacctcatctccgtggcgcaggccttccactggctcgacctcccgcgcttctacgcgcaggcccgctccgtgctgcgccccggccaaggggtgctcgccgcctggtgctacaccgagccgcgcgtcgccggcgccgccgccgtcgatgccgcgttctggcgcctctaccgccgctcggcgccgcactgggcgcccaaccgccggatggtcgacgacgagtaccgcggcgccgacttccccttcgaccccgtcgacggcgaggcgcacacggggcccttcgagttcgccacggagcgccggatggacctggacgactacctcacgtacatcacgtcgtggtcggcgtaccagacggccaaggacagcggcgtcgagctgctcgacgaggcgacggtgcgcgagttcgaggccgcgtggggcggagatcggaaggaggtgaagacggtgacgtacccaatcttcctcaggatcggcaaggtgagggccgaagaatgagatacaacaaacaagttgacgatgatgggtacaataaaatcggacgaggcgactgctaggaattttttgtgtactgataacctttctatagaaagagaaaggtttcttttttattgactgctgtacaaatttttggttcagaatgtatttgaaattgtaatgcagttttttgtagttcacttttttattgggcgaaaaaaaaaaaaaaaaaaaa

SEQ ID NO: 6064 - protein, 265 aa, Panicum virgatum
  misc_feature: Ceres CLONE 1830996
  misc_feature (1)..(97): Pfam Name: Methyltransf_12 Pfam Description: Methyltransferase domain
  misc_feature (1)..(98): Pfam Name: Methyltransf_11 Pfam Description: Methyltransferase domain
MANLFLKQAKQYVATRPTYPPELFDFIASKTPRRDLAWDVGTGNGQAAASLAKLYKAVVGTDTSAQQLAYAAALPNVRYVHTPADLPLAGIHAAVAAPASVYLISVAQAFHWLDLPRFYAQARSVLRPGQGVLAAWCYTEPRVAGAAAVDAAFWRLYRRSAPHWAPNRRMVDDEYRGADFPFDPVDGEAHTGPFEFATERRMDLDDYLTYITSWSAYQTAKDSGVELLDEATVREFEAAWGGDRKEVKTVTYPIFLRIGKVRAEE

SEQ ID NO: 6065 - DNA, 1748 bp, Panicum virgatum
  misc_feature: Ceres CLONE 1831005
  misc_feature: Encodes the peptide sequence at SEQ ID NO. 6066
ctccccttccccgctcgcctccgctcccctgcggccctgcctcgtcgcctctcccctcgcgcaccacctcccctcccgcggtctctgtctctcaccttctcgctgcacacgctctcctgattggatcaattgggcttcgtgtgccgtctgctccgtggagcacccgctgccgagcggaatcgtcacctgatttggcgagactagcagatatttgtaaattcatggcgcacgatgaatctgtggctacccagaagactggaaatacagcatcatctcctaaggatcaaccagctccttctccatatcctgattggtcgaccatgcaggcatactatgggcccggtgtcttgccaccaacatattttgctccagcaatagctccaggtcatccaccagcatatatgtggggtcctcagcctctaatgccacaccctttcgggacaccatatgctgcaatgtacccacatggagcagcttacccgcacccccttgtgcccatggtatcaaatcccttgagtgtggagccaacgaagtctgcaactagtaaggataaaagttccaacaagaaacttaaagaaattgatcggacgccggtatctgctggcagcggtaacagtaaaagaacaatgtcatccagtgaagattacagtgcagaaggctccagcgatgtaaatgatcagaaggtgaacaaaacttccaggaaactgagctcagttgatggacctgctgcaaggattgaaggtgttatagctcctaaccatacactggcaaatacagccattttgccacaacactgctttccagctccagtaattaagcccagcgctacaaatgttgataactcaagggcaatgggtgcatcgatatctccatctcctggtgtgattgttccgcctcatactggaggaccaactgacttatcaatcaaggatgagagagaactgaagcgtgaaaagaggaagcaatcaaatagagagtctgctagacgatcaaagctgagaaaacaggctgagacagaggagatggcaacacaagtggaatctcttacagcagagaacacgtcccttagatctgaaattggcaggctaacagtgagttcagagaagctcagattagagaattccgctctgatggtgaaactgaaggatcctgaagtgccggcccctacagatccgtctccgaacaaagccgccgcatcctcgccctctccccgccccgccgcggaaaacttcctgtcaatgatcgacggcaccacgagcgcgccgggggtcagctggcacacggagcacggcgagcccaagctccggcagctcctcgactccaatccgtccacggacgtcgctgccgtaagctgatgctgacctgcctctctttcccccctggcgcggagagaggccggctaatacaacacagatgcatgtggcctggggggtcttggtcgcaagctcatgttgtctcaccataacgtttagcggtccagtgtactagtaggaggcattgattcgggtatagcatttgagatgagaacacaggtaactcgtatctgcaccagtgcagtcgctggcaggggatgcctgatgtaccgcgtgttatctacttgctatgagcgtctagcagtgttgtaagttgtaacatagggtgttgtgctgcatgccaacctgaaaacttcgaggccgtccttttggaccattttcggtgcaataacaaagtgtgaatcggagcttgtacaaaaaaaaaaaaaaaaaaaa

SEQ ID NO: 6066 - protein, 377 aa, Panicum virgatum
  misc_feature: Ceres CLONE 1831005
  misc_feature (1)..(65): Pfam Name: bZIP_1 Pfam Description: bZIP transcription factor
  misc_feature: The sequence is a functional homolog of  SEQ ID NO 110 in the  10/374,780 US patent application
  misc_feature: The sequence is a functional homolog of  SEQ ID NO 1104 in the  10/225,066 US patent application
  misc_feature: The sequence is a functional homolog of  SEQ ID NO 1225 in the  10/412,699 US patent application
  misc_feature: The sequence is a functional homolog of  SEQ ID NO 362 in the  10/412,699 US patent application
  misc_feature: The sequence is a functional homolog of  SEQ ID NO 847 in the  11/479,226 US patent application
  misc_feature: The sequence is a functional homolog of  SEQ ID NO 910 in the  10/374,780 US patent application
  misc_feature: The sequence is a functional homolog of  SEQ ID NO 911 in the  10/374,780 US patent application
  misc_feature: The sequence is a functional homolog of  SEQ ID NO 912 in the  10/374,780 US patent application
  misc_feature: The sequence is a functional homolog of  SEQ ID NO 913 in the  10/374,780 US patent application
  misc_feature: The sequence is a functional homolog of  SEQ ID NO 922 in the  10/374,780 US patent application
  misc_feature: Useful for making plants with modulated growth and phenotype characteristics
MAHDESVATQKTGNTASSPKDQPAPSPYPDWSTMQAYYGPGVLPPTYFAPAIAPGHPPAYMWGPQPLMPHPFGTPYAAMYPHGAAYPHPLVPMVSNPLSVEPTKSATSKDKSSNKKLKEIDRTPVSAGSGNSKRTMSSSEDYSAEGSSDVNDQKVNKTSRKLSSVDGPAARIEGVIAPNHTLANTAILPQHCFPAPVIKPSATNVDNSRAMGASISPSPGVIVPPHTGGPTDLSIKDERELKREKRKQSNRESARRSKLRKQAETEEMATQVESLTAENTSLRSEIGRLTVSSEKLRLENSALMVKLKDPEVPAPTDPSPNKAAASSPSPRPAAENFLSMIDGTTSAPGVSWHTEHGEPKLRQLLDSNPSTDVAAVS

SEQ ID NO: 6067 - DNA, 1134 bp, Panicum virgatum
  misc_feature: Ceres CLONE 1831037
  misc_feature: Encodes the peptide sequence at SEQ ID NO. 6068
gtgagttagcggagctgaccacatcgccgagggccagcctgcccgggggacgacatgtggggcctacctcggcggaggaagagcccctccgggttctcgccgtcgtccacggcagaggaggtcacggccggcatcgacggctccggccttgtcgccatcgtgaccggtgcatccagtgggattggagctgaaacatgcagagttcttgcactgcgtggcgtgcatgtcgttatgggggtgaggaatctgtccactgcctcacaggtgagggagaagattgtgggacaagtccccacggccaagattgagatccttgagcttgaccttagctcaatgtcatccgtgagaagattcgtggacaattttgatgcgctggacctcccactgaacattcttgttaataatgcagggattgcatttgttcctttcaagctttcagaggacggcattgagctgcattttgcaacgaatcaccttggacattttctactgactgatcttttacttgagaagatccatgttacggctaaagagagtggcatagaaggaagggttgtgatagttgcttctgacggctacaagcattcatatcgagagggaattcgttttgataagatcaatgatgagtctagctataacagaatatcagcttatggccactccaagcttgcaaatatattgcatgcaaatgaactgtctagccacttgaaggaacaagactcaaaagtggtcgtcaactcccttcatcctggagaagttgtcaccaacattgcccgctattggggtttgcttaatggtcttgtttccttacttggtaaatttgtactaaaaggtgttgatcaaggtgcagccacagtgtgttatctggcattgcatcctcaggttgctggagtcactgggagttactttgtggattgcaatactgttcaactgaaatctcatgcgaccgacaaggagctcgccaaacgactctgggattttagtatgagcctgctccgttgattcattggtataaaccatgtgtcgtattatttctgaaaagagaagtatgtaaagaaactaaaattgcaatgttatgtcttcactgatttgtaccaaaaataaaaaattgtagaaaaaaaaaaaaaaaaaaaa

SEQ ID NO: 6068 - protein, 315 aa, Panicum virgatum
  misc_feature: Ceres CLONE 1831037
  misc_feature (1)..(123): Pfam Name: adh_short Pfam Description: short chain dehydrogenase
MWGLPRRRKSPSGFSPSSTAEEVTAGIDGSGLVAIVTGASSGIGAETCRVLALRGVHVVMGVRNLSTASQVREKIVGQVPTAKIEILELDLSSMSSVRRFVDNFDALDLPLNILVNNAGIAFVPFKLSEDGIELHFATNHLGHFLLTDLLLEKIHVTAKESGIEGRVVIVASDGYKHSYREGIRFDKINDESSYNRISAYGHSKLANILHANELSSHLKEQDSKVVVNSLHPGEVVTNIARYWGLLNGLVSLLGKFVLKGVDQGAATVCYLALHPQVAGVTGSYFVDCNTVQLKSHATDKELAKRLWDFSMSLLR

SEQ ID NO: 6069 - DNA, 1433 bp, Panicum virgatum
  misc_feature: Ceres CLONE 1831068
  misc_feature: Encodes the peptide sequence at SEQ ID NO. 6070
accgtatgttttacttctgcacgcacatggcgagaattttgtttggctgcaagagcgagaataccagccggcccggccgtcacggtgtatatatctggccgttgcgttctctcccgatcactcgccgctcctgactccgttggtcgtcggcggagttctctcttcagccgccaccgtaccctctcctgggtctccagcacgccatggaggaccagagccccaagcctatccgttgcaaagcggcggtctgcagaggcgccggcgagccgctcaccatcgaggagatcgtcgtcgatccgccgaaagcgtacgaggtccgcgtcaaggttatctgcacctcgctctgccacaccgacatcaccttctggcgaggcaatgtgtcaccagcgttcccgagaatcttgggccacgaggcctacggggtggtggagagcgtcggggagcacgtggagggcttggccgccggcgacgcggtggtgccgacgatcgtgggccagtgcggtcactgcaccacctgcttgtccgaggacagcaaccgctgcgagggggtgccgactatcctgggccccgggatgcggcgcgacggcaccggcaggttctgggacccgcaggggaacccggtgcacgacctcctcgccgtgtccaccttcagccagtacaccgtcattgacgtgagccagctctccaagctcgaccccgccgtgccgcccaagctcggctgcctcatcagctgcggcggcgccactggggtaggagcagcgtggaaagcggccaggctgaaacctggctcgtcagttgccatctttggattgggagcagtcggactgtcggtggcacaaggtgcgaaaatgtgtggagcgtccaagattatcggcgttgacttaaaccctgacaaggagaaatttgggaaagcgttcggcgtgacagactttgttaacccatcaaaactggacaagaacaactccatcagtggggtgatcaaggagatgagcggcggcggcgtcgactgcagcttcgagtgcatcggcgtgccctcggtcatggccgaagcgttcagaagcaccaagaaggggaacagcaagacgatcgtcctgggcgtggggaaggacaatgccgaggtgcgcttgccggcccaggacctcctgtacggcaagtccatcatggggtcgtccttgggcgggctcaagcccaagatccacatccctatcctcgccaagaaatgcatgaacaaggagctggagctggacgggctggccacgcatgaggtgggcctgcgagagatcaacacggccttcgacctgctcctgcaggggaaaggcctcaggtgcatcatatggatggacaagtgacctacctgggaccatcgctgttgtcgatttgggtaactacgaataagaagggtcgagtagccggaaaaaaaaaaaaaaaaaaaa

SEQ ID NO: 6070 - protein, 381 aa, Panicum virgatum
  misc_feature: Ceres CLONE 1831068
  misc_feature (1)..(128): Pfam Name: ADH_N Pfam Description: Alcohol dehydrogenase GroES-like domain
MEDQSPKPIRCKAAVCRGAGEPLTIEEIVVDPPKAYEVRVKVICTSLCHTDITFWRGNVSPAFPRILGHEAYGVVESVGEHVEGLAAGDAVVPTIVGQCGHCTTCLSEDSNRCEGVPTILGPGMRRDGTGRFWDPQGNPVHDLLAVSTFSQYTVIDVSQLSKLDPAVPPKLGCLISCGGATGVGAAWKAARLKPGSSVAIFGLGAVGLSVAQGAKMCGASKIIGVDLNPDKEKFGKAFGVTDFVNPSKLDKNNSISGVIKEMSGGGVDCSFECIGVPSVMAEAFRSTKKGNSKTIVLGVGKDNAEVRLPAQDLLYGKSIMGSSLGGLKPKIHIPILAKKCMNKELELDGLATHEVGLREINTAFDLLLQGKGLRCIIWMDK

SEQ ID NO: 6071 - DNA, 1790 bp, Panicum virgatum
  misc_feature: Ceres CLONE 1831078
  misc_feature: Encodes the peptide sequence at SEQ ID NO. 6072
gacgcgaccaaccgcagctcaagctcaaggcctcgtcccctcctcccggtccgcggcgcctgtatatatagagcccacccgggcccgatgtgacgacgcaccagcagcgagcgccgagcgggaaggagcggccggcggcgagctgaggcagcggctcgcaccgcgcgttcccggtcacgcacgacgatggcgcccgccgcccgccactccctgctgctgctcgcgctcgccctctcgctcggcgccgtgtccgcggcgcagcaggtggacgccgtggccgcggcgcagcaggcggcggaccgcgtggcggggctcccggggcagccgcccgtggggttcgcccagtacgccgggtacgtgaccgtgaacgagacccacggccgcgcgctcttctactggttcttcgaggccaccgcggcgcccgacaagaagccgctcgtgctctggctcaacggcgggcctgggtgctcgtcgatcgggtacggcgaggcggaggagctggggcctttcttggtgcagaagggcaagccggagctcaaatggaacaactactcctggaacacagaggccaacctgatgttcctggagtccccggtgggcgtcggcttctcctacaccaacacgagctccgacctgctgaagcttggcgacaagatcaccgctgatgacgcttacgtgttcctgctcaactggttcaagaggttcccgcagtacaagtcccacgacttctacatcgccggcgagagctacgccgggcactacgtcccgcagctgtcggagaagatcttcgacggcaaccgggcgggccccaaggagagctacatcaacttcaagggcctcatggtcgggaacgcgctcatggacgacgagacggaccagacgggcatgatcgactacgcctgggaccacgccgtcatctccgaccgggtgtacgccgacgtcaaggcccgctgcaacttcagcatggcgaacgtcacggacgcctgcaacgccgcgctccaggagtacttcgccgtgtaccacctcatcgacatgtacagcctctacacccccgtctgcaccgacggctccgtctcgcccgccgccgcgcgcggcggccaccggaaggtcgccgtccatggcgccgcccccgggatcttctccaaatatcacgggtggatcatgaagccagcgggctacgacccctgcacggcggaggacgcggaggtctacttcaaccggcccgacgtccaggcggcgctgcacgcgaacgtgaccaagatcggctacaactggacgcactgcagcgacgtgatccccacttggaacgacgccgccttctccaccctccccatcatccgcaagctcatcaccggcggcctcagggtctgggtcttcagcggcgacaccgacgggaggatccctgtaacggcgacgaggctcaccctcaacaagctcgggctcaagaccgtccaggagtggacgccgtggtacgaccacctgcaggttggcggatggacgatcgtgtacgagggcctgacgttcgtgaccatccgcggcgccgggcacgaggtgcctatgcacgcgccgcgccaggcgctgacgctcttcagcaatttcctggccggcaccaagatgcccccaacggcgtacccctagtggccgcccgtcggcgggcgcccgggaacgccagcttgatctaaagtttttccattttcgtttctcccaaagatgcaagtgtaattcgattgggaaaaaaatcaggaataaaagtcatatagtgctgatctcaaaaaaaaaaaaaaaaaaaa

SEQ ID NO: 6072 - protein, 483 aa, Panicum virgatum
  misc_feature: Ceres CLONE 1831078
  misc_feature (1)..(339): Pfam Name: Peptidase_S10 Pfam Description: Serine carboxypeptidase
  misc_feature (30)..(478): SWISSPROT Homolog: EC 3.4.16.6 Serine carboxypeptidase 2 precursor
  misc_feature (4)..(478): SWISSPROT Homolog: EC 3.4.16.6 Serine carboxypeptidase 24 precursor
MAPAARHSLLLLALALSLGAVSAAQQVDAVAAAQQAADRVAGLPGQPPVGFAQYAGYVTVNETHGRALFYWFFEATAAPDKKPLVLWLNGGPGCSSIGYGEAEELGPFLVQKGKPELKWNNYSWNTEANLMFLESPVGVGFSYTNTSSDLLKLGDKITADDAYVFLLNWFKRFPQYKSHDFYIAGESYAGHYVPQLSEKIFDGNRAGPKESYINFKGLMVGNALMDDETDQTGMIDYAWDHAVISDRVYADVKARCNFSMANVTDACNAALQEYFAVYHLIDMYSLYTPVCTDGSVSPAAARGGHRKVAVHGAAPGIFSKYHGWIMKPAGYDPCTAEDAEVYFNRPDVQAALHANVTKIGYNWTHCSDVIPTWNDAAFSTLPIIRKLITGGLRVWVFSGDTDGRIPVTATRLTLNKLGLKTVQEWTPWYDHLQVGGWTIVYEGLTFVTIRGAGHEVPMHAPRQALTLFSNFLAGTKMPPTAYP

SEQ ID NO: 6073 - DNA, 1383 bp, Panicum virgatum
  misc_feature: Ceres CLONE 1831105
  misc_feature: Encodes the peptide sequence at SEQ ID NO. 6074
gtcgcgttaataaagcgcaaagccacccagtgatctaggccgccgcctcccctgctcccccccatctccccctccccctcgctcccgccgcctcgtccgctccgctccctgcccgagccgagccgagcgcagcgcaagcccgatccggaaggagggagagagatggcggacgcgaagcagcagcagcagcagacggcggtggcggccaccggcgtctggaagacgatcaagcccttcgtcaacggcggcgcctccgggatgctcgccacctgcgtcatccagcccatcgacatggtcaaggtcaggatccagttgggtgagggctccgctggtcaggtcacgaagaacatgcttgctaatgagggggtccgttccttctacaagggtctgtctgctggtttgctaaggcaagcgacatacacgactgctcgtcttggatccttcagggttctgacaaacaaagcagttgaaaagaatgagggaaagccgttgccgctaattcagaaagcttttattggtctgactgctggagcaattggtgcttgtgttggtagccctgctgatttggcactcattaggatgcaagctgattcaaccctgccagctgcacaaaggcgcaactacaagaatgctttccatgctctctaccgaattacagctgatgagggaatccttgcactttggaagggtgcaggccctactgttgtgagagctatggcattgaacatgggtatgcttgcttcgtatgaccagagtgttgagctatttagggacaaatttggcgcaggagaaatttctactgtcattggagccagtgctgtttctggattcttcgcctcagcatgcagtttgccttttgactacgtgaagacacagattcagaagatgcaacctgatgccaatggcaagtacccgtacacaggttctttggactgtgccatgaagaccttcaagagtggtgggccattcaagttctacactggcttcccggtgtactgtgtcaggattgcgccccatgtcatgatgacctggatattcttgaatcagatccagaagttcgagaagaagattggcatataacttcacaagaccgacatatcaaaatggggttgaccgctccatcctatcgtaataacatcccagctgctttgacactgtagtagttggttttggtagggacaagtctgggaccaatttttaccttagcttacatgccaattattattgttgcaataatcgtaatatttgttgtattgtgggggcattttttggggggtggagatgctttagttggctggggtgcagccacaagaggggatactaccagtcatgccattgaatggaactggaccatgttttatacaaaaaaaaaaaaaaaaaaaa

SEQ ID NO: 6074 - protein, 305 aa, Panicum virgatum
  misc_feature: Ceres CLONE 1831105
  misc_feature: Great-hit functional homolog of the protein sequence given in SEQ ID NO 9341
  misc_feature: Useful for making plants with modulated biomass
  misc_feature: The plant is abnormally small.
MADAKQQQQQTAVAATGVWKTIKPFVNGGASGMLATCVIQPIDMVKVRIQLGEGSAGQVTKNMLANEGVRSFYKGLSAGLLRQATYTTARLGSFRVLTNKAVEKNEGKPLPLIQKAFIGLTAGAIGACVGSPADLALIRMQADSTLPAAQRRNYKNAFHALYRITADEGILALWKGAGPTVVRAMALNMGMLASYDQSVELFRDKFGAGEISTVIGASAVSGFFASACSLPFDYVKTQIQKMQPDANGKYPYTGSLDCAMKTFKSGGPFKFYTGFPVYCVRIAPHVMMTWIFLNQIQKFEKKIGI

SEQ ID NO: 6075 - DNA, 1191 bp, Panicum virgatum
  misc_feature: Ceres CLONE 1831117
  misc_feature: Encodes the peptide sequence at SEQ ID NO. 6076
ctcccacccgcgctcccagcacgcccaccgtcgcctaccccgtctccagctcgatggactactcgagcaccaaggagttacctccggccggggcctggtggtcgagggagacggtggccgtggtgacgggcgcgaaccggggcatcgggcacgccctcgccgcgcgcctggcggagcacgggctcaccgtggtgctcaccgcgcgggacggcgcgcgcggggaggccgccgcggccccgctccgcgcgcgcgggctcgccgtcgccttccgcaggctcgacgtctccgacgccgcctccgtcgccgagttcgccgcctggctccgcgacgccgtcggcggcctcgacatcctggtgaacaacgccgccgtgtccttcaacgagatcgacaccaactcggtggagcacgccgagacggtcctccggaccaacttctacggcgccaagatgctcacggaagcgctcctgccgctgttccggcagtccccggccaccagcaggatcctcaacatcagctcgcagctcggccttctcaacaaggtgagcgacccgtccctgaaggcgttgctgctggacgaggagaccctgacggaggcggcgatcgacgccatggtgtcgcggttcctggcgcaggtgaaggacgggacgtggggcgcgcagggttggcccaaggtgtggacggactactcggtctccaagctggccctgaacgcctactcccggctgctggcgcggcggctgcaggcgcgcggcgcccgcgtgagcgtcaactgcttctgccccgggttcacgcgcaccgacatgaccaggggctgggggaagcgcaccgccgaggaggcggccgacgtcggcgcgcggctcgcgctgctgccgcccggcgagctccccacgggggccttcttcaagtggtgcacgccgcagccctactccaagctgtgacctgccgagccacgccgccggcccgcgcgccccggccatggcggccgcaggagtatgtagcgttggtttagctgcttctagttactttcaatgcagacaagaagccgatcgagtagtgtctcttagcagtctggctttctgccaaggtgctttggttgagcaatgcaaccaaaccatgtcagcgatcaatgtactatgcgtgcttagccgtgcaagatttaggtcaacttccgaaaaaaaaaaaaaaaaaaaa

SEQ ID NO: 6076 - protein, 294 aa, Panicum virgatum
  misc_feature: Ceres CLONE 1831117
  misc_feature (1)..(141): Pfam Name: adh_short Pfam Description: short chain dehydrogenase
MDYSSTKELPPAGAWWSRETVAVVTGANRGIGHALAARLAEHGLTVVLTARDGARGEAAAAPLRARGLAVAFRRLDVSDAASVAEFAAWLRDAVGGLDILVNNAAVSFNEIDTNSVEHAETVLRTNFYGAKMLTEALLPLFRQSPATSRILNISSQLGLLNKVSDPSLKALLLDEETLTEAAIDAMVSRFLAQVKDGTWGAQGWPKVWTDYSVSKLALNAYSRLLARRLQARGARVSVNCFCPGFTRTDMTRGWGKRTAEEAADVGARLALLPPGELPTGAFFKWCTPQPYSKL

SEQ ID NO: 6077 - DNA, 1394 bp, Panicum virgatum
  misc_feature: Ceres CLONE 1831146
  misc_feature: Encodes the peptide sequence at SEQ ID NO. 6078
agcgccggtgccggtgccggtgccggtgccagcatctttcctctgcatctgcaccacgccaccaccattctgttcctcaacctgcagacggatagagtcatagagagcccgggcgtcgcctgcactcgagccaccctgctggcacagtgctacaaaagaggaaggcagcaaagccggagtgccagagacccaccagccttgtgcttgctgaaagcgcatgtaggacatggatcaggcgggcactgccggcgccggtgagcagcctgcggcggctgccggcgatgaacccgcgaagaggatcgttggcggcggggacgcgccggccgccggggtggcgacgactggaggcggctgcttcgactgcaacatctgcctcgagtgcgccgcggagccggtggtcacgctctgcggccacctctactgctggccctgcatctacgagtggctgcgccccgacgccgacgcgggcacggcgaggcggcggtgccccgtgtgcaaggccgcggcgtcccccgacgcgctcgtgccgctctacggccgcggcgggagctcccgcgccaagaagccgccgcgcggcctggccggcagcatcccgcgccggccggctctgcgccggagagttcaagacagcgacaacggcggcggcaaccaccaccggaacgtggacaccgacgcaccggcccgggcaccactgcaggcgcggcaccacgccgacgccgcgcagtacgatgccctcccaccgccgtttggggaccgcgggatgatgcactcgacgcccggaggggtgctcgggggcatggcggtggccgtgctaccgtgggtgctccgagggcaggcgcagccgccgggcacgtaccactggagcccgtaccacctgatgaaccccaggcagagacggcggcacatggaggtcgaaagatctctacatcagatatggttcttcctcttcgtgttcgtgctgctctgcttgctcctgttctgacttctgaagcacaacctgccgtgcgccatgtgcagaaacgggagaaccgaatggctgacgtgctctgtagtctgtacatagatgtgaacgtgatagagctgtggctattgcaggatagcgttcaggatgaaaattgaaaaccaccaatgaccgcagcttttgatcctagaaagaatagagggaatcagtttggaaactgcaacggaccgaccgttagaagtagagatcagaaaatattgtccatatgttcatgcgcactcgaagctattgcctattggtaatgtttcaatatgtaactgataaactactatttttgccagacgaccacctgtgttcgctctcatctctggggtcgtagcaattaactcgaaacgtctgcaacgtgcgcacaacaagaatcacttcgttccag

SEQ ID NO: 6078 - protein, 251 aa, Panicum virgatum
  misc_feature: Ceres CLONE 1831146
  misc_feature (1)..(51): Pfam Name: zf-C3HC4 Pfam Description: Zinc finger, C3HC4 type (RING finger)
MDQAGTAGAGEQPAAAAGDEPAKRIVGGGDAPAAGVATTGGGCFDCNICLECAAEPVVTLCGHLYCWPCIYEWLRPDADAGTARRRCPVCKAAASPDALVPLYGRGGSSRAKKPPRGLAGSIPRRPALRRRVQDSDNGGGNHHRNVDTDAPARAPLQARHHADAAQYDALPPPFGDRGMMHSTPGGVLGGMAVAVLPWVLRGQAQPPGTYHWSPYHLMNPRQRRRHMEVERSLHQIWFFLFVFVLLCLLLF

SEQ ID NO: 6079 - DNA, 1327 bp, Panicum virgatum
  misc_feature: Ceres CLONE 1831151
  misc_feature: Encodes the peptide sequence at SEQ ID NO. 6080
actggcctttggacttcagcgagacacttgcagataaggctacactgccactcaccactcaccagtagagctgctggccatggcgcccttctgcgctcctgctgccactgcagctcctcatgccaccccaacccctctcaccagctcgcggaagcatatcgccatgtgcctctcccccaagcaaggcggcggcggcggcggcggcggccagagggcgcggcttgcgagttcagcagctcctcaggtgcgcgcgctgtcgccggcgacggcggcggaagaagcggcggatcccttccccgcccccgtcaacgtggagtacctggccgccgagttcgccggccacggcgtgggcttcgagcccgtgggcggcagctgcgccgtcaagatggcgctgcgcaacggcagcgtggcgcacctgctgctccccagcgggctcgtcacgtcctacaagcccgccatgtggcacggcaccgtcacggaggtgctccacacgaacgtcgccgagggccccggcgggcgggccgccatccgcggtggcgtgtccgtggacctccgctgcgccgccggcggcggcgggtggtcgccgagcggggcgtggtcgctccgcgacgtccggggaaaccccacgacctccatcgagatcgagctcgtgtcggcggcgccggggagcgcggccgcggcgaggtgcgtggtgacgctgcacccggaggcgctggccacggagctcgcggtgaccaacaccgcgccggcgccgatggcgctgtcgtgcggcgtgtcgaaccacctgcgcgtgagcaccccggacgccacctacgcgctggggctccagggctccgactaccgcagcgtcgagccggcgttgtcggagttcagcatcatccctccggactacggggcggccgcagggtcggcccggcaccggtgggcgaacaggggcttcgacatgatcctctcgggcggcggccgggaccgcggcgcggcggacgatcagcccgacggcgaggaggacgacgactacaagcacatgacggacgcgatgtgccgcatctacagccacgcgcccagggacttcgccatcatcgacaggggcaggaggaactccgttcgcttgcacaggagggggttcgaggagctctacgtcttcagcccagggtcccagtaccagtggtacggcaagtacgcctacgtggtcgtagggcccgccatgctggaacccgtggtgctgggccccggagacacgtggcagggcgctcagtacctgcgcaaccccaatgcctaggctcaccaaccggggcaagaaatgtgaaatgacagacgaggatactgg

SEQ ID NO: 6080 - protein, 399 aa, Panicum virgatum
  misc_feature: Ceres CLONE 1831151
  misc_feature (1)..(307): Pfam Name: Aldose_epim Pfam Description: Aldose 1-epimerase
MAPFCAPAATAAPHATPTPLTSSRKHIAMCLSPKQGGGGGGGGQRARLASSAAPQVRALSPATAAEEAADPFPAPVNVEYLAAEFAGHGVGFEPVGGSCAVKMALRNGSVAHLLLPSGLVTSYKPAMWHGTVTEVLHTNVAEGPGGRAAIRGGVSVDLRCAAGGGGWSPSGAWSLRDVRGNPTTSIEIELVSAAPGSAAAARCVVTLHPEALATELAVTNTAPAPMALSCGVSNHLRVSTPDATYALGLQGSDYRSVEPALSEFSIIPPDYGAAAGSARHRWANRGFDMILSGGGRDRGAADDQPDGEEDDDYKHMTDAMCRIYSHAPRDFAIIDRGRRNSVRLHRRGFEELYVFSPGSQYQWYGKYAYVVVGPAMLEPVVLGPGDTWQGAQYLRNPNA

SEQ ID NO: 6081 - DNA, 1210 bp, Panicum virgatum
  misc_feature: Ceres CLONE 1831183
  misc_feature: Encodes the peptide sequence at SEQ ID NO. 6082
gggccacaatgtcaaccacacaacctgctggagcctggaacccggggaaccctcgcgcagcccccctcgcgtccccatggagcctccgcatgagtccgccgccggtggccgcaagcgacgccggcgaggtggcgaccggaaccgctggaagccctcttcgtcctcgcaacaagaacctccgccagcggcggcacccgcaccgctgtcctcccctccggcaaagcggcggcgcaaggacggcaccggccaggccgcggccgcacccaagcgaggcaacacctcgagcctactcgaaaagatgcgtgcaaggttatctggtggccatttcagaatgctaaacgagaagctctacacttgcagtgggcaggatgcgtttgactacttcaaaaatgaccctactctttttgatgtgtatcatacaggatatcgagaacagatgtcacattggccagagcagccagtaaatgtgataatcaattggttgaagagacataatgcatcatggactgttgctgattttggatgtggcaacgcagcagttgcaaaaaatgtggagaacaaggttttctccattgatcttgtttcagatgatccttcagtgattgcttgtgatatggctcatactccattggagtcatcctcggtagatgttgcaatattttgtctttctttgatgggaaccaactatccaaattacttggaggaagcaaatagggtactcaatccaagtggttggcttgttattgccgaagtgcgaagtaggctagacccaaataacggtggtgctgaccctgaaaagttttctaaagccatcatccagcttggcttttcccttgtttcaaaggacgagaaagacaaaatgttcattctgttctacttcaagaaaaaggaaaagagtaaggtggcaaagagcatcgattggcctcagttgaaaccttgcctgtacaagcgtcgctgatctcatatccgccagtaaaactgtagtcgcactagaactcttgaaaagttacaaactggtgtatcttgttagattattaggtctcagcatgccaggctctcccacctctgttgtttcaaccttttccccacaacagccgtgtctttttatgtattggacctcacaaaacaagaccgcttgacctattggctagtgcaatgcgatgtcatccggaagcatgttttttttctcgaaaaaaaaaaaaaaaaaaaa

SEQ ID NO: 6082 - protein, 293 aa, Panicum virgatum
  misc_feature: Ceres CLONE 1831183
  misc_feature (5)..(209): Pfam Name: Methyltransf_8 Pfam Description: Hypothetical methyltransferase
MEPPHESAAGGRKRRRRGGDRNRWKPSSSSQQEPPPAAAPAPLSSPPAKRRRKDGTGQAAAAPKRGNTSSLLEKMRARLSGGHFRMLNEKLYTCSGQDAFDYFKNDPTLFDVYHTGYREQMSHWPEQPVNVIINWLKRHNASWTVADFGCGNAAVAKNVENKVFSIDLVSDDPSVIACDMAHTPLESSSVDVAIFCLSLMGTNYPNYLEEANRVLNPSGWLVIAEVRSRLDPNNGGADPEKFSKAIIQLGFSLVSKDEKDKMFILFYFKKKEKSKVAKSIDWPQLKPCLYKRR

SEQ ID NO: 6083 - DNA, 1323 bp, Panicum virgatum
  misc_feature: Ceres CLONE 1831196
  misc_feature: Encodes the peptide sequence at SEQ ID NO. 6084
aaaaacgtaaaccagcgtcccgccttaaaccgcctcttccgcttccgctcctctcgggcgtctgtccatggccggcggcggcgagaagacactggcgggttccgcccagccgcggaaggcccctacccctcatgcgtcggactatggaaggtctttggaacggcaaaagcagggggcatgtacattctctccttcacttagcagcaaatattcacctcaacagttggttgcacctgctcacccaccgcaagctgcagactccagaagcagttcatatagtgctggatctgtgggatctgattctggagcttccccatttgacatatgtttgagtggtaacaaatgcggcatcaagttgaattcttctttacttgagatcaacagagcaaaaagacgggacagggaactttccaaggatgctccattccagtacttgagacctgggatggttctgttgaaaagattcataaagcctaatgatcaggttaaaattgtcaaagtttgccagcagcttggtgttggttcaggaggattttatagacctggctaccgagatggggctatgttaagactctggatgatgtgcttagggaaaaactgggatccggattcacactcatatggcgatacacgtccgttcgatggagctcaaccaccgaccataccagaagaattcaggaagtatgttcaagatgccattcaagcttcccatgaactcctgaaacaaaacataggagctgtcaatgctgtggacgaacttcctctgatgtcaccagatatctgccttgttaacttctacaacagtagtgggaggctaggtcttcatcaggacaaagatgaatcaatgagcagccttgataagggattgcctgtcgtttctttttcattaggcgataccacagaattcttgtatggcgatgttagagatgaagagaaggtttcaaaggttgctcttgaatctggtgacgtccttatatttggtggtaagtcgaggctgatattccacggggtttccaacatgaaacctaatacggcgccaaagtggctgacggatgagacaagtcttcgacctgggcgtctgaatctcacattcaggcagtactagacagttgcctactaaccagtagaaggtcacttatctttttttgtacgtatctcagtatgttgttaccaaaaaaattgcagtagattctatctagtaactgaagatcatgaatgcaccgctgcattgaatgtttgttaccctgataaatcttttgccttcatcttgcatgtgaatatatgggaattcagagttgcagacaaaaaaaaaaaaaaaaaaaa

SEQ ID NO: 6084 - protein, 345 aa, Panicum virgatum
  misc_feature: Ceres CLONE 1831196
  misc_feature (1)..(111): Pfam Name: 2OG-FeII_Oxy Pfam Description: 2OG-Fe(II) oxygenase superfamily
MAGGGEKTLAGSAQPRKAPTPHASDYGRSLERQKQGACTFSPSLSSKYSPQQLVAPAHPPQAADSRSSSYSAGSVGSDSGASPFDICLSGNKCGIKLNSSLLEINRAKRRDRELSKDAPFQYLRPGMVLLKRFIKPNDQVKIVKVCQQLGVGSGGFYRPGYRDGAMLRLWMMCLGKNWDPDSHSYGDTRPFDGAQPPTIPEEFRKYVQDAIQASHELLKQNIGAVNAVDELPLMSPDICLVNFYNSSGRLGLHQDKDESMSSLDKGLPVVSFSLGDTTEFLYGDVRDEEKVSKVALESGDVLIFGGKSRLIFHGVSNMKPNTAPKWLTDETSLRPGRLNLTFRQY

SEQ ID NO: 6085 - DNA, 1338 bp, Panicum virgatum
  misc_feature: Ceres CLONE 1831230
  misc_feature: Encodes the peptide sequence at SEQ ID NO. 6086
gggcagcggctaggcctcccctagtgttaaacgggcgcacgcgcgtgcgcgcccgacccgctcgctccgcgccccgatgcgcccccgccggccggaagaaccctagccctaagcaggggggctcccgtccccaccgatgcgcgggcggccggggtacctcaccctgccgatcgtctcggtgctggcggcgatcgggtacgtctactacaccgcggtgttcctggccgtgccgcggtggctgggcctgtccacggcggccggggtcgccaacgccgccgcgttcacggcgcttgccgccgcctgcctcgccacctacgccgtcgccgtgcgcagggaccccgggcgcgtgccgccgggctacgtgcccgacgtcgaggacgccgagagcaccgtccacgagatcaagcgcaagagtggtgacttgagatattgccagaaatgctgccactataaacctccacgtgcacaccattgccgtgtttgcaagagatgtgttctaaaaatggaccatcattgcatttggattaataactgtgttgggcacgagaactacaagattttcttggtctttgtattgtatgctgtagttgcaagcttctatgcaatgattctgattataggaagcgttatgcacagtgttcctaaagacgaacagtcaggcagtgattcttctcgaacatccattattatttgtggagtcattctttctccattagcattggcgttggcagtgctcttgggttggcatatttacctcgtattacagaacaaaactacaattgagtaccatgaaggagttagagcgatgtggttggcagaaaagggtggagatctctatcatcatccatatgaccttggtgtctatgacaatcttatttcagttctggggcctaacatattctgctggctctgccctatatcaaatactacaggaaatggcctttggtaccgtacatcttatgatattcctaagtctacaccaccaatgtgattaaaaaagacaatagtacattcacataggtagttgctaatttgtgaaaggatttcccattcggctgctagaacgtgcttgttctgaacaattctgaattggggcactgcaagatccagattactacaagctttctcctggtgtctatcctgagtcgagacatgaatatgttaacctagatttttctttcattcttcacatacatcttgagaaaaatattctgcctcgcttgtaatctggagtaggctgtgcttacaaaaatctgagaaaaacaattctgttgtaaagttatgttcatgttttttgagagccaatgtagccaaaggtcatgaaaaacagttttgccc

SEQ ID NO: 6086 - protein, 284 aa, Panicum virgatum
  misc_feature: Ceres CLONE 1831230
  misc_feature (1)..(65): Pfam Name: zf-DHHC Pfam Description: DHHC zinc finger domain
MRGRPGYLTLPIVSVLAAIGYVYYTAVFLAVPRWLGLSTAAGVANAAAFTALAAACLATYAVAVRRDPGRVPPGYVPDVEDAESTVHEIKRKSGDLRYCQKCCHYKPPRAHHCRVCKRCVLKMDHHCIWINNCVGHENYKIFLVFVLYAVVASFYAMILIIGSVMHSVPKDEQSGSDSSRTSIIICGVILSPLALALAVLLGWHIYLVLQNKTTIEYHEGVRAMWLAEKGGDLYHHPYDLGVYDNLISVLGPNIFCWLCPISNTTGNGLWYRTSYDIPKSTPPM

SEQ ID NO: 6087 - DNA, 1687 bp, Panicum virgatum
  misc_feature: Ceres CLONE 1831239
  misc_feature: Encodes the peptide sequence at SEQ ID NO. 6088
accacaagtgcaaacgtgcaacacaataacgccctcccctgcctctcgctgctctccggctagtttggctagctgctccctgttcctactctgcttcgctcactgcagctgacaagctgagctgagctccctcccctgtttgcacgtatacaagacacgaggagaaagacggtagccgagtagagagcccgcgcgctcgttggccatggtagcgatcacggcgccgagctcgatggagcagatcccgctgatgcggtgccccaaggccaatgcgggccaggcgggcgcggccatcccgtgcgtcgacctgtcggcgccgggcgcggcggcggcggtggcggacgcgtgccgcagcgtgggcttctttcgggcgaccaaccacggcgtgccggcgggcgtcggcgaggcgctggagtcccgcgcgatggcgttctttgcgctgcccgcccaggacaaggtggacatgtccggcgccgcccggcccctgggctacggcagcaagaccatcggctccaacggcgacgtcgggtggctggagtacctcctgctgtccgtcagctccaactccgtcaaggtctcctccctgccgccgccactccgggcggcattggaggagtacacggcggcggtgcgcgaggtgggcgcgcgggtgctggagctgatagcggaggggctcggcgtggaccgggcgctgctgcggtcgatggtggtggagcgggagggcggcgacgagctggtgcgggtgaaccactacccgccctgcccgctgcgggcgccgggggactgcggcgtgacggggttcggggagcacacggacccgcagatcatctccgtgctcaggtccaactgcaccgcgggcctgcagatcaagctccgggacggcaggtgggtccccgtgccccccgacccggaatccttcttcgtcaacgtcggagactcgctgcaggtcctgacgaacgggcggttccggagcgtgaagcaccgggtggtggcgccggagggggcgcagtcgcggctgtccgtgatctacttcggcgggacggcagcgtcgcagcggatcgcgccgctgccgcaggtgatgcgggacggggagcagagcctgtaccgggagttcacctggggcgagtacaagcgcgccgcctacaagacccgcctcgccgaccaccgcctcggccccttcgagctgcgcgccgccgccagcagcgagcccgccgatccgcagccgcactgcagcaccagcaccagcacctgcatgccgccccagcagcagcagcaggtggcgcaggtgtactagctgggacctgggacaggcgtgccaggctaggctctggctgcagccggagccccctctgctggatggaatcatcgattcgacctcgccttttgtagcagtaaccctggtgttgtctgttgcctcatgcctgggactggccggtccaggactggcacctgcaggcctgcttcttctctcgctcgctgcgggctctgtgccagagcttgacggccttgaccactgccctgcctgcgtgtacatgccgggccgtccttgtaacttacttcccgtagtagtagttactgtttgtgtgcatgctgccacttttgttacttactgtgctctactttaaccggctggcagttgctaattacttcaattaggctgcggatgtaaaaaaaaaaaaaaaaaaaa

SEQ ID NO: 6088 - protein, 362 aa, Panicum virgatum
  misc_feature: Ceres CLONE 1831239
  misc_feature (2)..(113): Pfam Name: 2OG-FeII_Oxy Pfam Description: 2OG-Fe(II) oxygenase superfamily
  misc_feature (1)..(330): SWISSPROT Homolog: EC 1.14.11.13 Gibberellin 2-beta-dioxygenase
MVAITAPSSMEQIPLMRCPKANAGQAGAAIPCVDLSAPGAAAAVADACRSVGFFRATNHGVPAGVGEALESRAMAFFALPAQDKVDMSGAARPLGYGSKTIGSNGDVGWLEYLLLSVSSNSVKVSSLPPPLRAALEEYTAAVREVGARVLELIAEGLGVDRALLRSMVVEREGGDELVRVNHYPPCPLRAPGDCGVTGFGEHTDPQIISVLRSNCTAGLQIKLRDGRWVPVPPDPESFFVNVGDSLQVLTNGRFRSVKHRVVAPEGAQSRLSVIYFGGTAASQRIAPLPQVMRDGEQSLYREFTWGEYKRAAYKTRLADHRLGPFELRAAASSEPADPQPHCSTSTSTCMPPQQQQQVAQVY

SEQ ID NO: 6089 - DNA, 993 bp, Panicum virgatum
  misc_feature: Ceres CLONE 1831246
  misc_feature: Encodes the peptide sequence at SEQ ID NO. 6090
atctggcaaaagcccttcctgttcgtcgtgttgctgcgctcctcggcaagtccaagtcgggagagaagaaagaaacctcgaaaccctagccctgcgctccccctctccagtctccagcttcccggctgctaggaggaagctatgggcgccgaggaggacgctaccgcccgccgcgagcgcctccgtgccctccgcgccgccaaggagctcctctccaccccagcccccgacggagagcagcaaaatgggacccatagtgccaatgaagaacatgtggaacagccagcattaccagctccacaggatgcacctgatgaggcttctaaggagaatattagctccattgaggaggtcgaggatgttgaagatgatggtgagcttcctgccatgaagttcagaaactaccttcctcacgatgaacaacttcgaggtggtaagatggctccagtttctcttcctaagtttgaagatccaatcagtgccgaaactacagaaccaaagcaagtggagaacccctttggaaacatagccccaaagaatccaaactgggatctgaaacgtgatgtgcagaagagaattgataaactggagaagcgcacacagaaagcattggctgagattgcattggagcaacagagggagaaagaagccctggaggaagctcaagattgatcaaactgagtcagtgacaaaaactgtaatatgtaaggtactgggggtgcttagtgtatctactggtggggatgaactgaagtgaaccaaccttgatgagtatgagacgtggtgtctggctagtccttgtttttgagaggaaagctaacatataaaactagagtgaaatgtgcccagtgcctcttgaaagcccgagctgtagtagttgtcctgttttgcgtttaccgtatcaaactagtgtgttgattacgaagcatgccttcatgctgcatttaacagagtgaatctttgacattctggctcaaaaaaaaaaaaaaaaaa

SEQ ID NO: 6090 - protein, 176 aa, Panicum virgatum
  misc_feature: Ceres CLONE 1831246
  misc_feature: Great-hit functional homolog of the protein sequence encoded by LOCUS At3g05070
  misc_feature: Useful for making plants with altered cell wall content and/or composition
MGAEEDATARRERLRALRAAKELLSTPAPDGEQQNGTHSANEEHVEQPALPAPQDAPDEASKENISSIEEVEDVEDDGELPAMKFRNYLPHDEQLRGGKMAPVSLPKFEDPISAETTEPKQVENPFGNIAPKNPNWDLKRDVQKRIDKLEKRTQKALAEIALEQQREKEALEEAQD

SEQ ID NO: 6091 - DNA, 1323 bp, Panicum virgatum
  misc_feature: Ceres CLONE 1831249
  misc_feature: Encodes the peptide sequence at SEQ ID NO. 6092
accacccaccccccaccacccttgtggtccaggtcatggagtccgccctcgtctcgcgatccgttgggtcctccttcgccgccgctgcccccaggggttgtttgccccggccctcgcgcgtcgccaccttcaccggcgcacgcgcccgcgcccgcccgctccgcgccggcccccccaaggactcaattcttgaagcgctggctaaggacgacatgctgaacgccgaggagctggtccaatgggagaacggcaagtcggtcaacggcattgcagctagccaggggatccgcatccgcaggcactgccgccccactgcctccttgaaggagatagaggaggagatgggggcgcctcgcaacatcctagagaagatcatctgggacaaggagatcgaagtggctgaggggcttgcgaagaaccctctgaaggaggtgatggaggctgcagtgaaggctcctccttcaagagacttctatggcgctttagaagctgcctataagcgtaatggggtgcctgcactgatcgctgaggtcaagaaagcatccccgagcaggggtgtgctcagggagaactttaatcctgttgaaattgctaaagcttatgagaagaatggggctgcatgtttgagcatcttgaccgatgagaagtactttcagggaagctttgagaatcttgagaaagtgcgcacctcaggagtgaagtgccctcttatctgcaaagaatttgtcattgataagtggcaaatatataacgctcgatcaaagggtgccgatgcaatcttgctgattgctgctgtgctaactgatctcgacataaagtactttcttcggatatgcaaggagctgggaatgacagctcttattgaggttcatgatgaaagagagatggagcgtgtgctgaatataaatggagttaagcttatcggcatcaataatcgcagccttgagacatttgttgttgatactgcaaacaccaagatgttgctcgagaagcatggggatagcattagggagaagggaattttggttgtgggtgaatctgggctgtttaccccggatgatgttgcttatgtgcagaatgctggtgtctctgctgttttggtgggagaatccctggtgaagcaagaggaccctggacgagccatcgctgggctgtttgggaaagaattactgcattgaaaggacaaagagtctagtagtacttgctttgaaataataacatgtgagcattagttgtattaagaaattcgtatatcgccaattcgccatatgcaaaataaaaataatgttcacttgtaagcttcaaaaaaaaaaaaaaaaaaaa

SEQ ID NO: 6092 - protein, 380 aa, Panicum virgatum
  misc_feature: Ceres CLONE 1831249
  misc_feature (1)..(280): Pfam Name: IGPS Pfam Description: Indole-3-glycerol phosphate synthase
  misc_feature (48)..(380): SWISSPROT Homolog: EC 4.1.1.48 Indole-3-glycerol phosphate synthase, chloroplast precursor
  misc_feature (98)..(376): SWISSPROT Homolog: EC 4.1.1.48 Indole-3-glycerol phosphate synthase
MESALVSRSVGSSFAAAAPRGCLPRPSRVATFTGARARARPLRAGPPKDSILEALAKDDMLNAEELVQWENGKSVNGIAASQGIRIRRHCRPTASLKEIEEEMGAPRNILEKIIWDKEIEVAEGLAKNPLKEVMEAAVKAPPSRDFYGALEAAYKRNGVPALIAEVKKASPSRGVLRENFNPVEIAKAYEKNGAACLSILTDEKYFQGSFENLEKVRTSGVKCPLICKEFVIDKWQIYNARSKGADAILLIAAVLTDLDIKYFLRICKELGMTALIEVHDEREMERVLNINGVKLIGINNRSLETFVVDTANTKMLLEKHGDSIREKGILVVGESGLFTPDDVAYVQNAGVSAVLVGESLVKQEDPGRAIAGLFGKELLH

SEQ ID NO: 6093 - DNA, 1215 bp, Panicum virgatum
  misc_feature: Ceres CLONE 1831256
  misc_feature: Encodes the peptide sequence at SEQ ID NO. 6094
ctccctcgacccgccgccgccgccgccacctaagggctccagccccgcgccgccgagctatcgagctcaggcggaagatctttccccgggatctgatccctcgagctctcccctcactccgcgccgtccctcagctcctgttcccccactgcgcagcctgtccccctccctcgcgtcctcttatctgcttagcttgattctacgaaaatcggcacactcagttgtgcatgactacattggttcggctcgccggaagatcagcttcctggagcaggagtggcaaatcggcggtgccctctggtctcggcttgtttgcacagcgtcggagggcgtttcagggggtgagaatggcgaatgctggcagtaagagtgggcgaggtgctctgattgtactggaagggttggaccggagtggcaaatcgtcacagtgtgctcggctgctgtcctatctggaaggccaaggttgccgtgctgaagggtggcgcttcccggataggggcaccagtgttgggcagatgatctctgcctacctagctaatgagtcgcagcttgatgacagaacggttcatttgctcttcagtgcaaaccgctgggagaaaagggctttgatggaaagcaagctacttgatggaactactctcatcgtagatcgttattcttattctggagtggctttctcagctgataaagggcttgatattgaatggtgcaagtctccagatgttggacttatagctccagatcttgtaatttatctggatgtacaaccagagaaagcgtctgaaagagggggctatggtggtgagcgatatgaaaaggttgaattccaaaagagagttgcagatcattatcattcactctgtgattcgacatggaagattgttgatggttccctttccatggagaccgtggaagaacagctgagagaactggctacgaactgcattcaggagtctcaagagaagccacttaccaatctgacttggtgaagcgccaccatcccgtgaagaaacacagctcagcaaaggctgatacatccgcgtctttatgtgatccacaccgttgctggtgatgagaaattaggcatctggcagagctttcatttaccattctctctatcaccatcccgcgtacaatatacaattccacatttgattggtgttttcagataacattctttctacgcttatttctcaaaaaaaaaaaaaaaaaaaa

SEQ ID NO: 6094 - protein, 253 aa, Panicum virgatum
  misc_feature: Ceres CLONE 1831256
  misc_feature (1)..(177): Pfam Name: Thymidylate_kin Pfam Description: Thymidylate kinase
  misc_feature (50)..(253): SWISSPROT Homolog: EC 2.7.4.9 Thymidylate kinase
MTTLVRLAGRSASWSRSGKSAVPSGLGLFAQRRRAFQGVRMANAGSKSGRGALIVLEGLDRSGKSSQCARLLSYLEGQGCRAEGWRFPDRGTSVGQMISAYLANESQLDDRTVHLLFSANRWEKRALMESKLLDGTTLIVDRYSYSGVAFSADKGLDIEWCKSPDVGLIAPDLVIYLDVQPEKASERGGYGGERYEKVEFQKRVADHYHSLCDSTWKIVDGSLSMETVEEQLRELATNCIQESQEKPLTNLTW

SEQ ID NO: 6095 - DNA, 1043 bp, Panicum virgatum
  misc_feature: Ceres CLONE 1831278
  misc_feature: Encodes the peptide sequence at SEQ ID NO. 6096
atccgtagtaggaatagtctgccgtcgaaatttacctgcggcccggaagccacggaagcggaagcgatagcgggacgccgacatgccgtgcctggtcgcgctccaaccggtggcccggcccggcggccggcggcggccgccgacttcagcaacccgccgcggccgcaccctcgccgcccacccttgcggctgccgctgcggccggcggtgcctcatcggtgcctccgccctcctccctctagtcgcacctccctccccggccgcgccgcccgtcgaccccgaggtgatgctcgagcgagtgcacccgtcgaggccgtactggtacgaggagttctatgccacggccatggaccagggcatgaagtcatacgaagcagagattgcaggatataaagcaaagctcttttctcaattgtcggctacaggaaagagcattctggagcttggtgttggaacaggccctaacttcaaatattatgcaagcgatagtggggttaatataattggagtggatcctaacaagcacatggaggactatgccagaactgcagcagtatctgcaggacttccatcatcaagcttcactttcaaaagaggggttgctgaagctttgccagcagaggacaattccatggatgtggtgattggcacactggtattgtgttctgtaaataacattgacatggcgttgagagagatatatagagtcctaaagcctagcggtctctatctgttcgttgagcatgttgccgcaccagatggttccttgctccgattcgtacaaggcgccttcgatccgttgcagcaattcgttgctgacggatgccacctcaccaggaaaacgggagaaaacatcagagacgtggggttctcgagcctgagcctagacagtgtccggctctcaaatgcatacatcattagccctcacgtttatggcgtagcctccaagtgaagttttccgctgtaaatgatgatgcaccttccatctctgtgatgatgtttgtgatgatgcagagcaatgattcctcacgtttatggctctc

SEQ ID NO: 6096 - protein, 289 aa, Panicum virgatum
  misc_feature: Ceres CLONE 1831278
  misc_feature (1)..(100): Pfam Name: Methyltransf_11 Pfam Description: Methyltransferase domain
MPCLVALQPVARPGGRRRPPTSATRRGRTLAAHPCGCRCGRRCLIGASALLPLVAPPSPAAPPVDPEVMLERVHPSRPYWYEEFYATAMDQGMKSYEAEIAGYKAKLFSQLSATGKSILELGVGTGPNFKYYASDSGVNIIGVDPNKHMEDYARTAAVSAGLPSSSFTFKRGVAEALPAEDNSMDVVIGTLVLCSVNNIDMALREIYRVLKPSGLYLFVEHVAAPDGSLLRFVQGAFDPLQQFVADGCHLTRKTGENIRDVGFSSLSLDSVRLSNAYIISPHVYGVASK

SEQ ID NO: 6097 - DNA, 1183 bp, Panicum virgatum
  misc_feature: Ceres CLONE 1831324
  misc_feature: Encodes the peptide sequence at SEQ ID NO. 6098
atcggcctttccgtctccacaagcttcgcctgctctgctccggccccctccgccccctttggccctttcttgactccctctctctctccgcacaaggaaagctccgagctttctctctctacccggagggagaagcgaggaagccggcgccgcctgttggcgctgggggctggcagctgcccgcgctccaaggaatcgagttcttggagggccgtccgttccatggcggcgcagcggggcgacctggggcggcagctcccgctgagaggccccctcaaggccctagaggccgacatacaccacgccaacgccatggcggatgccattcagaggaactatggtggagcatgcgtgcagatgaggctgtcgttcagctccctggctccattcttcctgtacctcgtccagtggctggattgcggatgctgctacgctcttcccagttatttaggactctttcacattctcatatgcaaggtttatgcagatggggatagctcggtgtcaacatatgaaaggcgggcaagccttagggaattctacgcaatcatctatcctattctgcagcagcttgagagtagtctgattgagagggacctgaaagggaagggtcgatgcaaagatatagtgagtaggaggcgtatggaggattggaaaaggctttctggcaaggatgtagaaagggaggatgaatgtggaatttgcatggagacatgcaccaagatggtcctgcctaattgcagtcatgcaatgtgcataaaatgctatagggactggtataaaagatcagaatcttgccctttctgccgaggaagcctcaaaagaatccgctcaagagacctttgggtacttacaaactacaatgatgtcattgaccccgcaaatttagaaagagaaaatgtgaggcagttctatagttatattgacagcttgcctcttatacttcctgataatattttctttttctattatgattacctaatataatccagaagcaccatacattgaatgtgtaaattgtgaaatcagatgaaattaacgtagttcttctttggtagatgaaaggcattcctttctttgaccaacatgcatttgtatttacttgtagcgtagcaatgtaacactaacagaacagtgaataaaatttgtaggtgatattcattaaaaaaaaaaaaaaaaaaaa

SEQ ID NO: 6098 - protein, 254 aa, Panicum virgatum
  misc_feature: Ceres CLONE 1831324
  misc_feature: Great-hit functional homolog of the protein sequence given in SEQ ID NO 9295
  misc_feature (1)..(38): Pfam Name: zf-C3HC4 Pfam Description: Zinc finger, C3HC4 type (RING finger)
  misc_feature: Useful for making plants with altered Lignin content
MAAQRGDLGRQLPLRGPLKALEADIHHANAMADAIQRNYGGACVQMRLSFSSLAPFFLYLVQWLDCGCCYALPSYLGLFHILICKVYADGDSSVSTYERRASLREFYAIIYPILQQLESSLIERDLKGKGRCKDIVSRRRMEDWKRLSGKDVEREDECGICMETCTKMVLPNCSHAMCIKCYRDWYKRSESCPFCRGSLKRIRSRDLWVLTNYNDVIDPANLERENVRQFYSYIDSLPLILPDNIFFFYYDYLI

SEQ ID NO: 6099 - DNA, 1318 bp, Panicum virgatum
  misc_feature: Ceres CLONE 1831367
  misc_feature: Encodes the peptide sequence at SEQ ID NO. 6100
aatcgcaatccactcgagcatcccccagctccgaaatcccccgattccccatcccctccagacccctcgagagtcgaatcctccggtcccggcgacgatgccgtccgcgccggtgctcgtgcccgcgtgcgacgcggaggagcccttgctggcggagtcgtcggaccgcttctccatgttcccgatccggttcccgcagatctgggagttctacaagaaggcggtggcgtccttctggacggccgaggaggtggacctctcggccgacgcgcgccactgggacgcggcgctctcccccgacgagcgccacttcatctcccacgtgctcgccttcttcgccgcctccgacggcatcgtgctcgagaacctcgcctcccgcttcatgtccgacgtgcaggtcgccgaggcgcgcgccttctacggcttccagatcgccatcgagaacatccactcggagatgtactcgctgctgctggagacctacatccgcgacggcgccgagaaggaccgcctcttccgcgccatcgacaccgtccccgccgtgcgccgcaaggccgactgggccatgcgctggatcgacggcggggagcgcttcgccgagcgcctcgtcgccttcgcctgcgtcgagggcatcttcttctcgggctccttctgcgccatcttctggctcaagaagcgcggcctcatgccgggcctcaccttctccaatgagctcatctcccgcgacgagggcctccactgcgacttcgcctgcctcctctacgacctcctccgcagcaagctcgacgagggccgcgtccgcgagatcgtcgccgacgccgtcgacatcgagcgcgagttcgtctgcgacgcgctccccgtcgcgctcgtcggcatgaacggcggcctcatgagccagtacatcgagttcgtcgccgaccgcttgctcatggcgctgggccacaagaagatgtacaacgttgccaaccccttcgactggatggagctcatctcgctgcagggcaagaccaacttcttcgagaagcgcgtcggggagtaccagaaggcgtccgtgatgtccagcctcaacggcggcggcgccgcgaaccacgtcttcagcatcgacgaggacttctgagttgtgccagcgcgcgccctaatatattgctctgaataattttatctgctttggtcgcttactagttgtagtagatctagttaatgtactgcatgatgatgcataatgtgctgtgttactagttcctgttcgtcatgtaatgtagtaatcgacttctgaatacactggctgttctgaagccaaaaaaaaaaaaaaaaaaaa

SEQ ID NO: 6100 - protein, 339 aa, Panicum virgatum
  misc_feature: Ceres CLONE 1831367
  misc_feature (1)..(282): Pfam Name: Ribonuc_red_sm Pfam Description: Ribonucleotide reductase, small chain
  misc_feature (14)..(339): SWISSPROT Homolog: EC 1.17.4.1 Ribonucleoside-diphosphate reductase small chain
  misc_feature (14)..(339): SWISSPROT Homolog: EC 1.17.4.1 Ribonucleoside-diphosphate reductase small chain C
MPSAPVLVPACDAEEPLLAESSDRFSMFPIRFPQIWEFYKKAVASFWTAEEVDLSADARHWDAALSPDERHFISHVLAFFAASDGIVLENLASRFMSDVQVAEARAFYGFQIAIENIHSEMYSLLLETYIRDGAEKDRLFRAIDTVPAVRRKADWAMRWIDGGERFAERLVAFACVEGIFFSGSFCAIFWLKKRGLMPGLTFSNELISRDEGLHCDFACLLYDLLRSKLDEGRVREIVADAVDIEREFVCDALPVALVGMNGGLMSQYIEFVADRLLMALGHKKMYNVANPFDWMELISLQGKTNFFEKRVGEYQKASVMSSLNGGGAANHVFSIDEDF

SEQ ID NO: 6101 - DNA, 982 bp, Panicum virgatum
  misc_feature: Ceres CLONE 1831371
  misc_feature: Encodes the peptide sequence at SEQ ID NO. 6102
acactcggcactctctcggcagccgcgaacgccttcgccgtcgcgcgcgcaagagagagaggcagactcatggccggcgcggcggccgacgacgccgggatggacgccgtgcagaggcggctcatgttcgaggacgagtgcattttggtggatgagcaggacaatgttgttggccatgaatcaaaatacaactgccatctgatggaaaagaatttgctccatagggctttcagtgtgttccttttcaactcaaaatatgagctgctactccagcaaaggtccgcaacaaaggttacatttcctttagtttggagcaactcctgctgcagccatcctctgtaccgtgagtctgagcttatccaggagaacgaccttggtgtgagaaacgcagcacagaggaagctcctggatgagctgggcatcccagctgaagatgccccggtcgaccagttcacccctgttggccggatgctctacatggccccagctgacgggaaatggagcgagcacgagatcacccacattctgttcctcgtccgggacgtggagctgcggccgaacccggacgaggttgccggcgtcaggtacgtgagccgcgagcagctgaaggagctggtccgggaggcggacgccggcagcgaggacggcgtgaagctctccccctggttcaggctgatggtgaacaacctcctcatgggctggtgggaccatctcgagaagggcaccctcagtgaggccgcggacatggagaccatccacaacctcaaggagtgaagggccgccggccgccgcgccggggctccgacgaccgacgaccttgtcgttgctggaactggaatgttggccttgcctgtggcatgctacgtatgtcgtctaaataaacagcaataagacgaattcgtcgtcgctacacgtacaccgtgatcagattcagatcaataagacgaagagcgttcttccccaaaaaaaaaaaaaaaaaaaa

SEQ ID NO: 6102 - protein, 234 aa, Panicum virgatum
  misc_feature: Ceres CLONE 1831371
  misc_feature (3)..(232): SWISSPROT Homolog: EC 5.3.3.2 Isopentenyl-diphosphate Delta-isomerase I
  misc_feature (3)..(232): SWISSPROT Homolog: EC 5.3.3.2 Isopentenyl-diphosphate Delta-isomerase II
MAGAAADDAGMDAVQRRLMFEDECILVDEQDNVVGHESKYNCHLMEKNLLHRAFSVFLFNSKYELLLQQRSATKVTFPLVWSNSCCSHPLYRESELIQENDLGVRNAAQRKLLDELGIPAEDAPVDQFTPVGRMLYMAPADGKWSEHEITHILFLVRDVELRPNPDEVAGVRYVSREQLKELVREADAGSEDGVKLSPWFRLMVNNLLMGWWDHLEKGTLSEAADMETIHNLKE

SEQ ID NO: 6103 - DNA, 1247 bp, Panicum virgatum
  misc_feature: Ceres CLONE 1831372
  misc_feature: Encodes the peptide sequence at SEQ ID NO. 6104
acgcagcaaactgcaaacccgagcacaccaccaccattattagctgccactcgaagaggaaaggaagcatcttgatccatcttgagtggtagggtccagcaggagcgagcggcgagccatggagaaggcggccgagaatgcgagccaggcggcggcgccgctgaagctgttcgggtcgtgggcgagctcctacacgcaccgcgtgcagctggcgctgcgcctcaaggggctggacttcgagtacgcggaggaggacctcgggagcaagagcgccgagctgctgcgccacaaccccgtgtacaagaaggtgcccgtgctcgtccacggcggccgcgcgctcccggagtccgtcatcatcctccagtacctcgacgacgcctggccggagacccgcccgctcctccccgccgacgccttcgaccgcgcgctcgcgcgcttctggtgccacttcgccgacgacaagctcgggccggcggtgggcgcggtgttcgcgtcgacgggggaggaccaggaggcggcggtccgccaggtgcacgagaacctcgccctgatcgaggcggagctccgcgacggcgcgttcaggggccggcgcttcttcggcggcggcgaggtgggcctcctggacgtcgtcctcggctgcggctcctactggctcgccgtgttcgaggaggtgaccggggtgcgcctcgtggacgccgacgcgttcccgctcttccacgcctggctgcgcgacttcgaggccctggacgaggtccgcgagaccatccccgccgtcgaccgcctgctcgagtacgcccgcggcgtgcgccacatgctgctcggccacgccggcgccggcgccgcggccgccaccccggccgaggcgcctgctccggctcccgcggctgacatcgccgttgacatctgatcgttccacaggacgccgccgtgcgggcgccgtccggctgctggtgatcagtagctaggtagctagtagcagtatgatttgccgtgtcgatggcgccatgtgaggcgtgcgggggactgttgaggctgcgtgcccgcccggagtgcgcgcctctgcgttcagtgctcacgcctgaagaggcgcagtctgtctaggtgtctagtttgttttctcaacttcgtcgtcgtcgtcctgttaatctctgtctgccctgagtccttgtggctgggaatcttatgtgtatctactactagtaacctagcagtttagcttgcttgttcaaaaaaaaaaaaaaaaaaaa

SEQ ID NO: 6104 - protein, 262 aa, Panicum virgatum
  misc_feature: Ceres CLONE 1831372
  misc_feature (1)..(74): Pfam Name: GST_N Pfam Description: Glutathione S-transferase, N-terminal domain
  misc_feature (1)..(104): Pfam Name: GST_C Pfam Description: Glutathione S-transferase, C-terminal domain
MEKAAENASQAAAPLKLFGSWASSYTHRVQLALRLKGLDFEYAEEDLGSKSAELLRHNPVYKKVPVLVHGGRALPESVIILQYLDDAWPETRPLLPADAFDRALARFWCHFADDKLGPAVGAVFASTGEDQEAAVRQVHENLALIEAELRDGAFRGRRFFGGGEVGLLDVVLGCGSYWLAVFEEVTGVRLVDADAFPLFHAWLRDFEALDEVRETIPAVDRLLEYARGVRHMLLGHAGAGAAAATPAEAPAPAPAADIAVDI

SEQ ID NO: 6105 - DNA, 1333 bp, Panicum virgatum
  misc_feature: Ceres CLONE 1831389
  misc_feature: Encodes the peptide sequence at SEQ ID NO. 6106
gcgtccctgttgcttgctgcgccggttcttgggggccgaggagacgtcgccgtgggccggggcggcatgtcgaacgccggcgaggcccgaggcgtggggaccgggcgcgggtcgcggctgccgcggtggacgcggcaggagatcctggtgctcatcgaggggaagcgggtggtggagaggagcgggcgcggccgcggccgggggcgggctagggggggcgacggcgccggcgccggcggcgcggagccgaccaagtgggcggcggtggcggagtactgccggcgccacggcgtcgaccgcgggccggtgcagtgccgcaagcgctggagcaacctcgccggcgactacaagaagatcagggagtgggagcgcgtcttcgcggccaggaaggaggcctcgttctgggccatgcgcaacgacgcgcgccgggagaggcgcctcccggggttcttcgaccgcgaggtgtacgacatcctcgaggggcgcgccgtcggtaatgtggcggcggcggcggccacggccgcggcgcgccctgttgtgggggacgtggagagcaaggcggagatgaccgcggcggcgatcgacggcggccgcggggacgatggggccgggctgttctcgtcgtctgaggacgaggatgatcaagaagacgatgcggccacgccaagccccactcccacgccgacgccgacgccgccggcggcgccggtggccttacccatctccgagaagacggctgatgtgcccagacaagagagctccgagcaaggcacatcaaaaagaaagcagccagagcaaattccggaggactcaccagcgcagtgtggggagaagaggcagcgcagcgatgacaacgcctctggacgagccgctatgaccaacctgcaggggcagctggttgagatcctagaccggagtagccagatggtggcggcacagctggaggcacagaacatcaacagccgactggacagggagcagaggaaggaccaggtgggcagcctgctcggtgtgctcggcaaggtggcggatgccctctacagaattgctgataagctgtagccgccagccgccacaggatgtctcttgagcaccgtaaataaaacgctgcaagaatgtacagattgatacaggttcttggcatcctattgttcttgtgggttggttctgaaatttggtcagaaacctgaaatgggatgccctattttttttttttacccatgggatgtgtatctgtatgcctccatggtgcaaaactctgtattatgctggctctggatcctgcagaggaattgaagtgcatatctgatgacaaaaaaaaaaaaaaaaaaaa

SEQ ID NO: 6106 - protein, 331 aa, Panicum virgatum
  misc_feature: Ceres CLONE 1831389
  misc_feature: The sequence is a functional homolog of  SEQ ID NO 980 in the  11/479,226 US patent application
  misc_feature: Useful for making plants with modulated growth and phenotype characteristics
MSNAGEARGVGTGRGSRLPRWTRQEILVLIEGKRVVERSGRGRGRGRARGGDGAGAGGAEPTKWAAVAEYCRRHGVDRGPVQCRKRWSNLAGDYKKIREWERVFAARKEASFWAMRNDARRERRLPGFFDREVYDILEGRAVGNVAAAAATAAARPVVGDVESKAEMTAAAIDGGRGDDGAGLFSSSEDEDDQEDDAATPSPTPTPTPTPPAAPVALPISEKTADVPRQESSEQGTSKRKQPEQIPEDSPAQCGEKRQRSDDNASGRAAMTNLQGQLVEILDRSSQMVAAQLEAQNINSRLDREQRKDQVGSLLGVLGKVADALYRIADKL

SEQ ID NO: 6107 - DNA, 1342 bp, Panicum virgatum
  misc_feature: Ceres CLONE 1831393
  misc_feature: Encodes the peptide sequence at SEQ ID NO. 6108
gtcccacagtcccactccacgccgctggcacaaggcttgcttctacaggacgacgccgctgctccgtccatcacccattccccgccagatcctccacccgctactcctgcgtggagatccaccatcacgcagggtcgctgattgattctttcagtcctgtgctcgaaaagtattagcggaattccaatcgaattgtctaccatcttcacctttatgccacatggcattgtcttcatcaagcatcagagctgcatcctccacagtttaccctgcctatcttggtctccaccaaaaccccaaaagccaccatgcttcttttcatccttcaaaaacaaaccatgccaatacctataaatgcgtcgagtcacccaaaattgctagacgatctctcttcttcctacccgcctcctttcttctccttcacacttcctcctcccttgctgtagatgacacaaacacgccatccactttagcaattgacacaacgattacagatcgcatcttcatggacttcagtgtctgtccaagctactttcgttctgacagaccgttaggagctgagctttcctcatgccctgactctgagccacttggtcgtgttgtctttggtctctatggtcggcttctccccattactgctgccaatttcaaagctacatgtactacagctgcatataggggcactcttgtccacaagctccttcaaggacagtttttttctgctggccgacaaggctctcggcatgacaagggtgaagtccagcctccctcaggcctcattaggaattctgagactgtcaatcctaaagcattcaaactaaggcatgcaagacctggtacactttccttgtgcctcggacagaatgatgatgatgatgacatcaagctcaatcccaattatcacaatgttgaattcttggttaccacagggccaggaccctgtccagagcttgatggccagaacattgtctttggaactgtattggaaggaatggatgttatcaccagcatcgcaaccatacctacctacaaaccagctgaaaggatccgcttcttcaatgactttgcacagttgattggtgacgaaagagctcaaactgctcgggcattgtgggatcgcccacttaagactgtatatatcagcgactgcggagagctaaaagtgaccaaacaatctctttcccctccaagcttaccatgacgttatgcattaacctttttgtgtcactttattactaggatcctttccctgtactccataatctgtatatattccttcttttatcaacttatacgttccgacaaacggttgtatattatacgttccgacaaacggttgtat

SEQ ID NO: 6108 - protein, 326 aa, Panicum virgatum
  misc_feature: Ceres CLONE 1831393
  misc_feature (1)..(202): Pfam Name: Pro_isomerase Pfam Description: Cyclophilin type peptidyl- prolyl cis-trans isomerase/CLD
MALSSSSIRAASSTVYPAYLGLHQNPKSHHASFHPSKTNHANTYKCVESPKIARRSLFFLPASFLLLHTSSSLAVDDTNTPSTLAIDTTITDRIFMDFSVCPSYFRSDRPLGAELSSCPDSEPLGRVVFGLYGRLLPITAANFKATCTTAAYRGTLVHKLLQGQFFSAGRQGSRHDKGEVQPPSGLIRNSETVNPKAFKLRHARPGTLSLCLGQNDDDDDIKLNPNYHNVEFLVTTGPGPCPELDGQNIVFGTVLEGMDVITSIATIPTYKPAERIRFFNDFAQLIGDERAQTARALWDRPLKTVYISDCGELKVTKQSLSPPSLP

SEQ ID NO: 6109 - DNA, 1756 bp, Panicum virgatum
  misc_feature: Ceres CLONE 1831411
  misc_feature: Encodes the peptide sequence at SEQ ID NO. 6110
gagagcgcgcggcgagtatatagctagtatctagcaagctgcatgctgagagcattccgtcacttgcacacctgctagctagctagctctatctactactagcaacgtacgcaaggagcaccaccgtaccactcactcactcactcactcactcaccgatccatccaagacatacaacatcacacactcttcgtgcctgcttggagccgtgacactagcagatctctctgtctgaagctgagtagcttggtcgtggctggtgacccaagaagaagatatcgtatatatagaagagaccggctgaagaagaagaagaagaagaagaagaagaagctaagagacccaggaaggaagatgctggcctgcatcgcgtgcgtgaaagaagaaggcggcggccgggaccgcgaccgcgatgacgctgcgcggtccggcgccggcgacaccccgaccgtcaagtcgctcacctcccagctcaaggacatggtgctgaagctgtccggcacgcaccggcagcagggcgcgcagcagaggcgcgggggatcgccgccggcgaggggccgggccacctccatctaccgcagcggctactaccggccgggcgtggtgcaggacgacatggcggtgcccccggccacttacctgggcgcgtcgagcgcgagcgcgagctccaccccggcgtgggacttggcaggccgcgcggagggcgaggccatggccagggagtgggtggcgcaggtggagccgggcgtgcagatcaccttcgtgtccctcccgggcggcgccggcaacgacctcaagcgcatccggttcagccgcgagatgtacgacaagtggcaggcgcagaagtggtggggcgacaacaacgagcggatcatggagctctacaacgtgcggcgcttcagccggcaggtcctccccacgccgccgcgctccgacgacggcgagagggaatccttctactcgcagtcccaggtgggctccatggcagggagccctgccgccaccccgtcgccggcgccgctcaccccggacaggatcagctggggcgcgttcgcgcggccgccgggcgccgcgcggcagcagcagcagcacagcttccgcccgctctcgccgccgccgccttcctcgtccaacccatcggagcgggcctggcagcagcagcagcggcagaaccacggagcatcagccggcaagagccccgcggcctcagaggccaccgccaccgccaccgaggcggcgaggacgaccacctcgtcgagggacgacgtctccatcagcaacgccagcgagctggaggtgacggagtggatcatccaggacgagcccggcgtgtacatcaccgtcagggagctcgccgacggcagcagggagctacgccgtgtcaggttcagccgcgagaggtttgcagagctgaatgccaagctgtggtgggaggagaacaaggagaggatacaggctcagtacctttgaaacagcacaacttggtgatctgctgccactagggacacacaattaatctggtataagtatatactactagagtttgtgtttgagtttggagatgggggagagataggggccggggtgattaatttggagctgggagagataggaggggatcaggaaacaaggaaatgttcatgcatgtttagggcacctggcagcccaggtaacttgtgattggtgtaccgtgctaaagttttaccaatcagtcactatgcccaattctcgttttcaaaaaaaaaaaaaaaaaaaa

SEQ ID NO: 6110 - protein, 371 aa, Panicum virgatum
  misc_feature: Ceres CLONE 1831411
  misc_feature (1)..(36): Pfam Name: DZC Pfam Description: Disease resistance/zinc finger/ chromosome condensation-like region
MLACIACVKEEGGGRDRDRDDAARSGAGDTPTVKSLTSQLKDMVLKLSGTHRQQGAQQRRGGSPPARGRATSIYRSGYYRPGVVQDDMAVPPATYLGASSASASSTPAWDLAGRAEGEAMAREWVAQVEPGVQITFVSLPGGAGNDLKRIRFSREMYDKWQAQKWWGDNNERIMELYNVRRFSRQVLPTPPRSDDGERESFYSQSQVGSMAGSPAATPSPAPLTPDRISWGAFARPPGAARQQQQHSFRPLSPPPPSSSNPSERAWQQQQRQNHGASAGKSPAASEATATATEAARTTTSSRDDVSISNASELEVTEWIIQDEPGVYITVRELADGSRELRRVRFSRERFAELNAKLWWEENKERIQAQYL

SEQ ID NO: 6111 - DNA, 1480 bp, Panicum virgatum
  misc_feature: Ceres CLONE 1831422
  misc_feature: Encodes the peptide sequence at SEQ ID NO. 6112
gcagcggtagcacaggcaggcaggcacagctagctcccgatcagctagagcttcgttaagcgttccttgttgcgcgcgcactcggctccagcgagttcgaattcttgcgcagcttgctatagcctgttcgacagccgggagctgagccaacctgccatgccggccttcgcggggggcggcgcagcggagccgccgctggcggacagctaccacgcgctgctccggcgctgcggcggcgacgacgatggtgcgcgcgcggcagtggcggcggcgccgcccgtggcggagtgcgagctcccgatgatcgacgtcgggtgcctgacgggcgggggcggcgccggctcggaggcggagcgggcggcgtgcgcggcggccatcgcgcgcgcggcggaggagtggggcttcttccaggtgcgcaaccacggcgtggcgccggagctcctggacgcgatgcggcgggagcaggcgcgcctgttccgcctgccgttcgaggccaaggcctcggccggcctgctcggcggctcctaccgctggggcaccccgaccgcgacgtcgccgcggcagctctcctggtccgaggccttccacgtcccgctcgccgccgtctccggcgacgcctgcgacttcggcggcctcaccaccctgagggacgtgacgcgggaggtggcgggcgccatgtcgaagctggccggcacgctggcgcgcgtgctggccgaggccctccgccccggcggcgccgctggggagcagcgcttcccggaggggtgcgacgagacgacgtgcttcctccggctgaaccggtacccgccgtgccccgtctcggcggacggcgccgccttcggcctggtgccgcacaccgacagcgacttcctcaccgtgctctgccaggaccacgtcggcggcctgcagctcatgaagggcgccgccgggtgggtggccgtcaagccaatccccggcgccctcatcgtcaacgtcggggacctcttccaggcgtggagcaacaacaggtacaagagcgtggagcacaaggtgatgaccaacgcgacgaccgagcgctactcggtcgccttcttcctctgcccgtcccacgactcgcccatcggcacgtgcgcggagccttctccttacaggacgttcacgttcggggagtacagacggaaggtgcgggaagacgtcaagagaaccgggaagaagatcgggctccccaatttcctcatctaggtttgcatgcgcgacgatgttagtctacaaatccttcccacaaacccatcattgtttcattctggcccttgtcatgtcaacccatgcatgtttctttctgtataccagcagcattatacagtggagagtgcagtgtgattggtgcagtgattagttactagctagctagctagctaggttgtagcttaattgatgtagccagctactagcccacacaagaaagtagtaggatctataccaaaaaaaaaaaaaaaaaaaa

SEQ ID NO: 6112 - protein, 354 aa, Panicum virgatum
  misc_feature: Ceres CLONE 1831422
  misc_feature (1)..(100): Pfam Name: 2OG-FeII_Oxy Pfam Description: 2OG-Fe(II) oxygenase superfamily
  misc_feature (174)..(353): SWISSPROT Homolog: EC 1.14.11.13 Gibberellin 2-beta-dioxygenase 8
MPAFAGGGAAEPPLADSYHALLRRCGGDDDGARAAVAAAPPVAECELPMIDVGCLTGGGGAGSEAERAACAAAIARAAEEWGFFQVRNHGVAPELLDAMRREQARLFRLPFEAKASAGLLGGSYRWGTPTATSPRQLSWSEAFHVPLAAVSGDACDFGGLTTLRDVTREVAGAMSKLAGTLARVLAEALRPGGAAGEQRFPEGCDETTCFLRLNRYPPCPVSADGAAFGLVPHTDSDFLTVLCQDHVGGLQLMKGAAGWVAVKPIPGALIVNVGDLFQAWSNNRYKSVEHKVMTNATTERYSVAFFLCPSHDSPIGTCAEPSPYRTFTFGEYRRKVREDVKRTGKKIGLPNFLI

SEQ ID NO: 6113 - DNA, 1056 bp, Panicum virgatum
  misc_feature: Ceres CLONE 1831433
  misc_feature: Encodes the peptide sequence at SEQ ID NO. 6114
agccgcttccctacttcgtcttccggacttacttccaggcttccactcatgagcgcttagcaaattaaccagccatcgcagctccagagctccagctcccgggccgctcctccctcgctcgccggagcctccatggaccgcagggacaagtcccgtaggggctcgtcgagctcggcggtggcggcggcgtccatggccgcgctcgccgccgccgcggcggctggcgagggctcgagctccggctccggctcggccgacggggcgcttccgccgcacgcggaggaggaggaggaccagaagccccccaagcttgcggccgtgggaggcgcctctagctcctccccgtccccggtgccggcgaggaggggcgcggcggcgggcggcgggccgaggtgccaggcggagcggtgcaacgccgacctgaacgaggcggcgcagtacaaccggaggcacaaggtgtgccagacgcactccaagtcccccgtcgtgctcgtcgccggcctccgccagcgattctgccagcaatgcagccggttccacgagctgtcggagttcgacgagaacaagcgcagctgccgcctgcgcctggcggggcacaacgagcgccgccggaagagcgcggcggacacgcacgggcacggcggcggcggcggcagcagcagcaacggtggcggcggcggcggcgctggcgacgggtgccgccacgccgaccaggacggccggggccaccaggggaacccgccgccgaaccacttccagatcagataaacctatctactaagcatgctctctctcttctgtcatgcagctagctagcagcacatgtatgtgtcaattgtgcgtgcgtgcgtctaccctgctaccccccagtgtcgtgtattgcattgctctacgtgctaacttattggcggctcacatcgcctcctgtaataacgtgacgtgcaccggccggaggtgtatgtgccacaaaacctagttgatgatgctgattgttgtaacctaacctgctggcaatttaagcaggaactgctagagtaaaaaaaaaaaaaaaaaaaa

SEQ ID NO: 6114 - protein, 211 aa, Panicum virgatum
  misc_feature: Ceres CLONE 1831433
  misc_feature: Great-hit functional homolog of the protein sequence given in SEQ ID NO 9240
  misc_feature: Useful for making plants with altered Lignin content
MDRRDKSRRGSSSSAVAAASMAALAAAAAAGEGSSSGSGSADGALPPHAEEEEDQKPPKLAAVGGASSSSPSPVPARRGAAAGGGPRCQAERCNADLNEAAQYNRRHKVCQTHSKSPVVLVAGLRQRFCQQCSRFHELSEFDENKRSCRLRLAGHNERRRKSAADTHGHGGGGGSSSNGGGGGGAGDGCRHADQDGRGHQGNPPPNHFQIR

SEQ ID NO: 6115 - DNA, 1337 bp, Panicum virgatum
  misc_feature: Ceres CLONE 1831489
  misc_feature: Encodes the peptide sequence at SEQ ID NO. 6116
ccactccccgcgagcacggcgtcgaacaccccgcgcccgcgcacgtgagccaagcaggcggccggtcagggccagggccagcgccaccaccgccccccgcatcctccccctccgccatggcgttcgcgctcaaggccgcctccaccgccgggtcggcgtcgctcgccgccgcggggcccaggcgggccgccgcgccggccgcggggagggtctcgttccggggcgcgtcggccgccgggcccgtggtcgccgtcagggcggccgcggcggcggcctccgccgtggcgcatgacaggcgcagcatctccgggacgtttgccgagctcagggagcaggggaagactgccctcatccccttcatcactgctggtgaccctgacctggctaccacagcgaaggcactcaagatccttgacgcgtgtggttcggacgtgattgaattgggtgtgccttactcagatccgttggctgatggccctgttattcaggcctctgcaacacgtgcgctagcaaaaggcaccacgtttgaggatgtcatctccatggttaaggaggtgatacctgagctgtcctgccctgtatcacttttcacatattataacccgattctgaagcgcggaatcccaaacttcatgactattgttaaggaagctggtttacgcggccttgtggtacctgatgttcctttggaagagacagattttttgaggagcgaggctgctaagaacaaccttgagctggtgctactcacaacaccaactacaccaaatgaaagaatggagaaaatcgcacaggcttcagaaggatttatttatcttgtaagcactgttggagttactggtacacgtgcaaatgtaagcggcaaggtgcaatctcttcttcaggatatcaagaaggtcactgaaaaacccgtggctgttggctttggtgtgtcaactgctgagcatgtgaagcagatcgcaggttggggcgcagatggtgtgattgttggtagcgcaatggttaggctattgggggaatctgcttctcctgaagaaggattgaagaagctagaagagttagccaagaacctgaaggccgcattggaatgagccaaccatattctcctgaagaacacttaaaaagatttgttcttttttattattttccagtttaggattgcaggttgttattttgtggcgataataattatgtccttatgttgaatgctcaattgaataaattaaggtcattgtattaaaagcgcagaagacactcttcatatacattgcacggagaactggttgagaatcgcctcttgaatatgaataaggtcatgatcatgagtggcagtttct

SEQ ID NO: 6116 - protein, 324 aa, Panicum virgatum
  misc_feature: Ceres CLONE 1831489
  misc_feature (1)..(257): Pfam Name: Trp_syntA Pfam Description: Tryptophan synthase alpha chain
  misc_feature (25)..(323): SWISSPROT Homolog: EC 4.1.2.8 Indole-3-glycerol phosphate lyase, chloroplast precursor
  misc_feature (62)..(323): SWISSPROT Homolog: EC 4.2.1.20 Tryptophan synthase alpha chain
MAFALKAASTAGSASLAAAGPRRAAAPAAGRVSFRGASAAGPVVAVRAAAAAASAVAHDRRSISGTFAELREQGKTALIPFITAGDPDLATTAKALKILDACGSDVIELGVPYSDPLADGPVIQASATRALAKGTTFEDVISMVKEVIPELSCPVSLFTYYNPILKRGIPNFMTIVKEAGLRGLVVPDVPLEETDFLRSEAAKNNLELVLLTTPTTPNERMEKIAQASEGFIYLVSTVGVTGTRANVSGKVQSLLQDIKKVTEKPVAVGFGVSTAEHVKQIAGWGADGVIVGSAMVRLLGESASPEEGLKKLEELAKNLKAALE

SEQ ID NO: 6117 - DNA, 1451 bp, Panicum virgatum
  misc_feature: Ceres CLONE 1831564
  misc_feature: Encodes the peptide sequence at SEQ ID NO. 6118
gcgttcacacgcggagaggcgagggacgaggcgggcgagcgattacaagggcaatccaatccctccctcctctggtttcgattcgcgccatggaggcgcaggcgcaggacagggcggaggagggcgaggccgctgcgcggcagcacgtggtgggggcgggggcggcgggggtggcgatgggcgcgatccccatgcacgggttcatggtcccgaagccggagccggtggagtacttcggcgggatggcggtggtgcgcagcaagccgccgccgcggaaccgcgaccggcacaccaaggtggagggccgcgggcggcggatccgcatgccggcggcttgcgcggccaggatcttccagctcacgcgggagctagggcacaagtccgacggcgagaccatccggtggctgctgcagcagtcggagcccgccatcatcgccgccaccggcaccggcacggtcccggcgatcgcgaccaccgtcgacggcgtcatccgcatccccacgcagtcgtcctcctcctcgagcccctcgtccctcgccatggtcatggtcgacggcgaggagtcctccgccaagcgccgccggaagctgcagcccacgcgcgcggcggcgggcgcgtccccgctcgccaccgcggcgcccgcggcctactacccggtcatcgccgacccgctcctgcagggcaccggcggggcggccatctccgtcccgagcgggctcgcccccatcaccgcggcgcccggcgcgccccaggggctcgtcccggtcttcgcggtcccggccgccggcagccccggcggcggcgccaaccgcatgatcccgcaggccaccgccgtgtggatggtcccgcagcccggcgccgcggcggggggcgcggccgcccagcccgcgcagttctgggccatccagtccgcgccgcagctcatcaacctcggcggcgggcagaccgccgtgttcccgacggcggtgaacgtcgccgacttccagcagcagcagcatgcctccaccatgtcgcacaacagcaactcggagcagcacccggggtccgggccccacgagcagcagcgcggcggccggagcgacgtggaccacccggaggaggaggaggacgacgacgaggaggagccggtgtccgactccagcccggaggagtagcgcgcggcccggcgcacgcccggaaaagtccaaaccacaaagcttaggttcttttccctctaatttaattaattaatcaatcttttccccctttcgcaatcctcctccttatgatgaactagtaattacgcgatgctcaggcagccgtgtgtgtgcgctttccgtcttaggctcaggccagtaacccagtgttagtggtagagagaagaagaagatgatggtgaagaagaaagaggtagaagaagaagcatgtaatgtaatgcaaatgaaatgagcagctgatttgttcagttaatc

SEQ ID NO: 6118 - protein, 354 aa, Panicum virgatum
  misc_feature: Ceres CLONE 1831564
  misc_feature: The sequence is a functional homolog of  SEQ ID NO 941 in the  11/479,226 US patent application
  misc_feature: Useful for making plants with modulated growth and phenotype characteristics
MEAQAQDRAEEGEAAARQHVVGAGAAGVAMGAIPMHGFMVPKPEPVEYFGGMAVVRSKPPPRNRDRHTKVEGRGRRIRMPAACAARIFQLTRELGHKSDGETIRWLLQQSEPAIIAATGTGTVPAIATTVDGVIRIPTQSSSSSSPSSLAMVMVDGEESSAKRRRKLQPTRAAAGASPLATAAPAAYYPVIADPLLQGTGGAAISVPSGLAPITAAPGAPQGLVPVFAVPAAGSPGGGANRMIPQATAVWMVPQPGAAAGGAAAQPAQFWAIQSAPQLINLGGGQTAVFPTAVNVADFQQQQHASTMSHNSNSEQHPGSGPHEQQRGGRSDVDHPEEEEDDDEEEPVSDSSPEE

SEQ ID NO: 6119 - DNA, 1250 bp, Panicum virgatum
  misc_feature: Ceres CLONE 1831594
  misc_feature: Encodes the peptide sequence at SEQ ID NO. 6120
aaccaatcaccaggcagcttggaacacgcggcagtgggatcgacggccgccagctgttgaagtgcgttccgcgctgctagaatggcgtccgggtggaggggcatcctggactttgactacggcatcgtgcaggcgccgctcggtccggacatctcgggccccgagctcgccgccgccgtcgccaacgcgggggccatcggcctcctccgcctccccgactggccggagccggatcgcgtcagagagctgatttggaagacgaggagcctgacgtcgaggccgttcggggcggccattgtgctggcgttcccgtacgaggagaacctgagggtcgtcctggaggagaagctcgccgtgctgcaggtgtactggggggagttcccgagagagcgagtcgaagaggcgcaccgcgccggcgtcaaggtcttgcatcaggttggcagccttgaggaggcagcaaaagctaaagaagccggtgtagatggaatcattgttcagggccgtgaagcaggaggtcatgtaattggtcaggaaggactgtttccactgttgccgagtgtagtagatcttgtttcggactctggcattccagttatcgctgctgggggaatcgtaaatgggcgtggctatgttgccgcattggcacttggtgctcaaggtgtttgtttaggaacaaggttcgtggctactgaggaaagctttgcacatcctatttataagaaaaagctaattgagatgagtcgcacagactacacaaatgtgttcgggcgtgctagatggcctgatgctccacagcgtgtcctggaaacacccttctatgctgggtggaagaataatctgtcagatcatgaaacagaggaaagccagcccatcataggccactctatcatccatggcatgcacaaggatattcgtcggtttgccagtactgttccaagcgccacagctacaggtgatgtcgagagcatggccatgtatgcgggtcagggtgttgggctaatcacggagatcctaccagctggcgaagttgtcaaaaggctggtcgctgaagcaaaggatgtcatcagagaaaagttttctgatttgaagtaaaatcctcctgaactgtaagctctatcaacaatgcatcaagcatttgtaactagtcacccatcagaacaaactggtatcaccatgtttgcttctgtatgctatttgtaaaaatagctgttgaaaataaatgagattaccaaaaaaaaaaaaaaaaaaaa

SEQ ID NO: 6120 - protein, 336 aa, Panicum virgatum
  misc_feature: Ceres CLONE 1831594
  misc_feature (2)..(318): Pfam Name: NPD Pfam Description: 2-nitropropane dioxygenase
MASGWRGILDFDYGIVQAPLGPDISGPELAAAVANAGAIGLLRLPDWPEPDRVRELIWKTRSLTSRPFGAAIVLAFPYEENLRVVLEEKLAVLQVYWGEFPRERVEEAHRAGVKVLHQVGSLEEAAKAKEAGVDGIIVQGREAGGHVIGQEGLFPLLPSVVDLVSDSGIPVIAAGGIVNGRGYVAALALGAQGVCLGTRFVATEESFAHPIYKKKLIEMSRTDYTNVFGRARWPDAPQRVLETPFYAGWKNNLSDHETEESQPIIGHSIIHGMHKDIRRFASTVPSATATGDVESMAMYAGQGVGLITEILPAGEVVKRLVAEAKDVIREKFSDLK

SEQ ID NO: 6121 - DNA, 1565 bp, Panicum virgatum
  misc_feature: Ceres CLONE 1831595
  misc_feature: Encodes the peptide sequence at SEQ ID NO. 6122
atcggcatcgcctcccgggccgacctccgctccgcctccgcctccgccaagcacgacgacgctcgtcctccccgtgctgcggtggggtgcgggcggaggtccatccagcccggccaacctctccacccgctgccgctggtgcatttgatccacaaccggcggcggcggcgaggagtttcacgatgtccaaggcaggagccctggatcttgcgtctggccttggagggaagatcaacaaggcggaagttaagtcggcagtcgatgagtatgagaaatatcatggatattatggagggaaggaggaaacaagaaaatccaactacactgatatggttaataaatattatgatctagccactagcttctacgagtatggttggggcgaatccttccactttgctcacagatggagtggagaatccttacgtgaaagcatcaagcgacatgagcattttcttgccctgcagcttggtttgaaagcaggaatgaaggttttggatgtgggctgtggaataggtggaccactacgagaaattgcaagatttagctcaacttcagttattgggttgaataacaacgattaccagataaccaggggaaaggagctcaatcggttggcaggagttagtggaacctgtgattttgtcaaggcagacttcatgaagatgccgttcgatgacaacacttttgatgctgtttatgccatagaggcgacatgtcacgcacctgatccagttggctgctataaggagatatatcgtgtattgaagcctggtcagtgctttgctgtatatgagtggtgcattactgatcactatgatccaaacaatgcaacccataaaaggattaaggatgaaattgagcttggcaatggcctgccggatattagaagcactcaccaatgtcttcaggcagtaaaagatgctgggtttgaggttgtttgggataaggatcttgccgaagattcccccttgccttggtacttgccctttgatccaagccgattttccttaagtagcttccgtttgacgtctgtgggacgtatggtcactcgtacaatggtcaaggcgttagaatacattggtcttgctccacaaggaagtgagagggtctccaatttcctagagaaggctgcagaaggtcttgtagagggtggcaagaaggaaatcttcacgccgatgtacttctttctggttcggaagcctcttacagaatgagcccatcagagcacatttaagagagaaaacaaggagtcattgcgaggaagctgaatgaagatgcagaatgagaaatctgcaatcaagatactggagttcttctccctaggaagagaagtagtggaatgtgctaactgttgagcatatatttgttggattgttttgtttgcgtgagcttccttggtatagtgtttgtgctgttcttggactgacaatttgaatccctttccttgtcctaagctcagtagtataaaataagttggtttatacaactcctttgattgatgtactaaatgtcgaaataattttgggtggtggttcggagatcaaaaaaaaaaaaaaaaaaaa

SEQ ID NO: 6122 - protein, 344 aa, Panicum virgatum
  misc_feature: Ceres CLONE 1831595
  misc_feature (1)..(130): Pfam Name: Sterol_MT_C Pfam Description: Sterol methyltransferase C-terminal
  misc_feature (1)..(99): Pfam Name: Methyltransf_11 Pfam Description: Methyltransferase domain
  misc_feature (1)..(344): SWISSPROT Homolog: EC 2.1.1.41 Cycloartenol-C-24-methyltransferase 1
  misc_feature (7)..(341): SWISSPROT Homolog: EC 2.1.1.41 Cycloartenol-C-24-methyltransferase
MSKAGALDLASGLGGKINKAEVKSAVDEYEKYHGYYGGKEETRKSNYTDMVNKYYDLATSFYEYGWGESFHFAHRWSGESLRESIKRHEHFLALQLGLKAGMKVLDVGCGIGGPLREIARFSSTSVIGLNNNDYQITRGKELNRLAGVSGTCDFVKADFMKMPFDDNTFDAVYAIEATCHAPDPVGCYKEIYRVLKPGQCFAVYEWCITDHYDPNNATHKRIKDEIELGNGLPDIRSTHQCLQAVKDAGFEVVWDKDLAEDSPLPWYLPFDPSRFSLSSFRLTSVGRMVTRTMVKALEYIGLAPQGSERVSNFLEKAAEGLVEGGKKEIFTPMYFFLVRKPLTE

SEQ ID NO: 6123 - DNA, 990 bp, Panicum virgatum
  misc_feature: Ceres CLONE 1831653
  misc_feature: Encodes the peptide sequence at SEQ ID NO. 6124
agcgcaaaacacctcgctttttgtagtcttccgtctttgccctcgcgctctcgcctctcgcccccgtttgctcggccggcgcgtgtacgtgtgtacagcgagcggagcagggagaacggaaaagaaagaaaaagaaagtcttgccctgccttggctctcctccttggggttgagctcaaccgttgttcgttcatggagagctcttcctcctccacccacaagcgggcgcgggaagcggccgacctcgccgccgccggcgacggcgcgctgccggaggccggcgccaagaggctgcggcccgaggacctactcgacctgctcgacgatgacgccgacgcggcggccgccggcgacctggcgtccgtcatgcggagcctcgaggaggagatagggagcttcgacgaggccggggccgccgacgccgccgtcgtgccgccggtgcaccagccggagctggggttcctgctggaggcctctgacgacgagctgggcctgccgccggcgggcgcctcctcctcgtcggaggaggccggagccgccggggcgcccgacgtggccgccggccttgacggccagatctgggggttcgaggacgagatcgacggcggcttcggcggctactcgccggaggccgcggccgccgccgccgccgccgcggcgtgggacgacgacggcttcgacgccgggctgttcgcgttcggcgacgacgcctgcgggccctcggatctcgcggccctgcgccacgagaccatgccggccgtctgattacgggccccggccggccggccagtggattagcgttctttttctggcttttttttaaccttgggctaaccttagctggtactgcccttttctttaaccttggtgtaaagtttttagaagggtaaaaacagaggcgtggaaacctggggaaggttccgaccggggaaaagaatctgaaaatggtttccctttttgcccttgggtcaaaaaaaaaaaaaaaaaaaa

SEQ ID NO: 6124 - protein, 190 aa, Panicum virgatum
  misc_feature: Ceres CLONE 1831653
  misc_feature: Great-hit functional homolog of the protein sequence given in SEQ ID NO 9355
  misc_feature: Useful for making plants with modulated low light sensitivity
MESSSSSTHKRAREAADLAAAGDGALPEAGAKRLRPEDLLDLLDDDADAAAAGDLASVMRSLEEEIGSFDEAGAADAAVVPPVHQPELGFLLEASDDELGLPPAGASSSSEEAGAAGAPDVAAGLDGQIWGFEDEIDGGFGGYSPEAAAAAAAAAAWDDDGFDAGLFAFGDDACGPSDLAALRHETMPAV

SEQ ID NO: 6125 - DNA, 1668 bp, Panicum virgatum
  misc_feature: Ceres CLONE 1831681
  misc_feature: Encodes the peptide sequence at SEQ ID NO. 6126
acccaaaaaccaaacccaaaggagaggaaacaagaaagcgaagggggacaagaggtctagaaagagacgctcgtctcgtcacgtccgccgccatggctctgggccggggcctcgccgccgccgccttcctcctgctcctcgccgtcgccgcctccgcggcgcccgacatgtccatcatctcctacaacgaggagcacggcgcgcgggggctggagcggacggaggccgaggcgcgggcgatgtacgacctctggctcgccgagcacggccgggcctacaacgcgctcggcgagcacgaccgccgcttccgcgtcttctgggacaacctccgcttcgtcgacgcgcacaacgcccgcgccgccgaccacgggtacaccctcggcatgaacaagttcgccgatctgaccaacgacgagttccgcgccgcctacctcggcgccaggctccccacccggggcgaccgcgtggtcggggagaggtaccgccacgacggcgtcgaggcgctgccggactccgtcgactggaggaacaagggtgccgttgctcccatcaagaaccaggggcaatgcggaagttgctgggctttctctgcagtaagcacagttgaaagcattaacaaacttgttactggtgagatgatcacattgtcagagcaagaacttgtggagtgctcgaccaatggagggaacagtggttgcaatggtggccttatggattccgcctttgagttcatcataaagaacggaggcattgacactgaagctgactacccgtacaaagctgtggatggccaatgcgacatgaacaggaaaaatgcaaaggttgtgagcattgatggctatgaagatgtgccgaaaaatgatgagaaatcactgcagaaggcggttgctcaccagccagttagcgttgctattgaggctggtggccgcgagttccagctctacaaatcgggtgtctttagcggaaagtgcaccacaaaccttgaccatggtgtggttgcggtcggttatggcaccgagaacggcaaggacttctggatcgtccgcaactcatggggtcctaagtggggtgaggatgggtacatccgcatggagcgcaacattgatgccacctctgggaagtgtggaattgctatgatggcatcttaccccacgaagaagggacccaaccctcccaagccatctccaacccctcctacaccgcctccccctgtcgcccctggaaatgtgtgtgatgagaactactcctgctcagcaggcagcacctgctgctgcgcttttggcttcaggagtgtatgcttggtctggggttgctgcccaattcaaggtgccacctgctgcaaggatcatgccagctgctgcccgccgaactaccctgtgtgcaacatcagggctcgtacttgctcagcgagcaagaacagcccacttagcgtgccggccttgaagcgcaccctggcaacgctgaacactgcctgaactcggcaagacgttcaggattgatccggagcccgcagcttgaagacgtggctttcatagatcatcattgtatcttcatgaatttgctattcgctgtaaataactgctagctatcatttgtactctgattcctcaaggatattatgcgccactaatggagtgttttacaatccaaaaaaaaaaaaaaaaaaaa

SEQ ID NO: 6126 - protein, 460 aa, Panicum virgatum
  misc_feature: Ceres CLONE 1831681
  misc_feature (1)..(217): Pfam Name: Peptidase_C1 Pfam Description: Papain family cysteine protease
  misc_feature (37)..(371): SWISSPROT Homolog: EC 3.4.22.14 Actinidain precursor
MALGRGLAAAAFLLLLAVAASAAPDMSIISYNEEHGARGLERTEAEARAMYDLWLAEHGRAYNALGEHDRRFRVFWDNLRFVDAHNARAADHGYTLGMNKFADLTNDEFRAAYLGARLPTRGDRVVGERYRHDGVEALPDSVDWRNKGAVAPIKNQGQCGSCWAFSAVSTVESINKLVTGEMITLSEQELVECSTNGGNSGCNGGLMDSAFEFIIKNGGIDTEADYPYKAVDGQCDMNRKNAKVVSIDGYEDVPKNDEKSLQKAVAHQPVSVAIEAGGREFQLYKSGVFSGKCTTNLDHGVVAVGYGTENGKDFWIVRNSWGPKWGEDGYIRMERNIDATSGKCGIAMMASYPTKKGPNPPKPSPTPPTPPPPVAPGNVCDENYSCSAGSTCCCAFGFRSVCLVWGCCPIQGATCCKDHASCCPPNYPVCNIRARTCSASKNSPLSVPALKRTLATLNTA

SEQ ID NO: 6127 - DNA, 1643 bp, Panicum virgatum
  misc_feature: Ceres CLONE 1831684
  misc_feature: Encodes the peptide sequence at SEQ ID NO. 6128
cttccccgctcgccaccgctcccctgcctcgtcgcctctccctcgcgcaccacctccccctcccgcggtctccgtctctcaccttctcgctgcacacgcatctcctgattggatcaattgggcttcgcgtgccgtctgatccgtggagcgcccgctgccgagcggaatcgtcacctgatttggcgagatatttgtgaagtcatggcacacgatgaagctgtggctacccagaagactggaaatacagcatcatctcctaaggatcaaccagctccttctccatatcctgattggtcgagcatgcaggcatactatggacccggtgtcttgccaccaacatattttgctccagcaatagctccaggtcatccaccgccatatatgtggggtcctcagcctctaatgccacacccttttgggacaccatatgctgcaatgtacgcacatggcacagcttacccgcacccccttgtgcccatggtatcaaatcccttgagtgtggagccaacgaagtctgcaaacagtaaggaaaaaagttccaacaagaaacttaaagaaattgatcggacggcagtatctgctggtagcggtaacagtaaaagagcaatgtcatccagtgaagattacagtgcagaaggctccagcgatgtaaatgatcagaaggtgaacaaaacttccaggaaactgagctcagttgatggacctgctgcaaggattgaaggtgttatagctcctaaccatacactggcaaatacagccattttgccacatcactgctttccagctccagtagttaagaccagcactacaaatgttgctaactcaagggcaatgggtggatcgatatctccatatcctggtgtgattgttccgcctcatactggaggaccagctgacttatcaatcaaggatgagagagaactgaagcgtgaaaagaggaagcagtcaaatagagagtctgctagacgatcaaggctgagaaaacaggttgagacagaggagctggcaacacaagtggaatctcttacagcagaaaacacgtcccttagatctgaaatcggcaggctaacagagagttcagagcagctcagattagagaattcagctctgatggtgaaactgaaggatcctgaagtgccggcccctgcagagccgtctccaaaagccaccgcatcctcgccctctccccgccccaccgcggagaatttcctgtcgatgatcgacggcaccacgagcgcgccgggcgcgagccggcacacggagcacggcaagcccaagctccggcagctcctcgactccaatccgtcgacggacgtcgctgccataagctgatgctgatctgcctctctttcccccctggcacggagagaggccggctaatacaacacaggtgcatgtggccaatcttggtcgcgagctcatgctgtctcaccataacgttctgcgttgcagtgtactaggaggcattgattccggtatagcatttgagaacacaggtgacaagtatctgtctgccctagtgcagtcactggcaggggatgcctgatgtatcgtgtgttaattagttttacttgctatgagctttagcagtgttgtaacatagggtgttgtgctgcatgccaacctgaaaacttttttttcgc

SEQ ID NO: 6128 - protein, 376 aa, Panicum virgatum
  misc_feature: Ceres CLONE 1831684
  misc_feature (1)..(65): Pfam Name: bZIP_1 Pfam Description: bZIP transcription factor
  misc_feature (3)..(54): Pfam Name: bZIP_2 Pfam Description: Basic region leucine zipper
  misc_feature: The sequence is a functional homolog of  SEQ ID NO 110 in the  10/374,780 US patent application
  misc_feature: The sequence is a functional homolog of  SEQ ID NO 1104 in the  10/225,066 US patent application
  misc_feature: The sequence is a functional homolog of  SEQ ID NO 1225 in the  10/412,699 US patent application
  misc_feature: The sequence is a functional homolog of  SEQ ID NO 362 in the  10/412,699 US patent application
  misc_feature: The sequence is a functional homolog of  SEQ ID NO 847 in the  11/479,226 US patent application
  misc_feature: The sequence is a functional homolog of  SEQ ID NO 910 in the  10/374,780 US patent application
  misc_feature: The sequence is a functional homolog of  SEQ ID NO 911 in the  10/374,780 US patent application
  misc_feature: The sequence is a functional homolog of  SEQ ID NO 912 in the  10/374,780 US patent application
  misc_feature: The sequence is a functional homolog of  SEQ ID NO 913 in the  10/374,780 US patent application
  misc_feature: The sequence is a functional homolog of  SEQ ID NO 922 in the  10/374,780 US patent application
  misc_feature: Useful for making plants with modulated growth and phenotype characteristics
MAHDEAVATQKTGNTASSPKDQPAPSPYPDWSSMQAYYGPGVLPPTYFAPAIAPGHPPPYMWGPQPLMPHPFGTPYAAMYAHGTAYPHPLVPMVSNPLSVEPTKSANSKEKSSNKKLKEIDRTAVSAGSGNSKRAMSSSEDYSAEGSSDVNDQKVNKTSRKLSSVDGPAARIEGVIAPNHTLANTAILPHHCFPAPVVKTSTTNVANSRAMGGSISPYPGVIVPPHTGGPADLSIKDERELKREKRKQSNRESARRSRLRKQVETEELATQVESLTAENTSLRSEIGRLTESSEQLRLENSALMVKLKDPEVPAPAEPSPKATASSPSPRPTAENFLSMIDGTTSAPGASRHTEHGKPKLRQLLDSNPSTDVAAIS

SEQ ID NO: 6129 - DNA, 1619 bp, Panicum virgatum
  misc_feature: Ceres CLONE 1831691
  misc_feature: Encodes the peptide sequence at SEQ ID NO. 6130
aacgatgctgctgctttgcttaaaacccaaacccaaacccaaaccctgacgagtgccaccaccatggctccgccgccgccgctcctcctcctcctcctcctcccacttctctccaccgccggcgccgcgccgaccatttccacttccaccacgacgctccccctataccgccacctcccgcacgtcgccgagacagcgcaccaccacccgctctcgcgcctcgccgccgcctcgctcgcccgcgcctcgcacctcaagcgccccgcccaccacaaagcccaagcgccaagttccaccaccgcgctctacccgcactcgtacggcggctacgccttcaccgcctccctcggcacgccgccgcagccgctgcccgtcctcctcgacaccggcagccacctcgcctgggtgccctgcacctccaactaccattgccgcaactgccccaccgccgccgtccccaccttccaccccaggaactcctcctcccgcctcgtcggctgccgcaacccctcctgcctctgggtccactccgccgcgcgcctcgccgccaccaactgcaccgccggcgccgtctgcccgccctacgccgtcgtctacggctccggctcaaccggcggcctcctcatcgccgacacgctccgcgcgcctggccgcgccgccgtcaggaacttcgtcgtcgggtgcagcctcgtgtccgtgcaccagccgccgtcgggcctcgcgggcttcggccgcggcgcgccgtccgtgcccgcgcagctcggactcaccaagttctcctactgtctgctctcccgccgcttcgacgacaacgccgccgtcagcggctcgctggtcctcggcggcggcagagccggcggcgggatgcagtacgtcccgctgctcaagagcgcggccggcgacaagcagccgtacgccgtgtactactacctggccctgagcggcgtgacggtgggcggcaaggccgtgcggctgccggagcgggccttctccgccaacgccgccggggcgggaggcgccatcgtggactcgggcaccaccttcacgtacctggacccgtcggtgttccagccggtggcggaggcggtgatcgcggcggtgggcgggaggtacaagcagtccaaggaggcggaggacgggctgggcctgcgtccctgcttcgcgctgccgcagggcgccaagtccatggcgctgccggagctgtcgctccacttcaagggcggcgccgagatgcggctcccgctggagaactacttcgtggtcgcagggcgagctcccgtgaccgctggtccgccgggcgccggcgaggccatctgcctcgccgtggtcaccgacatgggaggcgcgggagacgtgggcggcgggccggccatcattctgggtagcttccagcagcagaactacttggtggagtacgacttggagaaggagaggctgggcttccgccggcagccgtgcgccgcgtcgtcgtcgtgatcggattgacccagcgagccatgaattacggaattgcattgcttgctccacgacgtactgtttgttgctaataacaaaggtgtttgctttctttttgtgtgctccatcggattgtctttgttactgctaataaaattactgcg

SEQ ID NO: 6130 - protein, 470 aa, Panicum virgatum
  misc_feature: Ceres CLONE 1831691
  misc_feature (37)..(397): Pfam Name: Asp Pfam Description: Eukaryotic aspartyl protease
MAPPPPLLLLLLLPLLSTAGAAPTISTSTTTLPLYRHLPHVAETAHHHPLSRLAAASLARASHLKRPAHHKAQAPSSTTALYPHSYGGYAFTASLGTPPQPLPVLLDTGSHLAWVPCTSNYHCRNCPTAAVPTFHPRNSSSRLVGCRNPSCLWVHSAARLAATNCTAGAVCPPYAVVYGSGSTGGLLIADTLRAPGRAAVRNFVVGCSLVSVHQPPSGLAGFGRGAPSVPAQLGLTKFSYCLLSRRFDDNAAVSGSLVLGGGRAGGGMQYVPLLKSAAGDKQPYAVYYYLALSGVTVGGKAVRLPERAFSANAAGAGGAIVDSGTTFTYLDPSVFQPVAEAVIAAVGGRYKQSKEAEDGLGLRPCFALPQGAKSMALPELSLHFKGGAEMRLPLENYFVVAGRAPVTAGPPGAGEAICLAVVTDMGGAGDVGGGPAIILGSFQQQNYLVEYDLEKERLGFRRQPCAASSS

SEQ ID NO: 6131 - DNA, 1158 bp, Panicum virgatum
  misc_feature: Ceres CLONE 1831717
  misc_feature: Encodes the peptide sequence at SEQ ID NO. 6132
caccacgcgccccaacctccaaaaaaaaagagaggaaaaggaaacgccccccaaatcggaatccgcacgcacccatggccgccgccgccctcctccgccgctcgccggcggcgcgcgcgctcctctcgccggccctctcgtcccgcctcgtcgcgtccaagccccactcctcgtcccccgcgcccccgcccccgccgaaggcgtcctccgagatgaagaccttctcgatctaccggtgggacccggagtcgccgtcgacgaagccgcacctcaaggactaccaggtggacctctccgactgcgggccgatggtgctcgacgcgctgctcaagatcaagaacgagcaggacccgtcgctcaccttccgccgcagctgccgcgagggcatctgcgggagctgcgccatgaacatcgacggcgacaacggcctcgcctgcctcaccaagatctccgccgcctcctcggcctccacggtctcgccgctgccccacatgttcgtcgtcaaggacctcgtcgtcgacatgaccaacttctacagccagtacaagagcgtcgagccgtggctcaagcgcaaggacccgccgcagcaggagggcaaggagatcctgcagaccaaggccgaccgcgccaagctcgacggcatgtacgagtgcatcctctgcgcctgctgctcaacctcgtgcccatcctactggtggaacccggaggagtacctcggcccggccgcgctgctccacgccaacaggtggatacaggacagccgtgaccagttcaccaaggagcgcctggatgccatcaatgacgagttcaagctctaccgctgccacaccatcaagaactgcactcacgcctgcccaaagggtctgaacccggctaagcagatcgacacgatcaagaagctccagatcgacacctaaaagtcttggcccccataaaaacgaacatggatgggatggagcagacctgtggaaatttgtgatgaacatgccttttgtttcgcgtcatggtctctacctgacgaataattcctgcttggggcctccactctggtgcttgcaattatcaggtggaggtagattagggagtgaataattgctaccgtatttcatttttatgtgctgtatctaatttgatcgtcaaaaaaaaaaaaaaaaaaaa

SEQ ID NO: 6132 - protein, 280 aa, Panicum virgatum
  misc_feature: Ceres CLONE 1831717
  misc_feature: Great-hit functional homolog of the protein sequence given in SEQ ID NO 9515
  misc_feature (6)..(277): SWISSPROT Homolog: EC 1.3.5.1 Succinate dehydrogenase [ubiquinone] iron-sulfur subunit 1, mitochondrial precursor
  misc_feature (8)..(277): SWISSPROT Homolog: EC 1.3.5.1 Succinate dehydrogenase [ubiquinone] iron-sulfur subunit 2, mitochondrial precursor
  misc_feature: Useful for making plants with modulated biomass
  misc_feature: The plant is abnormally small.
MAAAALLRRSPAARALLSPALSSRLVASKPHSSSPAPPPPPKASSEMKTFSIYRWDPESPSTKPHLKDYQVDLSDCGPMVLDALLKIKNEQDPSLTFRRSCREGICGSCAMNIDGDNGLACLTKISAASSASTVSPLPHMFVVKDLVVDMTNFYSQYKSVEPWLKRKDPPQQEGKEILQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQIDT

SEQ ID NO: 6133 - DNA, 1437 bp, Panicum virgatum
  misc_feature: Ceres CLONE 1831728
  misc_feature: Encodes the peptide sequence at SEQ ID NO. 6134
cacaagcctacaacacaacacacaccaaagagcttcaaacacagatagactcaatcactagaccttctatgcatgccaacatggatgttgtcgctgaagtcgactttgacttctccccgttcctaaaacggtacaaggatggccaaatcgagcggttgctgaggagccctctcgtggctgcgtcggagaacccgacagccaaccgcggggtggcaacaagagatgtggtcatcgatcatggcaccggtgtgtcggcacgactgttcctcccctcccgagccgccatggctgccggtaggaggaggctccccctcgtcgtgtacatctacggtggctcattctgcacagagagcgccttttgccggacgtaccaccgctacgccacctcccttgcagcgagcgccggggcgctcgtcgtctcggtggaggaccgccttgcgccggagcaccccatacccgcggcctacgacgacgcatgttctgcgctaaaatgggtggcgtccctcgccgacccatggctcgcagactacgcagaccccgcgcggacgttcctcgctggtgatagcgccggcaggaacatcgcctaccacacagcagtacgggccagccgagacagtggcatgggtgtcgacatcgaggggatggtcatcgtgcatccctacttctggggagccgaacggttgccttcggaggaggtctgggatggcgcagcagtgtttccggcatacggggtggactggctctggccattcgtgaccgcgggccaagccagcaacgatgaccctccgctcaaccctcccgacgaggagatcgcgtcgctggcttgccggcgcattctgcttgctgtggccgagaaggacaccctgcgggaacgcgggtgccgcctcctcaatcgcttccgcgactactacgcgcgcaccggcggcggggaggcgacgctggtggagtcagagggcgaggaccatggcttccacctctacagccccctgcgcgccaccagcagaaggctcatggcgagcatcgtgcacttcattaaccagccgccggtgccgaagatggagcacgcatgggagggtaagcaaattgacaagacaacggcgaccacaacagctccaaagcctatgatactaggcgtgcctcgtcggccgtttatggacgtatttggctatgggatggaaatgaaacgttattgcagcggctcgagctccacgacctgcatgacgtatgcaacgtcaaaaattggaggacgtgtcaaagctgctgcatccaaacactatgggctcttttcgggcgcagtgtgcctaagaaggcctaccgggggtcatcagcagcattcccccgaactcatcatgttatcaagaacatgtggtaacaattcagggctgccttgaccaaatgtgggtctagttgtgttgtactaatctctcattaattatc

SEQ ID NO: 6134 - protein, 440 aa, Panicum virgatum
  misc_feature: Ceres CLONE 1831728
  misc_feature (1)..(212): Pfam Name: Abhydrolase_3 Pfam Description: alpha/beta hydrolase fold
MHANMDVVAEVDFDFSPFLKRYKDGQIERLLRSPLVAASENPTANRGVATRDVVIDHGTGVSARLFLPSRAAMAAGRRRLPLVVYIYGGSFCTESAFCRTYHRYATSLAASAGALVVSVEDRLAPEHPIPAAYDDACSALKWVASLADPWLADYADPARTFLAGDSAGRNIAYHTAVRASRDSGMGVDIEGMVIVHPYFWGAERLPSEEVWDGAAVFPAYGVDWLWPFVTAGQASNDDPPLNPPDEEIASLACRRILLAVAEKDTLRERGCRLLNRFRDYYARTGGGEATLVESEGEDHGFHLYSPLRATSRRLMASIVHFINQPPVPKMEHAWEGKQIDKTTATTTAPKPMILGVPRRPFMDVFGYGMEMKRYCSGSSSTTCMTYATSKIGGRVKAAASKHYGLFSGAVCLRRPTGGHQQHSPELIMLSRTCGNNSGLP

SEQ ID NO: 6135 - DNA, 1429 bp, Panicum virgatum
  misc_feature: Ceres CLONE 1831838
  misc_feature: Encodes the peptide sequence at SEQ ID NO. 6136
ctccctccccatccaaaaccctcgccgaaacctgagatccatctcggagtccccggcgcggcacgaagccctagcccagggaaccgctccatggcgatcatctccgacttccaggacgacgaggcccagccgcggcagcaggcggcggcggacgtcgaggaggccctcgcggcgctgctggagcggtgcggcggcgccttgccgttcctccaggcggccatcggcgtcgcgcaccgccgctccggcctgttccgcgacccgtccgcggtgagcaaggtcaccgcgatggcggcggccgctagggcggaggtggaggccgaggagagggcggcaagggaggcgaagagaaaggcggaggaggccgagcggaaggcggcggccgaggcggagaaggcggccaaggccgcggcggcgccggtggcggaggagaagccggagagctcggcggagaaggacagcatggaggtggataagaaggaggagggcaaagtgagacaaccaaatgctggcaatggtcttgacttggagaagtactcatggactcaacagctgccagaggttaacatctctgttcctgttcctgaaggaacgaaatcaagatttgtggtctgcgatataaaaaagaaccatctgaaggttggcctgaagggccagccccctatcattgatggtgagctctataagccagttaaggttgatgactgcttctggagcatagaggatggaaaatcgctaaatatattgcttacaaagcacaaccaaatggagtggtggaagtctgtgataaagggggaccctgaagtcgatacccaaaaggtggaaccagagagcagcaaactttctgatttggatccagagactagacaaactgtggagaagatgatgtttgaccaacgtcagaagcagatgggccttccaacaagtgatgagatgcagaagcaagaaatgctcaagaagttcatggctgagcaccctgagatggacttctcaggggcgaaaatagcttgaggacaattgaagccaaaccactagaggttggggaaattgtttctacaagtagacgatcgaagccaaaccaccggaggttggggaaattgtttctacacaagtatcttcatcaggttgtctgggtgtcttgtgtctatgctggaaggttgtctgggtgtcttgtgtctatgctggatgatggttcttttgctgcggtttagaagtatacattagaaccgtgacaatcctgaacctttctactgggttatatcaatattagcatgaatcgtaatgtgctgctctactgccctctagatgcctgtcaactgaaatttccgctgttgtactctgttacatgctcacgtgagccaacttacgaaacggaagtgtttccttcttaggggccgtttagttccggaagcaaaaaaaaaaaaaaaaaaaa

SEQ ID NO: 6136 - protein, 305 aa, Panicum virgatum
  misc_feature: Ceres CLONE 1831838
  misc_feature: Great-hit functional homolog of the protein sequence given in SEQ ID NO 9535
  misc_feature: Useful for making plants with modulated biomass
  misc_feature: The plant is abnormally small.
MAIISDFQDDEAQPRQQAAADVEEALAALLERCGGALPFLQAAIGVAHRRSGLFRDPSAVSKVTAMAAAARAEVEAEERAAREAKRKAEEAERKAAAEAEKAAKAAAAPVAEEKPESSAEKDSMEVDKKEEGKVRQPNAGNGLDLEKYSWTQQLPEVNISVPVPEGTKSRFVVCDIKKNHLKVGLKGQPPIIDGELYKPVKVDDCFWSIEDGKSLNILLTKHNQMEWWKSVIKGDPEVDTQKVEPESSKLSDLDPETRQTVEKMMFDQRQKQMGLPTSDEMQKQEMLKKFMAEHPEMDFSGAKIA

SEQ ID NO: 6137 - DNA, 2049 bp, Panicum virgatum
  misc_feature: Ceres CLONE 1844231
  misc_feature: Encodes the peptide sequence at SEQ ID NO. 6138
ggggacgccaccgcggctgatatatacctccgcctccgcctgctcccatggccaccgccgcatccacctccgccgccgccgccgttctcgcatcccggctcctccgacgctcgccgcgcctgctgcggcgactcagcctctcgcgcgcgccgcccccggcgctctcgtcgtctagccgttccctcgcgcccctcgcccgccaaccgatcggtcaccgcgctcggatggggcacaccgccgcagcggccgcggccgccggacccgcgctcggactcaccaagcccaacgccgtcgagccgcctcagatcactttttccgctaaagacatcgaattctccgagtggaagggcgatattctcgccgtcgcggtcacagagaaggatctctccaaggattccgactccaaattcgagaatgctgtcttgaagaagctggacagccagctcggcggtctcctatctgaggcggcagcggaggaagatttcaccgggaaagccggacaatcagtggttctccgcctcgcggggcagggtttcaagagggtgggtctgattggtcttggccagaacgccccttccactgccgccgctagcaggggccttggcgaatctgtcgcatcagttgccaagtctgttcaagctagcagcgctgctattgttgttgcctccccaagtgggatcccggaggagttcaagctaactgcagcagcagcaattgcttccggaactgtgctcgggttgtatgaggacagcagatacaagtccgaatcaaaaaagacgcacctgaaacaggttgatattattggattgggttctggtcccgaggtggatcagaaacttaagtatgccaacgatctttcatcaggcgtgatatttggtagagagcttgtgaactctcctgccaatgtccttacccctgctgtgcttgcggaggaggcatcgaagatcgcttctacatacagtgatgtgttcactgccacaatattagatgtggagaaatgcaaagagttgaagatgggctcctacttgggagtttctgccgcttctgctaaccctcctcacttcatccacttgtgctacaaaccaactgatgggaatgtcaagagaaagctggctattgttgggaagggtctaacttttgacagtggtggctacaacattaagactgggccaggatgcagcatcgagctgatgaaatttgacatgggaggctctgcggctgtgtttggtgcagctaaagcgttgggccaaatcaaacctcctggtgtagaggttcactttatagttgctgcctgtgaaaatatgattagtggcacaggcatgagacctggtgacattgtgactgcttctaacgggaagacaattgaggtaaataatactgatgcagaggggaggcttacccttgctgacgctttggtctatgcttgcaaccaaggtgttgacaagattgttgatctggcaacacttactggtgcgtgcgtggttgcacttgggcctagcattgctgggattttcacaccaagcgatgagctagccaaggaggttactgctgcttcagaggtatcaggcgagaagttttggagactgccactggaagacagctactgggaatcgatgaagtccggtgttgctgatatggtcaacactggtggtaggcagggcggttctattaccgccgctctgttcctgaagcagtttgttgacgagaaagtccagtggatgcacatcgacatggcagggccagtgtggaacgacaagaagcgcgctgccaccggtttcggagtctccaccctggtggagtgggtcctcaagaactcctcatcctgaacagccacaacaaactcatatgctttcccttttccaagctgggaccggtgaatggaggtctaccatggttttttttcttttgtgctactaccattttgtagttgccacttgcaaactgcgagcaaagcggacggcgcttttggcataccatgtgatactgtgtgtgatagaataagcagaagggctggaacgccttttgtgtcaaaaaaaaaaaaaaaaaaaa

SEQ ID NO: 6138 - protein, 592 aa, Panicum virgatum
  misc_feature: Ceres CLONE 1844231
  misc_feature (1)..(311): Pfam Name: Peptidase_M17 Pfam Description: Cytosol aminopeptidase family, catalytic domain
  misc_feature (1)..(591): SWISSPROT Homolog: EC 3.4.11.1 Leucine aminopeptidase 2, chloroplast precursor
  misc_feature (74)..(592): SWISSPROT Homolog: EC 3.4.11.1 Leucine aminopeptidase 1
MATAASTSAAAAVLASRLLRRSPRLLRRLSLSRAPPPALSSSSRSLAPLARQPIGHRARMGHTAAAAAAAGPALGLTKPNAVEPPQITFSAKDIEFSEWKGDILAVAVTEKDLSKDSDSKFENAVLKKLDSQLGGLLSEAAAEEDFTGKAGQSVVLRLAGQGFKRVGLIGLGQNAPSTAAASRGLGESVASVAKSVQASSAAIVVASPSGIPEEFKLTAAAAIASGTVLGLYEDSRYKSESKKTHLKQVDIIGLGSGPEVDQKLKYANDLSSGVIFGRELVNSPANVLTPAVLAEEASKIASTYSDVFTATILDVEKCKELKMGSYLGVSAASANPPHFIHLCYKPTDGNVKRKLAIVGKGLTFDSGGYNIKTGPGCSIELMKFDMGGSAAVFGAAKALGQIKPPGVEVHFIVAACENMISGTGMRPGDIVTASNGKTIEVNNTDAEGRLTLADALVYACNQGVDKIVDLATLTGACVVALGPSIAGIFTPSDELAKEVTAASEVSGEKFWRLPLEDSYWESMKSGVADMVNTGGRQGGSITAALFLKQFVDEKVQWMHIDMAGPVWNDKKRAATGFGVSTLVEWVLKNSSS

SEQ ID NO: 6139 - DNA, 2269 bp, Panicum virgatum
  misc_feature: Ceres CLONE 1844321
  misc_feature: Encodes the peptide sequence at SEQ ID NO. 6140
aaaacacgccgcccccattttctcctccctgtcaacctttttccctttgagaaattcggcctcgctgcgagatctttagctccgggccccgagcccccgtgtggattagtcgctgtcacgttcgacgacgggcgccaattgcggtggccaccacctccaatccactccccgcggtcgccgcgccgagctgttcttgctctgtcctcctaacgtcctcccaagattcgttctttagacccagttcctgcgcccagttcttcctaaggcggaggggtggttgcttctccgggctctgaggttggaatcttgtccctctcacaaggtttagtcttgattggtctcatctgctcagctgtcaggttgcaagcttagaactggaaggaataatttgactagagaaatgggacagtgttgcagcagagctacggccccagattctggacggggaggtaccaatgggtatggctattctaaccaggcaaagccagcacaaacgcctcccagttataatgctcctcagccacaggccgaggtacggtacacgccaccggcgatgaaccctccggtagtcccacctgtagttatcccaccaaagcccacatcagacacaattcttggcaagccgtatgaggatgtgcgcacagtctactccctcgggaaggagcttggccgcggccagttcggggtgacgtacttctgcacagagattgctactggtaggcagtacgcctgcaagtccatctctaagcgcaagctcaccagcaaggcagacagggaggacattcgcagggagatccagatcatgcagcacttgtctgggcagccaaacattgtcgagttccggggagcgtacgaggataagagcaatgtgcatgtggtgatggagctctgtgctggtggtgagctatttgatcggatcattgctaaggggcactacacagaacgggcagctgctacaatctgcagagcagttgtgaatgttgtgaacatttgccacttcatgggagtgatgcatcgtgatctgaaaccagagaatttcttgctcgcaaccaaggaggagaatgcaatgctcaaggccactgatttcggtctttcagtcttcattgaagaaggaaagatgtacagggacattgttggaagtgcttattatgttgctcctgaagtccttaggcggagttatggaaaagagatagatgtttggagtgcaggagttattctgtacattctcctcagtggcgtgcctccattttgggctgaaactgaaaaggggatatttgatgctattctgcatgaggagattgactttgaaagtcagccttggccatcaatttctgagagcgctaaagacctggttagaaagatgttggcacgagatccaaagaaaagacttacttcaggccaagttcttcaacatccatggctcagagaaggtggagatgcatctgataagcctattgacagtgctgttctttctagaatgaagcaattcagagcaatgaataagctgaaaaagatggctctgaaggttattgcttcaaaccttaacgaggaagagatcaagggcttgaagcaaatgttcatgaacatggacacagacaacagtggtacaatcacatacgaagaactcaaagcaggattagccaaacttggatcaaaactgtcagaagctgaagtaaagcagttgatggaggctgctgatgttgatgggaatggatccattgactatgttgagttcatcactgccacaatgcatagacacaagctcgaaagggacgagcatttgtttaaggcattccagtactttgataaagataacagcggcttcatcacaagagatgagctagagtcagctttgatcgaacatgagatgggtgacacgagtacgataaaggagatcatatcagaagttgacacggacaatgatgggaggattaactatgaggaattttgcgctatgatgagaggtgggatgcagcagccaatgaggcttaagtagcctgttcacgttgtagaaacggtgtaccattactccattagtaactgttgtttgctcttttttcttcatggttggtacttggtagctggataaaggcttacaatggactttgcttgtgcattgttgagagatcattgtgtatatcttttttgctcgtgtttgttggttgttgccttgtagtatcttgaacgtcccgtactttcttctgtaagtttgtttatgcaaatacatctaataaaacgtgcattttgccaaaaaaaaaaaaaaaaaaaa

SEQ ID NO: 6140 - protein, 531 aa, Panicum virgatum
  misc_feature: Ceres CLONE 1844321
  misc_feature (1)..(531): SWISSPROT Homolog: EC 2.7.11.1 Calcium-dependent protein kinase, isoform 2
  misc_feature (36)..(531): SWISSPROT Homolog: EC 2.7.11.1 Calcium-dependent protein kinase 2
MGQCCSRATAPDSGRGGTNGYGYSNQAKPAQTPPSYNAPQPQAEVRYTPPAMNPPVVPPVVIPPKPTSDTILGKPYEDVRTVYSLGKELGRGQFGVTYFCTEIATGRQYACKSISKRKLTSKADREDIRREIQIMQHLSGQPNIVEFRGAYEDKSNVHVVMELCAGGELFDRIIAKGHYTERAAATICRAVVNVVNICHFMGVMHRDLKPENFLLATKEENAMLKATDFGLSVFIEEGKMYRDIVGSAYYVAPEVLRRSYGKEIDVWSAGVILYILLSGVPPFWAETEKGIFDAILHEEIDFESQPWPSISESAKDLVRKMLARDPKKRLTSGQVLQHPWLREGGDASDKPIDSAVLSRMKQFRAMNKLKKMALKVIASNLNEEEIKGLKQMFMNMDTDNSGTITYEELKAGLAKLGSKLSEAEVKQLMEAADVDGNGSIDYVEFITATMHRHKLERDEHLFKAFQYFDKDNSGFITRDELESALIEHEMGDTSTIKEIISEVDTDNDGRINYEEFCAMMRGGMQQPMRLK

SEQ ID NO: 6141 - DNA, 1903 bp, Panicum virgatum
  misc_feature: Ceres CLONE 1844328
  misc_feature: Encodes the peptide sequence at SEQ ID NO. 6142
gcgccacatctagtaggccgccgccacctccacgcgcgcgctcgtgaccgccgccgcccgccgcgctcgggccgccaggaaaagaatccctccttggtggcgaccgcggaggctccccggcgcttctcgctctccccctggcgtggcgctttggtccccagtttgtcgactgtcttttctgcctgctgcgcttgcacagggtggggaagatgggtggggtggtcttgccaggataacaccttatcctgttccccatccccgtgctagatcgatgcgcccctgcgcgtgtgggtgcatcatgtatgtgtgtcgggcgtattagggggcagctgcttgttcttgtgcttggcctagaagggagcgtgcttactgacactgaccaactgaccgttccattccgggcgccagagtagagattctagtgttgtttcttggctcgctgggagggtaggatctggctatggacatggtgctgaacccggtgaaggaggagagccatggggatggcggtttgttgccgggcgcagcggctggggatgggccgtctgccgccgcgccgaagccgatggaggggctgcacgacgccgggccgccgccgttcctgaccaagacctatgacatggtcgatgacgcggccaccgatcccatcgtgtcgtggagcgccaccaacaacagcttcgtggtgtgggatccccatgctttcgccaccgtgctgctgcccaggcacttcaagcacaacaacttctccagcttcgtcaggcagctcaacacctatggtttcaggaaggtggatcctgatcggtgggaatttgcgaatgaggggtttttacggggacaaaggcacctcctgaagaacattaggcgtcgaaaacctcctgctcagaatgcctcaaaccagcagtctcttgggtcataccttgaggtgggacactttggatatgatgctgagattgaccggctgaagagggacaagcaattattgatggcagaagtggtgaagctaaggcaggagcagcagaacacaaatgcaaatctcaaagccatggaggataggctacaaggcactgatcagaagcagcagcagatgatggcgttcttggcacgcatcatgcggaaccctgaattcttgaagcacctggtttcccagaacgagatgagaaaggagctccaagatgctatttcaaagaaaagaaggcgccgcattgatcagggacctgaagttgatgacttggggaccagtagcagcctagagcaaggttcaccagttctatttgacccccaagactcggtcgaattccttgttgatgggattccaactgatcttgagagtacagctttcaatggcgaaggcctggttgagccacaggatattggtcttggtacctctgagcagcagcaagacatgccccaggaggacttgactgacaacttctgggagcaattgctgaatgaaggacttggcgaggagaatgacaaccctgttgtcgaggatgatatgaatgtgctttctgagaagatgggctatctcaactcagatggctcgacatccaggaaatagttttgtttcattgcatcacattgccatcaccttttgtaattttctcgtatccgcccgcagctttctgagttctactgtgtcagcaagatggcaattgttccggggctagtgttttcttatgcttgccgaactccttggcaagggagagcttgcttccatcaaaagcgccatggattctggggcgagcggcaagtttatctgatctgactgactgtagtgattgccggttgtctagacccttgtatgtctatcagaattcaggacgtgcagtgagtcgtgctgttgatccctgcatgtctcggtaggtggtgatggcatactttgttctgttgatattctaatgtt

SEQ ID NO: 6142 - protein, 365 aa, Panicum virgatum
  misc_feature: Ceres CLONE 1844328
  misc_feature: The sequence is a functional homolog of  SEQ ID NO 1686 in the  10/412,699 US patent application
  misc_feature: The sequence is a functional homolog of  SEQ ID NO 1687 in the  10/412,699 US patent application
  misc_feature: The sequence is a functional homolog of  SEQ ID NO 1688 in the  10/412,699 US patent application
  misc_feature: The sequence is a functional homolog of  SEQ ID NO 2660 in the  10/374,780 US patent application
  misc_feature: The sequence is a functional homolog of  SEQ ID NO 74 in the  10/225,066 US patent application
  misc_feature: The sequence is a functional homolog of  SEQ ID NO 926 in the  10/412,699 US patent application
  misc_feature: Useful for making plants with modulated growth and phenotype characteristics
MDMVLNPVKEESHGDGGLLPGAAAGDGPSAAAPKPMEGLHDAGPPPFLTKTYDMVDDAATDPIVSWSATNNSFVVWDPHAFATVLLPRHFKHNNFSSFVRQLNTYGFRKVDPDRWEFANEGFLRGQRHLLKNIRRRKPPAQNASNQQSLGSYLEVGHFGYDAEIDRLKRDKQLLMAEVVKLRQEQQNTNANLKAMEDRLQGTDQKQQQMMAFLARIMRNPEFLKHLVSQNEMRKELQDAISKKRRRRIDQGPEVDDLGTSSSLEQGSPVLFDPQDSVEFLVDGIPTDLESTAFNGEGLVEPQDIGLGTSEQQQDMPQEDLTDNFWEQLLNEGLGEENDNPVVEDDMNVLSEKMGYLNSDGSTSRK

SEQ ID NO: 6143 - DNA, 2066 bp, Panicum virgatum
  misc_feature: Ceres CLONE 1844349
  misc_feature: Encodes the peptide sequence at SEQ ID NO. 6144
aacctccaattccagttgtcttccccgccccgccgcggcctccctccgatccccaattttaaacgcccccttcttcttcttctctctcctgcggcccactcgcctcccctccctccccacctcctcccacgccgcgagcgaatccggacggctcgctgccccggctccccctctcctgtcccgcgatggcggcgtccatggcgtcgccgcgggggcggtcgatccgggaggcggtgctggagaccgtcgcggcgtaccacaaccagcagcggatgaggcgcaagctgcgcaagagcctcacctacgccggcgagctctcctccgcgggccggccacgcggggacggcgcctcctcgtccgcctcggtatcctcgctttgcggggccgaggacgacgacgagcccttctgggaggaggaggagggcaccgtcgagctcgtccagctcggggccaaccgcgccaagaacgtcctcatcctcatgagcgacaccggcggcggccaccgcgcatccgcggaggccatcaaggacgccttccggatcgagttcggcgacgagtaccgggtcttcgtcaaggatctgtgcaaggatcacgccggctggccgctcaacaacatggagagctcatacaagttcatggtgaagcatgtgcagctctggaaagtggccttccacagcacctctcctagatgggtccattgcttctacctcgctgctctcgcctcattctatgccaagaaggtggaggctggactgaagaagtacaagccagacatcataattagtgtccaccccctcatgcaacacattcctctgtgggtgctcaaatggcaaggcctgcaaaacagggtagtctttgtaaccgtcatcacagacctcaacacttgccaccctacatggttccatgccaatgtgaatagatgttactgcccctcagaagaagttgccaagagggcagcattggatgacctacaaccttctcaaatccgtgtgttcggtcttccgattcgaccatcattttgccgtgcagttcttgtaaaggatgaattgatgaaggaacttgaattggatcccgagcttcctgcagtgctgctcatgggaggtggagagggcatgggtcctgtcaagaagactgcaaaagctcttggagaatcattgtttgacaaagaacaaggaaaaccaattgggcagcttattgtaatttgtggtcggaacaaaacactaagctcctccctacaggcacttgaatggaaaataccagtaaagattagaggatttgagacccaaatggagaagtggatgggtgcttgtgattgtattataacaaaggctggaccaggtaccattgctgaagccttgataaggggtcttcctataatccttaatgatttcattcctggacaggaagttggcaatgtcccttatgttgtggacaatggtgcaggcgtgttctccaaaagccccaaggaaattgctagtcttgttgcccgttggtttggtccagactcggaggaattgaaaaaaatgtcagaaaatgcactgaaattggcgcagccagaagctgtctttgacattgtcagagacatacatgagctctctcgggagcaaggcgtgatgtcacagatctctagttccttgacgtcatctttcttcatatcatcacctgaaaccacacctctccaacttatctgaagccatcaagctgtgtatagctagaactgcaatctctgaccttgtgaacttggcattgccccctacatggaaatggaacttcagggagccagatgttgtactgcatttcacaacttttcagttcatgctctcccgtggtagatatgggcggggctggtttgactaaaaggtcgtgtctattgttggcttcatgttaactttgcagaaatcattcattcatatcatgtttgctcccttcatcatcaatggggggagatttggtggtggtggtggcttgtaaatacactcaggccgtgtttagttccctggcgtgtaaacacaaattttttttgcaacggaatcttgctaatttgaagtactaaatgaagtttattc

SEQ ID NO: 6144 - protein, 501 aa, Panicum virgatum
  misc_feature: Ceres CLONE 1844349
  misc_feature (1)..(169): Pfam Name: MGDG_synth Pfam Description: Monogalactosyldiacylglycerol (MGDG) synthase
  misc_feature (1)..(164): Pfam Name: Glyco_tran_28_C Pfam Description: Glycosyltransferase family 28 C-terminal domain
  misc_feature (1)..(170): Pfam Name: Glycos_transf_1 Pfam Description: Glycosyl transferases group 1
MAASMASPRGRSIREAVLETVAAYHNQQRMRRKLRKSLTYAGELSSAGRPRGDGASSSASVSSLCGAEDDDEPFWEEEEGTVELVQLGANRAKNVLILMSDTGGGHRASAEAIKDAFRIEFGDEYRVFVKDLCKDHAGWPLNNMESSYKFMVKHVQLWKVAFHSTSPRWVHCFYLAALASFYAKKVEAGLKKYKPDIIISVHPLMQHIPLWVLKWQGLQNRVVFVTVITDLNTCHPTWFHANVNRCYCPSEEVAKRAALDDLQPSQIRVFGLPIRPSFCRAVLVKDELMKELELDPELPAVLLMGGGEGMGPVKKTAKALGESLFDKEQGKPIGQLIVICGRNKTLSSSLQALEWKIPVKIRGFETQMEKWMGACDCIITKAGPGTIAEALIRGLPIILNDFIPGQEVGNVPYVVDNGAGVFSKSPKEIASLVARWFGPDSEELKKMSENALKLAQPEAVFDIVRDIHELSREQGVMSQISSSLTSSFFISSPETTPLQLI

SEQ ID NO: 6145 - DNA, 1990 bp, Panicum virgatum
  misc_feature: Ceres CLONE 1844359
  misc_feature: Encodes the peptide sequence at SEQ ID NO. 6146
gtgctaggttagctgaaatctccctaatctgttcatctccctgtgtggtgctagtcagctagtgtgaccctgcgatgtcttctcctacctcatgagcttccagtctggaactgtggtagcttcttgtttttcctaatcccttttcagctcaggtatttttcttcgtttggaactgccgggtccgaaattccggtgatttgttgggtttttcgcctgcgaaatccgggcaaaaatggggatctgcagcttctgtgctttgttggctaaatcctgacccaaatttggctcttaaacctaccttttcttggaccttctatttttatctcccattttttccagtaatttatttttctttttcatttctacctattttcatcttccttttcttcgagaaatttgcttctgtggtaaaactgcgtgttcgtcgcgagaaagatcttgtacttgagcactgaaagggttttatgggtttttttacagattcacaatccgtagacctgacctcagttgagcactcgtgagctcgtgccgctgattaaagctggcagctttcagttatagtccaataaacgagtgctcctccgccatggaggtgaggtctgagcaagggctgatggcgggcagggatctgtttggcatgcccaagagcccgccggcgccgccggcgtccgcggccatgcagagcgtgcgcatggcgcacaccgcagacggcacccctgtcttcgccccggtaacctcggcagcgccgccgtcttaccagccgcaggtcgcggtccacgggcctagcatgtccactgcggcggccactggaggcaatggcgccatggcgtcgccgagcataagtgagccagtggccaagaagaagcgtgggcggccaaggaagtacggacccgacgggtccatgtcgctggcattggtgcctgcatcgtcggctacagggtcaccggcgatggggcagggttcttccgggcctttctcactggcggggccgaatccggcgaactctgtgctgggggtgtcgccggatggagtgaagaagcggggccggcccaagggttctaccaacaagccgcgcatgggtgcccttgggtcatcaggagttggatttactcctcatgttattacagttcaagctggggaggacgtttcatcgaagattatgtcattttctctgcatggaacacgtgcagtttgcgttctttcagcaaatggtgccatatcaaatgtaacgcttcgccagactgctacttcaggtggaactgtaacatacgagggtcgatttgagatactatcactgtcagggtcattcctcctgatagagaatggaggccagcgtagtcgaacaggaggactcagtgtgtcactggcgggtcctgatggtcgtctcttgggtggtggagttgcagggcttctcatagcggcttcaccaattcagatagtattgggaagcttcagttctgaaagcaaaaaggagccaaaacagcatgctccttcagaccctgcatcagcgccattgaaggtcgccccgaccacctctatgggacccaacagccccccttcaagaggcacattgagtgaatcatctggtggggctggaagcccaccaccactgcatcaaggcatggctgctagcaacagtaatcaaccaccaatcatgtccagcatgccctggaaatgatctctgcatccttgaccaaatccaggcaggctcagatctagattggcgaactgccttccaggaggaagtagcaatttgcgcttcaatagtgctcgttctctgactagcttatatgtagtgtaattcggagcttgagtagtgagagtactgtagccagaagtttgtagctctattgtaggtttcaccctgaattcatgtgctaggagctgtctgtcatctagagatgatgtactgagctttgtccatgtgatccttggcagtgctatcaaatgtttatttagttctatgttcgaaaaaaaaaaaaaaaaaaaa

SEQ ID NO: 6146 - protein, 363 aa, Panicum virgatum
  misc_feature: Ceres CLONE 1844359
  misc_feature: The sequence is a functional homolog of  SEQ ID NO 1012 in the  10/225,066 US patent application
  misc_feature: The sequence is a functional homolog of  SEQ ID NO 124 in the  10/374,780 US patent application
  misc_feature: Useful for making plants with modulated growth and phenotype characteristics
MEVRSEQGLMAGRDLFGMPKSPPAPPASAAMQSVRMAHTADGTPVFAPVTSAAPPSYQPQVAVHGPSMSTAAATGGNGAMASPSISEPVAKKKRGRPRKYGPDGSMSLALVPASSATGSPAMGQGSSGPFSLAGPNPANSVLGVSPDGVKKRGRPKGSTNKPRMGALGSSGVGFTPHVITVQAGEDVSSKIMSFSLHGTRAVCVLSANGAISNVTLRQTATSGGTVTYEGRFEILSLSGSFLLIENGGQRSRTGGLSVSLAGPDGRLLGGGVAGLLIAASPIQIVLGSFSSESKKEPKQHAPSDPASAPLKVAPTTSMGPNSPPSRGTLSESSGGAGSPPPLHQGMAASNSNQPPIMSSMPWK

SEQ ID NO: 6147 - DNA, 2120 bp, Panicum virgatum
  misc_feature: Ceres CLONE 1844387
  misc_feature: Encodes the peptide sequence at SEQ ID NO. 6148
agcggatcgatcatgtttttccagtagtgggacccaccaccgcaccaccgtctccggacgcggctgccgagcattggttgcgcccgggcgtgtccccacggccgagcggcgcgtcggctgaaatctctcgctgggcggcgatgtggcgctcggcggcgcggcggtcggcgcagatccggcggctcctgtcgtcgtccgcgcccccggcgggcgccggcgccgccgtcccggggccctgcatcgtgcacaagcgcggcaacgacatcctccacgacccatggtacaacaaggacacggcgttccccatgacggagcgcgaccgcctcggcctccggggcctgctcccgccgcgggtcatgtccttcgagcagcagtacgagcgattcataaactcgttccggtcgctggagaacaacacgcggggcgcaccggattccatcgtcgcgctggccaagtggaggatcctcaacaggctgcacgaccggaacgagacattgtactacagggtgctaatcgacaacatcaaggattttgcaccgataatatacactcccactgtcggcttggtctgtgagaattacagtggtctgttcagacgaccccgcgggatgtatttcagtgcaaaggataagggggagatgatgtcgatgatttacaactggccagcagagaaggttgacatgatagttgtgactgatgggagtcgcattctaggcttaggtgaccttggtgttcaggggataggcatacctattggtaaacttgatgtctatgttgcagctgccggtattaacccacaaaaggttcttccaataatgcttgatgtggggacaaataatgaaaagcttctggaagacaagctatatttaggactaaggcaacctcggttggaaggagaagaatacttggccgttgtagatgaattcatggaggctgtccatgcacgttggcctaaagcagttgtgcagtttgaagacttccaaatgaaatgggcctttgagactcttcagaggtatcggaacagattttgcatgttcaatgatgacgtacaggggacagccggagttgccctagctggcctacttggtgctgttagagcacaaggccggcctctgcaggattttccaaatcaaaagatagtcgttgtgggagctggaagtgctgggataggtgtgctaagcatggctaaacagtcaatgttgaggatgcctgggatccatagaactggtgaaggacataatcaattctgggttctggacaaagatggccttattacgaaaactaggaagggtctggatcctgctgtagcacgttttgccagaggctatggtccagatgaggtcccagatctccatgaaggagccagtcttgttgaagtggtcaagaaagttaaacctcatgtgcttttaggactatctggagttgggggcatatttaatgaggaggttctcaaggctatgaaagaatctgattcccctcgccctgcagtttttgcaatgtccaacccaactactaaagctgagtgtactcctgatgatgtattcaagcatgttggagagaatgcaatatttgctagtggaagccctttcagtaacatttctttaggaaatggtaagacaggttatgctaatcaagcaaacaacatgtatctgtttcctgggattggtttaggagctctcctttcaggtgctcggcatatttcggatggcatgcttcaagcagcagctgagtgcctggcatcatacatcacagatgatgaaattcgaaaaggaatcctcttcccttcagtctccagtatcaggcacatcactgcacaggtcggcgcagcagtcgtccgtgccgctgtcgctgaagaccttgctgaggggtgctgcgatgtgggtcctagggagcttgggagcatgtcagagtcggaaacggtggactacgttgctcgcaaaatgtggtaccctatttacagcccccttgtgagcgacaaataaatcggaaccagctgttcctgacattccattcgaaggaatgtatcagactttgtcatttgttttggctaaaattattagccatttttaatttagttgctcagctagaaagcatttcagcaaaaaaaaaaaaaaaaaaaa

SEQ ID NO: 6148 - protein, 613 aa, Panicum virgatum
  misc_feature: Ceres CLONE 1844387
  misc_feature (1)..(267): Pfam Name: Malic_M Pfam Description: Malic enzyme, NAD binding domain
  misc_feature (1)..(612): SWISSPROT Homolog: EC 1.1.1.39 NAD-dependent malic enzyme 59 kDa isoform, mitochondrial precursor
  misc_feature (32)..(613): SWISSPROT Homolog: EC 1.1.1.39 NAD-dependent malic enzyme 62 kDa isoform, mitochondrial precursor
MWRSAARRSAQIRRLLSSSAPPAGAGAAVPGPCIVHKRGNDILHDPWYNKDTAFPMTERDRLGLRGLLPPRVMSFEQQYERFINSFRSLENNTRGAPDSIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNEKLLEDKLYLGLRQPRLEGEEYLAVVDEFMEAVHARWPKAVVQFEDFQMKWAFETLQRYRNRFCMFNDDVQGTAGVALAGLLGAVRAQGRPLQDFPNQKIVVVGAGSAGIGVLSMAKQSMLRMPGIHRTGEGHNQFWVLDKDGLITKTRKGLDPAVARFARGYGPDEVPDLHEGASLVEVVKKVKPHVLLGLSGVGGIFNEEVLKAMKESDSPRPAVFAMSNPTTKAECTPDDVFKHVGENAIFASGSPFSNISLGNGKTGYANQANNMYLFPGIGLGALLSGARHISDGMLQAAAECLASYITDDEIRKGILFPSVSSIRHITAQVGAAVVRAAVAEDLAEGCCDVGPRELGSMSESETVDYVARKMWYPIYSPLVSDK

SEQ ID NO: 6149 - DNA, 3376 bp, Panicum virgatum
  misc_feature: Ceres CLONE 1844402
  misc_feature: Encodes the peptide sequence at SEQ ID NO. 6150
ctacccgcacccgcacgggcattcatggccgcagagccgacgcgggcgccgctgtccgccaaagcgccaagcaggcgtcgcgtagcccaccggcgcagaccgggatccccgtgagcggccctggccctgctccaacatagctggcgccccagccgcatcggttttgtccgcgtcaggcgccctcgccccggccacagcagcacacggcgtccttgcatgcgtccatggagccgtgcagggaagatttcatttcacacggcagaggcagagcccagcttccgcggctctccctccctccctctgaaatctgaatcgatttgagcaattcgatcgaggcggaaccggggccgctggaatccgtccgatcgcccgccatgttctcgcgatcctacaccaacctgctcgatctcgctaacggcaacctctccgccctcgactactgcggcggcggagggggaacgggcggcgggggcgggggcgggggccgtccgccgcgggccaggcggatgcagcggaccagcacgacgcccgggacgttcgcggacctcgacgaggaccgcgcgggcagcgtcgcctccgacgcgcagtcctcgctcgccggcgaccgcctcatcgtcgtcgccaacacgctccccgtgcgcggggagcgccggccggacggccgcggctggagcttcagctgggacgaggactcgctcctcttccacctccgcgacggcctccccgacgacatggacatggaggtcctctacgtcggctccctccacgccgacgtgccgcccgccgaccaggacgacgtcgcgcaggcgctcctcgaccgcttccgctgcatcccggccttcctccccaaggacctctgcgaccgcttctaccacggcttctgcaagcagacgctctggccgctcatccactacatgctcccctactccgccgaccacggcggccgcttcgaccgctcccactgggaggcctacgtcctcgccaacaagctcttctcccagcgcgtcatcgaggtcctcaaccccgaggacgactacgtctggatccacgactaccacctcctcgccctcccgtccttcctgcgccgccgattcaaccgcctccgcatcggcttcttcctgcacagccccttcccttcgtcggagctctaccgctctctccccgtccgcgacgagatccttaaatcgctgctcaactgcgatctgattggcttccacaccttcgattacgcccgccatttcctctcctgctgcagccgcatgcttgggatcgactaccaatccaagaggggatacattggcctcgattactttggacgcacggtggggataaagatcatgcctgttgggataaacatggagcacctgcagtcactgctccagcaacctgacctcgagcggaaggtcgcagagctccggaaccaattcagccggaagactgtcttgcttggtgtggatgatatggacatattcaagggcattgatctcaagattcttgcatttgaacagatgctcaaggcgcacccgaaatggcagggccgagcagtgttggtgcagattgcgaacccaaaaggcggcagcaggaaagaactggaagagctgcaggccaagattgaacagagttgcaagaggatcaatgaccagtttggacggcctggatatagtcctgtcgtgcttgtcaatagggcactgtcaagtgtcaagaggatggcttattacaccattgccgagtgtgttgttgtcaccgcagtcagggacgggatgaaccttacaccttatgaatacatcgtgtgtaggcagggaattccaggtttggatgggtctgggggtgatagaccaaggggcaagagtatgctagttgtctcagaattcattggttgctcaccatcactgagtggagcaattcgggtaaacccctggaacattgagtcaacagcagaggcaatgcacgagtccatcgcttcatctgataatgagaagcaactgcggcatgagaagcactatcggtatgtcagctcacacgatgttgcctattggtctaagagctttattcatgacttcgagagaagctgtagggaccattttaggagaagatgctggggtattggactaggatttggatttagggtcgttgcccttgaccggaatttcaaaaagcttacagtggattctattgttgctgattacaagaagtcaaagagccgggtcatactactggactatgatggaactctagtaccacaaactacaatagacaagactccaaatgaaactattgttagcatgatgaatactctgtgtgctgataagaagaatgttgttttcattgtaagtggaagaggaagggatagccttgaaaaatggttttactcttgcccagagcttggcattgctgctgaacatggctactttatgagatggaccagagatgaacagtggcaaacacaaaatcagagctcagaatttgaatggatgcatatggccgagccggtaatgaaactgtatacagaggcaactgatggatcatatattgaaaccaaagagagtgctttggtttggcaccaccaagatgctggccctgattttggatcttcacaagcaaaagaaatgttagatcacttggaaagtgtccttgccaatgagccagtctctgtaaagagcggccaacatatcgtagaagttaaacctcaggctgtcagcaaaggatttgttgcagagaagattctttcaactctcatggagaaggaaaggcaagcagattttgttctctgcattggtgacgatagatcagatgaggatatgtttgaaaaaattgctgatatcatgaggaggaacatggttgatccccaaacctcgttatatgcctgcacagtaggccggaaaccaagcaaggctatttactatttggacgatgcaaatgatgttctgaacatgcttgaggcacttgctgatgcatcggaggaggctggctctggctctggttcaccggaagaaacagaggtaccatctacactggaggaagcatgatgatgacatgagatgtcctggagatgtcgaattgcttggctgacgtgacaatgccaccagcaagtcttctgacaaaaactgaagccgatttcgtttggcaggaagtgaaaaattagcaaaactcagatagtcggataaatgtcaataacctagttgtttagtgccatagtagttctcatgttgtctagatagaagaaaaaaaattgtctagagggaagaatccatggcggcatcctttgacttcttggagtattgctaacatgggttcttccaggaaaaattcatggagtattcctgcgagtttatagaatataagccgagattagcagcaaaaaaaaaaaaaaaaaaaa

SEQ ID NO: 6150 - protein, 883 aa, Panicum virgatum
  misc_feature: Ceres CLONE 1844402
  misc_feature (1)..(236): Pfam Name: Trehalose_PPase Pfam Description: Trehalose-phosphatase
MFSRSYTNLLDLANGNLSALDYCGGGGGTGGGGGGGGRPPRARRMQRTSTTPGTFADLDEDRAGSVASDAQSSLAGDRLIVVANTLPVRGERRPDGRGWSFSWDEDSLLFHLRDGLPDDMDMEVLYVGSLHADVPPADQDDVAQALLDRFRCIPAFLPKDLCDRFYHGFCKQTLWPLIHYMLPYSADHGGRFDRSHWEAYVLANKLFSQRVIEVLNPEDDYVWIHDYHLLALPSFLRRRFNRLRIGFFLHSPFPSSELYRSLPVRDEILKSLLNCDLIGFHTFDYARHFLSCCSRMLGIDYQSKRGYIGLDYFGRTVGIKIMPVGINMEHLQSLLQQPDLERKVAELRNQFSRKTVLLGVDDMDIFKGIDLKILAFEQMLKAHPKWQGRAVLVQIANPKGGSRKELEELQAKIEQSCKRINDQFGRPGYSPVVLVNRALSSVKRMAYYTIAECVVVTAVRDGMNLTPYEYIVCRQGIPGLDGSGGDRPRGKSMLVVSEFIGCSPSLSGAIRVNPWNIESTAEAMHESIASSDNEKQLRHEKHYRYVSSHDVAYWSKSFIHDFERSCRDHFRRRCWGIGLGFGFRVVALDRNFKKLTVDSIVADYKKSKSRVILLDYDGTLVPQTTIDKTPNETIVSMMNTLCADKKNVVFIVSGRGRDSLEKWFYSCPELGIAAEHGYFMRWTRDEQWQTQNQSSEFEWMHMAEPVMKLYTEATDGSYIETKESALVWHHQDAGPDFGSSQAKEMLDHLESVLANEPVSVKSGQHIVEVKPQAVSKGFVAEKILSTLMEKERQADFVLCIGDDRSDEDMFEKIADIMRRNMVDPQTSLYACTVGRKPSKAIYYLDDANDVLNMLEALADASEEAGSGSGSPEETEVPSTLEEA

SEQ ID NO: 6151 - DNA, 1818 bp, Panicum virgatum
  misc_feature: Ceres CLONE 1844455
  misc_feature: Encodes the peptide sequence at SEQ ID NO. 6152
cttcccgtccctccatctcgccatttatccgctgccctcgtgctctccccgccaatccctcccaagattaggaggcacaggagcccgagattcggatttaggatttggattctggtgcaggaatcgaaagcgccactcgctggagtcgcggccgaattgcttgggtgagcacgccatgatggcgaacgggaggctccaaaagcaggccttgctgccgccgcggagcccattccctgcagcggcggctgcgccggcgccggcgcagcacgccgagctcggcccgatcgcgcggccgcgggacgcgcaccaccgccacggccaccagcgcacgtcgtctgagagcttcctcgccgacgagcagccgtcgtggcttgacgacctgctggacgagcccgagacgccggcgcgggcgcatggccggcccggccaccgcaggtcgtccagcgactcgttcgcgctcttcgaaggcggcggcggcgccgcggcgggcatgtacgacaatgtgctcgatggcatgaggggaggaggcggaggacagttggcttcttgggctggcgcgcccgagttcttcccggaacccacctcgtttgggcgacctcagggcaggccgtgggagtcaaggcagatgtaccggcagggtagtggcatgccgatgccagggagagagaagaacggagggcgccatggtccgtccagctcatttggtgatcttgagcatgcccgtgtgccgaatggggtggacaggaaaggccatggtgatgcagctcatgaccagaggattggagcagagaggaaggacggcctgaggcactcacagtcggaggcggacaccaagcgagccaaacaacaatatgctcagagatctcgtgttcggaagctccagtatattgcagagctcgagagaagagttcagtccttgcagacagatgggatagaagttactgctgaaatggattttcttggtcagcaaaatatcatgttggacctggaaaataaagccttgaagcaacggcttgagagtctatctcaagagcatcttattaaacgctatcagcaagagatgtttgagagggaaattggtcgtcttagatcattgttccagcaacagcagcagcagcaacagcatccccagcagcaggctcctacgcacagccgcagtaacagcagagacctcgattcacaattcgcaaacctgtctctgaaacacagcgatcccaattccgggcatgatgctgtctctggccttcgcatttaagatttttttccagcttttggttctccgagcttcacatcttgctgcccttgttacaccactctttgtggctgttgcatcaagagaggggcagcaacattgaacctggaatcacatcccatggtgaataaagctggaaaggttaataactgtgggtccaatctttagttctttcggagtgtgcacctgatggtcatccttagctcctgtccattgttgacgcttgaccagtcggaggtgtttagggtctatacgcagattgatgcctttcatggatccttgtatcagtttgaagttagaacactaattcattcctttttagttgattctgttctcgagtttaggcaccatgtggtgcttgtattagttagcttggcacatgaatggaatgtgagctgatcgtcttttggttaatgccacatcctggagaactgttgtgccagcatgttcaataagctagtgaggtcgaagtgttgtagttcagtttcatttcatttgtgatatgcggaacaagatattggatactcaggttctcacgtttatttgaaaaaaaaaaaaaaaaaaaa

SEQ ID NO: 6152 - protein, 359 aa, Panicum virgatum
  misc_feature: Ceres CLONE 1844455
  misc_feature (1)..(49): Pfam Name: bZIP_1 Pfam Description: bZIP transcription factor
MMANGRLQKQALLPPRSPFPAAAAAPAPAQHAELGPIARPRDAHHRHGHQRTSSESFLADEQPSWLDDLLDEPETPARAHGRPGHRRSSSDSFALFEGGGGAAAGMYDNVLDGMRGGGGGQLASWAGAPEFFPEPTSFGRPQGRPWESRQMYRQGSGMPMPGREKNGGRHGPSSSFGDLEHARVPNGVDRKGHGDAAHDQRIGAERKDGLRHSQSEADTKRAKQQYAQRSRVRKLQYIAELERRVQSLQTDGIEVTAEMDFLGQQNIMLDLENKALKQRLESLSQEHLIKRYQQEMFEREIGRLRSLFQQQQQQQQHPQQQAPTHSRSNSRDLDSQFANLSLKHSDPNSGHDAVSGLRI

SEQ ID NO: 6153 - DNA, 2223 bp, Panicum virgatum
  misc_feature: Ceres CLONE 1844466
  misc_feature: Encodes the peptide sequence at SEQ ID NO. 6154
ataaatccctctgcttccggcccaggctccgctccgcccgccccagcgacgcaccactgatctcccggcgaaatcccgcctccccctccggccgcgcccggcttcgcccccctgcttcggaaggtgaagtaaataatggcgacgggccaacttttctcgaaaactacccaagcattattctacaattacaagcaacttccaatccaacggatgcttgattttgacttcctctgtgggagggaaacaccttctgttgctggaataatcaatcctggttctgatggttttcagaaacttttctttggacaagaggaaattgctattccagttcatcctacaattgaagctgcctgcaatgcgcacccaacagctgatgtatttatcaactttgcatccttccggagtgctgctgcttcttcaatgtcagctttaaagcagccaacaataagagttgtagccattattgcggagggtgttcctgaatcagatgcaaagcagctaattagttatgcacgtgctaataacaaggtcatcattggacctgcaacagttggaggaattcaagctggtgctttcaagattggtgatactgctggaaccattgacaacataattcagtgcaagctttacaggcctggatctgtcggttttgtgtctaaatcgggtggtatgtcaaacgagctctacaacaccattgccagagtgacagatggtatttatgaaggaattgcaattggaggagatgttttccctggatcaactctgtctgatcacattctgcgttttaataacataccacaggttaaaatgatggttgttcttggggagcttggtggaaaagacgagtattcacttgttgaagccttgaaacaaggaaaggttcagaaaccagttgttgcatgggttagtggaacgtgcgcacgtctcttcaaatcagaagtgcagtttggccatgctggtgctaagagtggtggtgagttggaatctgcccaagctaagaatcaggcactaagggaagctggggcaattgtgcctacttcatatgaagctctcgaaagtgctattaaggagacatttgacaaactggctgaggaaggaaagatttctcctgtgactgaaattacacctcctcccattcctgaggaccttaaaactgcaatcaagagtgggaaggtccgggctcctacccatatcatctccactatctctgatgacagaggcgaggaaccatgctatgctggtgtccctatgtctacaattattgaacagggttatggcgttggtgatgttatctctctcttgtggttcaagcgcagtcttcctcgctattgcactcagtttattgagatatgcatcatgctttgcgctgaccacggtccatgtgtgtccggtgctcacaactctatagttactgctagggctggaaaggaccttgtttccagcttggtgtctggattattgacaattggtccccgttttggtggagcaattgatgatgcagcccgatacttcaaagatgcatacgataggggtctcacgccttacgagtttgttgaaggcatgaaaaagaagggtatccgtgtccctgggattggtcacaggataaagagcagggacaacagggacaagcgtgtgcagcttctacaaaaatatgctcacacacatttcccatcagtcaagtacatggaatacgctgttcaggttgagacctacaccttgtcgaaagccaacaatttggtcatgaatgtcgatggtgcgatcgggtcgcttttcttggatcttctatctggaagtggaatgttcaccaaacaggagatcgacgagattgttgagattggttatcttaatgggctcttcgtccttgcacgttcaattggtctgattgggcacacttttgaccagaagaggctcaagcagccactctaccgtcacccatgggaggatgtcctctacactaagtgagatagaatcattctttgtgcacggaattaatactgtcacctagggcttccagctgtctgtacacttgataaactcgagcacagttgcataaaagttggaagttgtgattgatggtgaaactaggagagagagagagagaggacgtcactagtcagcactagcttgtgtgttttatgtgttgcaaattcaagtctctagtcctgatttttgtccagcaaaatgaaccgttgggccatatgataaaaaaaaaaaaaaaaaaaa

SEQ ID NO: 6154 - protein, 608 aa, Panicum virgatum
  misc_feature: Ceres CLONE 1844466
  misc_feature (1)..(146): Pfam Name: Ligase_CoA Pfam Description: CoA-ligase
  misc_feature (6)..(606): SWISSPROT Homolog: EC 2.3.3.8 ATP-citrate synthase
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNELYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALREAGAIVPTSYEALESAIKETFDKLAEEGKISPVTEITPPPIPEDLKTAIKSGKVRAPTHIISTISDDRGEEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFTKQEIDEIVEIGYLNGLFVLARSIGLIGHTFDQKRLKQPLYRHPWEDVLYTK

SEQ ID NO: 6155 - DNA, 1731 bp, Panicum virgatum
  misc_feature: Ceres CLONE 1844467
  misc_feature: Encodes the peptide sequence at SEQ ID NO. 6156
atcccgctcaccgcgcagtaatctcttctcagctagtagtagtagtgcgcgcgacgcgaggtccagaataagagctcgtccgctaatggaggtcgccgccaggaccgccactgcactgctcctcgcgctcgccgtcgcctcggggtgcctctgcggcggcgcgcagggtcgccaccaccgccacaccaagcacaccaggcacaactcggcgcccgcgcgcgcgcccgcccaggccccgggcccggcgagctccaggaggcacgcgcctccgcacgcgcgccccgtctctcccccggccccaccgccgtcgtcgtcgtctgggagcggcggcgcctacccgaccccgggcgcggcgccagagcccgcggcgggcggcgcggccgccgtgtacgacgtcgtgaaggacttcggcgcggryggggacggcgtggcggacgacaccgacgccatcaagacggcgtgggacaccgcgtgcgcggacgacggcgacggcgtcgtgctcgcggccgccgggtactcgttcctcgtgcacgccaccgtcttcaccgggccgtgccagggcagcgtcacgatccagctcgacgggacgatcgtggcgccgagcgaccccgacaagtggccggccaacaccaagcgcaactggctcgtgttctacaacgcccacggcacgacgctgcgcggcgccgggctcatcgacggcaagggccagaagtggtgggagctcccctgcaagactgacaagggccagggcggatccagcggccacggagcatcctgtgacagcccagtggcgctccggttcttctcgagcaacaacgtgaaggtgcagggcctgcgggtgcagaacagccccgagttccacttccgtttcgacggctgccgcggcgtggtggcgagcgggctgtccatcagctccccggcgcagagccccaacacggacggcatccacatcgagaacacccaggacgtgctcgtcgccgacacggccgtctccaacggcgacgactgcgtctccatcggcgccggcgccctcaacgtgcgcatcgagaacgtgacctgcggccccggcgggcacggcatcagcatcgggtccctgggcaagcagggctcccgggcgtgcgtcgccaacgtgaccgtgcgcaacgccgtgatccggcgctccgacaacggcgtccggatcaagacgtggcagggcgggtccgggtccgtgtccggggtggcgttcgagaacgtgcgcatggacgccgtgcgcaaccccatcatcatcgaccagtactactgcctctcccggacctgcgagaacgccaccaccgccgtcctcgtctccggcgtctcctacgccgggatccggggcacctacgacgcgcgcagcccgccgatacacttcgggtgcagcgacgccgtgccctgcaccaacatcacgctcgccgacgtcgagctgctcccggcggcggggaaggcggtcgacgacccgttctgctggaacgtctacgggagcgccgccacgcccacggtgccgccagtggcgtgcctcatggacggcgcgcccggtggccacgccgacaagagcagcttgaaatgctactgatcgatgcatgattaactagctactactggtgatgatgatccgatcgaggtcatcgtacagtctacaaatcctgctgctgagtgctgctacttgtttaggaggaagtaaaacagtcaacagacagagaaaagtaagattagtgc

SEQ ID NO: 6156 - protein, 500 aa, Panicum virgatum
  misc_feature: Ceres CLONE 1844467
  misc_feature: Great-hit functional homolog of the protein sequence encoded by LOCUS At1g02460
  misc_feature (1)..(347): Pfam Name: Glyco_hydro_28 Pfam Description: Glycosyl hydrolases family 28
  misc_feature: Useful for making plants with altered cell wall content and/or composition
  misc_feature (111)..(111): Xaa is any aa, unknown, or other
MEVAARTATALLLALAVASGCLCGGAQGRHHRHTKHTRHNSAPARAPAQAPGPASSRRHAPPHARPVSPPAPPPSSSSGSGGAYPTPGAAPEPAAGGAAAVYDVVKDFGAXGDGVADDTDAIKTAWDTACADDGDGVVLAAAGYSFLVHATVFTGPCQGSVTIQLDGTIVAPSDPDKWPANTKRNWLVFYNAHGTTLRGAGLIDGKGQKWWELPCKTDKGQGGSSGHGASCDSPVALRFFSSNNVKVQGLRVQNSPEFHFRFDGCRGVVASGLSISSPAQSPNTDGIHIENTQDVLVADTAVSNGDDCVSIGAGALNVRIENVTCGPGGHGISIGSLGKQGSRACVANVTVRNAVIRRSDNGVRIKTWQGGSGSVSGVAFENVRMDAVRNPIIIDQYYCLSRTCENATTAVLVSGVSYAGIRGTYDARSPPIHFGCSDAVPCTNITLADVELLPAAGKAVDDPFCWNVYGSAATPTVPPVACLMDGAPGGHADKSSLKCY

SEQ ID NO: 6157 - DNA, 1788 bp, Panicum virgatum
  misc_feature: Ceres CLONE 1844483
  misc_feature: Encodes the peptide sequence at SEQ ID NO. 6158
acctcaatttgtcaccgccggggcgagcacgtcgccggcgccctcctcctccaggctctcagctcccgccgtctctccttccaccggagcacgacgggggccccttcgaattcttcttctctgtctcctgctccgtccccctccaacacctctcctcgattgctaccggaagtgcagatccatccgggcttcgattggctccctcgcttggtggtgatttcaacattgatcaatcacgtcaaacattaggccactcgtcaccttgcaactttgaaggagatagcaaagtgatttgctgtctcctggcaaccgttgcctgcaaggcccagtgatggcagatgctagttcaaggactgacacctcaactgttttacaagacaacgacaagaatcagaggatggaaaacggacaaattgtggcagctgtgccttctaattcttctgataggtctgataggtccgacaaacctttggaccaaaagaccttgcgacggctagcccaaaatcgtgaggcagcaagaaaaagtcggctgaggaaaaaggcatatgtgcaacagctagagagcagtaagctgaaacttgcgcaactggagcaggagctccagaaagctcgccagcagggaatcttcatttccagctctggcgaccaaacccatgccatgagtggaaatggagcgttgacttttgacatagaatatactagatggctagaggagcaaaataagcagataaatgagttgaggactgcagtgaatgctcatgcaagtgacagtgatctacgacttattgtagatggcataatggcacattatgatgaaatattcaaggtcaaaggtgttgctgcgaaggctgatgtatttcatatactttcaggcatgtggaagacacctgcagaaaggtgcttcctctggcttgggggttttcgtccatctgagcttttaaagctcctagcgaatcacctcgagcccctaactgagcagcaattgctgggattgaccaacctccagcaatcttcccagcaggcagaggatgcattgtcacagggcatggaagcgctgcagcaatcattggcagagactttggctggatctcttggtccatcaggttcttcaggcaatgtggcaaactacatgggtcagatggccatggccatgggcaaacttgggacacttgagaattttcttcggcaggcggacaatctgcgacagcagacattgcatcaaatgcaacggattctgacaatccgacaggcttcccgtgctcttcttgctatccatgactatttttctcggttgcgtgctttaagttctctgtggcttgctaggccacgtgaataaccaaggattgctgcaatgttgagttccatgagctggtgtggtgaattctatggcgcactcgttcacgacgatgcattacagttacagctcgctggcgacttggtttttgattgtacaattactttgagctgctgcttggtccgaattgtacttaaggtggtgtacaagtaggttaatcctgtaagttatggtgatttgtgggtgtattagcaataatgattagaggaatcaggatcagtgctctgttgtttgtaatggttagaaattgatttattagtcctaaatgtaactcctgggacatggggggcagaatgggaagagagtaataagagtctccccttggttgttatatgttggtattatcgcatctcagaatctccagtttgcttgtggcataatgattatgtttatgtacttgattgctgtttctggaaaaaaaaaaaaaaaaaaaa

SEQ ID NO: 6158 - protein, 334 aa, Panicum virgatum
  misc_feature: Ceres CLONE 1844483
  misc_feature (1)..(45): Pfam Name: bZIP_1 Pfam Description: bZIP transcription factor
  misc_feature: The sequence is a functional homolog of  SEQ ID NO 1494 in the  10/374,780 US patent application
  misc_feature: The sequence is a functional homolog of  SEQ ID NO 1564 in the  10/412,699 US patent application
  misc_feature: The sequence is a functional homolog of  SEQ ID NO 1788 in the  10/412,699 US patent application
  misc_feature: The sequence is a functional homolog of  SEQ ID NO 1792 in the  10/412,699 US patent application
  misc_feature: The sequence is a functional homolog of  SEQ ID NO 1794 in the  10/412,699 US patent application
  misc_feature: The sequence is a functional homolog of  SEQ ID NO 2026 in the  10/374,780 US patent application
  misc_feature: The sequence is a functional homolog of  SEQ ID NO 2030 in the  10/374,780 US patent application
  misc_feature: The sequence is a functional homolog of  SEQ ID NO 2032 in the  10/374,780 US patent application
  misc_feature: The sequence is a functional homolog of  SEQ ID NO 206 in the  10/225,068 US patent application
  misc_feature: The sequence is a functional homolog of  SEQ ID NO 354 in the  10/412,699 US patent application
  misc_feature: The sequence is a functional homolog of  SEQ ID NO 356 in the  10/412,699 US patent application
  misc_feature: The sequence is a functional homolog of  SEQ ID NO 380 in the  10/412,699 US patent application
  misc_feature: The sequence is a functional homolog of  SEQ ID NO 534 in the  10/225,066 US patent application
  misc_feature: The sequence is a functional homolog of  SEQ ID NO 823 in the  11/479,226 US patent application
  misc_feature: The sequence is a functional homolog of  SEQ ID NO 831 in the  11/479,226 US patent application
  misc_feature: The sequence is a functional homolog of  SEQ ID NO 930 in the  11/435,388 US patent application
  misc_feature: The sequence is a functional homolog of  SEQ ID NO 934 in the  11/435,388 US patent application
  misc_feature: The sequence is a functional homolog of  SEQ ID NO 936 in the  11/435,388 US patent application
  misc_feature: Useful for making plants with modulated growth and phenotype characteristics
MADASSRTDTSTVLQDNDKNQRMENGQIVAAVPSNSSDRSDRSDKPLDQKTLRRLAQNREAARKSRLRKKAYVQQLESSKLKLAQLEQELQKARQQGIFISSSGDQTHAMSGNGALTFDIEYTRWLEEQNKQINELRTAVNAHASDSDLRLIVDGIMAHYDEIFKVKGVAAKADVFHILSGMWKTPAERCFLWLGGFRPSELLKLLANHLEPLTEQQLLGLTNLQQSSQQAEDALSQGMEALQQSLAETLAGSLGPSGSSGNVANYMGQMAMAMGKLGTLENFLRQADNLRQQTLHQMQRILTIRQASRALLAIHDYFSRLRALSSLWLARPRE

SEQ ID NO: 6159 - DNA, 1740 bp, Panicum virgatum
  misc_feature: Ceres CLONE 1844526
  misc_feature: Encodes the peptide sequence at SEQ ID NO. 6160
acataagcagaggagcacacactctcccatggagctcaagtcctcttatctccagcctgcttcttcaaccttgccgtcctccacaagacgaaactcgttccatggagaaggagccgctgcagcagccggaggaggaagaggaggcggtggtggcaacgtgtttgggcccacattcagtgacacgctcggcagcctgaacctgaaggagacctccgagctcgtgaggacttccttccccatggcgaccatgaccaggagcagcagcagcagcaccggccacggcaggagcagccaccacgaggcctccaccaccacctcgtcgtcctcctcctccacggcctcagcgcagaggcgacgcgcggagccgccgccgccgccgctgcaggtcgtcccggcgacgccggggcggccgttgcagttcttcgcgagccccgcgcaccaccaccagctcgtcgccccgaggaggtcggtgccgtccaagtgggaggacgccgagaagtggctgcggcagccgtcggactccgaccacctccatggcgccggcaaggtcgcgttctccaggcagcggagcagcgggctgggccggagaggcggcggcgaggaggagaagccggcggcggcggtggcggtgaggaggtcggtggacgcgctctcggacgcccacgcgctcgcgctgtacgcgccgccggcagcagaggtgctcctcaaagacaagttcacggacaacgaggagccgtcgaaggagaccttcgtgttccggagcgcgtattgcgagccggcgccggcgaagggcgcggcggcggccgccagcggcgaccagcggagggacattggcacggagatgacgccgctggggagctcgtgccacacgccgctcaagagcacctccccggcgcggcacaacacgccggcgagccggtcggggccgctggtgccgtacgccggcggcggcgggatggacatctcggagctggcggactgccacctcgcgaagctggacctgggcgcgcggttcgacgccatgctcgtcaactggagctccaaggaggaggaggaagaggaggtgtccaagagcctgcggcacttcgaggccaccgtcggcgccggcggtgcgccgccttgcgatgaacgcggcggccactgccggtgggaggacgatgacagggccaagagctgcatcaggtatcagagggaagaggcaaagatccaggcttgggttaacctggagagcgccaaggctgaagcacaatcaagaaagctggaggtgaagattcagaagatgcgttcgaacctggaggagaagctgatgcggcggatgacgacggtgcaccggcgcgctgaggagtggcgcgcgacggcgcaggcgcagcacctgcagcaactgcggcgcgcggcggcggccggcagcggcggcaccacccggcggctccgggcgacgagccaccaccggcacctgcccgggagcgacgcggccgcatgcggctgcttcccgtgcagcagcaacgtcgtcagcggcaacctcctgaactactactgaaacgagatggtgagggcaagatcatcagggcggtaggttgttgatgtttttgtagagggtgtttgagatgatgggtggcaggctgctgagaatggggagattgttgggaacgtgtctgaatactggtaccagattgctgaatgctgacccacagtggaaacatcaagaggttgtttcttttttaaaaaaaaaaaaaaaaaaaa

SEQ ID NO: 6160 - protein, 502 aa, Panicum virgatum
  misc_feature: Ceres CLONE 1844526
  misc_feature: The sequence is a functional homolog of  SEQ ID NO 1042 in the  10/666,642 US patent application
  misc_feature: Useful for making plants with modulated growth and phenotype characteristics
MELKSSYLQPASSTLPSSTRRNSFHGEGAAAAAGGGRGGGGGNVFGPTFSDTLGSLNLKETSELVRTSFPMATMTRSSSSSTGHGRSSHHEASTTTSSSSSSTASAQRRRAEPPPPPLQVVPATPGRPLQFFASPAHHHQLVAPRRSVPSKWEDAEKWLRQPSDSDHLHGAGKVAFSRQRSSGLGRRGGGEEEKPAAAVAVRRSVDALSDAHALALYAPPAAEVLLKDKFTDNEEPSKETFVFRSAYCEPAPAKGAAAAASGDQRRDIGTEMTPLGSSCHTPLKSTSPARHNTPASRSGPLVPYAGGGGMDISELADCHLAKLDLGARFDAMLVNWSSKEEEEEEVSKSLRHFEATVGAGGAPPCDERGGHCRWEDDDRAKSCIRYQREEAKIQAWVNLESAKAEAQSRKLEVKIQKMRSNLEEKLMRRMTTVHRRAEEWRATAQAQHLQQLRRAAAAGSGGTTRRLRATSHHRHLPGSDAAACGCFPCSSNVVSGNLLNYY

SEQ ID NO: 6161 - DNA, 2465 bp, Panicum virgatum
  misc_feature: Ceres CLONE 1844529
  misc_feature: Encodes the peptide sequence at SEQ ID NO. 6162
gatcacgagttcattcgatcacgagcaccaattccatccatcatccttcacgtgcgccgctgccggccggcgatcgccggcgtgcaccgtaacttgcacccgccgccgcacgtgatcggcccgacaccggtcagagatgcccccacctccgtcatcctgcctcctcggtgcccgcgcacctgacccgacgacgaccatcaccatagaaaaatcacaataatactttatttatttgcggtgtcggacgaggcgcgcgccatgtacaacggcggcgcggcggggctgaccttctggtccccgaacgtcaacatcttccgcgacccgcggtggggccgcggccaggagacccccggcgaggaccccgccgtctcctcccgctacgccgccgcctacgtccgcggcctccagcagcaggaccgccgctccggcggcggcctcaagctcgccgcctgctgcaagcacttcaccgcctacgacctcgaccgctggggcggcaccgaccgcttccacttcagcgccgtcgtggccccgcaggacctcgaggacaccttcaacgcccccttccgcgcctgcgtccgcgacggcggcgccgccgccgtcatgtgctcctacaaccaggtcaacggcgtccccacctgcgccgaccaggccttcctcaagggcaccatccgccgccagtggggcctcgacggctacatcgtctccgactgcgactccgtcggcgtcctcttccgggaccagcgctacacccgcaccgccgaggacgccgccgccgcctcgctccgcgccggcctcgacctcgactgcgggcccttcctcgcgcagtacaccgagcccgccctcgccgccggcaagctctccgacgccgacgtcgacgccgcgctgctcaacaccgtcgccgtgcaggtgcggctcggcatgtttgacggcgaccccgccgcggggccgttcgggcacctcggcccccgcgacgtgtgcgcgccgccgcaccaggagctcgcgctcgaggcggcgcgccagagcgtcgtgctcctcaagaacgacaaggggaagcaccgggccggcgtgctcccgctccgcccggcggcgcacccggtcgtcgccgtcgtggggccgcacgccgaggccacggtcgccatgatcgggaactacgccggcaagccgtgccggtacaccacgccgctgcggggcgtcgcggggtacgtcaagcaggcggtgcaccaggccgggtgcgccgacgtggcgtgcgccggaggccagcagcccatcgccgccgccgtcgacgccgcgcgccgcgccgacgccaccatcgtcgtcgcggggctcgaccagaacgtcgaggccgaggggctggaccggtcgagtcttctcctccctggacggcaagcggagctcatctccgccgtggccaaggcggccaaggggcccgtcgtcctcgtgctcatgtccggcggccccatcgacatcgccttcgcgctcaacgaccccaggatcgccgccatcctgtgggcgggctaccccggcctggccggcgggcaggccatcgccgacgtcatcttcggccaccataacccaggcgggaagctgccgatgacatggtacccgcaggagtacctgcagaaggcgccgatgacgaacatggcgatgcgcgccaaccccaagacggggtaccccggccggacctaccgcttctacacgggcccgacgatcctcccgttcggccacgggctcagctacacccagttcacgcactcgctggcgcacgcgccagcgcagctcaccgtgcagctcgccggcggccacgccgcctccgccgcggcgtcgctccccaacgcgacgcgctccggcggcggcgcccgcgccgtgcgcgtggcgcacgcgcgctgcgagggcctggccgtgccggtgcacgtggacgtgcggaacgtcggcggccgcgacggcgcgcacgcggtgctcgtgtaccacgcggccccgcggggcgccgtggccggcgcgccggcgcggcagctggtggcgttcgagaaggtgcacgtgccggcgggcggcgtggcgcgcgtggagatggccgtcggcgtgtgcgaggggctcagcgtggcggaccgcgacggcgtgcggcggatccccgtcggcgagcacagcctgatgatcggcgagctgacgcactcggtcacgatcggcgtcgagcagctcggggtatagataagaacgagaagcactgaagcgtaggtggtgggttcggagggttctctgaataatgtgtgccgtcgttttgggaggggagggggtattggattgccattgcgattgccggtgcttccgtctctgcaaaggtggagatggatatctgtcaggttagaaaaggcaccggattactgaaaaattgttgaaatgattgcaaacgattaaactggaaggaacacagaatgtggtttcttcatcccgaaaaaaaaaaaaaaaaaaaa

SEQ ID NO: 6162 - protein, 647 aa, Panicum virgatum
  misc_feature: Ceres CLONE 1844529
  misc_feature (1)..(235): Pfam Name: Glyco_hydro_3_C Pfam Description: Glycosyl hydrolase family 3 C terminal domain
  misc_feature (1)..(172): Pfam Name: Glyco_hydro_3 Pfam Description: Glycosyl hydrolase family 3 N terminal domain
MYNGGAAGLTFWSPNVNIFRDPRWGRGQETPGEDPAVSSRYAAAYVRGLQQQDRRSGGGLKLAACCKHFTAYDLDRWGGTDRFHFSAVVAPQDLEDTFNAPFRACVRDGGAAAVMCSYNQVNGVPTCADQAFLKGTIRRQWGLDGYIVSDCDSVGVLFRDQRYTRTAEDAAAASLRAGLDLDCGPFLAQYTEPALAAGKLSDADVDAALLNTVAVQVRLGMFDGDPAAGPFGHLGPRDVCAPPHQELALEAARQSVVLLKNDKGKHRAGVLPLRPAAHPVVAVVGPHAEATVAMIGNYAGKPCRYTTPLRGVAGYVKQAVHQAGCADVACAGGQQPIAAAVDAARRADATIVVAGLDQNVEAEGLDRSSLLLPGRQAELISAVAKAAKGPVVLVLMSGGPIDIAFALNDPRIAAILWAGYPGLAGGQAIADVIFGHHNPGGKLPMTWYPQEYLQKAPMTNMAMRANPKTGYPGRTYRFYTGPTILPFGHGLSYTQFTHSLAHAPAQLTVQLAGGHAASAAASLPNATRSGGGARAVRVAHARCEGLAVPVHVDVRNVGGRDGAHAVLVYHAAPRGAVAGAPARQLVAFEKVHVPAGGVARVEMAVGVCEGLSVADRDGVRRIPVGEHSLMIGELTHSVTIGVEQLGV

SEQ ID NO: 6163 - DNA, 2686 bp, Panicum virgatum
  misc_feature: Ceres CLONE 1844558
  misc_feature: Encodes the peptide sequence at SEQ ID NO. 6164
attgctgtcctgaaatctgcctccatccatccatctcggtcagcttcggctcgtcctccatgggttttagcagcgcgagacggagggctctgccgctatgcctagctctagtggctctgcaagcatgcctcccggcgtgcgcggcggcgcccaagacgtacatcgttcagatggcggcgtctgagatgccgagctcgttcgatttccaccacgaatggtacgcctccaccgtgaaatccgtgagttctgtgcagctgcaaggcgaggaggacgacccgtacgcgaggatcgtctacaactacgagacggcgttccacggcttcgcggcgaggctggacgaggacgaggccgagcggatggccgacgcggacggcgtggtgaccgtgctcccggagacggtcctgcagctgcacaccacccggagccccgacttcctgggcatcagcccggaaatcagcaacagcatctggtccgcggggctcgccgaccacgacgtcgtcgtgggcgtgctcgacaccggcatatggcccgagagacccagcttcagcgacaagggcctcggccccgtgccggccaagtggaagggcctgtgccagacggggcgcggcttcaccgcggccaactgcaaccgcaaggtcatcggcgcgcgcatcttctacaacggctacgaggcctcgtcggggcccatcaacgagaccaccgagctcaagtccccgcgggaccaggacggccacggcacccacaccgcggccaccgctgcgggcgcgcccgtgccggacgccaacctcttcggctacgcccgcggcgtcgcccggggtatggcgccccgcgcccgcgtcgcggtgtacaaagtgtgctgggcgggcggctgcttcagctccgacatcctggcggccgtcgaccgggccgtggcggacggcgtcgacgtgctctccatctcgctcggcggcggctcctccccctaccaccgcgacagcctggccatcgcgtcgttcggcgccatgcagatgggcgtgttcgtcgcctgctcgggcggcaacgccggcccggaccccataagcctcaccaacctgtcgccgtggataaccacggtgggcgcgagcaccatggaccgagacttcccggccacggtgacgctcggcaatggcgccaacatcaccggcgtttcgctctacagaggccggcgaaatctctcttcccaggagcagttcccgttggtgtacatgggcggcaactcgagcatcccggaccccaggtctctgtgcctggatgggactctgcagccgcaagaagtcgctggaaagattgtgatttgcgaccgcggcattagtccccgggtgcagaagggccaggttgtcaagaacgccggcggcatgggcatgattctcgccaacactccggcgaacggcgaggagcttgtcgccgacagccacctgctgcctgcagttgccgttggggagtccgaaggcatcgccgccaagaagtacagcaaaaccgccgcgaaaccaaccgcgacgctcagcttcgacgggaccaagctcgggatccgcccatcgccggtggtcgccgcgttctcctcccggggaccgaacttcctgaccctggagatcctcaagccggatgtcatcgcgcccggcgtgaacatcctggcggcatggagcggcgacgccagcccgtcgagcttgtccaccgaccgccgccgcgtcgggttcaacatcctctcggggacgtccatgtcatgcccgcacgtcgccggcgtggccgcgctgatcaaggccagccacccggactggagcccggccaagatcaagtccgcgctgatgaccacggcgtacgtccacgacaacacgtaccggtcgctgaaggacgcggccaccggcaaggcgtccacgccgttcgatcacggagccgggcacatacacccgctgcgcgctctcaaccctggcctggtctacgacatcggccaggacgactacctggagttcctctgcgtggagaacctgacgccgatgcagctcagggccttcaccaagaactcgagcaagacatgcaagcacaccttcagctcgccgggtgacctgaactacccggccatctccgccgtcttcgccgagcagccgtctgcagctctgacggttcgccgcaccgtgacgaacgtcggccctccatcttcgacataccgtgtcaaggtctctgagttcaaaggcgccgacattgtcgtcgaaccgagcaccctgcacttcacaagctcgaaccagaagctgacctacaaggtgacgatgacaaccaaggctgcgcagaagacaccggagttcggagcgctgtcctggagcgacggcatccacatcgtccgaagccccctcgtcctcacatggctgccaccaatgtgagcttggtttgtttactgtgcatgggcatttagacaagcaatggagcaggaacctccgcggccagggtaatcaagccacatatcggttgtgtagcaggaaaacaggaagtccactaactaaccgatgcaaaacaccgtcaagctccagggaaaacaggctttattcctcaatgttgtattcatgcttattccaaatgttcagttgctgatttgattgtttctacattaatgtgtgtacaacaacatatgcgagcaaatagtatggaaaattcgctggaaaaaaaaaaaaaaaaaaaa

SEQ ID NO: 6164 - protein, 776 aa, Panicum virgatum
  misc_feature: Ceres CLONE 1844558
  misc_feature (14)..(482): Pfam Name: Peptidase_S8 Pfam Description: Subtilase family
MGFSSARRRALPLCLALVALQACLPACAAAPKTYIVQMAASEMPSSFDFHHEWYASTVKSVSSVQLQGEEDDPYARIVYNYETAFHGFAARLDEDEAERMADADGVVTVLPETVLQLHTTRSPDFLGISPEISNSIWSAGLADHDVVVGVLDTGIWPERPSFSDKGLGPVPAKWKGLCQTGRGFTAANCNRKVIGARIFYNGYEASSGPINETTELKSPRDQDGHGTHTAATAAGAPVPDANLFGYARGVARGMAPRARVAVYKVCWAGGCFSSDILAAVDRAVADGVDVLSISLGGGSSPYHRDSLAIASFGAMQMGVFVACSGGNAGPDPISLTNLSPWITTVGASTMDRDFPATVTLGNGANITGVSLYRGRRNLSSQEQFPLVYMGGNSSIPDPRSLCLDGTLQPQEVAGKIVICDRGISPRVQKGQVVKNAGGMGMILANTPANGEELVADSHLLPAVAVGESEGIAAKKYSKTAAKPTATLSFDGTKLGIRPSPVVAAFSSRGPNFLTLEILKPDVIAPGVNILAAWSGDASPSSLSTDRRRVGFNILSGTSMSCPHVAGVAALIKASHPDWSPAKIKSALMTTAYVHDNTYRSLKDAATGKASTPFDHGAGHIHPLRALNPGLVYDIGQDDYLEFLCVENLTPMQLRAFTKNSSKTCKHTFSSPGDLNYPAISAVFAEQPSAALTVRRTVTNVGPPSSTYRVKVSEFKGADIVVEPSTLHFTSSNQKLTYKVTMTTKAAQKTPEFGALSWSDGIHIVRSPLVLTWLPPM

SEQ ID NO: 6165 - DNA, 1642 bp, Panicum virgatum
  misc_feature: Ceres CLONE 1844583
  misc_feature: Encodes the peptide sequence at SEQ ID NO. 6166
tttcgaagctcgcccaactcccttccaccctcgcaaccatcaccgctgcccaccgttcccgccgccgccgcctctatatctcctcccttccccctcgcatgccccgctcgccgccgctacttccccctcttcctctccctcctccttccgcccccaagtgaatcgcggctgcctccaccgcagccgcatctctccctcgcgccgccgccgccgccgcgagatctccggctgcccgcgccatggtcgccgcctccggcctcgcgctgccgcgggcggccgcaccctgcccggcgcgcacgcgcgctggcctccgccccgccttcctccgattcgtgccgccggtggcgctgccaccgcagcagctccggtgctgcgcgtccacagtcgacgatggcgtggtgtccgcagaggcctccaagccccgcctccccagagtggttggtatgggctcaaagctcgttggatgcggatcggcgatcccagcacttagcatttcaaatgataacctttcaaaaatagttgaaacgtcagatgaatggattgcgactcgaactgggattcggaataggcgagttctttcaggagacgaaacattgcgggggctctcaatacaagcagcgcaaagggcacttgagatggctcaagtaaaagctgaagatgttgatcttcttgtcctttgtacatctactccagatgatctgtttggaggtgctgcccaggtgctgacggaagtggggtgcacaaatgcatttgggtttgatattacagctgcctgcagtggattcattgttggcttaatcaccgctacacgttttatcaaaggtgggggtattcggaatgtccttgtagttggtgcggatgctctttcaaaatttgtagattggacagacagaggtacatgcatccttttcggagatgctgccggtgctgtgttggttcaggcttgcaatgctgatgaagatggcttgctaggtttttgtgttcagagtgatggcaatggacaaaagcacctaaatgctgcatcgtcaaatgatgagtcgatcttgtccaataccaatggtgttcctggatttccaccaaagaaggcaacctactcatgcattcaaatgaatggaaaggaagttttccgctttgctgtacgatgtgtgccgcagtccattgagaaggctcttgaagaagctggtttgcctgcctccagtattgattggttgttgttacatcaagctaatcagcggattattgatgctgctgccagtcgtttagatatcccatctgacaaggttatttcaaatcttgctaattacggcaacactagtgcggcatccattccattggcattggatgaggctgttcggggcggcaaggtgaagaccggtgatattattgcggcatcaggttttggagctggacttacctggggttccgccattgtcaaatggggctaattattctatgtgaagtcgtgaaccatggcaaaagatgaaagagattgcctcaaaggctctgcattggcctcggggcccctatgtttagtggttcatttacccatttctctgtgcaacatttttctttggcatctgtcagtctttcttgcacatgaaaaattagtggcatttttccttaaaaaaaaaaaaaaaaaaaa

SEQ ID NO: 6166 - protein, 401 aa, Panicum virgatum
  misc_feature: Ceres CLONE 1844583
  misc_feature (40)..(400): SWISSPROT Homolog: EC 2.3.1.41 3-oxoacyl-[acyl-carrier-protein] synthase III, chloroplast precursor
MVAASGLALPRAAAPCPARTRAGLRPAFLRFVPPVALPPQQLRCCASTVDDGVVSAEASKPRLPRVVGMGSKLVGCGSAIPALSISNDNLSKIVETSDEWIATRTGIRNRRVLSGDETLRGLSIQAAQRALEMAQVKAEDVDLLVLCTSTPDDLFGGAAQVLTEVGCTNAFGFDITAACSGFIVGLITATRFIKGGGIRNVLVVGADALSKFVDWTDRGTCILFGDAAGAVLVQACNADEDGLLGFCVQSDGNGQKHLNAASSNDESILSNTNGVPGFPPKKATYSCIQMNGKEVFRFAVRCVPQSIEKALEEAGLPASSIDWLLLHQANQRIIDAAASRLDIPSDKVISNLANYGNTSAASIPLALDEAVRGGKVKTGDIIAASGFGAGLTWGSAIVKWG

SEQ ID NO: 6167 - DNA, 2379 bp, Panicum virgatum
  misc_feature: Ceres CLONE 1844628
  misc_feature: Encodes the peptide sequence at SEQ ID NO. 6168
gatcgctccttcacttgtttcagattttagccgccgccctgtgtgggaaaaaaaaatccttattgttcctggcctgaggcagtgccggcgagatccggtcctggaatcgggaaggcgccaaggctgggaagagttggagtgagatttacggcgacctgtgagccgcggttccggaagggcacgccggggaggttcttgccgacgcggatctgcctgaagccagccaaggggggtcgccgaattggggtgttcggccgtgcgaggccaaaaggctcccgccttggctgccaaaccgcgtgacgcgaccaccaccacatggtcgtggtggtccggcacaagtaggggggctctcgcttctcgtgcctggccgttgtgggactcgtgggcagccatggagccgtcgtcgtccatcacgttcgcgtcctcgtcgtcgtacctgtccaacgggtccagcccctgctccgtcgcgctcccgccgccggccgccccaggctcccccgttgaccgccggcgaggggtggggcggtgggggcgctgcgggagggagcggcagcagcgtggaggcggtcagcctgaaccggctcagcaaaaacctcgagcagctgctcctcgaccgggacctcgactgcagcgatgccgacgtcgaggtgcccgacggtgggccgcccgtcgccgtccaccgctgcatactcgccgcgcgcagcgccttcttctatgacctcttcgccgcgcgcggccgcggaggcgcagcgcgcggtgatgtcgccgccgccgccgccgccgccggaggggcgggggagggggctgccagtggcaggccgcggtacaagatggaggagctcgtgcccggcggccgcgtggggcgcgaggccttccaggcgttcctgggctatctgtacaccggcaagctccggccggcaccgctcgatgtggtgtcttgtgctgaccccgtgtgccctcacgactcgtgcccgccagccatcaggttcgccgttgagatcatgtacgcagcgtggaccttcaagatccccgagctcatttcgctctaccagcggcggcttcttaactttgtagacaagactctagtggaagatgtcattcctattctgcaagttgcttcccactcagagctgactcaagtgcttgacaaatgtattcagaggattgctagatcagatcttgacgatatatctttggataaggagctcccttcagaagttgtcgagaagataaaaaagattcgtaaaaattcacaaactgctgacgatgacgcctccatttcggaccctgtgcatgagaaaagagtcagaaggatccacagagcactcgactctgatgatgttgagcttgtgaagttgcttcttagtgagtctgagatcacattagatgatgccaatgcattgcactatgcagcttcttactgtgattctaaagttgtctcggagttgttagacttggggctggctaacttgaatttgaagaatagccgtggatacacagcactccacttggctgctatgaggagagaaccagctatcattatgtgcctccttaacaaaggggcaactgtatcgcaactgacagctgatggccgaagcgcaattggtatttgtcggaggttaacaagagcaaaagactacaatacaaagatggagcagggtcaagagtcaaacaaagataggttgtgtatagatattctagagcgggagatgatgcgaaatcctatgtcggtagaagatgctgtcacctcacctttgttagccgatgatcttcacatgaagcttctctacctggaaaacagagttgcatttgctagactgttctttcccgctgaagcgaaggtcgccatgcaaatcgcgcaagcagacaccacagaagaatttggtggtattactgtaccaggtacttctggaaaactgagggaagtcgacctgaacgaaacaccagccatacaaagcaaaagactccgttcaagggtggatgcactgatgaaaacagtggagctgggccggcggtacttcccgaactgctcgcaagtgctggacaagttcctggaggacgacctgcctgacggggggcttgacaagttctacctccagaggggcacccccgacgagcagaaggtgaagaggatgcgcttcagcgagctgaaggaggacgtgcaaaaggcgttcagcaaggacaaggccgacaacagcatgatctccggcctgtcgtcgttgtcgtgctcgccgccccagaaggtcgccaagaagtgaccagtttttgccgcgtatagttctgtaattcactgtattggaccgggacagcgtatagggatggatcgcttagacctgtgaatgcatagcgctttcctcgcaaaaaaaaaaaaaaaaaaaa

SEQ ID NO: 6168 - protein, 475 aa, Panicum virgatum
  misc_feature: Ceres CLONE 1844628
  misc_feature: The sequence is a functional homolog of  SEQ ID NO 146 in the  10/666,642 US patent application
  misc_feature: The sequence is a functional homolog of  SEQ ID NO 1466 in the  10/374,780 US patent application
  misc_feature: The sequence is a functional homolog of  SEQ ID NO 2062 in the  10/374,780 US patent application
  misc_feature: The sequence is a functional homolog of  SEQ ID NO 597 in the  10/374,780 US patent application
  misc_feature: The sequence is a functional homolog of  SEQ ID NO 872 in the  10/666,642 US patent application
  misc_feature: Useful for making plants with modulated growth and phenotype characteristics
MEELVPGGRVGREAFQAFLGYLYTGKLRPAPLDVVSCADPVCPHDSCPPAIRFAVEIMYAAWTFKIPELISLYQRRLLNFVDKTLVEDVIPILQVASHSELTQVLDKCIQRIARSDLDDISLDKELPSEVVEKIKKIRKNSQTADDDASISDPVHEKRVRRIHRALDSDDVELVKLLLSESEITLDDANALHYAASYCDSKVVSELLDLGLANLNLKNSRGYTALHLAAMRREPAIIMCLLNKGATVSQLTADGRSAIGICRRLTRAKDYNTKMEQGQESNKDRLCIDILEREMMRNPMSVEDAVTSPLLADDLHMKLLYLENRVAFARLFFPAEAKVAMQIAQADTTEEFGGITVPGTSGKLREVDLNETPAIQSKRLRSRVDALMKTVELGRRYFPNCSQVLDKFLEDDLPDGGLDKFYLQRGTPDEQKVKRMRFSELKEDVQKAFSKDKADNSMISGLSSLSCSPPQKVAKK

SEQ ID NO: 6169 - DNA, 2948 bp, Panicum virgatum
  misc_feature: Ceres CLONE 1844635
  misc_feature: Encodes the peptide sequence at SEQ ID NO. 6170
gacatccggtcttccttttggctaagcaacacacatagccatgatgcttacggccacataccctctaggggcagtgctctccccgagccatggcccttcttccttcccgagcagcacagcctcgccaggccagtgggcgcctcgccgggccgtctcatcatccaaggtaagctgcacccgcgtcagcttgtccgaggtcgtcaatggctcagccgtaggcacggtcgaccaagaacagtccggcttccttctcacgcgccacgagaaggccgagcacatcacgctgaatgccacagtgacggttcgcttggacgagggatggtccactcccaagaacgtggcggacatggctcatcgacggtggctgttccttgagttcatcagctcggagttggatccagagggcaaggagatgagcacagcctcccgccacgccagctactcgcgcacggacggcgccggttccttcatattcgaggtcagcgttccgtcctcgtttggcgccatcggcgccgtggtggtcgagaaccgctacagcagcgaggtgtacatctcggacatcaaggtcctcccccacggcggcggcgagtcgagcgccgccgtcaccttcagctgtagctcctgggtcacctaccacgccggctacaatcagcggatcttcttccctctcaacaagtccttcctcccgtcgcagacgcctaggggcgtgcagaggctgcgcgacatggacctcaaggccaaacgcggggacggccacggcgagcgcatgccgtggcagcgcatctacgactacgccgtgtacaacgacctcggtgaccccgacaaaggccccaacctccggcggccggtgctcggcggcaaggagtacccctacccgcggcgctgccgcacgggccgcccccgctgccgggcggacccgtcgtcggaggcgcgggccgagggcgacatctacgtgccccgggacgaggcgttcacggagcgcaaggcgggggcgttcctgaccaagacggtgacgtcgacgctgtccgcgttcaccacggcccaggaggtggccggcgacagacggcggagcttcccgtccttggcggccatcgacgcgctgtacgaggacggctacaagaaccagccggggcagcaaccggacgacctcaacgcctacttcgcggacctgctcaagaagcaggcggagctcctgctcaggggcgaggaggaggcggtcaaggaggacatacgcagagtgttcaagttccaaacgccggagattcaccagaaggacaagcttgcctggttcagagacgaggagttcgcgcgagaaaccttggcagggatgaatccgctgagcatccaactactcacggagctccctattgccagcaggctcgacgagaaaacctacggcccacgggactccctcatcaccaaagagctgatcgaaaagcagataaacggtgtcatgacagctgaggaggccgttctgaacaagaagctgttcatcctggactaccacgacatgctgctgccttacgtgcacgaggtgcgcgagctcgatgacacgacgctctacgcctcgcgcacggtcttcttcctgcaagaggagggcacgctgaggccgatcgccatcgagctgaccaggcccaggtcccccaacatgccgcagtggcggcaggtcttcacgccggggtccagcgtcacggactcgtggctgtggcagctcgccaagacccaggtcctagcccaggacaccggctaccaccagctcgttagccactggctgaggacgcactgctccgtggagccgtacgtgatcgcggcgaaccggcagctgagccagatgcaccccgtgtaccggctgctgcacccgcacttccgcttcaccatggagatcaacgcccaggcgcgcaaggcgctcatcaacgcgggtgggatcatcgagagcagcttctcgccggggaagtacagcatgctgctcagctctggggtttacgacaccttctggcggttcgacaaggaggctctgccggccgatctgatccgaaggggcatggcgttccaaggggaggatggcaagctggagctgaccataaaagactacccgtacgccaacgacggcctgctgatctgggattccatcgagcgctgggtgtcagactacgtggagaattactacccgtcggcggcggacatcgccggcgacgaggagctccaggggttctggacggaggtgcgcacgaggggccacgcagacaagcaggacgagccatggtggcccaggctggacggccacgagagcctggtccaggtcctgagcaccatcatctgggtcgcgtctggccaccacgccgcggtgaacttcccccagtacccctacgccggctacctcccgaaccgcccgaccatcgcgcggaggaacatgccgacggagcagggctgcgaggacacgcgctccttcctacgggacccggagaaggtgctgctggacacgttgccgtcgcagtaccagagcaccctcgtcctgcccgtgctcaacctcctgtcgtcgcactcggccggcgaggagtacctgggcgtgtactcagagccggcgtggatggcggatgcggaggtgagggcggccttcctcaggttcaacgggaggatgatggagatcgcggcgacgatcgacgctcggaacaaggacccgaggctgaagaaccggcagggccccggcgtggtgccgtatgtgcagctcaagcccaactacggtgacgtcaaggacatgacgtcggtgatggagatgggcatcccgaccagcatctccatttgagctcatccgatgagcagtaatgtgtctagttggccgtttatactactagtagggtgcacgtgcggcacgcacgtgttcgaagaccaatgctgaaaaaaaatgatcaacttaaattttagttgaataaaaaaaaaaaaaaaaaaaa

SEQ ID NO: 6170 - protein, 920 aa, Panicum virgatum
  misc_feature: Ceres CLONE 1844635
  misc_feature (1)..(671): Pfam Name: Lipoxygenase Pfam Description: Lipoxygenase
  misc_feature (2)..(920): SWISSPROT Homolog: EC 1.13.11.12 Lipoxygenase 2.1, chloroplast precursor
MMLTATYPLGAVLSPSHGPSSFPSSTASPGQWAPRRAVSSSKVSCTRVSLSEVVNGSAVGTVDQEQSGFLLTRHEKAEHITLNATVTVRLDEGWSTPKNVADMAHRRWLFLEFISSELDPEGKEMSTASRHASYSRTDGAGSFIFEVSVPSSFGAIGAVVVENRYSSEVYISDIKVLPHGGGESSAAVTFSCSSWVTYHAGYNQRIFFPLNKSFLPSQTPRGVQRLRDMDLKAKRGDGHGERMPWQRIYDYAVYNDLGDPDKGPNLRRPVLGGKEYPYPRRCRTGRPRCRADPSSEARAEGDIYVPRDEAFTERKAGAFLTKTVTSTLSAFTTAQEVAGDRRRSFPSLAAIDALYEDGYKNQPGQQPDDLNAYFADLLKKQAELLLRGEEEAVKEDIRRVFKFQTPEIHQKDKLAWFRDEEFARETLAGMNPLSIQLLTELPIASRLDEKTYGPRDSLITKELIEKQINGVMTAEEAVLNKKLFILDYHDMLLPYVHEVRELDDTTLYASRTVFFLQEEGTLRPIAIELTRPRSPNMPQWRQVFTPGSSVTDSWLWQLAKTQVLAQDTGYHQLVSHWLRTHCSVEPYVIAANRQLSQMHPVYRLLHPHFRFTMEINAQARKALINAGGIIESSFSPGKYSMLLSSGVYDTFWRFDKEALPADLIRRGMAFQGEDGKLELTIKDYPYANDGLLIWDSIERWVSDYVENYYPSAADIAGDEELQGFWTEVRTRGHADKQDEPWWPRLDGHESLVQVLSTIIWVASGHHAAVNFPQYPYAGYLPNRPTIARRNMPTEQGCEDTRSFLRDPEKVLLDTLPSQYQSTLVLPVLNLLSSHSAGEEYLGVYSEPAWMADAEVRAAFLRFNGRMMEIAATIDARNKDPRLKNRQGPGVVPYVQLKPNYGDVKDMTSVMEMGIPTSISI

SEQ ID NO: 6171 - DNA, 1849 bp, Panicum virgatum
  misc_feature: Ceres CLONE 1844641
  misc_feature: Encodes the peptide sequence at SEQ ID NO. 6172
gggggtaggtgcaagcgacggcttcctgttttcaggtgcggcacccggcccgggtgctgcgctgcttatatgcaaccacccgctgctgctcctcgttccaagcccacacccgccacgcccgtgcctgcgcgacccgacggccagccagaccggccatggacatggcgctgcccgtcccgctgctgctcggctccatggccgtggccgtcgccgcctgcctcctcctcctcctccgcggccgtggcgggaagcagcgcccgctgccgccggggccgcgggggtggccggtgctgggcaacctgccgcagctcggcgccaagccccaccacaccatgcgcgacctggcgcgggagcacggcccgctcttccgcctccgcttcggcagcgccgaggtcgtggtggccgcgtcggcgcccgtggccgcgcgcttcctccgcgcccacgacgccaacttcagcagccgcccgcccaactcgggcgccgagcacgtcgcctacaactaccaggacctcgtcttcgcgccctacggcgcgcgctggcgcgcgctgcgcaagctctgcgcgctccacctcttctccgcccgggcgctcgacgacctgcgcgccgtcagggagggcgaggtcgcgctcatggtcggggacctcgcgcgccgccgcgggggtggtggtcagggggtggcgctggggcaggtggccaacgtctgcgccaccaacacgctcgcccgggccacggtggggcgccgcgtcttcgcggccgacggcggggagggccccagcagggagttcaaggacatggtggtcgagctcatgcagctcgccggcgtcttcaacgtcggggacttcgtgcccgcgctggcctggctcgacccgcagggcgtcgtcgccaggatgaagcgcctgcaccgccgctacgacgacatgatggaccggatcatcagggagaggcaggccgccgaggaaggcaaggacctgctcagcgtgctcctggccaggatgcgggaccggcagccgctcgctgacggcgaggacggcacgatcaacgagaccgacatcaaagcgcttctcctcaacctgttcacggctgggacggacacgacgtccagcacggtggagtgggcgctggccgagctcatccggcacccggacgtcctcgccaaggcgcagcaggagctcgacgccgtcgtcggccgcggccgcctcgtctccgaggccgacctcccgcgcctcacctacctggcggccgtcgtcaaggagaccttcaggctgcacccgtccacgccgctgtcgctgccgcgcgtcgccgccgaggagtgcaaggtggacggctaccgcatcccgcggggcgccacgctgctcgtgaacgtctgggcgatcgcccgcgacccggacgcgtggcccgagccgctcgagttcaggccggaccggttcctccccggcggctcgcacgacggcgtcgacgtcaaagggagcgacttcgagctcatcccgttcggcgccggccggaggatctgcgcgggcctcagctggggcctgcgcatggtgacgctcatgacggccgcgctggtgcacgcgctggactggcacctcgccgacggcatgaccgccgacaagctggacatggaggaggcctacgggctcaccctgcagcgcgccgtgccgttgatggtccggccggagcccaggctgctgccgtctgcctatgcagtagagtaaaaacggaagcgtatgtatgaaatcgggcttttgtacggcgaggtcatcaagtataaacgacgatgtagtatactcttgtggtgcaataaataatattcatttagatgttagtttttcaaaaaaaaaaaaaaaaaaaa

SEQ ID NO: 6172 - protein, 518 aa, Panicum virgatum
  misc_feature: Ceres CLONE 1844641
  misc_feature (14)..(517): SWISSPROT Homolog: EC 1.14.13.21 Flavonoid 3'-monooxygenase
  misc_feature (35)..(515): SWISSPROT Homolog: EC 1.14.13.21 Flavonoid 3'-monooxygenase
MDMALPVPLLLGSMAVAVAACLLLLLRGRGGKQRPLPPGPRGWPVLGNLPQLGAKPHHTMRDLAREHGPLFRLRFGSAEVVVAASAPVAARFLRAHDANFSSRPPNSGAEHVAYNYQDLVFAPYGARWRALRKLCALHLFSARALDDLRAVREGEVALMVGDLARRRGGGGQGVALGQVANVCATNTLARATVGRRVFAADGGEGPSREFKDMVVELMQLAGVFNVGDFVPALAWLDPQGVVARMKRLHRRYDDMMDRIIRERQAAEEGKDLLSVLLARMRDRQPLADGEDGTINETDIKALLLNLFTAGTDTTSSTVEWALAELIRHPDVLAKAQQELDAVVGRGRLVSEADLPRLTYLAAVVKETFRLHPSTPLSLPRVAAEECKVDGYRIPRGATLLVNVWAIARDPDAWPEPLEFRPDRFLPGGSHDGVDVKGSDFELIPFGAGRRICAGLSWGLRMVTLMTAALVHALDWHLADGMTADKLDMEEAYGLTLQRAVPLMVRPEPRLLPSAYAVE

SEQ ID NO: 6173 - DNA, 2240 bp, Panicum virgatum
  misc_feature: Ceres CLONE 1844736
  misc_feature: Encodes the peptide sequence at SEQ ID NO. 6174
gaatatttgcggcgagcacgccgggattccgccagaggattaaccatccgtccatcagcagcagcggcagaggcatggcggtcatcgtggcggcgcgggcgtccgcgcccggcggggcggccgtgagcaccatcgcggcgtttcacagccacgcatccccgtcccgcgcgctcccgcgcgccgtgtccgccgctgcctcctcctcctcctcctcctccgcctccatcggcgccaccaggcgctaccaccacggctctgcgtgctgcttcgccgccaagcccaccacgcccgtggcggccgagctcgtggacgaggactggtccgagccggcgacggccagcgccgcctccacgcaggaggccgcgaagccgcgcaagaaacgccggtcccggaaggctaagaagtcggccaccgccaagctcgaagagaaggacgaggggacgggcaagcctgcggcgccggcagaagacgaggctaagaagaggaagaaggagggcggcgccgaggagaatgcccgggcgttggtggctggcctcgacgacgtgatcgtcaaccccgtggggctgggccggcggtcgcggcaggtgttcgacgaggtgtggcgcaaattctcgcggctcgggcagatttccagcgcctcgtccacggcgctggcggaggaggagcaggccgtgctcatccgcggcgggcccatgtgcgagttcaccgtgccgggggcgcaggacaccaccgtcctcgtcgtcggcgccaccagccgcatcggacgcatcgtcgtgcgcaagctcatgctccgaggctacaatgtcaaggctttagtaagaagaaacaatcccgaagtgatagatatgctcccaaggtctgtggacattgttgttggtgatgttggtgatcctgcaactgtcaaagcagctgtatcaggctgcagcaagataatatattgtgcaactgcacgctcaactattacaggagacctaaatagggttgataaccaaggggtaaggaatgctagcaaggctttccaggactactacaacgaattggcccagctcagggctggtaaaagcagcaagagcaaactacggatagcaaaattcaagtcagcaaagtccttgaatggttgggaggtgcgccagggatcttacttccctaatacctttgcttctcgatttgatgaaggtatcgatgcagcatttgaattttcagaagaccggatggccattttctcaggatttgttttcacgagaggtggatacgttgagatatcaaaaaggctctctcttcctctaggttccaccctagacaggtacgatggtttaattttttcagtgggaggaaatggaagatcatatgttgttattcttgaaactggtccactggcagacacgtcccagagcaagaagtattttgctcggatgactacaaaaataggcttttgcagggtaagagtgccattttcatcttttcggccagtaaacccacaagatcctcccctggacccttttcttgtgcatacactgaccattaggtttgagccaaaaaggcagagacctggtgatggatctcaaaattctagtgacccccgaaactttgagctaaaattggaatacatcaaagctttacctactggacaagaaacagacttcatattggtgtcatgtgcaggttcaggaattgaacctaacagaagagaacaagttctgaaagccaagaaggctggagaagatgcattgaggaggtcaggccttggatatacaattgtgcgcccgggcccgctgcaggaagaacctggtggtcagcgtgccctgatctttgatcaagggaacagaatctctcagggtattagctgtgctgatgtagcagatatttgtgtcaaagcattgcatgattccactgcaagaaacaaaagttttgatgtatgttacgagtacgttgctgaccaagggaacgagctatatgaacttgtggctcatctaccagacaaggctaacaactatcttacacctgcattatctgttctagagaagaacacctgattgatgtgcctggagactcagatatgtgggtcatgtaatgtgtatattttctcctcttgtaaagccatacattttgcttttgtatacatgccttgtgcaattcacatggtaggccgtttcggcactttttgtaaagatcgtcacacagattgacttcaggaaaccaatacgatgacttcttgtaattaaaaaaaaaaaaaaaaaaaa

SEQ ID NO: 6174 - protein, 652 aa, Panicum virgatum
  misc_feature: Ceres CLONE 1844736
  misc_feature (1)..(91): Pfam Name: Epimerase Pfam Description: NAD dependent epimerase/dehydratase family
MAVIVAARASAPGGAAVSTIAAFHSHASPSRALPRAVSAAASSSSSSSASIGATRRYHHGSACCFAAKPTTPVAAELVDEDWSEPATASAASTQEAAKPRKKRRSRKAKKSATAKLEEKDEGTGKPAAPAEDEAKKRKKEGGAEENARALVAGLDDVIVNPVGLGRRSRQVFDEVWRKFSRLGQISSASSTALAEEEQAVLIRGGPMCEFTVPGAQDTTVLVVGATSRIGRIVVRKLMLRGYNVKALVRRNNPEVIDMLPRSVDIVVGDVGDPATVKAAVSGCSKIIYCATARSTITGDLNRVDNQGVRNASKAFQDYYNELAQLRAGKSSKSKLRIAKFKSAKSLNGWEVRQGSYFPNTFASRFDEGIDAAFEFSEDRMAIFSGFVFTRGGYVEISKRLSLPLGSTLDRYDGLIFSVGGNGRSYVVILETGPLADTSQSKKYFARMTTKIGFCRVRVPFSSFRPVNPQDPPLDPFLVHTLTIRFEPKRQRPGDGSQNSSDPRNFELKLEYIKALPTGQETDFILVSCAGSGIEPNRREQVLKAKKAGEDALRRSGLGYTIVRPGPLQEEPGGQRALIFDQGNRISQGISCADVADICVKALHDSTARNKSFDVCYEYVADQGNELYELVAHLPDKANNYLTPALSVLEKNT

SEQ ID NO: 6175 - DNA, 1795 bp, Panicum virgatum
  misc_feature: Ceres CLONE 1844777
  misc_feature: Encodes the peptide sequence at SEQ ID NO. 6176
ccgctctctaaaccgagtcctgagcccgatctcctgctcctcatcccctgcaactaacgcacgcgcccgtcccgatggcccaggccatggccgccgcctccgagctggtcacccccctgaagcgcccgttcgggagcgacgggctcggcgacggcaacatcatcagcaacagcggcggcagcaacggcggcgtcgcgccgggcgccgacgacgagaagcccaaggcgcggcgccgcgaggcggacccggcggcggcgctggcagcggcgcggcacgagttcagcgagcacggcggcgtcaacatgtccatcgaggcgtccgcgacgttcacggtgatggagccggacacgatgcggcggctgtttgcgggggagctgggccccgaccgcggcgacatgtacatctacagccggcacttcaacccgacggtgctggcgctggggcggcagatggcggcgctggagggcaccgaggccgcctactgcacggcgtcgggcatgtccaccatctccgccgtgctgatgcagctggtgggcgctggcgggcacgtggtggcgtcgcggtgcctgtacggcggcacccacgcgctgctgtcccggttcctgccgcgggcgtccggggtgcgcgccacgttcgtggacgccgacgacgaggccgccgtgcgcgccgcggtggtgccgggggagacccgggtggtgtacgtggagaccatgtccaacccgacgctggccgtagcggacatcccgatgctggcgcgggtggcgcacgaggcgggggccaagctggtggtggacaacaccttcacccccgccgtggtctcccccgcgcgcctcggcgccgacgtcgtcgtccacagcgtctccaagttcatcagcggcggcgccgacatcatcgccggcgcgatctgcggaccggcgagcctggtgaacgcgatgatggacctgcaggagggggcgctgatgctgctgggcccgacgatgaacgccaaggtggccttcgagctgtcggagcggctgccgcacctgccgctgcggatgcaggagcactcgcggcgcgcgctggcgttcgcgtcccggatgcagcgcctgggcctgcgcgtgctctacccggggctccccgaccacccgcaccacgcgcgcctcgccgccgccgccaaccccgggtacggctccggcggcatgctctgcgtcgacatgggcaccgaggaccgcgccaaccgcctcatgcaccacctccagaacaccacccagttcggcctcatggccgtcagcctcggctactacgagacgctcatgtcctgctcggggagcagcaccagcagcgagatgccgcccgaggaccgcgcccgcgccggcatctcgccgggcctcgtccgcatgtccgtcggctacaacggcacgctcgagcagcgctgggcgcagttcgagcgcgcgctcgcgctcatgcagccgccgccgctgcaccacaaggccgccgccggccgcgacgtccccgacgccggcaccaccaaccaccgcaagcactgaccggcgtccgagtccaaatgtgtgcttccctggcagggggtgatatatatgttgtgcctgtttctggtgtatagtgcactattattactattaccatttgagtaagcaaggttaaggttaaacaccgtctgacccctccggttcagatggatagtgtaagccgcttcgtctctgggggatcctggaaacggacctgaataagtgtaatcagctagtgtgctgcttaatctgaacttcttgcaggaagataaaaaaaaaaaaaaaaaaaa

SEQ ID NO: 6176 - protein, 483 aa, Panicum virgatum
  misc_feature: Ceres CLONE 1844777
  misc_feature (1)..(388): Pfam Name: Cys_Met_Meta_PP Pfam Description: Cys/Met metabolism PLP-dependent enzyme
MAQAMAAASELVTPLKRPFGSDGLGDGNIISNSGGSNGGVAPGADDEKPKARRREADPAAALAAARHEFSEHGGVNMSIEASATFTVMEPDTMRRLFAGELGPDRGDMYIYSRHFNPTVLALGRQMAALEGTEAAYCTASGMSTISAVLMQLVGAGGHVVASRCLYGGTHALLSRFLPRASGVRATFVDADDEAAVRAAVVPGETRVVYVETMSNPTLAVADIPMLARVAHEAGAKLVVDNTFTPAVVSPARLGADVVVHSVSKFISGGADIIAGAICGPASLVNAMMDLQEGALMLLGPTMNAKVAFELSERLPHLPLRMQEHSRRALAFASRMQRLGLRVLYPGLPDHPHHARLAAAANPGYGSGGMLCVDMGTEDRANRLMHHLQNTTQFGLMAVSLGYYETLMSCSGSSTSSEMPPEDRARAGISPGLVRMSVGYNGTLEQRWAQFERALALMQPPPLHHKAAAGRDVPDAGTTNHRKH

SEQ ID NO: 6177 - DNA, 2003 bp, Panicum virgatum
  misc_feature: Ceres CLONE 1844786
  misc_feature: Encodes the peptide sequence at SEQ ID NO. 6178
aaaaccacacttataagccacagacaagccgcaacagcacgacgccggcctcctttcacccgccgcgccagcaggaggagagagggctcccgggtgggagaagcacgcgttgatggctactgccgtcgtcccgccgccgccgccgcccccggcgctgccggagcggagagtgccggcggtgccgcggctggcggacgacggtggcggcggcggaaggggggacgcgcgggggagtagcgcgggagggggcgggagcggtggcgtggcgggcatctcgccgagcatcctcatcatcgcggtcatcgtggtggtgatgctgctggcgtcgctgtgcatccactacttcatccgccacctgtgccgccacgtggggcctgcggggtcctcctccgcctcgtcccgccaggcgccgccgctcccgctcgtggtgcgccccgcggcgggggcgtccgtggcgcccgccgacggccacggagggggcggagggaaggcggcggcggcggaggcggaggcggcggagcggctcatcgcgcgcctgccgctgttcacgctgtcctcgtcgctggcgtccgtgcccaagtcgtcgcgagactgcgccgtgtgccagagcgcgttccgcgacgacgacgagctccgcctcctgcccgcctgccggcacgccttccactcccggtgcgtggacccgtggctgcgcggcaacccgtcctgcccgctgtgccgcgcctccatcgcgctaccccacccgccgctcaccgacctcctccgagtggagctcggaagcgtgagcagccgccgctccaaccccgacgccgctgccgccgccgtccgcgcgtacccgctccccagcggcctccccaactcggcgtcgtcggagtacctcgtcgaggaggagctccaggtcgtgctcaagccgagcccgcgcgccgccgccgggtccagcgacccgccgacccagcagcatcctcagcagcagcagctcgccgcggtggagcgcgggcagccatcgtcgtcgaccgtgggcctgaccccgacggcgtcgttcaggtcgacggcggagcggtggagcagcaggtggagcaaccgttggagcagccggtggagcagcgggcgctggagcagccggtacgacgccgggaccgtgacggcggcggccacggcggagtggtggtgggacatggacggcggcgccgccccggcggcgcggcggcgggaggcggaggacggcaacggcagcgcgtcgttctacgggttcgtgcggtggctcacgggcgcatactagcggacacgctcgtacgctgtaagcattcagtccacgcgacgcggttgaagctagcttcgccgcccatgcggtggcggccgcggccggcaccgcatgggcggcgctgttcccgaaagggccctcctcctcgtcttcgtgaaacgaatcgaaatgtgactcggggtgcctggctcttcttttcggcatgcgagcgggggtttttattttatttttgtttcttttttttggggcgagtgggtggatttcgaggacggagatgccgtttgcgggtttcaaaactgcttccgaattggagaatgtcggcgggaagaatgaggaggaatgaatttggggactttgcaggagcccagcacagcacattcactctcgacccatcgaaggaaaatttaaaactttccagcttggagaattccaggacttttgccgcattttgattagattctgtggatgtacgtatgtagtgtggattggcctttgacctttttatataggttttttttatatctcaaaattcatcggattatatttagttcttctaatcttcggttgaaaattactacaataaatttcgtccaaatttttacagtgaatttcgtccaaattagcaaggtggtggatttagcgaagtggggcagtcctctcatctcatgagatggggaggctttgttatgtgcacatctgcaaagttgaagcaaaattttggcaaaaaaaaaaaaaaaaaaaa

SEQ ID NO: 6178 - protein, 388 aa, Panicum virgatum
  misc_feature: Ceres CLONE 1844786
  misc_feature (1)..(42): Pfam Name: zf-C3HC4 Pfam Description: Zinc finger, C3HC4 type (RING finger)
MATAVVPPPPPPPALPERRVPAVPRLADDGGGGGRGDARGSSAGGGGSGGVAGISPSILIIAVIVVVMLLASLCIHYFIRHLCRHVGPAGSSSASSRQAPPLPLVVRPAAGASVAPADGHGGGGGKAAAAEAEAAERLIARLPLFTLSSSLASVPKSSRDCAVCQSAFRDDDELRLLPACRHAFHSRCVDPWLRGNPSCPLCRASIALPHPPLTDLLRVELGSVSSRRSNPDAAAAAVRAYPLPSGLPNSASSEYLVEEELQVVLKPSPRAAAGSSDPPTQQHPQQQQLAAVERGQPSSSTVGLTPTASFRSTAERWSSRWSNRWSSRWSSGRWSSRYDAGTVTAAATAEWWWDMDGGAAPAARRREAEDGNGSASFYGFVRWLTGAY

SEQ ID NO: 6179 - DNA, 1803 bp, Panicum virgatum
  misc_feature: Ceres CLONE 1844793
  misc_feature: Encodes the peptide sequence at SEQ ID NO. 6180
agcacggcgaaagcttgggtcgcaaagacagcctcgtcctcgatccagtgctcggaggcgaacaacaactcgagtgacagacaatggcaaccgcaacccctactatcgtgctcgtcccgctctgcgtccccagccacctcccgtccttgtttgaggccggcaagcggctggtcagcaccagcggcggcgccatgtcgctcacggtgctcttcatgcagatgaccatggacgacagcctgatgtccagcgtcgccgacttcatccgccgggagtccgggtccggcctggacatccgcttccaccacctccccgccgtggagctccccaccgacacgcccggcgtcgagaacttcatcatgcgcttcatccagctccacgcgccgcacgtcaaggccgccctctccggcctggcctccccggtcgccggcgtcgtcgtcgactacttctgcaccaccctgttcgacgccatccgcgagctcgcaatgcccgtgtacgtgtacgtgccgtgctcctccgccgttctctcgctcatgctgcgcctgccggccctcgacgaggaggtggcgggggatctcggggacatggaaggagcggtggatgtgcccgggctgccgccgctgccggccgccctcctgccgacgccgctgatgaagaaaggcccggactacgcgtggatggtgtaccacggcggacgcttcatggaggccgccggcatcatcgtgtacacggtggccgtgctggagggggccgtcctcaccgccatcgccgacggccgctgcgtgcccggacgccgcgctccgaccgtctacgcggtcggccccgcggtgtctgcgccggtcaaggcacccggcgagcagccgcaccggtgcgtggcgtggctcgacgcgcagccgccggcgtccgtcgtgctgctctgcttcgggagcatgggcggtagcttccccgcgccgcaggtgagcgcgatcgctgccgcgctcgagcgcagcgggcaccggttcctgtgggtgctccgtggccccgtaccggccggcagccactcgccgtacccgtccgacgccaacgtcgacgagctcctcccggaagggttcctggagaggaccaaggacaggggcctcgtgtggcccacgtgggcgccgcagaaggccatcatcgcccacgccgccgtcggcgggttcgtgacccactgcgggtggaactcaatcctcgagagcctgtggcacggcgtgccgatggcgccgtggccgcagcacgcggaccagcacatgtgcgcgttccagctcgtgtccgtggtgggcgccgccgtgggcatggaggtgaacaggaagcggggcaacttcgtggaggccgcggagctggagcgggcggtgcggagcctgatgggcgacgggtcggaggaggggcggagggcgcgggagaaggccgcggagatgaaggccgcgtgccggaaggccgtggcggagggcgggtcgtcgcacgccgcgctgcagaaactggcccgggagatgttacaacgtggcggatgcgaggctgaggcttctgctgctgcaagcctgtaaaccgggccctggttcgctactgtggtggctgttgctgtatcctgtctctgcgtctgcgtctcctacgtttgcagaactttcgtagctctatttggcttgaataattaatgttctgttgagtcacaatgttgtgtatgttctgttgtgaggttttctgcaaacagttgggtaattgttggagacaagaaagattgatctttggtgcgccgtgcgcggcgagaattgtcaaaaaaaaaaaaaaaaaaaa

SEQ ID NO: 6180 - protein, 490 aa, Panicum virgatum
  misc_feature: Ceres CLONE 1844793
  misc_feature (2)..(138): Pfam Name: UDPGT Pfam Description: UDP-glucoronosyl and UDP-glucosyl transferase
MATATPTIVLVPLCVPSHLPSLFEAGKRLVSTSGGAMSLTVLFMQMTMDDSLMSSVADFIRRESGSGLDIRFHHLPAVELPTDTPGVENFIMRFIQLHAPHVKAALSGLASPVAGVVVDYFCTTLFDAIRELAMPVYVYVPCSSAVLSLMLRLPALDEEVAGDLGDMEGAVDVPGLPPLPAALLPTPLMKKGPDYAWMVYHGGRFMEAAGIIVYTVAVLEGAVLTAIADGRCVPGRRAPTVYAVGPAVSAPVKAPGEQPHRCVAWLDAQPPASVVLLCFGSMGGSFPAPQVSAIAAALERSGHRFLWVLRGPVPAGSHSPYPSDANVDELLPEGFLERTKDRGLVWPTWAPQKAIIAHAAVGGFVTHCGWNSILESLWHGVPMAPWPQHADQHMCAFQLVSVVGAAVGMEVNRKRGNFVEAAELERAVRSLMGDGSEEGRRAREKAAEMKAACRKAVAEGGSSHAALQKLAREMLQRGGCEAEASAAASL

SEQ ID NO: 6181 - DNA, 2177 bp, Panicum virgatum
  misc_feature: Ceres CLONE 1844796
  misc_feature: Encodes the peptide sequence at SEQ ID NO. 6182
atcgacctccacccattggattttattttagcaataaagattcctgttgggatatactcccccaattcccctcctcgtcgtcccaacaacaatctggtcgatcactcccgccaaaccaaaacagaaacccagttcagttcgatcccaatccgatcccacaagaacagagaaagaacccaacaccatcccagttcagttcgatcgccgttggccaatcacccagaccggaaggacacgatggccttcagcgtggctcagagcgccgccgccgcggcgtccgtcgcgcccggcacccctcggcacgcgccggcgccgacactagcgcccgcgtccgtctccgtgaccgtgaggaaggccggcggcgcgccgtcgcgctgcctcaggctgcagcggcagccaccggtggagccggcgcgtccggtggcgtgccgggccgcagcagcggcggcggccgagcgcgcctcgacgaggagcgcgggggtgccggtgttcgtcatgatgccgctggacaccgtcaagaagtgcggcaccgcgctgaaccgccggagggccgtccaggcgagcctggcggcgctcaagagcgcgggcgtcgagggcgtcatggtggacgtgtggtggggcatcgccgagagcgacggccccgggaggtacaacttcgccgggtacacggagctcatggagatggcgcgcaagacggggctcaaggtccaggccgtcatgtccttccaccagtgcggcggcaacgtcggcgactccgtcaccatcccgctgccgcgctgggccctggaggagatggagaaggaccgggacctctgctacaccgaccagtggggccgccgaaactacgagtacgtctccctcggctgcgacgccatgcccgtcctcaagggccgcacccccgtcgagtgctacaccgacttcatgcgcgccttccgcgaccacttcgccgactacctcggcaacaccatcgtcgaaatccaagtcggcatgggccccgccggcgagctgcgctacccgtcctacccggagagcaacggtacctggaggttccccggcatcggcgccttccaatgcaacgacaggtacatgcttagcagcctgaaggaggcggcggccgcggccggcaagccggagtggggccacggcgggccgaccgacgccggcagctacaacagctggccggaggataccatcttcttccgccgcgagaacggcgggtggagcaccgagtacggcgacttcttcctgtcgtggtactcgcggatgctcctggagcacggcgaccgcgtcctcgccggcgcggcgtccgtgttctccgcctcgcccgtcgccatctccgtgaaggtggccggcatccactggcactacggcacccggtcgcacgcgccggagctcacggcggggtactacaacacgcggcgccgcgacgggtacctcccgatcgcgcgcctcctggcgcgccacggcgccgtgctcaacttcacctgcgtggagatgcgggtccacgagcagccgcgggaggcgcagtgcatgcccgaggcgctggtgcggcaggtggccgccgcggcgcgcgccgccggcgtgtggctggccggcgagaacgcgctgccccggtacgacgccgcggcgcacgaccaggtggtagccgcggccgccgagcgcgccgccggggaccggatggtggccttcacctacctgcgcatgggcgccgacctcttccacccggacaactggcaccggttcgccgccttcgtgcgccgcatgagcggcgccgggtcgtgccgggaggccgcggagcgggaggcgcgcggcgttgcgcaggccaccggctcgctggtgcgcgaggccgccgtcgcgctgcggagctaaccgcgaccgaatgatccgatcgccgccgcgttgtctaggggttggggttgggagggagctcgggatttttcgttttggctttccttgggagggaaaacgcgctcggatctcgagagcgggcgatctctcgagcaggttacgcgtagacgacgagattgtgacgaggccgggaggggatgacaaaaaagatgtttttttgtcacgttacaggctccgacgatggccggagcttgttgggggaatttgaccatcgcctgcagaaatccgtagaaaccgctgtgttcttgcaaaaaaaaaaaaaaaaaaaa

SEQ ID NO: 6182 - protein, 543 aa, Panicum virgatum
  misc_feature: Ceres CLONE 1844796
  misc_feature (1)..(415): Pfam Name: Glyco_hydro_14 Pfam Description: Glycosyl hydrolase family 14
MAFSVAQSAAAAASVAPGTPRHAPAPTLAPASVSVTVRKAGGAPSRCLRLQRQPPVEPARPVACRAAAAAAAERASTRSAGVPVFVMMPLDTVKKCGTALNRRRAVQASLAALKSAGVEGVMVDVWWGIAESDGPGRYNFAGYTELMEMARKTGLKVQAVMSFHQCGGNVGDSVTIPLPRWALEEMEKDRDLCYTDQWGRRNYEYVSLGCDAMPVLKGRTPVECYTDFMRAFRDHFADYLGNTIVEIQVGMGPAGELRYPSYPESNGTWRFPGIGAFQCNDRYMLSSLKEAAAAAGKPEWGHGGPTDAGSYNSWPEDTIFFRRENGGWSTEYGDFFLSWYSRMLLEHGDRVLAGAASVFSASPVAISVKVAGIHWHYGTRSHAPELTAGYYNTRRRDGYLPIARLLARHGAVLNFTCVEMRVHEQPREAQCMPEALVRQVAAAARAAGVWLAGENALPRYDAAAHDQVVAAAAERAAGDRMVAFTYLRMGADLFHPDNWHRFAAFVRRMSGAGSCREAAEREARGVAQATGSLVREAAVALRS

SEQ ID NO: 6183 - DNA, 2345 bp, Panicum virgatum
  misc_feature: Ceres CLONE 1844804
  misc_feature: Encodes the peptide sequence at SEQ ID NO. 6184
gcggcgcggcgcgcacgcagggacaggggcgctagtgcgggaagcaggcagagctagcggagagcgaccgcggcagcagggggttcgccatggcggtgggcgcgaccgccgcgaagctgcacctctcgtcggtcgccggggccgctcgccgcccctcgctgctccacctcgcggccgtcgcggtcctctgctccctgtcctacctcctaggcatctggcaccacggcggcttttccgcggcccccgccgccggcgccggcgccggcgtctccatcgccaccgccgtctcctgcgcctccccgaccccgaccgtccccgcgggctcctcctcctcggggccgctcgacttcgccgcgcaccacaccgcggaggggatggaggcggaagccgcgccgcgccagcgcgcctacgaggcctgccccgccaagtactccgagtacacgccctgcgaggacgtggagcgctccctgcgcttctcgcgcgaccgcctcgtctaccgggagcgccactgcccctcctccgacaccgagcgcctccgctgcctcgtgccggcgcccaggggctaccgcaacccgttcccgtggcccgccagccgcgacgtcgcctggttcgccaacgtcccgcacaaggagctcaccgtcgagaaggcggtgcagaactggatccgcgtcgacggcgacaagttccgcttccccgggggaggcaccatgtttccgcgcggcgccggcgcctacatcgacgacatcgggaggatcatcccgctccacgacggatccatccgcaccgccctcgacaccggctgcggggtcgcgagctggggagcctacttgctgtcgcgcaacatcctggccatgtccttcgcaccgcgagattcacatgaggcacaggtgcagtttgcactggagcgtggtgtgccagcgatgattggggtgcttgcctccaatcggctcacctatccggcccgttcctttgacatggcgcattgctcccgctgcctcatcccatggcagctctatgatggtctgtacttgatagagatcgatcgtgttctacggcctggagggtattggatcttgtccggaccaccaatcaactggaagaagcactggaagggttgggccaggaccaaagaggacctgaatgcagagcagcaagctattgagaaagttgccagaaacctctgctggaagaaggtcaaggaggaaggtgacattgctatctggcagaagcctactaaccacattcactgcaaggtcaatcgcaaggttatcaagtccccacccttttgctctagccaaaatccagatgctgcctggtacgacaagatggaggcttgtataactccactcccagaggtcagtgacttgaaggaggttgccggtggcgagttgaagaaatggccggagaggcttactgcagtaccgcccaggattgccagtggcagcatcgagggggtcacggaagatatgtatgtcgaagatactgagttatggaagaggagagttgggcactacaagtccgtgatctcgcaattcgggcagaaaggccggtaccgcaatttgcttgatatgaatgcgaagtttggtggcttcgctgcagctttggtggatgacccagtgtgggtcatgaacatggtccctactgtgggcaactcaacaaccctgggggtaatatacgagcgtggcctcatcgggagctaccaggactggggtgagggcatgtctacttatccccggacctacgacctcattcatgctgattcagtgttcacgctatacaatggcaggtgtgagatggagaacattctgctggaaatggacaggatcctgaggccggagggcacgatcatcattagagatgacgtggacctgttagtgaagataaagagcatcgcggacgggatgagatggaatagccagatcgtggatcacgaagatggtccgctcgtccgcgagaagctcctccttgttgtgaagacatactggacattgggggacaacacacaataggaataacgtggaataaaagagttagagtgattgacttgctcggcaaatcttgtgactggctttgccctgtgaatctcgagtttgttttcgtttttccttttgggtattcttttggaagaaatagtccacaaaaaggagatgctctccttgttaagctatgagagagggaaacccagcacagattttgacatgaaaaaacagaacaaattgtgcgaagtgggtaaatagaaagtataatattgggttcaaatttttctcccggtggacattgtttagttttagttgttagatgttcattatgtgatgctttttgttcaaaaaaaaaaaaaaaaaaaa

SEQ ID NO: 6184 - protein, 639 aa, Panicum virgatum
  misc_feature: Ceres CLONE 1844804
  misc_feature (1)..(96): Pfam Name: Methyltransf_11 Pfam Description: Methyltransferase domain
  misc_feature: The sequence is a functional homolog of  SEQ ID NO 1593 in the  11/479,226 US patent application
  misc_feature: Useful for making plants with modulated growth and phenotype characteristics
MAVGATAAKLHLSSVAGAARRPSLLHLAAVAVLCSLSYLLGIWHHGGFSAAPAAGAGAGVSIATAVSCASPTPTVPAGSSSSGPLDFAAHHTAEGMEAEAAPRQRAYEACPAKYSEYTPCEDVERSLRFSRDRLVYRERHCPSSDTERLRCLVPAPRGYRNPFPWPASRDVAWFANVPHKELTVEKAVQNWIRVDGDKFRFPGGGTMFPRGAGAYIDDIGRIIPLHDGSIRTALDTGCGVASWGAYLLSRNILAMSFAPRDSHEAQVQFALERGVPAMIGVLASNRLTYPARSFDMAHCSRCLIPWQLYDGLYLIEIDRVLRPGGYWILSGPPINWKKHWKGWARTKEDLNAEQQAIEKVARNLCWKKVKEEGDIAIWQKPTNHIHCKVNRKVIKSPPFCSSQNPDAAWYDKMEACITPLPEVSDLKEVAGGELKKWPERLTAVPPRIASGSIEGVTEDMYVEDTELWKRRVGHYKSVISQFGQKGRYRNLLDMNAKFGGFAAALVDDPVWVMNMVPTVGNSTTLGVIYERGLIGSYQDWGEGMSTYPRTYDLIHADSVFTLYNGRCEMENILLEMDRILRPEGTIIIRDDVDLLVKIKSIADGMRWNSQIVDHEDGPLVREKLLLVVKTYWTLGDNTQ

SEQ ID NO: 6185 - DNA, 1987 bp, Panicum virgatum
  misc_feature: Ceres CLONE 1844827
  misc_feature: Encodes the peptide sequence at SEQ ID NO. 6186
atcgctcgcctttggatcatcgatcggagcaagcaagctcgctctccactcatagcaataaaagcccgcaatgggtcgggaggtgctcggtggtgcgccgactaatagtaatgcgcaggcgttgtgccgccgggtcgtcggccacctcccgctcctcctcgccggcgcggcgctcctcgccgcggtcccgcggctgccggccccggcgaacaggctgctggcgaacggcctcctgcgggagctggccgccctgggcgtgagcgcgccggcagtggcggtggcctgctgggcggcggcggtggcggcgtgggcgtacgccgtgtcgcgcccccggcccgtgtacctggtggagctgtccgggtacgtcgccggcgaggcgcacgaggcgtcccgcgccaagacggtggcgcacttcgggcggtgcgggcggttcagcgcggagagcatggcgttccagaagcggatgctggagcggtcggggctcggggagcggacccacttcccggcgtcgctgatccgcgtgcccgtggacatgtgcctccgcacggcgcgggaggagtcgcacgccgtcatcttcggcgtggtggaggacgtgctccggcgggccggcgtcgccgccgccgacgtcggcgtgctcatcttcaactccagcctgctcagcaccacgccgtccttcacctcgctcatcgccaaccggtacggcatgaggcacgacgtcgtcagccacaacctcagcggcatgggatgcagcgccggcatcatagccatcgacctcgcgaagcggctgctccaggtacccaaccaacgcctctccttgtgccaccgtacccggccgggccgtcttaaattcttgtaccatgcatgcgtcctttccatgcagccatgcacgcacgaaaaccgaggccataactctcgatgaactagccaatgaataatgaccaatttggacatattggctgtgtttagttcccctggaaagtactgtagcgaccgggaaaaataactgtagcacactgtatcacgttttgtttgtttgtggtagatattgtcctaccatgacctaactaggctcaaaagattcgtctcgcaacgtatatcaaaactatgcaattagtttttttatttacctacatttagtactccatgcatgggtcatttgttacatttaatgtttcgatctgatggagatgtgatggaaagtgatgtttttgtgggggtttttggtggatctaaacacacccatacttacggccaatctagagcatcttgttgatgtacacataataataactaatccagatttgagaccttatcatgcatcaaatatatactactatagtttatcaggaagcttatactagctttatactagctaagagcaagtattatagttgccgtttcgcctgcctcatcagcggagaggctgaggcagcgtagaggctgaggcgggcgtatggcagttgtggggctgccgccaccgatttcttgagtcggattggctgctcgttaatgctgagcggcacggatcattaagggtgtgtttggttggagggtccaactgggttgggttgggttcagcccagttggacccgtgtttggttcgaagtttactgggttagggtcaactcttgatgggaatattcctctaatatgcgggtcggagtgatacctccaaatcgagcggaccactccgacccactcgaacggcgtcaaaggcgtcgctgggcggacgcggggcacgggaaaggagcggcggcgtggcagggagcgagcggcgcagcaaggacgagccgcggccgccggtgtggcaggaagcgagtggcggtcgagcacctgtggcggtgctctagcagtgtgtcggtgtgtgcagcaggccatgctctgatctgtggtgtaggtgtgtggcctgcttggtgtcccttgtgtcatgtgtaaccatccatctatatcattatctatctatctacaaaaaaaaaaaaaaaaaaaa

SEQ ID NO: 6186 - protein, 282 aa, Panicum virgatum
  misc_feature: Ceres CLONE 1844827
  misc_feature (1)..(168): Pfam Name: FAE1_CUT1_RppA Pfam Description: FAE1/Type III polyketide synthase-like protein
MGREVLGGAPTNSNAQALCRRVVGHLPLLLAGAALLAAVPRLPAPANRLLANGLLRELAALGVSAPAVAVACWAAAVAAWAYAVSRPRPVYLVELSGYVAGEAHEASRAKTVAHFGRCGRFSAESMAFQKRMLERSGLGERTHFPASLIRVPVDMCLRTAREESHAVIFGVVEDVLRRAGVAAADVGVLIFNSSLLSTTPSFTSLIANRYGMRHDVVSHNLSGMGCSAGIIAIDLAKRLLQVPNQRLSLCHRTRPGRLKFLYHACVLSMQPCTHENRGHNSR

SEQ ID NO: 6187 - DNA, 1619 bp, Panicum virgatum
  misc_feature: Ceres CLONE 1844913
  misc_feature: Encodes the peptide sequence at SEQ ID NO. 6188
gtcgtccgcccagagtctaatccgattcaaaccgcccgttccccgtgtctgtccgagccaagcaagccgagcccaatcccctgcgccagctgctgggtgagcgccccgccccgtccccgtcccctccctccgcccttcccacgcttcttcgttgctcgctcgctcgcaattgcgtgatcgcttttggtcccgccccgttccggtgcgtgatttttacctgacgcctgacgcgtgtggtttgggttggatctgggcggaaccaggtgcgcgacgcgatggcgcagaaggagaccaatggcagcaacggcgagcacaccacctcccgcccgccgccgaccccctcgccgctccgcttctccaagttcttccaggccaacctgcggatcctggtcaccggtggggcgggcttcatcggctcgcacctcgtcgacaagctcatggagaacgagaagcacgaggtcattgttgctgataacttcttcactggttcaaaagacaacctgaagaagtggatcggccacccaagatttgagctcatccgtcacgatgtcacccaaccgctgcttgtggaggttgaccaaatctatcatcttgcttgccctgcttccccaatcttctacaagcacaatcctgttaagaccatcaagactaatgttattgggacccttaacatgctgggacttgcaaagagagttggagctaggattttgttgacttcgacctctgaagtttatggtgatccgcttgagcatcctcaaaccgaggcctactggggcaatgttaacccaattggagtcaggagttgttatgatgagggtaagcgtgtagcagagacactgatgttcgactatcacaggcagcatggcattgaaatccgaattgccaggattttcaacacgtacgggcctaggatgaacattgatgatggccgtgttgttagcaacttcattgctcaggctgttcgtggcgaacccctgactgtgcagaaaccaggcacacagactaggagcttctgctatgttgccgatatggttgatggtcttattaagctgatgaatggaaacaacactggaccgattaacttgggtaacccaggtgaatttaccatgctggaacttgctgagaatgtgaaggagttgatcaacccagaagtgacagtgatgatgaccgagaacactcctgatgatcctcgccagaggaagccagacatcacaaaggccaaggaagttcttgggtgggagcccaaggtcgtcctgcgcgacggtttggtgctcatggagggtgatttccgggagcgcctggcggtgcccaagaagaccaaggcctaaaccgccctgtgtttggcgagaaggatatccaaggggggagcatactcatagttgggttcgtcattattcgtggccgcatttcattacggaatttgagttccaataaactgaatacacatttgtcgttcaccttgaaagattgtactattagaattcccatacagggccggccgttttgcgtctctctgctcccgcagatcttgttgtacttgtgtttgtagcctgtgtactcctgaatcgattatagcaatgttgatgccattttgagcttaaaaaaaaaaaaaaaaaaaa

SEQ ID NO: 6188 - protein, 350 aa, Panicum virgatum
  misc_feature: Ceres CLONE 1844913
  misc_feature: Great-hit functional homolog of the protein sequence encoded by LOCUS At2g28760
  misc_feature: Great-hit functional homolog of the protein sequence encoded by LOCUS At3g46440
  misc_feature: Great-hit functional homolog of the protein sequence encoded by LOCUS At5g59290
  misc_feature (1)..(235): Pfam Name: Epimerase Pfam Description: NAD dependent epimerase/dehydratase family
  misc_feature (36)..(342): SWISSPROT Homolog: EC 4.1.1.35 UDP-glucuronic acid decarboxylase 1
  misc_feature: Useful for making plants with altered cell wall content and/or composition
MAQKETNGSNGEHTTSRPPPTPSPLRFSKFFQANLRILVTGGAGFIGSHLVDKLMENEKHEVIVADNFFTGSKDNLKKWIGHPRFELIRHDVTQPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAVRGEPLTVQKPGTQTRSFCYVADMVDGLIKLMNGNNTGPINLGNPGEFTMLELAENVKELINPEVTVMMTENTPDDPRQRKPDITKAKEVLGWEPKVVLRDGLVLMEGDFRERLAVPKKTKA

SEQ ID NO: 6189 - DNA, 1772 bp, Panicum virgatum
  misc_feature: Ceres CLONE 1857737
  misc_feature: Encodes the peptide sequence at SEQ ID NO. 6190
cctcctctccgtctccctctctctctctctccccctctcccttccttcgcctcgtcttggccagttggcccctcctctacctctgctggctgctgcagtgggttcctcctccggccccatcggattcctgaaatttggtggctcggttcggtgcttaactacatccaccccggagaacatcggacggagcatttgaggtggttgcctgcccaaccaagctctctcagcagctccggcctctgactttctcgggaggaggaggcgcagcagcgcgggcaccatgatgagcttcaggagccacgaggggttcgggcaggtccccgccggcgccagctccaacggacccgcggtgccgtggtgggcgccggcgcctcagctgctgctgtacggcgaggcgctgggccaggggaaggtgccgccggaggcgtcgccgtgccgggaggcccggttccaggtcgcgccgggagcgcaggcgccgctgggtcctccggtgccgccgccgccgccagcgaaggctgctgccgagaggggcctccccgaagtcctcaagttctccgtggcgcaaggtaaaggggagaaaggttctgggcactctgccactgctgctttgccatccccattcgcgatctacaatggtcattttgagctgggccttggtcaatctacggtttctgctaataatctttatgttgaccaacactgtggcctgctttctccctatccaatgggagcaacgcccggagggtgcatgcgaataccactgaatatgccaacagaagcaccaatttatgtgaatgctaagcaatatgaaggcattcttcgtcgacgccgtgcccgtgccaaagcagagagggaaaataggctggtgaaagctaggaagccatatctccacgagtctcgccatctgcatgcactgcgtcgcgcaagaggctctggtgggcgttttctgaacacaaagaaagagtccaattcgaaggatgctgttggagatggcaaggcaatgttcagcaatccgcttatgcgccaggtggcatctccaagttcagagatccagcagtcagacctgggcaacccgagcagcgtctccagtctgtcaggctcagaggtgtcaagcatatatgatcatgaagatgtggatcactaccacagctttgatcacctccgcactccgtttttcaccccgctcccgagcatcatggacagtgaacatggggtcggtatccccttcaagtggccaacagcctctgaaggctgttgtgacctcctcagagcatgactagaggggttactggacagccgaatgctaggaactggcgacaaccagcagatgctgctgggtgttaccagctccgggtcagggattgtccctcccatcgtttggctgtcggtaggcaattcattcttggctgaaggcattgtggttatttcctcttatcgcctaattctcctagatattctatttctgggatcttgtgatgagtggaacacccgtgcccccaaaaatgctggtagtactagcttccagcatcaaactcgttttgcgcgagcaggtttcagtgttgtttttctgaataaagcttgaaacttcagactaggtactggaagtggagtatatttctgagtctgattgtgtgtcaagacttggcttttgttagtgatgaattgtggtgtgcttgaagcttgtgtggacatggtttgtaatatgtggtgtgttgaaagcttgaactcagtaatgtaatgatgtatttgaccaaaaaaaaaaaaaaaaaaaa

SEQ ID NO: 6190 - protein, 331 aa, Panicum virgatum
  misc_feature: Ceres CLONE 1857737
  misc_feature: Great-hit functional homolog of the protein sequence given in SEQ ID NO 9219
  misc_feature (1)..(57): Pfam Name: CBFB_NFYA Pfam Description: CCAAT-binding transcription factor (CBF-B/ NF-YA) subunit B
  misc_feature: Useful for making plants with altered alkaloid content
MMSFRSHEGFGQVPAGASSNGPAVPWWAPAPQLLLYGEALGQGKVPPEASPCREARFQVAPGAQAPLGPPVPPPPPAKAAAERGLPEVLKFSVAQGKGEKGSGHSATAALPSPFAIYNGHFELGLGQSTVSANNLYVDQHCGLLSPYPMGATPGGCMRIPLNMPTEAPIYVNAKQYEGILRRRRARAKAERENRLVKARKPYLHESRHLHALRRARGSGGRFLNTKKESNSKDAVGDGKAMFSNPLMRQVASPSSEIQQSDLGNPSSVSSLSGSEVSSIYDHEDVDHYHSFDHLRTPFFTPLPSIMDSEHGVGIPFKWPTASEGCCDLLRA

SEQ ID NO: 6191 - DNA, 1812 bp, Panicum virgatum
  misc_feature: Ceres CLONE 1857755
  misc_feature: Encodes the peptide sequence at SEQ ID NO. 6192
acacctccgcatttcgcattcgactcgacccgactctccactcgtcgtcctgcacaaacccccaaaaccctaccgccgccgccgccatgtcctcggcgccgtctccggcgagccgccgccccccgggcccgctggcgctggggctggagtcctcggccaacaagatcggcatcggcgtggtctccctctcgggcgagatcctctccaacccgcgccatacctacgtgaccccgccgggccacggcttccttccccgcgagaccgcgcagcaccacctcgtgcacctcctcccgctcctccgcgccgcgctcgccgacgccggcgtcgcccccgccgacctcgcctgcgtctgctacacgaaaggccccggcatgggcggcccgctccaggtcgccgccgcggccgcccgcgcgctctccctcctctggaggaagccactcgtggcgatcaaccactgcgtcgcgcacatcgagatggggcgcgcggtcacgggggccgtggaccccgtcgtgctctacgtctccggggggaacacccaggtcatcgcctacagcgaggggaggtacaggatcttcggggagactatcgatatcgcagttgggaactgcctcgaccgctttgccagggtccttgagctctccaatgaccctagccccgggtataacatcgagcagcttgcaaagaagggagaaaaattcattgatctcccatatgctgtaaagggtatggatgtgtcatttagtggcatattgagctttattgaagctgcagcaattgaaaagcttaaaaataatgagtgcacacctgcggacctatgctactcattgcaggaaactgtctttgccatgcttgttgaaattactgaacgcgccatggcacattgtgattcaaaggacgttcttattgttggtggtgttggttgcaatgaacgtttacaagagatgatgaggattatgtgctcggaaagagggggtaggctgttcgcaactgatgaccgctattgtatagataatggggcaatgattgcatacactggtttactcgcgtatgcacatggtgtgaccactcccctggaggagtcaacatttacacaaagattcagaactgatgaggtccaagcgatttggagggagaaggagatgcctgtgttgagtaatatccatgcagatgcaatggctgaagtatccaaggatgaagcctctatgccaactccaatcattgtagattgctgaggtagtaaatgcttaatagtgtaggagcattcatgcatgagatgcctttgcttgctggtttggaggaagcctcgaggctcatgggctcattgcaggcggcttgtactaccctgctgcagtatgagcctcgcagttgcaaagcatttacagcaagatactgatctgcaacctggtaaaatgaatgtgttgtactcctatgtcacattcgcacgtgccaatagctgacagtgatcaaactcaacaacattctggttagtcaagactttttatcccctttgcttgacccttaccgaccgtttgttgtaaaatgtaaactagtcagtatcaggatcagccaagctagggtaactcttaagctactcactcgagtgatggtgtattggcgctgtttcggtttgtttccacggaatgtgtacagattgcgttacacagaagctagttgttcggacgcgtatattgatatctttctgtttggcagagacctttataccttatctttctgttaggcggtgaccttttctacctcccactacgcaatgcaactcacggtatgctgccggaaaaaaaaaaaaaaaaaaaa

SEQ ID NO: 6192 - protein, 381 aa, Panicum virgatum
  misc_feature: Ceres CLONE 1857755
  misc_feature (1)..(279): Pfam Name: Peptidase_M22 Pfam Description: Glycoprotease family
MSSAPSPASRRPPGPLALGLESSANKIGIGVVSLSGEILSNPRHTYVTPPGHGFLPRETAQHHLVHLLPLLRAALADAGVAPADLACVCYTKGPGMGGPLQVAAAAARALSLLWRKPLVAINHCVAHIEMGRAVTGAVDPVVLYVSGGNTQVIAYSEGRYRIFGETIDIAVGNCLDRFARVLELSNDPSPGYNIEQLAKKGEKFIDLPYAVKGMDVSFSGILSFIEAAAIEKLKNNECTPADLCYSLQETVFAMLVEITERAMAHCDSKDVLIVGGVGCNERLQEMMRIMCSERGGRLFATDDRYCIDNGAMIAYTGLLAYAHGVTTPLEESTFTQRFRTDEVQAIWREKEMPVLSNIHADAMAEVSKDEASMPTPIIVDC

SEQ ID NO: 6193 - DNA, 2302 bp, Panicum virgatum
  misc_feature: Ceres CLONE 1857823
  misc_feature: Encodes the peptide sequence at SEQ ID NO. 6194
atcgccacccgccttcccctccctctacacgcacctctcgggctcggctccgaagagggaggaggacgccagctgccacggcacccgcacccgctcccgcgctacccgccgccaccatgctgtccgcgcaggccgccgccgccgtcacctcaccggcttccctgtggaagcgggcaggagggagcgagggcgggagccgcagctgcgacggatgcaggacctacagggagtccctgcggaggcgggccgcggcggtgcgggtgcgcgccgcggcgccggggcgggtggaggccgtcgcgatgggctccgccgcggagaccgagaaggagctgcaggagcagcagcagcaggagaaggaggtggcggcggccggcggcggggtcgaggacccctacggcgaggacagggccaccgaggagctgcccgtcacgccctgggcctactccgtcgcgagcggttacacccttttgagggatccacatcacaacaagggtctttccttcactgagaaggagcgggatgcacactacttgcgtggccttctgcctccggcggttgtgtctcaggaactccaaattaagaagatcatgcacaacctgcggcagtaccagctccctttgcagcgctatatggccataatggaccttcaggagagaaatgaaaggcttttctacaagcttttaattgatcatgtggaggagctgctccctgtggtttacacaccaactgttggtgaggcctgccagaagtatggttgcatctttagacaaccacagggtctgtatgtcaccctgagggacaaggggaaggtcctggaggttctaaggaactggccccagaggaacattcaagttattgttgttactgatggtgagcgaatcttgggacttggagatttgggttctcagggaatgggaattcctgtaggcaaacttgctctctacactgcacttggaggagttcgcccatcagcttgtttgcctatcacaattgatgttggcacgaacaacgaggaactgcttaaagatgagttctatattggactccggcagaaacgtgcaactggcaaggagtatgatgaacttatggaagaattcatgacagctgtgaaacaaatctatggtgagaaagtcctcattcagtttgaggactttgccaatcataatgcttttgatttgcttgcaaaatatagcaagagccatcttgttttcaatgatgatatccagggcacagcatcagtggtccttgcaggtttgttatcagcacttaaggtggttggtgggaccctagcagagcacacctatttgttccttggcgctggggaggctggaactggcatagccgaactcattgctctcgagatttcaagacagacaaaagctccgattgaagagtgccgcaagaaggtttggctggtggactcaaagggtttaattgttaattcccgtaaagactcccttcagtcattcaaaaaaccttgggcacatgagcatgagcctttgacgtccttgtttgatgctgtccagtccatcaaacctacggttttgattgggacatcaggtgttggaagggcattcacaaaagaagttgttgaggcaatggcttccttcaatgagaggcctgtcatcttttcactgtcaaatccaacctcacattctgaatgtaccgctgaggaagcatataactggactcagggccgtgctgtatttgccagtggtagtccatttgcccctgtggagtacagtgggcaaacttttgtacctgggcaggcaaacaatgcttacattttccctgggtttggccttggtctggttatctctggagccatccgtgtccacgaggacatgcttcttgctgcttcggaagcactagctgatcaggccactcaggagaatttcgacaagggatcaatcttcccacctttcaccaacatcagaaagatctctgctcacattgctgctgccgtggctgcaaaagcctatgagctcggtttggcgacccgtctgcctccttccagagacctggtgaaatatgcagagagctgcatgtacactcctgtctaccgcaactaccggtagcgacgcggggttcaattttgcagtaataaaaaccaatcaatgcagggtactgcaatgttgttgtgctgcatgtgtatgttgttcgtcgtcaccgctgctaccacccttgtgtacttgttgctggtgctgctggtagacactgtagctgtctatgcatatatgatatggtgtaacgcgttatggaagcagaccatcttgtgtgccaaaaaaaaaaaaaaaaaaaa

SEQ ID NO: 6194 - protein, 653 aa, Panicum virgatum
  misc_feature: Ceres CLONE 1857823
  misc_feature (1)..(254): Pfam Name: Malic_M Pfam Description: Malic enzyme, NAD binding domain
  misc_feature (1)..(653): SWISSPROT Homolog: EC 1.1.1.40 NADP-dependent malic enzyme, chloroplast precursor
  misc_feature (8)..(653): SWISSPROT Homolog: EC 1.1.1.40 NADP-dependent malic enzyme, chloroplast precursor
MLSAQAAAAVTSPASLWKRAGGSEGGSRSCDGCRTYRESLRRRAAAVRVRAAAPGRVEAVAMGSAAETEKELQEQQQQEKEVAAAGGGVEDPYGEDRATEELPVTPWAYSVASGYTLLRDPHHNKGLSFTEKERDAHYLRGLLPPAVVSQELQIKKIMHNLRQYQLPLQRYMAIMDLQERNERLFYKLLIDHVEELLPVVYTPTVGEACQKYGCIFRQPQGLYVTLRDKGKVLEVLRNWPQRNIQVIVVTDGERILGLGDLGSQGMGIPVGKLALYTALGGVRPSACLPITIDVGTNNEELLKDEFYIGLRQKRATGKEYDELMEEFMTAVKQIYGEKVLIQFEDFANHNAFDLLAKYSKSHLVFNDDIQGTASVVLAGLLSALKVVGGTLAEHTYLFLGAGEAGTGIAELIALEISRQTKAPIEECRKKVWLVDSKGLIVNSRKDSLQSFKKPWAHEHEPLTSLFDAVQSIKPTVLIGTSGVGRAFTKEVVEAMASFNERPVIFSLSNPTSHSECTAEEAYNWTQGRAVFASGSPFAPVEYSGQTFVPGQANNAYIFPGFGLGLVISGAIRVHEDMLLAASEALADQATQENFDKGSIFPPFTNIRKISAHIAAAVAAKAYELGLATRLPPSRDLVKYAESCMYTPVYRNYR

SEQ ID NO: 6195 - DNA, 1647 bp, Panicum virgatum
  misc_feature: Ceres CLONE 1857913
  misc_feature: Encodes the peptide sequence at SEQ ID NO. 6196
cggttcgtctccccacctcgcgccgccgccgccgcgcgggtcgccggattccgccgcccccgcgttctcctcgcccctcctgggtcctgactcccgagaggcgggtcatggcgtcactggcttccccctccctctccctccacactgtcccggggcgggcgcgccttggccttgctgctgccgcgggggtgccgcgcccgcggcggaggacggtggctgtggtgcgggcgaaggtgcgggagatattcatgccggcgctgagctcgacgatgacggaggggaagatcgtctcctggaccgccgccgagggggaccgcgtcgccaagggcgaccccgtggtggtcgtcgagtccgacaaggccgacatggacgtggagacgttccacgacggcatcgtcgcagccgtcctcgtcccggccggggggaccgcgcccgtgggcgcccccatcgccctcctcgccgagtccgaggaggaggtcgctctggcgcgggcgcgcgcccagtccctctcccagggacagagccaggaacagccccctccccatgccgccgccgccgccaccccggcgccacctcctccagcgacaaaaggcgttgcgacgccttatgccaagaagctcgcgaagcagcacagggtggacatcgccgcggttgtcggcacggggccacacgggcgcgtcacggcggctgacgttgaggcagctgctggcatcaagccgaagccaaaggtcactccacctccactccctgccgccgctgttccccctgctactccgatggcctcgggtgcagtgctgccaccactgcccggtggcagggtggtgccgttcacaacaatgcaggcggcggtgagcaggaacatggtggagagcttgtcagtgccaacattccgggttggctactctatgatcactgataagctcgacgcactctatgaaaaggtcaagtcgaagggggttacaaagacagtgctgctggtgaaggcagcagccatggccctaacccagcaccctgttgtaaatgctagctgcagagatggaaagagcttcagctacagcactaatgtgaacattggagtggctgttgcactcgagggtggtcttcttacgcctgtcctggaggatgctgataagttggatatatatctgcttgcacaaaagtggagagttctgctcaagaaggcacgcaccaagcagctacaaccaaatgagtacaactcagggacgtttacgctgtccaatttgggtatgtttggggtggatagatttgatgcaatccttccagctggtcagggagctatcatggctgttggagcatcaaaacctactgtggtggctgataaggatggtttcttcagtatcaagagtgaaatgctggtgaatgttactgctgatcacaggattatctacagtgctgatttggcagcattcctgcagacgtttgcaaaaattgttgaggatcctgcatgcctcacactgtaaaaaaagttccatttgacggttctatgatttctttgattcctaattgggagacaatgccaataaataataatgctatatagagtttgtaaaggtattaacagaagaataatgagccacttgattttgcttccacatagaactttgtttcttgtttatatacactttc

SEQ ID NO: 6196 - protein, 457 aa, Panicum virgatum
  misc_feature: Ceres CLONE 1857913
  misc_feature (1)..(225): Pfam Name: 2-oxoacid_dh Pfam Description: 2- oxoacid dehydrogenases acyltransferase (catalytic domain)
MASLASPSLSLHTVPGRARLGLAAAAGVPRPRRRTVAVVRAKVREIFMPALSSTMTEGKIVSWTAAEGDRVAKGDPVVVVESDKADMDVETFHDGIVAAVLVPAGGTAPVGAPIALLAESEEEVALARARAQSLSQGQSQEQPPPHAAAAATPAPPPPATKGVATPYAKKLAKQHRVDIAAVVGTGPHGRVTAADVEAAAGIKPKPKVTPPPLPAAAVPPATPMASGAVLPPLPGGRVVPFTTMQAAVSRNMVESLSVPTFRVGYSMITDKLDALYEKVKSKGVTKTVLLVKAAAMALTQHPVVNASCRDGKSFSYSTNVNIGVAVALEGGLLTPVLEDADKLDIYLLAQKWRVLLKKARTKQLQPNEYNSGTFTLSNLGMFGVDRFDAILPAGQGAIMAVGASKPTVVADKDGFFSIKSEMLVNVTADHRIIYSADLAAFLQTFAKIVEDPACLTL

SEQ ID NO: 6197 - DNA, 1716 bp, Panicum virgatum
  misc_feature: Ceres CLONE 1858141
  misc_feature: Encodes the peptide sequence at SEQ ID NO. 6198
cgtctccaccttccccacgagtcgcaggccaaccaaccaatctcccgtctcgcttcgccgcgctttgaagtcgagagatctttttttttgtccgcgtcctcctccgcccctcgatcgctgctccagtgctcccccccgccaccggccgctactgccgccggcgatggatcgtgaagaaggtaaagcagcgccagcgcagagcccgacgaattcgggagcgattctggctaatctggggcctggttgccattggtgtgcagtgaccgagttcctcgggcaggtgcccctcctgcagtgcctcccgggctcctccatccgcaggatcgccgaggctgttcagctcaagcgctacgaacctggtgactatgttgcccgcgaaggtgaacctgtagatggcctttacatcatattggatggtcaggctgaagtttccgcatctgcgaatgcagaagaagcaaaccgcccagactatgtgttaaataagtatgactactttggttacggcacgaatagttccgatcttcaagtaaatgttgttgcactatcgaagctgacctgcttcatattgcccaatcaatatggacatttgttacaaccaaaaacaatttggaatgcggaggagacacctgaacattctttactggaacgaattttgcatttagaaccactagaggttgatatcttccgtgggtttactttgccagaagctccaacttttaggcaagtttttggaggacaattgattggacaggcacttgcagctgcatccaagactgttgattgtcttaaaatggttcatagtttgcatgtgatttttcttgttgctggagacaataacatgccaataatatatcaagttcatcgggcgcgtgatggatccagttttgcaaccagaaaagtggaggcaaagcagaaaggcctagttatattcactttgattgcttctttccagaaggaagaagtaggttttgaccatcaggctgcaatcatgcctgatgttcctcctcctgaacagctccttaatctggaggagatacgagaaagacggcttactgacccgcgcttcccaacgcaatataggaacttggcagctaaaaagaagttcacgccttggcctatagaaatgagattctgtgaagattcagcgtctcaacataaaccaagcttaaactattggtttagagctcgaggaaagctttcagatgatcaagctctgcatagatgtgtcgtagcatatgcttcagatctactgtattctggtgtcagcctgaatcctcatcgggagaagggtttaaagacatactcactcagtctcgaccactcgatctggttccacaagcctgtgaaggctgatgactggttgctgtatgtgatcgagagcccatctgcgcatggtggccggggtttcgtcaccggacgcatgttcaacaggcaaggagagcttatcatgtcgctgactcaagaggcgctgattaggagggagaagacacgagaaccaaacccgaggccaaagctttgaaaggtgcagaagagtctgtactaggctctcttttcaatttgtttcgcatatgtacgattcagcgcaaaaatgtacagtatcggtatattgaaggaaaaggtggtatcaattgttctgagctgggtatatttgtaactcgaagtgtgaacagggtaatggaatatgaatgagagttggaaaaaaaaaaaaaaaaaaaa

SEQ ID NO: 6198 - protein, 451 aa, Panicum virgatum
  misc_feature: Ceres CLONE 1858141
  misc_feature (1)..(128): Pfam Name: Acyl_CoA_thio Pfam Description: Acyl-CoA thioesterase
MDREEGKAAPAQSPTNSGAILANLGPGCHWCAVTEFLGQVPLLQCLPGSSIRRIAEAVQLKRYEPGDYVAREGEPVDGLYIILDGQAEVSASANAEEANRPDYVLNKYDYFGYGTNSSDLQVNVVALSKLTCFILPNQYGHLLQPKTIWNAEETPEHSLLERILHLEPLEVDIFRGFTLPEAPTFRQVFGGQLIGQALAAASKTVDCLKMVHSLHVIFLVAGDNNMPIIYQVHRARDGSSFATRKVEAKQKGLVIFTLIASFQKEEVGFDHQAAIMPDVPPPEQLLNLEEIRERRLTDPRFPTQYRNLAAKKKFTPWPIEMRFCEDSASQHKPSLNYWFRARGKLSDDQALHRCVVAYASDLLYSGVSLNPHREKGLKTYSLSLDHSIWFHKPVKADDWLLYVIESPSAHGGRGFVTGRMFNRQGELIMSLTQEALIRREKTREPNPRPKL

SEQ ID NO: 6199 - DNA, 1935 bp, Panicum virgatum
  misc_feature: Ceres CLONE 1858210
  misc_feature: Encodes the peptide sequence at SEQ ID NO. 6200
aattgggaggagctgagaacctgagacggcggccatggcggggcgtcagctgaacgtgctgtccacgctggaccaggcgaggacgcagtggtaccacttcatggcgatcgtgatcgccggcatgggcttcttcaccgacgcctacgacctcttctgcatctccctcgtcaccaagctgctgggccgcatctactacaccgacacctccaggccggacccgggcacgctgccgcccaacgtgtcggccgccgtcaccggggtcgcgctctgcggcacgctggcggggcagctcttcttcggctggctcggcgacaagctcggccgcaagagcgtctacggcttcacgctcgtcctcatggtcgtctgctccgtcgcgtcgggcctctcgttcgggcgaacgcccaggggcgtcgtcgccacgctctgcttcttccgcttctggctcggcttcggcatcggcggcgactacccgctcagcgccaccatcatgtccgagtacgccaacaagaggacccgcggcgccttcatcgccgccgtcttcgccatgcagggcttcggcatcctcttcggcgccatcgtggcgctcgtcgtctccgccggcttccgcgccgcgtacccggcgccgccctactcccaggaccgcgccgcctcgctcgtgccgcaggccgactacgtgtggcgcatcatcctcatgttcggcaccctcccggccgcgctcacctactactggcgcatgaagatgcccgagacggcgcgctacacggcgctcgtggcgcgcaacgccaagcaggccgcggccgacatgtccagggtgctgcaaaccgagatcaaggagagcgcggcgcgtgacgagaggacggtcctcgccggcgaggagtggggcctcttctcgccccagttcgcccggcgccacgggctccacctcctggcgaccaccagcacgtggttcctcctcgacatcgccttctacagccagaacctgttccagaaggacatcttcagcaaggtcgggtggatcccggcggcgaggaccatgaacgccgtcgaggagctgttccgcatcgcgcgcgcgcaggcgctcatcgcgctgtgcggcaccatcccgggctactggttcaccgtcgccttcatcgacatcgtcggcaggttctggatccagatcatgggcttcgccatgatgacggccttcatgctcggcctcgccgtgccgtaccaccactggacgacgcccggccaccacacggggttcatcgtcatgtacggcttcaccttcttcttcgccaacttcgggcccaatagcaccaccttcatcgtccccgccgagatatacccggcgcggctgcggtccacctgccatggcatctccgccgcggccgggaaggccggcgccatcatcggcgcgttcgggttcctgtacgccgcccaggacccgcacaagcctgaggccgggtacccccggggcattggcatccgcaacgcgctcttcgtgctcgccggcaccaacttcttgggcaccgtcatgacgctgctcgtccccgagtccaagggcaagtcgctcgaggtggtatcacaggaggtcgccgacgacgaggaggccgcgtaaaataaaactagatgcagcgttcagagaaatggatttgtgatggagcaggtggctgctgctgttactagcatagttgtttcgcgtagtggttgctagagtgtgccctcgatcagtcgatctgaagaagtagcagaaccatgatgtagctcgaaagtaaatccatggtgtacaaattatccttgtacttcagtctcagccctccctccgtgttgtgttgtgtccaagaagacgcgtgttcatgcaatgctcatagttaagaggctgtcgactggcataccatccgctgcagcagtgttctccgatcattcatccaaaaaaaaaaaaaaaaaaaa

SEQ ID NO: 6200 - protein, 522 aa, Panicum virgatum
  misc_feature: Ceres CLONE 1858210
  misc_feature: Great-hit functional homolog of the protein sequence given in SEQ ID NO 9533
  misc_feature: Great-hit functional homolog of the protein sequence given in SEQ ID NO 9537
  misc_feature: Great-hit functional homolog of the protein sequence given in SEQ ID NO 9538
  misc_feature: Useful for making plants with modulated phosphate use efficiency
MAGRQLNVLSTLDQARTQWYHFMAIVIAGMGFFTDAYDLFCISLVTKLLGRIYYTDTSRPDPGTLPPNVSAAVTGVALCGTLAGQLFFGWLGDKLGRKSVYGFTLVLMVVCSVASGLSFGRTPRGVVATLCFFRFWLGFGIGGDYPLSATIMSEYANKRTRGAFIAAVFAMQGFGILFGAIVALVVSAGFRAAYPAPPYSQDRAASLVPQADYVWRIILMFGTLPAALTYYWRMKMPETARYTALVARNAKQAAADMSRVLQTEIKESAARDERTVLAGEEWGLFSPQFARRHGLHLLATTSTWFLLDIAFYSQNLFQKDIFSKVGWIPAARTMNAVEELFRIARAQALIALCGTIPGYWFTVAFIDIVGRFWIQIMGFAMMTAFMLGLAVPYHHWTTPGHHTGFIVMYGFTFFFANFGPNSTTFIVPAEIYPARLRSTCHGISAAAGKAGAIIGAFGFLYAAQDPHKPEAGYPRGIGIRNALFVLAGTNFLGTVMTLLVPESKGKSLEVVSQEVADDEEAA

SEQ ID NO: 6201 - DNA, 2148 bp, Panicum virgatum
  misc_feature: Ceres CLONE 1858232
  misc_feature: Encodes the peptide sequence at SEQ ID NO. 6202
atttctgcccttttctctctccgtcccggcggcgttgccgttgctctgcgccgctctcctgtctccccaccagtagccgctgcgagagtagagtagcagaccccgccgccgcggccatgttctcctggatcctccgcggctgccgcgacgaggtgctgttcgagcatttcgccgaggagttcagggacaggtataagatcgatgtcgtggggcatgtaaaggcgagtatgaggttgagggcagcgtgcgagaaggcgaagaaggttctgagcgcgaatgcggaggctgtggtgaacatcgagtgcttgatggaggagaaggatgtcaggggggtgattcggagggatgaattcgagaagctatgtgctggactgctggagagggttgttgaaccttgcaagagggcggtggcagattcagggattggattggagaagctgcattctgtggaactcgttgggtctggttctcgggtaccttccatcgccaaggtgcttgcaggattcttcagaagggaacctagtcgcacactcaatgctagtgagtgtgtggctcgggggtgtgccttgcagtgtgcgatgcttagtcctgcattccgtgttcgggagtatgaggtgcaagatgctattcctgcttcgataggatttagcacaagagaaggcccaatttcgacattgtcaagtaatgcattattccggagaggcctgccatttcccagtgtcaaaacaattactctgcataagaacagcagttttaatttggatgcatattatgtggatgagaatgaattgcctcctggtacctcagcaaacattggtagtttccagattggcccattccaagcacataccgaagcttctaaagtcaaagtaaaagtccgtttgaatctacatggtctcatttcagtcgaatctgctgctttgatagatgattatcaaaggaatgcgaattctgctgaccatatggaggtggattccagtggtgatgatatgggtgacaagtcaagaagtgaaaggtctatccaccggcagtatttgccagtcgctgagtacatttatggtgcaatgagcaagcaggaattgctggaggctcaggagcaagagcaacaactggcttatcaggataaacttatggaacgaacaaaagacagtaagaatgcattagaatcttatgtatatgacacccgcaataagctttctgagaggtaccggagttttgctactgattcagaaagggaagaaatatcagttaatctacaacagactgaagaatggctttacgaagaaggtgatgatgagacagaagcggtttattgtagtaaacttgaggaactgagaaagcttgtagatcctattgaatatcgttgtaaagacgatgaagtgagagctgaagccacgagggagcttttgaagtgcatcgttgaccacaggatggctgccaagtcattatccacatctgaaagagaagctgttgacaacgagtgcaataaagctgagcagtggctaagggaggggttgcaacttcaagaatcgttgcccaagaatgtcgaccctatactttgttcctatgaaattaagagaaggggagaagagttggatatgttctgtcaaaacatagcaaggcacatgggctctccagcaagaacggatggcagcaggggttcagatcacatgcatacaccagatagagattagatgttcatgaggtttcttcactgtaggaccacgattgtcttacattctggtagcaatatatgaatgaatgagtttttgctaacaccatcatataatccaccctgtactatactgggcccgccattgggcaactgcgtcttggttctcaaggttcagggtgcagttttcacttgagagcctactaatcatgattattggtatttgtgaattcttttcctgtactcggagcaatgttgctgcctgcctcagtttgtgctgaatgaaaagaaccaaaagataattcgtacgcaagccacacgaggacaagtgactttttagcttgggagatttattgtttgttgatccaaggaagtttccctgaacggtttttatttcttatttttaaagaccttgcacagtacatttctcatagttcattcgaaatttgaatattgcaaaaaaaaaaaaaaaaaaa

SEQ ID NO: 6202 - protein, 525 aa, Panicum virgatum
  misc_feature: Ceres CLONE 1858232
  misc_feature (238)..(645): Pfam Name: HSP70 Pfam Description: Hsp70 protein
MFSWILRGCRDEVLFEHFAEEFRDRYKIDVVGHVKASMRLRAACEKAKKVLSANAEAVVNIECLMEEKDVRGVIRRDEFEKLCAGLLERVVEPCKRAVADSGIGLEKLHSVELVGSGSRVPSIAKVLAGFFRREPSRTLNASECVARGCALQCAMLSPAFRVREYEVQDAIPASIGFSTREGPISTLSSNALFRRGLPFPSVKTITLHKNSSFNLDAYYVDENELPPGTSANIGSFQIGPFQAHTEASKVKVKVRLNLHGLISVESAALIDDYQRNANSADHMEVDSSGDDMGDKSRSERSIHRQYLPVAEYIYGAMSKQELLEAQEQEQQLAYQDKLMERTKDSKNALESYVYDTRNKLSERYRSFATDSEREEISVNLQQTEEWLYEEGDDETEAVYCSKLEELRKLVDPIEYRCKDDEVRAEATRELLKCIVDHRMAAKSLSTSEREAVDNECNKAEQWLREGLQLQESLPKNVDPILCSYEIKRRGEELDMFCQNIARHMGSPARTDGSRGSDHMHTPDRD

SEQ ID NO: 6203 - DNA, 2264 bp, Panicum virgatum
  misc_feature: Ceres CLONE 1858308
  misc_feature: Encodes the peptide sequence at SEQ ID NO. 6204
caatcaagatcattatttctttctcctcccttgtccctgcccaaatcgcagggctgcgttcttgcaaatcgccttcggctttgccccaagattcgccgcccagcgccctcgctggaatcgtgggcgctgaggtgaggggaggactcgaggcggccgtcgcttgccgcttgtctcgtctcgtgaatcccccgccggtatcttgttctcttgcggcgattcaggctgatttagaggagggaattgttcgtatcggccccgttctgctcggtcgggaccgacgattcggggcagttctgaaggaaaagctaggtctttcttgtcgttagcttgagatcatccagtcccactcgccacaattgggcttcacaacctgtctcctaatcatcctggaatgcggtttgccggagccccgtagaagattgagaaatttaagaggcatctgatacgaggtcttcttgtgcgcgctgaaggaagggagctgtgccgtgaaggcctcatcttgggcatccatgggattcctcagccttgtgggcaactcctttgggtgctctgcttccggtgagcggcttgtctcagctgcccgcgacggcgacctgcaggaggcgcgtgcgctcctcgagtacaaccctcgccttgcccggtactccacatttggcggccgcaactcaccgctgcactatgccgctgcgcaaggccaccatgagattgtctctctattgcttgaatccggcgttgagatcaaccttaggaattacaggggccagactgctttgatgcaagcctgtcaatatggccactgggaggttgttcaaacactgattctcttcaatgcaaatgttcacaggacagattatctcaatggtggaactgctgtccatttcgctgccctgcatggtcatgcccgatgccttcgtcttgttcttgcagattacgtgccaagcataccaaatttcttcacccagacaaatcatagatcatctgaagaagattcaactactgattttgatcatgatgctttggtcaagatggtaaatcacaaggcggatggaggcttaaccccacttcatatggcagcgttaaatggacatgtagagtgcgtgcaacttttactggacttaggagcatctgtttctgaggttactattgaggatggaacgactatagacttaataggagctggtagcaccccacttcactatgctgcttgtggtggaaatgttgtctgttgtcaactccttattgctcgaggggcttccattactgcacaaaatgctagcggatggaccccattgatggtggctcgttcctggcaacgaaattcaattgaagaaattttaagtaacgaaccagagggccagatacgcactcttccatctccatatctttgtcttccactcatgagtatcatgaacattgcaagggagtgtggatggagatacctaaaccagtcgcctgtttgtattgacccctgtgctgtctgcttagacgggagctgttctgttgctgcagaaggttgcaaacatgaattctgcacaaggtgtgctctatacctttgttcaactagctacacatcagtgagcccagcgggcgcaataccatgtcctctctgtagacatccaatcatctctttcatcactcttcctggcacgagccctataagagagctgccgagaaacagcctttcattgtcattttgcacaacatgcccagcagttaactccgattcttctgcttcgattgctgcccatctgtaccggactgaattccagtgtgggcgcatgccaccgatgggctcgtcctccttccgctcgctgagctgccagaggataccagcgatgaaactgaacccagcattttgtatgggtggcatggaaacaaatccctgccttataagatgctcgaggttcgggtctagcttgcggcgctcagcttcccatggagagactaccagaagagcctggcctgtaacttttaacccaattgttgctactggcaactgatagagcgaataggcatttgcatctccccagttttgtgctctttttgagttgaggtctgtttttgtgtattctttggttggcttggtctgatgttcgcgtcccgttgtggtatgaattcgccggtcccaacttcttgttgatatatcaggagcaacatgtaaccactaccttttcggtttgtaaataaccttgtggtgttgtatattttctgggaagcaatgaaatgcagaggcatcgatttttcaaaaaaaaaaaaaaaaaaaa

SEQ ID NO: 6204 - protein, 496 aa, Panicum virgatum
  misc_feature: Ceres CLONE 1858308
  misc_feature (1)..(50): Pfam Name: zf-C3HC4 Pfam Description: Zinc finger, C3HC4 type (RING finger)
MGFLSLVGNSFGCSASGERLVSAARDGDLQEARALLEYNPRLARYSTFGGRNSPLHYAAAQGHHEIVSLLLESGVEINLRNYRGQTALMQACQYGHWEVVQTLILFNANVHRTDYLNGGTAVHFAALHGHARCLRLVLADYVPSIPNFFTQTNHRSSEEDSTTDFDHDALVKMVNHKADGGLTPLHMAALNGHVECVQLLLDLGASVSEVTIEDGTTIDLIGAGSTPLHYAACGGNVVCCQLLIARGASITAQNASGWTPLMVARSWQRNSIEEILSNEPEGQIRTLPSPYLCLPLMSIMNIARECGWRYLNQSPVCIDPCAVCLDGSCSVAAEGCKHEFCTRCALYLCSTSYTSVSPAGAIPCPLCRHPIISFITLPGTSPIRELPRNSLSLSFCTTCPAVNSDSSASIAAHLYRTEFQCGRMPPMGSSSFRSLSCQRIPAMKLNPAFCMGGMETNPCLIRCSRFGSSLRRSASHGETTRRAWPVTFNPIVATGN

SEQ ID NO: 6205 - DNA, 1360 bp, Panicum virgatum
  misc_feature: Ceres CLONE 1858376
  misc_feature: Encodes the peptide sequence at SEQ ID NO. 6206
attctcactcgtacctccaattcctttctccccggacgacgacgacgacaatggccagtgccccctcttctctcctcgtcctgctcgccgccatggcggtggccgcactcgccgtggcgccagcctcgtcggcggcggacctgccatccggcttcgcgtccattgcatccaagatccccaacccgtggtcagccttcaagaacctcaccggctgccacttcggcgaggagcagcagggcctcgccaagctcaagggctacctctcccacttcggctacctccccgagtcgccggggttcgacgacatattcgacgccgacctggaggaggccatcaaggtgtaccagcgcaacttcggcctcaacatcaccggcgcgatggacgcgccgacggtggcccagatgatggcgccgcggtgcggcgtcgcggacgtcgtcaacggcacctccaccatgggcggcgcctcgtcgtcatcgcacgcccacggccggaacctctacacctacttcccgggagccccgaggtggccgcgctccaggcggagcctccggtacgccatcgcgcagaccgccgggacaaccatcaaccgggcggcgctgagccgggtgttcgcgcgcgccttctcgcggtggtcggcggccacgacgctcaacttcacggagaccgcgtcggagcaggacgccgacatcaccatcgggttctacgcgggggaccacggcgacggcgaggcgttcgacgggccgctgggcacgctggcgcacgccttctccccgacggacgggcggttccatctggacgccgccgagtcgtgggtggccgccggcgacgtgtcgcgggcgtcctcggccgccgccgtggaccttgagtccgtggccgtgcacgagatcgggcacctcctcgggctgggccactcgtcggagcccggcgccatcatgtacccgaccatcacgtcgcgcaccaggaaggtggacctcgccgcggacgacgtcgtgggcatccagagcctgtacggtggcaacccaaacttcaaaggcgtcgctccgccggccacgagcagccgggagatggacagcgccgccggcgcgcgctcccggccgtggagcacgctggtggccgtcgtcgtggccgccgggctcgcggtagcgttgtagtgagcgggcagattttctgtcggcgttgaccgttctactctgctcttttactttttattaccttcagctgattcggatggtagagtagaatttgtttgtcttggggggtaattcttgcgtagatcagtggatatacatttgtaatttactacttgatacatggtagacacatggattatagatttatagaatctaatccaattgggatt

SEQ ID NO: 6206 - protein, 366 aa, Panicum virgatum
  misc_feature: Ceres CLONE 1858376
  misc_feature (1)..(164): Pfam Name: Peptidase_M10 Pfam Description: Matrixin
MASAPSSLLVLLAAMAVAALAVAPASSAADLPSGFASIASKIPNPWSAFKNLTGCHFGEEQQGLAKLKGYLSHFGYLPESPGFDDIFDADLEEAIKVYQRNFGLNITGAMDAPTVAQMMAPRCGVADVVNGTSTMGGASSSSHAHGRNLYTYFPGAPRWPRSRRSLRYAIAQTAGTTINRAALSRVFARAFSRWSAATTLNFTETASEQDADITIGFYAGDHGDGEAFDGPLGTLAHAFSPTDGRFHLDAAESWVAAGDVSRASSAAAVDLESVAVHEIGHLLGLGHSSEPGAIMYPTITSRTRKVDLAADDVVGIQSLYGGNPNFKGVAPPATSSREMDSAAGARSRPWSTLVAVVVAAGLAVAL

SEQ ID NO: 6207 - DNA, 2305 bp, Panicum virgatum
  misc_feature: Ceres CLONE 1858407
  misc_feature: Encodes the peptide sequence at SEQ ID NO. 6208
atccgcttcctctctctctctctctctctctctctctctctctctctctttctctgggctcccaagctccagctctcaaccctagcacgcgggttatatccagagcctccggtcccgtcttcttcctcaaacccgatcgatcgatcgctgagctgactccaacccgctccatgtatggcaattccgcggcacgggcagtactaggacgacgtaccagctgctagtcccttcaagattcaagggggtggctagcgaggtgccgtccccaccgctgccgcctgccggagcaggacaagcactagctgatctgggcgcagctgcaagtaccaccacggcggcacatgcatgatcggcccgcccgcccgtgagatccgatcctgctgcgcctgcgcctgcatgcgcgcgagctgatccgtccgtcatcttcatccatccacacacaagcgtggtagcggctgctgctggtagcaggcgagagcgtgcatcgagaagaagatctcgtatcggtcgggaagatgatgctcaaggatctggcggcgattcagcagcagcagcagcacatggccgccgacgagaacatgtccaacctcacctccgcctccggcgaccaggccagcgtctcctcccacccgctcccgccgcccgccaagaagaagcgcagcctccccgggaatccagaccccgacgccgaggtgatcgcgctgtcgccgcggacgctgatggcgacgaaccggtacgtgtgcgaggtgtgtggcaaggggttccagcgcgaccagaacctgcagctgcaccggcgcggccacaacctgccgtggaagctcaagcagcgcaaccccaaggaggcggtgcgcaagaaggtgtacgtgtgcccggagcccggctgcgtgcaccacgacccggcgcgcgcgctcggcgacctcaccggcatcaagaagcacttcagccgcaagcacggcgagaagaagtggaagtgcgaccgctgcgccaagcgctacgccgtccactccgactggaaggcgcactccaaggtctgcggcacgcgcgagtatcgatgcgactgcggcaccctcttctcaaggagggacagcttcatcacgcaccgggccttctgcgacgcgctcgcggaggagagcgccagggcggtgaccgcggcggcggcggcggcggcggtggcgggccagcaccaccccgggatgctcttctcgcagggcgccgggggcgacgagggcgccgccgcgggcgggctgcacctgccggcggtgctggaccagtcgcagccgctgggcgggcacgggatgtccttgcaagagctgtgcctcaagagggagcagcagcagtttgcgccggcgtggctcacggcccagcagcagcagcagcagcacctggagctgcagacggctggctccggtagcgtggccgtgttcgggtcggcgagggcgctggacccagactacatcgggagctccacgccggagagcacggcgcagccggcgggcctcgggttcgggttctcgccgtcgtccgccgctgccacagcctccgcgcacatgtcggccaccgcgctgctgcagaaggcggcgcagatgggtgcaacgctgagccggccgtcgaaccagggccagatggcgagcacccacagcaccagcaccaccagtgctgccactgccaacgcagcaggcaacgtgcccagcactggcgccggtgccgtcggcttcggggcatctcatcactttggagtggatgagaggaccagggccgatcgcgacgccggtagcggcggcaatgccgccgtgggtgccggcgccggaggcggcaacgacggcctcacccgggacttcttggggctccgggcgttctcccacggcgacatactgagcatggccgggttcgatccctgcatgtcgtcgccctcgtcggcggcgtacgagcaagggcaccagagcagcaagcagtggcatgtctagtcatcggctcaatcccatagctcgccatggatgaatattcatatccaagatgaggtgcagcatgcatgcatgcacgacattgctcgatcttgtcggtcgagatcgaacttggggtaagtcggatcgatcaaatcctcagatcgcttttttttttctgttggcactagttttgatgttcatttgggggtatgggcatttcaattcttatataaacttcaaggcgctacatatatggaagacttggaaacgtttatgctactatatatatcatagttgactcatgcatgttcttggccagaatttatactgtattatccatctaaaaaaaaaaaaaaaaaaaa

SEQ ID NO: 6208 - protein, 482 aa, Panicum virgatum
  misc_feature: Ceres CLONE 1858407
  misc_feature (1)..(23): Pfam Name: zf-C2H2 Pfam Description: Zinc finger, C2H2 type
  misc_feature: The sequence is a functional homolog of  SEQ ID NO 1086 in the  10/666,642 US patent application
  misc_feature: The sequence is a functional homolog of  SEQ ID NO 1087 in the  10/666,642 US patent application
  misc_feature: The sequence is a functional homolog of  SEQ ID NO 312 in the  10/666,642 US patent application
  misc_feature: Useful for making plants with modulated growth and phenotype characteristics
MMLKDLAAIQQQQQHMAADENMSNLTSASGDQASVSSHPLPPPAKKKRSLPGNPDPDAEVIALSPRTLMATNRYVCEVCGKGFQRDQNLQLHRRGHNLPWKLKQRNPKEAVRKKVYVCPEPGCVHHDPARALGDLTGIKKHFSRKHGEKKWKCDRCAKRYAVHSDWKAHSKVCGTREYRCDCGTLFSRRDSFITHRAFCDALAEESARAVTAAAAAAAVAGQHHPGMLFSQGAGGDEGAAAGGLHLPAVLDQSQPLGGHGMSLQELCLKREQQQFAPAWLTAQQQQQQHLELQTAGSGSVAVFGSARALDPDYIGSSTPESTAQPAGLGFGFSPSSAAATASAHMSATALLQKAAQMGATLSRPSNQGQMASTHSTSTTSAATANAAGNVPSTGAGAVGFGASHHFGVDERTRADRDAGSGGNAAVGAGAGGGNDGLTRDFLGLRAFSHGDILSMAGFDPCMSSPSSAAYEQGHQSSKQWHV

SEQ ID NO: 6209 - DNA, 1770 bp, Panicum virgatum
  misc_feature: Ceres CLONE 1858438
  misc_feature: Encodes the peptide sequence at SEQ ID NO. 6210
ctctccccttcacgccacagccacaccacaagtgtccggcggctccggcctcagaatcggatcaaggcaagcaaccggagacgcggccgcctctgcccgaggcctgcataaaaaagatctcgcgctccctccgtcccgtcgtcctcgcgagcagcttaatttcgtccgtccctctctcccggcgtctcgtctcgcgactgcctgtggtgggcggcggttgatcggcttggtccgcggcgagctcccccctgacatggtcggccggatggagcggcagaccgcgtcttcgtcggcgtcctgctcgccctccaccgcggcctcgtcctcctcggcctgcggtggcaagaagcggtctgatttcctcagcatgttccggagtgcagcctgtcttaattcatcatctgctgatactggcaagggaaggagtaaactctcaagcaacaaaatcacacatggcttccacctggtcgaaggcaagtctggccatgacatggaagactaccatgtagcagagtacaagtatgagaagaaccatgagctaggcctctttgccatttttgatggccatttgggagataaggtgccaagttacctgaaaactaacctttttagcaacataataaaagagcctgtcttctgggatagccctcaagacgcaataaagaatgcataccgctctacaaacaaatacattctagaaaatgctaagcaacttggaccaggtggttctacagcagttactgctattgtagttgatggcaaggatatgtggatagcaaatgtaggtgactctcgagctgttgtgtgtgaaagaggtgctgctaatcagctcactgttgaccatgagccacatacaactaatgaaagacagaggattgagaaacagggtggctttgtaacaacatttcctggtgatgttcctcgggtaaatggccagcttgctgttgctagggcatttggtgaccaaagcctcaaggcccacttgagttcagagcctgatattagacatgtaccaataaactcaagtatagaattcgtcatacttgccagtgatagattatggaaggtaatgaagaaccaggaagctgttgatcttgtgaaatccattaaggacccccaggcagcagcgaagcggctgacgacggaagcacttgcaagaaagagcaaggatgatatctcttgcattgtcatccgtttccgctgttgaatctcacctgcgcactacattaatctccaacgattgagacaatcgtctgtgatcgtcttcctctgtcaaatttctgatagcatctgctgtgcctatttgccgaatttccaatagcatctgctgtgcctatttgcccaatttctgatagcatctgctgtacctatttgccgaatttctgatagcatctgctgtacctatcatagttgtggacaaacctggaactaattaggacattgaagacatgagagctagatggcgagtgtgtgcgcagggtgctcattcgtctgtgagtatatacaccagcatactctagttgacctggacttgctgtctgtccggaccttagtgcttgtgtgcttgtgatggtaatggaccaatggtggcaaaggttgtgtataggagcttgctgacttaatttggttatatttagtttttatggctcgcattcatagggtaggtgcctctgatctcaatgaaacagatttaagttcaaagttttgtccttgaggtttcttacagtggtattcaaagttaagtattggcaaaaaaaaaaaaaaaaaaaa

SEQ ID NO: 6210 - protein, 317 aa, Panicum virgatum
  misc_feature: Ceres CLONE 1858438
  misc_feature (1)..(244): Pfam Name: PP2C Pfam Description: Protein phosphatase 2C
MVGRMERQTASSSASCSPSTAASSSSACGGKKRSDFLSMFRSAACLNSSSADTGKGRSKLSSNKITHGFHLVEGKSGHDMEDYHVAEYKYEKNHELGLFAIFDGHLGDKVPSYLKTNLFSNIIKEPVFWDSPQDAIKNAYRSTNKYILENAKQLGPGGSTAVTAIVVDGKDMWIANVGDSRAVVCERGAANQLTVDHEPHTTNERQRIEKQGGFVTTFPGDVPRVNGQLAVARAFGDQSLKAHLSSEPDIRHVPINSSIEFVILASDRLWKVMKNQEAVDLVKSIKDPQAAAKRLTTEALARKSKDDISCIVIRFRC

SEQ ID NO: 6211 - DNA, 2871 bp, Panicum virgatum
  misc_feature: Ceres CLONE 1858525
  misc_feature: Encodes the peptide sequence at SEQ ID NO. 6212
ataatgagcatgtgcaatgtggttctttagttttctttagttcaaattacaaaaaaaatccagtaattttatagtatggctgattatttaggcattaatagttttttgtctaccatcagcggacaaaattctcatacttatagaaaaagaaagatgtctcctttgtccctttctttttgcttggcatatactaaactggaattatctccatcaatgggttacattttctcaaagaagattgtggcatgttgtgaatttgttttactcccactaatgttatttttgtcatgtaggcatggttcgcccaagcctatgaattatggctcatacctcattcgccttcaaaatttactattgaagaggacgctaagaggagaacactacttaaagctgtacagctaccgctacttggttaatggttttgctgttgtccttactcctcagcaggcagacaagctatcgaggagaaacgaagtagcaaatgtgatgttggactactcagttaggacagcaacaactcacacccctgaatttcttggactgccgcaaggagcctgggttcaagaaggtggtccgcaattcgctggtcagggtgttgttgttggcctcattgacacaggaatagatccaacccaccctagcttcgcagatgatctgtcaactgatagttatccagtccctgctcgctactcaggaatttgtgaggttacaaatgattttccatctggatcctgcaacagaaagctagtaggtgctcggcattttgcagcatctgcaataactagaggagtattcaatgcttctcaagatcttgcttcaccatctgatagtgatggccatgggacgcatacagcatccattgctgctggtaatcacggaattcctgttgttgtggctggacatcaatttggaaatgcaagtggcatggctcctcgtgcacacattgctgtctataaagctctttacaaaagctttggaggttttgcggctgatgtagtggctgcaatagatcaggcagctgaagataatgttgacatcatcagcttatccattactcctaatcggagacctcccggactggctacattcttcaacccaatagatatggcacttctttcagctgtaaaggctggcatatttgtggtgcaggctgcaggaaatactggcccttcccctaagagcatgtcttcctacagtccttggatatttactgtaggagcttctgcccatgacagggtatataacaattatgttgtacttggcaacaatttaaccattcaaggagtcggacttgctcctggaacggacggtgatagcatgtacactctaattgctgcacctcatgcactgaaaaacaatacagtcagtcctactgagatgtcccttggggagtgccaagattcaagtcgcctagatgctgatttgataaaaggaaagatactagtgtgcagctattctataagatttgtacttggtctttcttcagtgaaacaagctttagatacagccaacaatgtcagtgctgcaggagttatattctatttggacccatttgttcttgggttccagttgaacccaactccaatgcgcatgcctggacttataataccatcgtctgatgactctaaggtatttctcacttactacaatgattccctagtgagagatgagacatcaggccaaattatcagctttggtggtgttgcaaaaatattagggggcctaaatccgaattatggaaattctgcaccgaaagtaatgttctattctgctaggggtcctgaccctgaggacaactcactgtcaaatgctgatatcttgaaaccaaatctgatagcacctggaagttccatttggggtgcttggagttcccttggattggattctgctgaatttgctggtgaaagttttgcaatgctctcgggcacaagtatggctgcaccccatgttgccggccttgctgctctaatcaagcagaagtttccttcttttagcccagcagctatagcttctgcattgtctacaactacaactcttagtgacaggcaagggaaaccaatcatggcacagcgaacatacagcaacccagactcaacgcaatctcctgctacagcttttgatatggggaatggctttgtcaatgctactgctgctttagacccggggataatatttgattgcagttacaacgatttcttctcctttctctgtggcataaacgggtcgggcccagtagtgacaaactacacaggcaacagctgtgcggcttccaccatgacaggagcagatctaaaccttccctcaatcaccatagccgtgctcaaccagacaagaaccataactagaacggtgacaaatgtggcgactgatgagagctacacggtcagctacagtgctccctacggaaccgtagtctccgtggcaccagcgcagtttgtcattccgagcgggcagaagcagctcgtgaccttcgttgtaaacgccaccatgaagagctccactgcgagcttcgggagcgttgggttctatggtgacaaaggccaccaggcgatcatcccgttctctgtgatctccaaggttgtatacggttcctgatgactgactagctgagctgatcctgtggatgcaaagcaaaccagggcctgactgatccaacatatgcagtgaagacttagactgctgggggtggagtggagcttaccttgactagggattctttcttggttgtggtgtgtacattctgaagcacgtttgatgtaagtagctgagtgattaaccagtaactgtaaagagaatgtaccagagcaacctatttgccacgaatgtggaaatccttttgcaacagaatgataaaaaaaaaaaaaaaaaaaa

SEQ ID NO: 6212 - protein, 839 aa, Panicum virgatum
  misc_feature: Ceres CLONE 1858525
  misc_feature (1)..(538): Pfam Name: Peptidase_S8 Pfam Description: Subtilase family
  misc_feature (607)..(653): SWISSPROT Homolog: EC 3.4.21.62 Subtilisin Savinase
MADYLGINSFLSTISGQNSHTYRKRKMSPLSLSFCLAYTKLELSPSMGYIFSKKIVACCEFVLLPLMLFLSCRHGSPKPMNYGSYLIRLQNLLLKRTLRGEHYLKLYSYRYLVNGFAVVLTPQQADKLSRRNEVANVMLDYSVRTATTHTPEFLGLPQGAWVQEGGPQFAGQGVVVGLIDTGIDPTHPSFADDLSTDSYPVPARYSGICEVTNDFPSGSCNRKLVGARHFAASAITRGVFNASQDLASPSDSDGHGTHTASIAAGNHGIPVVVAGHQFGNASGMAPRAHIAVYKALYKSFGGFAADVVAAIDQAAEDNVDIISLSITPNRRPPGLATFFNPIDMALLSAVKAGIFVVQAAGNTGPSPKSMSSYSPWIFTVGASAHDRVYNNYVVLGNNLTIQGVGLAPGTDGDSMYTLIAAPHALKNNTVSPTEMSLGECQDSSRLDADLIKGKILVCSYSIRFVLGLSSVKQALDTANNVSAAGVIFYLDPFVLGFQLNPTPMRMPGLIIPSSDDSKVFLTYYNDSLVRDETSGQIISFGGVAKILGGLNPNYGNSAPKVMFYSARGPDPEDNSLSNADILKPNLIAPGSSIWGAWSSLGLDSAEFAGESFAMLSGTSMAAPHVAGLAALIKQKFPSFSPAAIASALSTTTTLSDRQGKPIMAQRTYSNPDSTQSPATAFDMGNGFVNATAALDPGIIFDCSYNDFFSFLCGINGSGPVVTNYTGNSCAASTMTGADLNLPSITIAVLNQTRTITRTVTNVATDESYTVSYSAPYGTVVSVAPAQFVIPSGQKQLVTFVVNATMKSSTASFGSVGFYGDKGHQAIIPFSVISKVVYGS

SEQ ID NO: 6213 - DNA, 1888 bp, Panicum virgatum
  misc_feature: Ceres CLONE 1858559
  misc_feature: Encodes the peptide sequence at SEQ ID NO. 6214
ggcgtgacggggagacctgcccgacacggcgcgcccccccggccaatcacctcctcccacctcgccgcctcctcccttctcccccctcctctccctttctctcctttcccctctcttcccccacgcgcgcgcgcacaccaccgttccattccactcccacccttcgcctcctctccacccaccccaccccacctcaccgaggctatagccgtacccttgcttgctcctcgcctccgccacttgctcctgctgctcgtgtatttgggggggggggaggggcgtggtgtctggaactcttctatctcttcgcggtggtggttcttcggcgccgcggtgggcggggggaagcgcggttcggggggagggggagttttttttctttccctatttcgctgtgattttgcgatggcggcggcggcggcgatctgcgtggaggacgaggcagcgtgcgccgcggcggaatgcgcggggatcgagaagctggatctcgccgccggtggctgcggcggcggggccgagggcaaggccgggctcgcgggcggcaagaggagcgtgtacctcatggcctgcgcgccggtctggggctgcgcgtccacgcgcggccgcagcgccgagatggaggacgcctgcgcggcggcgccgcggttcgcgcacgtgccggtgcgcctgctcgccagccgccgggacctcgacgggctgggcctcgacgccgacgagctccggctgcccgcgcacctgttcggcgtcttcgacggccacggcggcgccgaggtggcgaactactgccgggaaaggctccaggtgctcttgagccaggagctgagccggctcggcaaggatttgggggaggtgggcgtggtggacatgaaggagcactgggacgagctgttcagcaaatgtttccagagagtagatgacgaggtgtcagggcgggtgagcaggctcgtcggcggtgtacaggagtccaggcaggttgccccggagaacgtgggctccacggcggttgtcgtggtcgtgtgctcatctcatttggtggttgcaaactgtggagattcacgggttgtgctctgccgagggaaggagccagtggcgttgtccattgatcacaagcctgacaggaaggatgagcgagcgaggatcgaggccctgggaggcaaggtcatccaatggaatggttaccgtgtgtccggtatacttgctatgtcgcgatcaataggggatcgatatttgaaaccgtttgtcatttcaaaaccagaagttacagtcattcctagggcgaaagatgacgactgtctcgttcttgcaagtgatggactgtgggatgttgtatcaaatgaagaggcatgcaaagttgcacggcgacaaatccagttgtggcacaagaacaatggcgttacaacatcgttgtgtgacgaaggtgatgaatccactgatccagctgcgcaatccgctgctgattatcttatgaggctcgcattgaagaagggaacagaggacaatgtcactgtcattgtggtcgacttgaagcctcgaaagaagcttaagaacaactcataacatgagctggattaatcgggagtagctgaccatgatatgtctaaaagagttcatactgctagttggtcgtccgcctgagacttgacccacagttttttttccgttgggcctcaagaattgtacatgtatatgctagatgcattgtccatctaggggagcatgatgttacccccacgttggattctggtggctaaaatgacctgaagtcatcttctaccttgagccctgccacttagtataccccttgtaatgctgtatgatagtcgaacctgtaaagagccaagcggctgagacagacactgaaattaacatactgttacctttatgattc

SEQ ID NO: 6214 - protein, 383 aa, Panicum virgatum
  misc_feature: Ceres CLONE 1858559
  misc_feature (1)..(310): Pfam Name: PP2C Pfam Description: Protein phosphatase 2C
  misc_feature (109)..(381): SWISSPROT Homolog: EC 3.1.3.16 Protein phosphatase 2C ABI1
  misc_feature (95)..(383): SWISSPROT Homolog: EC 3.1.3.16 Protein phosphatase 2C ABI2
MAAAAAICVEDEAACAAAECAGIEKLDLAAGGCGGGAEGKAGLAGGKRSVYLMACAPVWGCASTRGRSAEMEDACAAAPRFAHVPVRLLASRRDLDGLGLDADELRLPAHLFGVFDGHGGAEVANYCRERLQVLLSQELSRLGKDLGEVGVVDMKEHWDELFSKCFQRVDDEVSGRVSRLVGGVQESRQVAPENVGSTAVVVVVCSSHLVVANCGDSRVVLCRGKEPVALSIDHKPDRKDERARIEALGGKVIQWNGYRVSGILAMSRSIGDRYLKPFVISKPEVTVIPRAKDDDCLVLASDGLWDVVSNEEACKVARRQIQLWHKNNGVTTSLCDEGDESTDPAAQSAADYLMRLALKKGTEDNVTVIVVDLKPRKKLKNNS

SEQ ID NO: 6215 - DNA, 1750 bp, Panicum virgatum
  misc_feature: Ceres CLONE 1858570
  misc_feature: Encodes the peptide sequence at SEQ ID NO. 6216
gagatgggcagtatgtgcggtctgccaatccgtttgccgattgggagcgtgcggttcggatggctctggttccccaatcactcccctcccccttcttccctggcggcgacggctgggcgagcggcgccgcccttcaccggcgacgaccacccaccaggtactctttgctgtctatcatgtgctgggaaatgaggccgcagctcgggacgacgcggcgcgccatctggagaagctggcccgtcctatgttcacaccacaagctgtccacatcttcccactccgcaaacaaggtcgccatggccaccgcctccccgccaccagccgagaagaagaggaacaagggcacggtcattgtcatctcaggcccgaccggcgccgggaagagcaggctcgcgctggaggtggccaggaggctcggaggcgagatcatcagcgccgactccgtccaagtctaccgcggcctcgacgtcgggtccgccaagccgtccgcggcggagatgggcgcggtgccgcaccacttgatcgacatactggacaccaccgacgattactccgccggggccttcttccgggatgcccgcagagcgacgcagcatgtccttgacaggggccgcgtgcccgtcgtcgcgggagggaccgggctctacctgcggtggtacatctacggcaagccagatgttccgcaatcctccatggacactacttccgctgtgtggtctgagctcatcggtttcagggagagcggccagtgggaggaagcggtggagctagtggtccaggctggcgaccccaaagctctggacttgtccgtgaataactggaataggttgagtcgcaggctcgagattatcaggtcatcaggctcccctctgtctgccttcaccttaccgtacaattcgtttcatgaacatcaagttgacgccaagctaaccgaggtctccgctgacggaaattgtgaaaccgggaagctggattacgacttcttctgtattttccttgcaagttcacgcgttgagctgtaccggtcaattgatctgaggtgtgaagagatgctggctgacacaggaggcttactttcagaagcgtcgtggctgcttgatatcggtctgcatccgcacattaactctgcaactcgtgccattggttacaagcaaaccatggagtacctgctgcaatgtaggcagaatggtggcgagagcaccccacaggaattcctccagttcctggccaaatttaagagtacatctaggaacttcgcaaagaggcagattacctggttccgcaatgagatgatctaccagtgggtcaatgcttcacagcccttcgaggaagttgttcaatttatttgtgatgcttaccatgaccgtggtgcaagggtggttcctgaatcacttgaaatgaaaagggaaagttgcatgcataaagcctgtgatctcaaaacctatcgctcagagaacagggtgttccgtggggatgacgactgctctcatattttggattggattaggagaacacagcggaaatgaggtctagttctactctctagtccttttttttccaccttgaaattgtcctggttttgggtgttgaccaattagcagatgatttttagggcaatacatagataattgaggaatttagtttataggtttgaattctgtttttcatcatagtgcaaatgccttggcaaagtgccacatcggaatgaaaaatcaggttgcttctttggcaaaaaaaaaaaaaaaaaaaa

SEQ ID NO: 6216 - protein, 488 aa, Panicum virgatum
  misc_feature: Ceres CLONE 1858570
  misc_feature (1)..(290): Pfam Name: IPPT Pfam Description: IPP transferase
MALVPQSLPSPFFPGGDGWASGAALHRRRPPTRYSLLSIMCWEMRPQLGTTRRAIWRSWPVLCSHHKLSTSSHSANKVAMATASPPPAEKKRNKGTVIVISGPTGAGKSRLALEVARRLGGEIISADSVQVYRGLDVGSAKPSAAEMGAVPHHLIDILDTTDDYSAGAFFRDARRATQHVLDRGRVPVVAGGTGLYLRWYIYGKPDVPQSSMDTTSAVWSELIGFRESGQWEEAVELVVQAGDPKALDLSVNNWNRLSRRLEIIRSSGSPLSAFTLPYNSFHEHQVDAKLTEVSADGNCETGKLDYDFFCIFLASSRVELYRSIDLRCEEMLADTGGLLSEASWLLDIGLHPHINSATRAIGYKQTMEYLLQCRQNGGESTPQEFLQFLAKFKSTSRNFAKRQITWFRNEMIYQWVNASQPFEEVVQFICDAYHDRGARVVPESLEMKRESCMHKACDLKTYRSENRVFRGDDDCSHILDWIRRTQRK

SEQ ID NO: 6217 - DNA, 1851 bp, Panicum virgatum
  misc_feature: Ceres CLONE 1858581
  misc_feature: Encodes the peptide sequence at SEQ ID NO. 6218
aacccaccaccaccggatcagctgctagcttcctcctcccacatcaggcggcgccagccgaggacaccgtcggagcccacaaccacccacccgaataaggcacccgcacaccccacctccggccggccggaaacaccgcgcgcccggaatggagaacggcaacggcgcgtcgccgtgctgcaacggcaacggcaacggcaacggcgcggcggcggcggcgccgccgccgcacgtggcgatgctggtgacgccggggatgggccacctgatcccgctggcggagctggccaagcggctggcgcggcggcacggcgcgacggcgacgctcctcacgttcgcgtcggcggcgtcggccacgcagcgcgcgttcctggcgtcgctgccgcccgccgtcacctccctggcgctcccgcccgtcgacctctccgacctgccccgcggcgccgccatcgagacgctcatgtccgaggagtgcgcgcgcagcgtgccggcgctcaccgacatcctccgggacctgcggcggcgcacccgcctcgtcgccttcgtcgccgacctcttcggcgccgactcgttcgacgccgcgcgcgccgcgggggtcgcccggcggtacctcttcttcccctccaacctccacgcgctcacgctcttcctccacctcccggagctcgacgccgccgtgcccggcgagttccgcgacctcgccgagccgctgcgcctccccgggtgcgtgcccatcccggggcccgacgtgctcatgccgctgcaggacaagtccaacccctgctacaggtggatggtccaccacggcgccaagtaccgcgaggccgacgccatcctcgtcaactccttcgacgccgccgagccgggccccgccaagatcctccggcagccggcgcccgggcgccccgccgtgttccccgtcggcccgctcatccaggccgaccgcggcggcagcgacgggccgtgcccgtgcctcgagtggctcgaccggcagccggcccggtcggtcatcttcgtctccttcggctccggcggcgcgctgccggccgagcagatgcgggagctcgcgctcgggctggagctcagcgggcagcgcttcctgtgggtggtgcggagccccagcgacgagggcgccgtcaacgacaactactacgacgccgagagcaagaaggaccccttcgcgtacctgcccgagggcttcgtcgaccggacccgcgacgtgggcctcgtggtgccctcgtgggccccgcagataaaggtcctggcccacggggccaccggcgggttcctgacgcactgcgggtggaactcggtgctggagagcctcgtgtacggcgtgcccatggtggcgtggccgctctacgccgagcagcggcagaacgcggtgatgctgtcggagggggtcggcgtcgcgatccgcgtccccgagtccaaggggcgggagaagatcgcggcggcggtgcaggaggtgatggagggtgagggcagaggcgccgcagtgcgggccaaggtggcggagctgcagaaggccgcggcggaggggctccaggaaggcggcgccgccacggcggcgctcgccgaggtggtggagaagtggacgtgcgaggagaactagagatgatgctgagctgagtgtgcagctgccaatccatcccattcacagctactatcctccccctccagcaccaccatctttggggcctagccggctccatggtttgtccgtttgtaaattattccaaacttttgatttgtattttgtatcttatcatacaacctgtaactatccatgcatgtcctactccattggtaggtaggagtatactaataaggtagctttgtgcgtatcag

SEQ ID NO: 6218 - protein, 488 aa, Panicum virgatum
  misc_feature: Ceres CLONE 1858581
  misc_feature: Great-hit functional homolog of the protein sequence given in SEQ ID NO 9586
  misc_feature (1)..(148): Pfam Name: UDPGT Pfam Description: UDP-glucoronosyl and UDP-glucosyl transferase
  misc_feature (27)..(483): SWISSPROT Homolog: EC 2.4.1.218 Hydroquinone glucosyltransferase
  misc_feature: Useful for making plants with altered Lignin content
MENGNGASPCCNGNGNGNGAAAAAPPPHVAMLVTPGMGHLIPLAELAKRLARRHGATATLLTFASAASATQRAFLASLPPAVTSLALPPVDLSDLPRGAAIETLMSEECARSVPALTDILRDLRRRTRLVAFVADLFGADSFDAARAAGVARRYLFFPSNLHALTLFLHLPELDAAVPGEFRDLAEPLRLPGCVPIPGPDVLMPLQDKSNPCYRWMVHHGAKYREADAILVNSFDAAEPGPAKILRQPAPGRPAVFPVGPLIQADRGGSDGPCPCLEWLDRQPARSVIFVSFGSGGALPAEQMRELALGLELSGQRFLWVVRSPSDEGAVNDNYYDAESKKDPFAYLPEGFVDRTRDVGLVVPSWAPQIKVLAHGATGGFLTHCGWNSVLESLVYGVPMVAWPLYAEQRQNAVMLSEGVGVAIRVPESKGREKIAAAVQEVMEGEGRGAAVRAKVAELQKAAAEGLQEGGAATAALAEVVEKWTCEEN

SEQ ID NO: 6219 - DNA, 1627 bp, Panicum virgatum
  misc_feature: Ceres CLONE 1858594
  misc_feature: Encodes the peptide sequence at SEQ ID NO. 6220
gattcggcgcgataaccctctagccaccgactccgcaactcatccagcatcagcaatcccctcccctccgcgctccctcccttttcgtgtcgtcttcccgtcgaccggcgagcgctagggtttagcggtttccacttttggccgcggggggtttcatccgcgtggcggcggcatctcagataggggttccccttaccggcgaggcgaggcgatggaggcggcggtggtcgacgacatgatccggcggctcctggaggcccgcggcgggcgcacgccgcgcaacgcgcaggtgacggacgcggagatccggcggctctgcgccgccgccaaggacgtgttcctctcccagcccaacctactcgagctcgaagcccccatcaagatatgcggggatatccatgggcagtattctgatcttcttcgattattcgagtacggtggctacccacgagaggcaaattatctctttctgggtgactatgttgatcggggaaaacagagtatagaaacgatatgccttctcctggcgtacaagataaagtacccagaaaacttctttctcctcaggggaaaccatgaatgtgcctccatcaacagaatatatggattctttgatgagtgtaagagaagattcaatgtacggatctggaagattttcaccgaatgcttcaactgcctcccagtggctgcacttatcgatgataagatcttatgcatgcacgggggtttgtctcctgaattgaagaatatggaccagatacgcggcattgcccgtcctgtggatgtgcctgaccatggtcttctttgcgatctgctatggtcagatcctgataaagagattgaagggtggggagagaatgacaggggagtgtcctacacttttggagctgacaaggtatctgaatttcttcagaagcacgatcttgacctggtctgcagagctcaccaggtcgtggaggatgggtatgaatttttcgccaagcgccagctcgttactatattctctgcacccaactactgtggcgagttcgacaatgctggtgccatgatgagcatagatgattccctaacatgttcgttccagatacttaaaccttcagataagaaaggaaaagccggaactggaaacatgtcaagacccgggacaccaccaaggaagataaaaataagtgtcactcgtatctaggtggattctcttaattaaactgaatttgcgaagttgtgatgaagtgtcctccccctagacttgttctggtaaacggttttggtgcgcctaacgcaatgttgaaacattgaccagcttggctcttgtcttgtgatgatctgaagtctgatgcaaatgtatcctggcattttgccaaccaaatggaagatcacgctagcataaacttttgtttttttattgttgacttgtatccttgttcctcggaaaatgcaacatgtttatggatagataggcagccttggttgctgtgaagattgtgtgtgaatatagacgtgatgttttgttctttacctgtaactataaagcttgtctttgaaaacgactggatagcagcagatgtctttagctgatgttgatggcagaaaacgactgaactccggtcaaaaaaaaaaaaaaaaaaaa

SEQ ID NO: 6220 - protein, 324 aa, Panicum virgatum
  misc_feature: Ceres CLONE 1858594
  misc_feature (1)..(196): Pfam Name: Metallophos Pfam Description: Calcineurin-like phosphoesterase
  misc_feature (1)..(316): SWISSPROT Homolog: EC 3.1.3.16 Serine/threonine-protein phosphatase PP1
  misc_feature (1)..(316): SWISSPROT Homolog: EC 3.1.3.16 Serine/threonine-protein phosphatase PP1 isozyme 3
MEAAVVDDMIRRLLEARGGRTPRNAQVTDAEIRRLCAAAKDVFLSQPNLLELEAPIKICGDIHGQYSDLLRLFEYGGYPREANYLFLGDYVDRGKQSIETICLLLAYKIKYPENFFLLRGNHECASINRIYGFFDECKRRFNVRIWKIFTECFNCLPVAALIDDKILCMHGGLSPELKNMDQIRGIARPVDVPDHGLLCDLLWSDPDKEIEGWGENDRGVSYTFGADKVSEFLQKHDLDLVCRAHQVVEDGYEFFAKRQLVTIFSAPNYCGEFDNAGAMMSIDDSLTCSFQILKPSDKKGKAGTGNMSRPGTPPRKIKISVTRI

SEQ ID NO: 6221 - DNA, 2427 bp, Panicum virgatum
  misc_feature: Ceres CLONE 1858671
  misc_feature: Encodes the peptide sequence at SEQ ID NO. 6222
aactcaaatccatctacacccaggaggccaggacccagcgccagcggttcctccaccaccagccgccccctccccgcgtccgccccgcccgcgcccgctgccgctgctgcttccaacgcactcgagctccgcggcatccgcatccgaatccgcacacgatccccgcgccacttgccccgcccgcccgcccgccggccggccaatgcccggcgcgatgagatgagacgccgccgccgcgcggcggtgctcgcagcccccctcacgcgcgcccgcatcggggatccctcctcctcccacccttcccccaccagcgccgcatttattccctcccccagcacgacaacggtcacgcttccgtcgtcccgtccgtctcgtcgcatccggcgctgcccccctatttaaggcgcgcgggctgagagccagcgataatgctcttgtccaggaggccccttgccgccgcgctccacctcgcgcccctctcgcctcccttgctcctcttcttcgcgtccgcgtcgtcgtcgtgctcgcccgccgcagcgtcggcctccggcgggtccagaggttgtagtgctgtaaggatggacagcggtgcagtggaaacagcatccacttgggcagtatggtcaacaccttcggcagaaccgagaagcatttctatcgggaaggagatattctgcaacaggtcactcaacatgaggaacatcacagcagtgggatttgatatggactacactcttgcacagtacaagcctgagaccttcgagtcccttgcttactatggtacaattgagaagcttgtgaaggatctgaactaccctgaagagctgttgacttgggagtttgattggaaatacatggtcagaggattagttcttgataagaagagaggaaatattttgaagatggaccgacacaagtatgtaaaagttgcataccatggttttagggaattgtcgaaagaagaaaaagttgctgcttatgggagtacattgataagagactcatttgatgaacctgattatgcccttatagatacacttttctcattgggtgaagcttatctatttgctcagcttgttgatttcatggacagtaatcctggaaaagtacctgcaggcacagactatccgcttatgtataaagatgtgaggtctgcggttgacttgtgtcatcgtgatggaacattaaagcggatggttgcgaaggaccctggcaggtacatcaatgaggacttggcaattgtaccaatgcttgaaatgataaaaaaatctggacgctcaacattcttggtgacaaatagtttgtgggactataccaatgttgtcatgaactacctttgtggaccatacacttcagatgcaggatctggtctcaaccacaagtggcttcaatatttcgatattgtaataactggcagttcaaagccaagtttcttccacgatgataaccgtgcgggactctttgaagttgagcctgattccggaaaacttctaaatgctgatattcagattggaagcccaagatcaagtcgtcagcatgcaatgccagttcacaaagtttaccagggaggcaatgttggtcatcttcacagattactttctattgcttctagttcacagatcctctatgttggcgatcacatatacggagatattttgcgcagcaagaaagttctgggctggcggactatgctggtgattccagaactggagcatgaggtgaagcttctttcagaatcaaagtcgactcggaaggagcttaggcatcttagaatggagcgtgattcaattgaagacagaatccatcatcttgaatggtctcttaaatttgatgatctcacagaaaatcagaaggaaaagttgttctctgaacatgtcaatctgctgcaacagcgagagcatgctcgtcgccttcatcaagaggctcaaaggcaacaccatcagaagtttcataaggtgtggggacagctcatgaagactgggtaccaaaattcccgatttgctcatcaggtcgagaggtttgcgtgcctgtatagcagccaggttacaaacttcggtttgtattcccccaacaagtactatcgcccgagcgaagattacatgccccatgagttcgatgtgcttgagctgtaggagcagtccctagttcaaagctccccgttgtaattgaaccacagcaggttaggtgggtgattttagctttgggcattgattaaaatgtgtagttgctgtatttatcaagcgaaagattcactcattggacatgttttatccgagtattgtgggttatgtatagtaaatatagtttcacatagagcaatacatttacctgtatattttttgtacataacaagttttaagcagaagcaaaggaaagcaatgccgatcgtgtcttaattacacgttgcaaaaaaaaaaaaaaaaaaaa

SEQ ID NO: 6222 - protein, 567 aa, Panicum virgatum
  misc_feature: Ceres CLONE 1858671
  misc_feature (1)..(411): Pfam Name: 5_nucleotid Pfam Description: 5' nucleotidase family
MLLSRRPLAAALHLAPLSPPLLLFFASASSSCSPAAASASGGSRGCSAVRMDSGAVETASTWAVWSTPSAEPRSISIGKEIFCNRSLNMRNITAVGFDMDYTLAQYKPETFESLAYYGTIEKLVKDLNYPEELLTWEFDWKYMVRGLVLDKKRGNILKMDRHKYVKVAYHGFRELSKEEKVAAYGSTLIRDSFDEPDYALIDTLFSLGEAYLFAQLVDFMDSNPGKVPAGTDYPLMYKDVRSAVDLCHRDGTLKRMVAKDPGRYINEDLAIVPMLEMIKKSGRSTFLVTNSLWDYTNVVMNYLCGPYTSDAGSGLNHKWLQYFDIVITGSSKPSFFHDDNRAGLFEVEPDSGKLLNADIQIGSPRSSRQHAMPVHKVYQGGNVGHLHRLLSIASSSQILYVGDHIYGDILRSKKVLGWRTMLVIPELEHEVKLLSESKSTRKELRHLRMERDSIEDRIHHLEWSLKFDDLTENQKEKLFSEHVNLLQQREHARRLHQEAQRQHHQKFHKVWGQLMKTGYQNSRFAHQVERFACLYSSQVTNFGLYSPNKYYRPSEDYMPHEFDVLEL

SEQ ID NO: 6223 - DNA, 1965 bp, Panicum virgatum
  misc_feature: Ceres CLONE 1858754
  misc_feature: Encodes the peptide sequence at SEQ ID NO. 6224
ccccgtccccaacccacgcactgtcccagtagcgataagccgagtccacgagatccccgtagaccaccggagcggaggagaaagcagccagccatgatgatgatgggcgaaggcgtgagcgtcccgccgtggtcgcaccacctcccggtgagcggcgtcgacgtcggaggcggcaccaccggcggcgacgagatgacgccgtacctgctgtcggcgctgcatcagtacctgccgtgcaacgacgccggcgcaggcgccgacgacgacgaggcggcggccgcggcggcgatggcggccggcgtcgacgggtacggctccgacgagttccgcatgtacgagttcaaggtccggcggtgcgcgcgcgcccgcagccacgactggaccgagtgccccttcgcgcacccgggggagaaggcgcgccgccgggacccgcgcaagtaccactactccggcaccgcctgcccggacttccgcaagggcgggtgcaagcgcggggacgcctgcgagttcgcgcacggcgtcttcgagtgctggctccacccggcgcgctaccgcacccagccctgcaaggacggcactgcctgccgccgccgcgtctgcttcttcgcccacaccccggaccagctgcgcgtgctcccggcgcagcagtccagccccaggggcgccgccgccgcggcctcgccgctcgccgagtcctacgacggctccccgctgcggcgccaggcgttcgagagctacctcaccaagagcatcatgtcgtcctcgcccaccagcaccctcatgtcgccgcccaagtcgcccccgtcggagtccccgccattgtcgccggacggcgccgccgccgccttccgccgcggctcctggccgggcgtcgggtccccggtaaacgaggtgctcgcctcgctgcgccagctccgcctcagcaaggccaactcgtcccctgccggcgggtggtccggctacccgtcctccgccgtcgcgtacggatcgcccacggcgaccgggctctacagcctgccctcgaccccgacgaccatgggcggctacatggccaacctggagccgcttgatgtctccttcggcggcggcgaggaggagcccgtgcagagggtggagtctgggcgagctctccgcgctaaggtgttcgagaggctgagcagggagggcgccgtctccggcgacgccacggccgcaatcggaggccccgacgtggggtgggtgtccgatctcatcaactgaggcggctggtcagtggtttctgacgtcttttgtgagtagcaaagtggcacggcgacggcaatggcttgggagaaaggtggtggtaagccgtgatggagaagaatggcatccaaaaatttcggtcttcttttgttgcttccagtttctttcgctaattccccctgtacatatctatcgccttgtgaatattctcggctggtagaggaaggatgcaaggtggtggaaggaggggtggatttgttttggggttcttgaggtagttgaaaatctctagaaaaaaaatagtcgagaaaaaaataagtagagatgtatttggtggtggtctgtgtcctctgttgtgcatagggtgtggaggcaagcatggcgggcagctgatggtggccatgaagacggacggaagacggccggatttcaagcgggcacggcggcggccggccgccggctctagctgcttaatttctatgattccggagtatgctagtttgatgatgtttaaagttcatcgtttgtgcattatcatgcatcggctagtttgatcgatttcaaccttgttgattattactacccacattttgttgatgtaatctctgtttattaagaccctcattccctacagcatattttgtattaccttttgtttagtagctgaaatctcattcacccgctattagaggtgaatttcctttgtaatattttgctcaagtaaatgaccaatccatgtttatc

SEQ ID NO: 6224 - protein, 381 aa, Panicum virgatum
  misc_feature: Ceres CLONE 1858754
  misc_feature: Great-hit functional homolog of the protein sequence given in SEQ ID NO 9307
  misc_feature (1)..(26): Pfam Name: zf-CCCH Pfam Description: Zinc finger C-x8-C-x5-C-x3-H type (and similar)
  misc_feature: Useful for making plants with modulated nitrogen use efficiency
MMMMGEGVSVPPWSHHLPVSGVDVGGGTTGGDEMTPYLLSALHQYLPCNDAGAGADDDEAAAAAAMAAGVDGYGSDEFRMYEFKVRRCARARSHDWTECPFAHPGEKARRRDPRKYHYSGTACPDFRKGGCKRGDACEFAHGVFECWLHPARYRTQPCKDGTACRRRVCFFAHTPDQLRVLPAQQSSPRGAAAAASPLAESYDGSPLRRQAFESYLTKSIMSSSPTSTLMSPPKSPPSESPPLSPDGAAAAFRRGSWPGVGSPVNEVLASLRQLRLSKANSSPAGGWSGYPSSAVAYGSPTATGLYSLPSTPTTMGGYMANLEPLDVSFGGGEEEPVQRVESGRALRAKVFERLSREGAVSGDATAAIGGPDVGWVSDLIN

SEQ ID NO: 6225 - DNA, 2848 bp, Panicum virgatum
  misc_feature: Ceres CLONE 1858857
  misc_feature: Encodes the peptide sequence at SEQ ID NO. 6226
acggccgctgccattgtcgtgtaaccgtttgctgcggctttgtcggaacactagccccgccgctcgcccagcggccgccgcggcagtttcggctcgctctcgccggccgctgtctccgccgcggtcgtcggacgccccgacgcctcctcctccgcgcttgagcgaagccatcttcggcaccagcctcctcgccatccaccggacccaccaattcccaaaaccctagcgccaaaatcccccatttcggtcgcgccaatcggaaccggatttcctcggttcccggctggcgccggcggcgagttgagcctcgctctcgcctcgcctcaccacatgttgcagcgagcgcgtgcatgaactctgcgatggatgagatcaacctgatgcggcaggcgcagcggcagcaccagcaccacctcatggtgcgcggcatgggcgaggagattgacctcgagatcggcccgggcgacgacccctccttctccggcgcagacctcgtcgccgtcgcttccgggcaccacgacaacgtcgtccccaccgacgaacacaagaccctccttatcccatgctctggcgccgtggacgggcatgcgcagcctccggcgccgcagccaccactgccgcacggggaggagcatgacgggatactccggctgccttcggcgcacaccaagaagaagaagaaggtggtgaagaaatggcgggaggagtgggcggatacctacaagtgggcttatgtcgccgtgcacgacaacacccccaggatcttctgctcggtgtgcaaggagtacggccggaagcaccggcggaacccgtatggcaatgagggaagcaggaacatgcagatgagtgcgcttgaggagcacaacaatagcttgctgcataaggaggcccttcggttgcagatggcctccaaggagaagttgcagccccccgagatcgagaggccggtctatgtcaaagctttgtcgaaaacagctgcatcaatacttgaatctgtcctaaggagggatccctatgaagctgaatttatacagtcaatccaggaggtggttcattccttggaaccagttttggtgaagaacactcaatatgttcaaattttggagcgtttgttggaacctgagagatgctttatcttcagagtaccatggattgatgacagaggtgaagcacatgtcaatagaggtttccgtgtgcaattcagtcaggcattaggtccatgcaggggtggtcttcggtttcacccatccatgagcttaagtgtggcaaagtttctggcctttgaacatactttgaagaatgctttgtcgttatataaacttggaggtgctgctggaggaagtgattttgatccaaagggtaaaagtgataatgagataatgcgtttttgtcaaagtttcatggatgagctatatagatatttgggccctgatcaggattttcccgctgaagacattggtgttggtccaagggaaatgggttacctttttgggcagtatagatgcctttctggtcattttcagggaaattttacaggacctaaaatcttctggtctggttcaagttttcgaacagaagctactggatatgggctggtattttttgcacgtcttttacttgctgaaatgaacaaagagcttaaaggattaagatgcgtgatcagtggttctggaaagatagcaatgcatgttttggaaaagcttctgtcatgtggagccattcctgttacagtctcagattcaaagggctatttggtagatgaagatgggttcgattatatgaaatattcacttcttagggatattaaggctcagcaaaagagcctcaaggagtacttgaaatcatatccacatgccaagtatatagatgatgcaaaaccatggagtgagcagtgtgatgttgcatttccttgtgcctcacataatgaaattgaccaaggggaggctgtcgcaataattaaatctggttgccgtgttcttatagagtgttcaaatatgccatgcaccgttcaagcagttgatatcctaagaaaggcaaaagtccttgttgctccagcaaaggcaactgctgctggtggggtagcctttggagaacttgaattgaaccccgagtttaatttgatgcagttgtcggtggaggattttgagaataaaatccaggatgcaataaagcaaacatacgaaaggtcaatcaaagctgctcaagattatggaatcatgaaagagaaccctgagtcattggtgcatggtgccaacatttgtgctttccataatattgcccaagccatgaccgatcaaggatgtgtctagttagacctttgatttagtcaaggagctacaactagagtgtcctgcaactgtgcagggggaaaatataattttctgctaagtgcttcgacaccttcagcttgtgctactataaatcgtggagcactccaaaatgcaaagtacttggaattcacccttggcttatgctagaaaatgggtgactcacaagagcttcccttgatctggaaggaaagccagctcagaagcttaaagaggtccaccaggaggcaaccaaatgatgagaatcacacaaaatagcgagctctggtgcttcacccacaacatactaccacattggatttcctaagtaaattcagcccatgaaggtacttctgtttggccttatagcctaagctgttggcttccctgattgttcggctaaataatgctcaagcatgtcctcttcatcatctgtatattatagtaacaggtttgtaagtgagggtttactggcaaattaaatataatgtatgtaaacaaatagttttgacctagaaagttgtaccttcaaaatcatcgtc

SEQ ID NO: 6226 - protein, 652 aa, Panicum virgatum
  misc_feature: Ceres CLONE 1858857
  misc_feature (1)..(248): Pfam Name: ELFV_dehydrog Pfam Description: Glutamate/Leucine/Phenylalanine/ Valine dehydrogenase
  misc_feature (1)..(131): Pfam Name: ELFV_dehydrog_N Pfam Description: Glu/Leu/Phe/Val dehydrogenase, dimerisation domain
MNSAMDEINLMRQAQRQHQHHLMVRGMGEEIDLEIGPGDDPSFSGADLVAVASGHHDNVVPTDEHKTLLIPCSGAVDGHAQPPAPQPPLPHGEEHDGILRLPSAHTKKKKKVVKKWREEWADTYKWAYVAVHDNTPRIFCSVCKEYGRKHRRNPYGNEGSRNMQMSALEEHNNSLLHKEALRLQMASKEKLQPPEIERPVYVKALSKTAASILESVLRRDPYEAEFIQSIQEVVHSLEPVLVKNTQYVQILERLLEPERCFIFRVPWIDDRGEAHVNRGFRVQFSQALGPCRGGLRFHPSMSLSVAKFLAFEHTLKNALSLYKLGGAAGGSDFDPKGKSDNEIMRFCQSFMDELYRYLGPDQDFPAEDIGVGPREMGYLFGQYRCLSGHFQGNFTGPKIFWSGSSFRTEATGYGLVFFARLLLAEMNKELKGLRCVISGSGKIAMHVLEKLLSCGAIPVTVSDSKGYLVDEDGFDYMKYSLLRDIKAQQKSLKEYLKSYPHAKYIDDAKPWSEQCDVAFPCASHNEIDQGEAVAIIKSGCRVLIECSNMPCTVQAVDILRKAKVLVAPAKATAAGGVAFGELELNPEFNLMQLSVEDFENKIQDAIKQTYERSIKAAQDYGIMKENPESLVHGANICAFHNIAQAMTDQGCV

SEQ ID NO: 6227 - DNA, 1965 bp, Panicum virgatum
  misc_feature: Ceres CLONE 1858864
  misc_feature: Encodes the peptide sequence at SEQ ID NO. 6228
aatcagctcgctcgtgcgtccgcctccccctcccctcgctgtcgccgccttctcctctcctggctgtcgccgcctcccctcccccgcgccgtcgtcgcctcccctccccctcggcatcgcgccatcgcagcctcccactccttctcggcgttgcgccgtcgccggcggcggctgcggttggcggcggcggtgggacgccatggttggtggcggcggcgcgcccgcgcctctgctgggcggcggtgggctgcggtcgtcgtcttggtggggcagcacgacgccgaggcctaggcacgccaacgggaggcacatccttggcggctgcagcagcagacctggagagcattggatcgtcggccacctcgagactgatcaggatatcattcctacatatgagctggaagatgtttggcaatggacaggcatgacaaggagaaagagatggcgtcaattcttctatcctcactaagcatggagcagaatagcgggaggacaccgcgaagcgcgtcgcctcctagggtttgccggctgggtggggagctccgatccgggcgggcgggcatgaggattcgggagctccgggatgggctggaggtggaggacgacgagcgggcggaggaggcgagcggcggcggcgaggtggtcgcggttgtgcggttgaaggcgaagcgcgcgctcgtcggcgccggcgcgaggttcctgttctacccgaccctgctctacaacgtcgtccgcaaccggttcgaggccgagttccgctggtgggatcgcgttgaccagtatgttctgctaggtgctgttccgttccctagcgatgttccgcgcctgaagcaacttggagttagaggagttgtcacattgaatgaaccctatgaaactctggttccaacatccctataccagtctcatggtattaatcatcttgaaattcccacaagggactacctgtttgccccctcccttgagcatatttgtcaggcagtggattttatccattggaatgaaatgcaaggtggtagcacctatgtccactgtaaggctggaaggggacgaagcaccactatagttttgtgctttttgatcaagtacaggaatatgactccggaagcagctttggatcatgcacggtctgtgaggcccagagtgcttttagcgccagcacagtgggaggctgttaaaacattcagcacactcagtgccacgtacaacgccagatacctttcgattgagagctcaaacctgacctgctcagcgctatcttatgaagaatccagtgaacactctagtatgctgaccagcagatgccattccccaaaaagctcggatgaagactcggtaacatctgatgaagcatctgtcgcagaccctgaagtttatggctatgccaccaccgagtttgacagtgagcattttgttttacctcgctgcgggagtatgctgtccaggccgacaagccccaccaggtgcagtgacttggtcttcataactgaagcagatctagagggctacgagtccttcactgatgttggggaggatgatgttgaagatgaagtggaagtagtggtccgccacaagcccatcatgaggaagctctcctgcttccttgggtccttgaagctcacaagtaactgccaaccaccaccgagtcggttgactgaggttcgagcctgctaggtagacctgcaatggtttctgcgatcctttttgtacgttgtacatcggcagagtgtagttagcggcatgagttcgcaaagcctgcggaattcccgagggagagaactgtatgttgttgagagagagagatttggtgttcgggagaggagtgtttgttctgtagagagccaaagatttgagccatcaggagaggattgtttgttctgtggagaacgagatacttgccttcgtgcctgattgtaggttgtacccactgttgtcctggaataaaatggtgtgcatgttttgagc

SEQ ID NO: 6228 - protein, 419 aa, Panicum virgatum
  misc_feature: Ceres CLONE 1858864
  misc_feature (1)..(73): Pfam Name: DSPc Pfam Description: Dual specificity phosphatase, catalytic domain
MDRHDKEKEMASILLSSLSMEQNSGRTPRSASPPRVCRLGGELRSGRAGMRIRELRDGLEVEDDERAEEASGGGEVVAVVRLKAKRALVGAGARFLFYPTLLYNVVRNRFEAEFRWWDRVDQYVLLGAVPFPSDVPRLKQLGVRGVVTLNEPYETLVPTSLYQSHGINHLEIPTRDYLFAPSLEHICQAVDFIHWNEMQGGSTYVHCKAGRGRSTTIVLCFLIKYRNMTPEAALDHARSVRPRVLLAPAQWEAVKTFSTLSATYNARYLSIESSNLTCSALSYEESSEHSSMLTSRCHSPKSSDEDSVTSDEASVADPEVYGYATTEFDSEHFVLPRCGSMLSRPTSPTRCSDLVFITEADLEGYESFTDVGEDDVEDEVEVVVRHKPIMRKLSCFLGSLKLTSNCQPPPSRLTEVRAC

SEQ ID NO: 6229 - DNA, 2304 bp, Panicum virgatum
  misc_feature: Ceres CLONE 1858887
  misc_feature: Encodes the peptide sequence at SEQ ID NO. 6230
attcccctcctccacctccctcgtcccagctgctaccctccgcctccccaattccaacgcgtcgtctcgagctcccccaattcccaaagcctcgattgatccccaaaggctcatggtgttctccgccgccgtgtcgcctctcgcagccaccgccgcctcttcctcctgcgccgcccgcctgcgctgctgctgtcgcgttggttgttgttgttgtcgttgttgacgaattagctagctagggtttgttgatttctcgcggatcggtaaggtatggatctctcgcggcccgcgtcgtcggacctctcgctcgggctccattcccacggcccctcccacgcccacgcccgcgtgcacgcggtcgccgcgccgctgcggctgttcgacgactcggaggacgccaagccggagcgtctcgagggcggggaagcaggcggggagagggaggacgacgacgacgacgggggagaccagcacttctcgctcctcggccactcgctctgcgtcaagcgcccgcgccgcgcggtcaacggcggtgggggcgggggaggagagacctcctcctgctcgtcctcgtccgcggcgctgcgccccgcgaagcggcaggcgacgggggagggctgccgcccggatctggagacccgccgcaccgcggtccgcgcctggggcaaccagtcgctggcggaggccgacccggatgtgcacgcgctgatggagcgcgagctcgaccgccaggtgcggggcatcgagctcatcgcgtcggagaacttcgtctgccgagcggtgctcgacgcgctcggcagccacctcaccaacaagtactccgaggggcttccgggtgctcgctattacggcgggaaccagcacatcgatgccatcgagcggctctgccacgagcgcgccctcgctgccttcggtctcgaccccgcctgctggggcgtcaatgtccagccttactcgtgcacgtccgccaatttgggtgtctacacggggctacttcaacccaaggatcgcatcatggggctggagccaccgtcaggcggccatgttagccacggttactacactcctggtgggaagaaggtgtcaggcgcctctattttcttcgagagcttgtcgtacaaggtgaacccacaaactgggtatattgattatgacaaggttgaggagcgggcaatggatttccatcccaaaattctcatctgtggtgggagctcgtaccccagagagtgggacttcacacggatgaggttgattgctgataagtgtggtgcggtgcttatgtgcgacatggcgcatatcagtggtcttgttgcagcaaaggaatgccgtagccccttcgactactgtgatgttgttacgtcaaatactcataagaaccttaggggtcctagaggtggtataatattcttcaggaaagggaaaaaattaaggaaacgaggtggatctttttctcaaggggacgagggtgaatacgactttgaggataagataaattttggtgttttcccttcaatgcaaggagggccccataataatcatattgctgccttggcaataaccctgaagcaggtagcaactcctgagtataaagcatacattcaacaagtcaagaaaaatgcccaggctttggcatcagccttgctcagaagaaaatgcagattggttactggtggcacagataatcacttagtgctttgggatctcagaactcttggcttgacgggcaagatcttcgaaaaggtctgtgaggcatgccacatatctatcaacaagacaccaatttacggggataatggctcgatatcaccaggaggtgttcgaatcggaacacctgcaatgactactagaggttgcttagaggatgatttcgagttgattgcagagttcctcatcagggcgactcagattgctagtaatgttctgaaagaacatgggaaactacaaaaggagtttctacgaggactacagaacaataaggatgttgtagaactccgcaatcaggttgaggcatttgcatcacagtttgcgatgccaggttttgatgtatgaatgtgcatatataccacagttgcaattatccagattcatcgctcatctgctacattatcgtccttaagctcgtccatactatcagtctcagcttcagaacgaatagcagagattgttttttttcttctgttagttaccggtattgactctcgattcaagcaattatatgtacagttcactgtccaagttgcggattattatgtatgtagtgaatcttggtatgacgatttactgtaaaaaaaaaaaaaaaaaaaa

SEQ ID NO: 6230 - protein, 592 aa, Panicum virgatum
  misc_feature: Ceres CLONE 1858887
  misc_feature (1)..(401): Pfam Name: SHMT Pfam Description: Serine hydroxymethyltransferase
  misc_feature (104)..(591): SWISSPROT Homolog: EC 2.1.2.1 Serine hydroxymethyltransferase, mitochondrial precursor
MDLSRPASSDLSLGLHSHGPSHAHARVHAVAAPLRLFDDSEDAKPERLEGGEAGGEREDDDDDGGDQHFSLLGHSLCVKRPRRAVNGGGGGGGETSSCSSSSAALRPAKRQATGEGCRPDLETRRTAVRAWGNQSLAEADPDVHALMERELDRQVRGIELIASENFVCRAVLDALGSHLTNKYSEGLPGARYYGGNQHIDAIERLCHERALAAFGLDPACWGVNVQPYSCTSANLGVYTGLLQPKDRIMGLEPPSGGHVSHGYYTPGGKKVSGASIFFESLSYKVNPQTGYIDYDKVEERAMDFHPKILICGGSSYPREWDFTRMRLIADKCGAVLMCDMAHISGLVAAKECRSPFDYCDVVTSNTHKNLRGPRGGIIFFRKGKKLRKRGGSFSQGDEGEYDFEDKINFGVFPSMQGGPHNNHIAALAITLKQVATPEYKAYIQQVKKNAQALASALLRRKCRLVTGGTDNHLVLWDLRTLGLTGKIFEKVCEACHISINKTPIYGDNGSISPGGVRIGTPAMTTRGCLEDDFELIAEFLIRATQIASNVLKEHGKLQKEFLRGLQNNKDVVELRNQVEAFASQFAMPGFDV

SEQ ID NO: 6231 - DNA, 2044 bp, Panicum virgatum
  misc_feature: Ceres CLONE 1858960
  misc_feature: Encodes the peptide sequence at SEQ ID NO. 6232
aattcgatcgcgggtccctttctctttctccgctgcttcctcaatcctcagcgccgtcgtcctcgcctccgtgtctcctccctattaatattgctctcatccaagcccaaatccaccgaattctcgccatagcgggagccgaattcacacgcgaaaggacgcgagggagcaccggttcttgagattccaggatggatctacacaaaaatggcaataacggttcctgccccagctcatgcgggccactgacagagtactacatccccgattacatactgaagccggactctgaaccagtcattattgataatgcaccatgttgtcctgtggtagtcttcatcaactctagaagtggcggccaactggggagcagtctgatcaaaacataccgtgaacttctcaatgaagcgcaggtttttgatctctcggaagagtctcctgacaaagttctgcacagattatattgcaatttcgaaaagctcaagtgtaacggtgaccttcttgctattcaagttcagaagagcttgagactgattgttgctggtggtgatggcacagcaagttggctgcttggagtagttagtgaccttaagctttcacatccacctccagttgctactgtgcctctaggaactggaaataaccttcctttctcatttggatggggaaaaaagaatccagctactgaccaagcagcagtgaaatcgttcctgggcaaagtaaaaagagcaagggaaatgaatattgatagttggcatatcatcatgaggatgcgaattccacaggaaggcccatgcgatcctattgctcccttggatcttccacattcgttgcatgcattccaccgtgtttcagactgtgactctctcaatgtggagggttaccacacatttcgtggaggattctggaattattttagcatgggaatggatgcacaagtatcatatgaattccactctgaaaggaagagaaatccagagaagttcaaaaaccagctaacaaatcagggtacatatgctaaacttggacttaaacaaggatggtttgctgcttccctaacccatccttcttcaaggaacattgcgcaacttgcaaaggtgaagatcattaaaagacctggtggccaatgggaagagcttaagattcctcgcagcatccgatcaattatctgcctcaacttgccaagtttctcaggaggattgaatccttggggtacgcctagcacgaggaaagtacaagacagagacctgactgcaccttatgttgatgatggccttattgaggttgtcggcttccgtgatgcctggcacgggctcgtcctgctggctcctaacggccatggaactcgtctagcacaggcccaccgaatccgtttcgagttccacaaaggagcggccgagcacacgttcatgaggatcgacggggagccatggaagcagcctctccccaaggaggacgacaccgtggtcgtcgagatctcgcacctccggcaggtggccatgctcgcgagcgacccgtgcaagtcgaagagcgtcaacgacccctcctccccgtcgtgccacggccacgacgacgacgacagcaacagcctggaggacgaggacgagtgggtggacgggaggaagaagttcggtgcggcggccaccttcaagatccccgacgaggtggacatcgcccatcttagctagagcgcgtccgtcctggcgtcctgcctctcctccgttcgtgctggttgtgcgtgaggtttggaagttcagaagccatttcagaatgttccctgcagctgttagtgattctgctcccttttttcttatcgttttcgggagttcagatttcagaagttaacgactgctgttagcgatactgctcattttgctctctattttcctgtaaatcacaagtttagcggaggtggctggactactccatatgttaattaacttgttatcattgttttgctatccgctgctcttgacaatggggcggtaattagaaaggttaccttccattcagataatcacatccaaaaaaatgctaaacactt

SEQ ID NO: 6232 - protein, 498 aa, Panicum virgatum
  misc_feature: Ceres CLONE 1858960
  misc_feature (1)..(144): Pfam Name: DAGK_cat Pfam Description: Diacylglycerol kinase catalytic domain ( presumed)
  misc_feature (1)..(174): Pfam Name: DAGK_acc Pfam Description: Diacylglycerol kinase accessory domain
MDLHKNGNNGSCPSSCGPLTEYYIPDYILKPDSEPVIIDNAPCCPVVVFINSRSGGQLGSSLIKTYRELLNEAQVFDLSEESPDKVLHRLYCNFEKLKCNGDLLAIQVQKSLRLIVAGGDGTASWLLGVVSDLKLSHPPPVATVPLGTGNNLPFSFGWGKKNPATDQAAVKSFLGKVKRAREMNIDSWHIIMRMRIPQEGPCDPIAPLDLPHSLHAFHRVSDCDSLNVEGYHTFRGGFWNYFSMGMDAQVSYEFHSERKRNPEKFKNQLTNQGTYAKLGLKQGWFAASLTHPSSRNIAQLAKVKIIKRPGGQWEELKIPRSIRSIICLNLPSFSGGLNPWGTPSTRKVQDRDLTAPYVDDGLIEVVGFRDAWHGLVLLAPNGHGTRLAQAHRIRFEFHKGAAEHTFMRIDGEPWKQPLPKEDDTVVVEISHLRQVAMLASDPCKSKSVNDPSSPSCHGHDDDDSNSLEDEDEWVDGRKKFGAAATFKIPDEVDIAHLS

SEQ ID NO: 6233 - DNA, 2118 bp, Panicum virgatum
  misc_feature: Ceres CLONE 1859110
  misc_feature: Encodes the peptide sequence at SEQ ID NO. 6234
gcagaaagaggccagactcgcccgtcttgacatgttgctggcttgaaaaagttgaggcctccacttgccaacttcgtcaaatcaccatcagcgctaatcccccggtcttatcgcaaaatcttaaccccacttgcccagtttagtttaggtttagacaaagggttagcggggtggttaggttaaccaactcgctttgcttagaataaagaaagttccccggcaggcccacttgccaatacagccttcccacaaactggggggcggcacaggcggttccggtttggcgccgctgccgcgccccacgctgacacggcacccgtatctctgcggcgccgcgtgtggccgcctcgccacgggctccgaggcgcgtggcgggcacacggcctcgtccccgcggtgcggccagcggcgccacggcgggacgcagagtgcagaggccgccccgccaaggatcgctggaagagctcaaaaccgctggccggggcacgcgcggcgccgccaagttgatcccagcccgtcccgtcccggcaccggcagcccgggtctacactacacgtcgctgtcccccgccccgcctcgcgccagcggcccggacccaacttggacgccgcggcgtgcaggaggaaggcagggcagatgcattgcacctcctcctggccatggcgaggtccaaccgtcgccgatagcgacgaggacagacgagcgggcccgtaccggcgtgtccgcccgcgccggccttatcctctcacacgctgcgatggcgctgccttgccttgccttgcctgctcggctctgcgcgccccgcgaattttggagccgccacgccacgccacaccgtccgtccgtcgccaccgcacccgctttctcttattagcccggcccggcgcgtcctccacctcctatttaacagcgagcgcctccccgagccgagaccaccattccaaaccaatcacgagagctagcgtccggctagtgagagcagcagccagcaagcgggcaaggcaagagagaaagcaagcaggcaaacatgtgtggtggtgcgatcctcgcggagctcataccgagcgcgccggcgcgccgcgtcacgccgggccacgtctggcccgcggccaagcagcagcggagggccgacgacttcgaggccgcgttccgggagttcgactccgactccgacgaggaggtggagagcaagccgctcggcttcaacgcttcccccgccggcgcggcgaccaggaagctgaggcagcagcagcagcagcgggagctggccgcgccggcgccgagcaggcgccgcaaggccgcgcagtacaagggcgtccggcgccgcccgtggggcaagtgggccgccgagatccgcgaccccgtcaagggcgtccgcgtctggctcggcaccttctcctccgccgaggccgccgcgctcgcctacgacgccgccgcgcgcgacatccgcgggcccagggccaagctcaacttcccctcgaacgccgacgccgctcccgccgccgggcgcaagcgcgcccgcgccgccgagttcgtcgacctcgtcgccgacgaggaggacgagcagcagcgcctcgcagcgtccggcgtcaagcacgaggccggggccaccaacagcgagacctccgagtccggcggcgccctcccggacttctcgtggcagggcgtgtcggcgtacgacgaggcccccgccccggaggccgtcgaggccgaggaccagagccgcggcgccagcaagcgcccgaggaccgagccggagagcgccgacgaggcgtcgccccgggcctccgactccgagtcggacgcgctgttcgacgcgttcctcttcggcgaccagctcgcctacttcaacggcggcgcgtacgagtccctcgacagcctgttcagcgcggacgccgtgcagagcaacgccgccgcggacgaggggatgggcctctggagcttcgacgacggctgcctcgtcgaggacaacctgtcgttttaagcttcttcgcctgatcgcctgtgttgaatgaacgtcttgtaaaattacggatggttttgtgatcttgtctagtttgtaactttggatccaggaagagatgaaattactgttctcaaaaaaaaaaaaaaaaaaaa

SEQ ID NO: 6234 - protein, 318 aa, Panicum virgatum
  misc_feature: Ceres CLONE 1859110
  misc_feature (2)..(61): Pfam Name: AP2 Pfam Description: AP2 domain
MCGGAILAELIPSAPARRVTPGHVWPAAKQQRRADDFEAAFREFDSDSDEEVESKPLGFNASPAGAATRKLRQQQQQRELAAPAPSRRRKAAQYKGVRRRPWGKWAAEIRDPVKGVRVWLGTFSSAEAAALAYDAAARDIRGPRAKLNFPSNADAAPAAGRKRARAAEFVDLVADEEDEQQRLAASGVKHEAGATNSETSESGGALPDFSWQGVSAYDEAPAPEAVEAEDQSRGASKRPRTEPESADEASPRASDSESDALFDAFLFGDQLAYFNGGAYESLDSLFSADAVQSNAAADEGMGLWSFDDGCLVEDNLSF

SEQ ID NO: 6235 - DNA, 1968 bp, Panicum virgatum
  misc_feature: Ceres CLONE 1859191
  misc_feature: Encodes the peptide sequence at SEQ ID NO. 6236
aatccaccaccgtgggcgctcccctcaatcttctccgtcgtcggggatggcggcgaccgcgctgctggcgggctcgccgtggctgcgcctccgcctccgcgcggacgctcccgcgcgccgccccttcgcccgccacactcacctccgccgggccctctcctcctgcgcccgcgcctccgccgccgaccccgcctccggccccgtccgcgtccgcttcgcgccgtcgcccacgggcaacctccacgtcggcggcgcccgcaccgcgctcttcaactacctcttcgcgcgctccaacggcggccgcttcgtgctccgcgtcgaggacaccgacctcgagcgctccaccaggaagtccgaggaggccgtcctcgccgacctcgcgtggctcggcctccagtgggacgaaggtcccgatgttggcggggagtttgggccttatcgccagtcagagcggaattcactgtacaaggattacgccgagaagcttttagactccggcgcggtttaccgctgcttttgctccaatgaggaacttgagcaaatgaaggaagtcgcaaagcagaggcaacttcctcctgtgtacatgggcaagtgggcaactgcttcagacgttgaagtggagcaggagctagagaaagggacaccatacacttaccggtttcgtgtgccaaaggaagggtcattgaaaattaatgaccttattcgtggcgaggtcagttggaatctagacacgcttggtgattttgtgattatgagaagcaatggacaacctgtctataacttctgtgtgacagttgacgatgctaccatgcaaatctctcatgttattagagctgaagagcatttaccaaacacactgcgccaagctctaatttataaagctcttggattcccgatgccttcatttgcccatgtgtcacttattctggctcctgacaaaagcaaactgtcaaaacgtcatggtgctacttctgtggggcagtataaagagatgggctatctacctcaggcaatggtaaattatttagcactattgggctggggtgatgggactgaaaatgagttcttcactatcaatgatctagttgaaaagttcactatcaatcgtgtcaataaaagcggagcagtttttgatgcaacaaaattaaaatggatgaatggacaacatctaagatcatttccaacagatgaactcatcaaggcttttgaagatcggtggaaggacaccggcattctccaggagtctgaaagtggttttgcaaaggaagctgccgagcttttgaaggatggtattgatctgataacagaggctgatgcagctcttacaaatttgttgtcgtatccccttcacgccactttaagcagtgatgaagctaaacctgtggtgcaagacaagatttctgaggttgctttgggtcttatttctgcgtacgatagcggtgaacttactcaagcactagctgagggccgtgatggttggcagaagtgggtgaaaggttttggaaagtctctcaaaagaaagggcaaagggctctttatgccgctccgagtactgttgacggggaagcttcatggtcctgacatgggtgccagcatagctcttatacacaaagctggcatctgtggagcggtgacgcctcagtcgaatttcataaccctagacgagcggttcaggatcctcaaggaggtcgactgggagtcggtggtggaggagtccccctcagaatcagccatccccgctgcttcatagaccatagatcgtgcttgtagatgttcttatcaatctgtggtgggttttgtttttgcaatgttgagacagaggagttttgcccctttttttgtgtgtgtgttttggctgcctagaggctaataatgcggaattttgatcttattagtgatgctgtaatggacaatatcgaatgatttggtgacgatgatctttttttctgaatgcagatgttcctaagc

SEQ ID NO: 6236 - protein, 567 aa, Panicum virgatum
  misc_feature: Ceres CLONE 1859191
  misc_feature (1)..(567): SWISSPROT Homolog: EC 6.1.1.17 Glutamyl-tRNA synthetase
  misc_feature (5)..(561): SWISSPROT Homolog: EC 6.1.1.17 Glutamyl-tRNA synthetase
MAATALLAGSPWLRLRLRADAPARRPFARHTHLRRALSSCARASAADPASGPVRVRFAPSPTGNLHVGGARTALFNYLFARSNGGRFVLRVEDTDLERSTRKSEEAVLADLAWLGLQWDEGPDVGGEFGPYRQSERNSLYKDYAEKLLDSGAVYRCFCSNEELEQMKEVAKQRQLPPVYMGKWATASDVEVEQELEKGTPYTYRFRVPKEGSLKINDLIRGEVSWNLDTLGDFVIMRSNGQPVYNFCVTVDDATMQISHVIRAEEHLPNTLRQALIYKALGFPMPSFAHVSLILAPDKSKLSKRHGATSVGQYKEMGYLPQAMVNYLALLGWGDGTENEFFTINDLVEKFTINRVNKSGAVFDATKLKWMNGQHLRSFPTDELIKAFEDRWKDTGILQESESGFAKEAAELLKDGIDLITEADAALTNLLSYPLHATLSSDEAKPVVQDKISEVALGLISAYDSGELTQALAEGRDGWQKWVKGFGKSLKRKGKGLFMPLRVLLTGKLHGPDMGASIALIHKAGICGAVTPQSNFITLDERFRILKEVDWESVVEESPSESAIPAAS

SEQ ID NO: 6237 - DNA, 1247 bp, Panicum virgatum
  misc_feature: Ceres CLONE 1859204
  misc_feature: Encodes the peptide sequence at SEQ ID NO. 6238
atcaaagctctcaaatctcgactctgctgttgcaatcgcttccaaagaaccaaagcagagatggccatgatcagggatcagcaggttgagcttgagcacagccatctgcccatccgaggtctcaacctccacgtagcccaagcaggcaaaggggagctggggacggtgctgttcctgcacggtttcccggagatttggtactcgtggcgccatcagatgctggccgtggccgccgccggctaccgcgccgtcgcgctggactggcgtgggtacgggctctcggaccagccgccggagccggaggcggcgtcgtacgacgacctggtggaggatctcctcgccatcctggatgctctttctattcccaaggctttccttgtagcgaaggatttcggagccaggccagcctattattttgctcttcatcaccctagccgcacatgtggtgttatgtgtttggggatcccctttcttcacggtagctcatccttcaccaacttgccagaaggcttctacattttgcgctggcgggaacaaggaagagcggagtctgactttggccggtatgatgtcaagagagttgtgcgaaccatctacattctcttttctaggagcgagatcccaatagcaaaacaagatcaagagattatggaccttgcagacttgtcaacacctcttcctgagtggttcactgaggatgatctcgctgtatatgcttcactctatgagaaatctggtttccgatatccactggagatgccatataggtctctccataaggcgaatgcaattgaagatccaaaattccaagtcccagtgtttgttgtcatgggggagaaggattatgtctacaaattccctgggatcgagtctgttttgaaagacggcataatggagaaattcgtaccagacctgaagatcgcctacatccctgaaggaagccattttgttcaggagcagttcccagacaaggtgaatgatctcctggttaggttcttgaaagaccatcccgtgtctacatagatgctctattagtgccgatgttcaacctcataactagcagacacgatgggcaaaactgcgatgtcaactatgcctgtaaaggaataattgtgacgactgaagctttctgtacgcatacgcaacaactgtactttgaactgtgctgtatctagtttttgtacagctagtttaccatgaataaatgatataatattttcgccattcaaaaaaaaaaaaaaaaaaaa

SEQ ID NO: 6238 - protein, 320 aa, Panicum virgatum
  misc_feature: Ceres CLONE 1859204
  misc_feature (1)..(250): Pfam Name: Abhydrolase_1 Pfam Description: alpha/beta hydrolase fold
MAMIRDQQVELEHSHLPIRGLNLHVAQAGKGELGTVLFLHGFPEIWYSWRHQMLAVAAAGYRAVALDWRGYGLSDQPPEPEAASYDDLVEDLLAILDALSIPKAFLVAKDFGARPAYYFALHHPSRTCGVMCLGIPFLHGSSSFTNLPEGFYILRWREQGRAESDFGRYDVKRVVRTIYILFSRSEIPIAKQDQEIMDLADLSTPLPEWFTEDDLAVYASLYEKSGFRYPLEMPYRSLHKANAIEDPKFQVPVFVVMGEKDYVYKFPGIESVLKDGIMEKFVPDLKIAYIPEGSHFVQEQFPDKVNDLLVRFLKDHPVST

SEQ ID NO: 6239 - DNA, 1803 bp, Panicum virgatum
  misc_feature: Ceres CLONE 1859208
  misc_feature: Encodes the peptide sequence at SEQ ID NO. 6240
tcttctccgcccccaccgcgcaccgccccgacaaggcacgggaaccacgccgcccctcctccccgcggacgccgccgttctctgctgacctgcccccctgccctccgcttccgcctccaacgcccgccttcgcctcttgctaggggagaccagggggcctccacgagtccccgccgacagctcccgccgcctccaggtccaggtggatcccatccgccgaccctcccaaagaggggctagctcagctccctgatctgagctgaaattaggatctgaacagtttgggccagctgatgcacggctcgccggtgtccaaggacctcaacctcccggtgcagccgccgatggcctcatccgggctgctgaggtacggatcggcgcccagctcggtgctcggcgagctctgcgaggacttcctttcggccggggcccgcgctgccagccctgacgccggcgccgacaacgtcttcgccaggttcctggccgaccaccacatccgggacgacaagccggcgccggcgcctgccccggccacgggccacttcgcaagtgaagcagacatggcctcccagcagcagcaaatgatgttccactcccagcaccagcaccaggagatggtggacgccaagtctggactctaccgcaccgtcagctccggcacggaaaccgcgtccgctgcagccgccggcgtcggttccagcaacctgactcggcagagcagctccccagccggattcctcgatcatttgaacatggaaaacggatacggtgccatgctgagggcgggcatgagcatgggcttcagggacggcagcagcgccgccacggccgagtctcttgcaggtggtggcagcaggctaaaggggcagctcagcttctcgtcacggcagggatcgttgatgtcacagatctcagagatggacagtgaggaggttggagggagcagcccagaggctgcaggtgctggtagggggtacatccctaggtacgccatgggctccgggtgggaggagtcgtcgtcgttcatgtcggagaacctatctgggatgaaacgccctcgggattcattagagcctgagcagaatggccttgcgcaacagttcagcttgccgaagacatcttcggagatggcaagtattgaaaagttcctccagttccaggatgctgtgccctgcaagatccgtgccaagcgaggatgtgccacacacccacgcagtattgccgagcgagtgaggagaacaaagatcagcgagcgaatccgaaaactgcaagaactcgtcccaaacatggacaagcaaaccaacacttctgacatgctggatttggctgtcgactacatcaaggatctccagaagcaggttaaggtgttaaaggagagcaacgctaattgcacatgctcagctagcaagaattagcagcactctaattgaagccccaactctgcaatgtacactgcaagttcactcggcatatagaagatgttaacgcagctcatgtttcttttggggggtttgaatagcagcagttgggaggcttgtctacaatgctatgtcactgtgtatgagcaaaggggcatggatcagtggcaccatcaagtattcaagtgataaggagatgggtggaagtggaagtgttgaaacataggagaaacaattgtatagtttggttgtaacttcgctatatatactacccttttggtagaaagttattactttacccctactagtgcagctgtaaatgtgccgcagataaagagtagaaaaacttgaaggtgttcaatggaagcaatattgtttcaagtct

SEQ ID NO: 6240 - protein, 373 aa, Panicum virgatum
  misc_feature: Ceres CLONE 1859208
  misc_feature (1)..(49): Pfam Name: HLH Pfam Description: Helix-loop-helix DNA-binding domain
MHGSPVSKDLNLPVQPPMASSGLLRYGSAPSSVLGELCEDFLSAGARAASPDAGADNVFARFLADHHIRDDKPAPAPAPATGHFASEADMASQQQQMMFHSQHQHQEMVDAKSGLYRTVSSGTETASAAAAGVGSSNLTRQSSSPAGFLDHLNMENGYGAMLRAGMSMGFRDGSSAATAESLAGGGSRLKGQLSFSSRQGSLMSQISEMDSEEVGGSSPEAAGAGRGYIPRYAMGSGWEESSSFMSENLSGMKRPRDSLEPEQNGLAQQFSLPKTSSEMASIEKFLQFQDAVPCKIRAKRGCATHPRSIAERVRRTKISERIRKLQELVPNMDKQTNTSDMLDLAVDYIKDLQKQVKVLKESNANCTCSASKN

SEQ ID NO: 6241 - DNA, 2141 bp, Panicum virgatum
  misc_feature: Ceres CLONE 1859315
  misc_feature: Encodes the peptide sequence at SEQ ID NO. 6242
aactgccaaagctcaaacccaaacgcgtgcgctgcagcaatgctagcctcaacctggctatcccctcccttcctgcccgcctccacaaacaaactcctcatcgtctccggcaactccggcagccgccgtcctccgcagcgcatgtcaggtacgcgcatccacctccacctgcaaactaaagcacgaagctcccggaatatgctctcatagatccatctgcaaatttaattcgtcttcttcaaccttaatagtaatctataactgtcaacgagaaatcatgcgtgtttctacacgcgtagcaggtggaggtggtctcgtcctccacgccaggctgggcgatggcgccggagccggcggcgagctcaccccgtcggcgtcgcgacgacacgcgtaagccgcacatcacattcctcatccgcacgctactgctcgcgtgcaagatagcccgcggggccgccgcgctgatccgcgtcctctgcctcgccgcggtggccgcccccgccaaaagcctcctcgccgccgccacggccgccttcgcgctcgtgaacgcgccgtgcgtccggtacatgaaccaggccgcgctcgggcggagcttcacgggcaccttctgcggcgacctggtggccggggccatggcgcactcctggaggctgctcgtgcagggcctcacgtcgctcatgtttctctgtgcccgcgccgatgagtacgtccggccgccgcccagcccgctggtgctcatggcgcacgacaagccggcgtcccatccccagcaggtacacatctccgtcgtcggcgcgaagaagatgtgcatctcatgggtcaccgacgaccggagcgcgccgtccgtggtcgagtacggcagatccccgggcaagtacacggcgtccgcggcgggcgaccacaccacgtaccattacttcttctacaagtccggcgcgatccaccacgccaccatcggcccgctggagcccggcacgacgtactactaccggtgcggcaaggccggcgacgagctcagcctccggacgccgccggccaccctgcccatcgagttcgtggtcatcggcgacctggggcagacggggtggacggcgtcgacgctgtcgcacatcggcggcggggactacgacatgctcctgctccccggcgacctgtcgtacgcggacacgcagcagccgctgtgggactcgttcgggcggctggtgcagccgctggcgagcgcgcggccgtggatggtgacggcgggcaaccacgagatggaggcgctgcccgtggtggagctcgcgccgttcgcggcctacaacgcgcggtggcggatgccgcacgaggagagcggctcgcgctccaacctctactactcgttcgacgcggcgggcggcgcggcgcacgtcgtgatgctggggtcgtacgcggcgttcggcgaggggtcggagcagcgccggtggctggaggcggacctgacgcgcgtcgaccggcggcgcacgccgtggctgctggtgctgctgcacgcgccgtggtacaacaccaaccaggcgcaccagggggagggcgagaagatgcgcctcgccatggagcggatgctctacgaggctcgcgtcgacgtcgtcttcgccgggcacgtccatgcctacgagcgctttacgaggatctacgacaatgaggccgacagccggggcccggtgtacatcaccattggcgacggcggcaacagggaaggccttgctctcaggttcatcgaggaccacaggtcggcgcacctgtcggtgttccgggaggcgagcttcgggcacggccggctgaggatcgtcaacgagacgagcgccgtctggacatggcaccgcaacgacgacgagtacgccaccgtccgcgacgaggtgtggatcgagagcttggccgccggaaaacaaagcatagcaagaaccgccggtcgtcacactgatgagctctaggaaacattattttttgtgtgaaaggtagctaacgctgtaacatggcaatgctatgatgttttcttagtgaaatgggggtgggaactttatacatccaaaatgccctgatgtttagcgttacgatagaaatgggggcataataaaatcacgttttgggccttggtgctctgctaaaaaaaaaaaaaaaaaaaa

SEQ ID NO: 6242 - protein, 536 aa, Panicum virgatum
  misc_feature: Ceres CLONE 1859315
  misc_feature (1)..(197): Pfam Name: Metallophos Pfam Description: Calcineurin-like phosphoesterase
MAPEPAASSPRRRRDDTRKPHITFLIRTLLLACKIARGAAALIRVLCLAAVAAPAKSLLAAATAAFALVNAPCVRYMNQAALGRSFTGTFCGDLVAGAMAHSWRLLVQGLTSLMFLCARADEYVRPPPSPLVLMAHDKPASHPQQVHISVVGAKKMCISWVTDDRSAPSVVEYGRSPGKYTASAAGDHTTYHYFFYKSGAIHHATIGPLEPGTTYYYRCGKAGDELSLRTPPATLPIEFVVIGDLGQTGWTASTLSHIGGGDYDMLLLPGDLSYADTQQPLWDSFGRLVQPLASARPWMVTAGNHEMEALPVVELAPFAAYNARWRMPHEESGSRSNLYYSFDAAGGAAHVVMLGSYAAFGEGSEQRRWLEADLTRVDRRRTPWLLVLLHAPWYNTNQAHQGEGEKMRLAMERMLYEARVDVVFAGHVHAYERFTRIYDNEADSRGPVYITIGDGGNREGLALRFIEDHRSAHLSVFREASFGHGRLRIVNETSAVWTWHRNDDEYATVRDEVWIESLAAGKQSIARTAGRHTDEL

SEQ ID NO: 6243 - DNA, 2159 bp, Panicum virgatum
  misc_feature: Ceres CLONE 1859363
  misc_feature: Encodes the peptide sequence at SEQ ID NO. 6244
ccacctcaactctttccatctcatctccctcgcgtccccatctgctgcctcctcggccgtcgcggcccacctccaaaccctaaccccaccgccgtgccggcctccttcggccacgacgtcgaagagggcagcggcggaggcggaaacctgatgcccagcctcccggtagggctatggagctcgtccccttcaagcccgcggccggagccctcgtcgaggcgggctccggggccggcgcgggctcgatcccggcgatggttgccgcgcagcagcagatgctgcacgagcaggcggaccagctccagcgcctcgtcgtcgcccagtgccgccttaccggcgtcaaccccctcgcccaggagatggccgctggtgcattgtccatcaagataggtaaaaggccaagggatttgttgaatccaaaagcagttaagtgcatgcagtcactttttgctttgaaggatactattggcaaaaaagaaacccgggaaattagtttactctgtggagttactgttactcaggttagggagttctttacaagtcaacgatcgcgagtgagaaaatttgttcaactgtctcaagaaaaggcattgagagtagaagcatccaaagagcatgacaatgtgtgctccataagcactgagcagatacctcttgacatagaggcacatgctgaggttatcgaacctttgaggactttagaaccagtggtccctcaaagctcttcacaaccaatgggtgtcccacaggtctcttcgcaaccaatggggctcccacaagggcttttgcagcctatggaggtcttccagaactcattgcaacaggcaacagcccagcagaactttgcagcccctgtgatgccatctggaacaatgggtgtgcaaccaactgatgctaagattagttccgactctgttcaaaaggaaattaagcaagaggaagtccatcctggtgttgagtcagaagataagaagttcttggaaagtatctttgccctaatgcggaaggaggaaacattctctggacaggtcaaattgctggaatggattctccaaataaataatgttacagttcttagttggttcgtaacgatgggtggtttaaccattatgtcaacatggttgagtctagcagcaattgaagaacaaacatcggttattcttgttattttcaaggtgcttctccacctccccttacataaggctttgccagcccacatgtcagttgtgcttcaaactattaacaggttgcgcttttataggactcaagacatatcaagcagggccaggaacctcctttccagattgagcaaagtgcttgtaaggagtcaggcactgaagaaacctcagaaggaattaatatgtaaacaacggataagtgaaattctccgcgatgagtcttggaaatctgaagttgatattactgaagagatacttgccttgactgacggtgcaaatgagagcagtaagcctgagcctagaaaaacaccaatgcttctcactgctgctgctgatgagacaaataaaaggagtgctacacaaacaaaatccaaacaaaaaagaaaagttctacttgtagaacctccaaataagaaagctgcggtgaagaatgttaactccgtcaggaacatctctacaaacaatagcagaccactatctgcagatgatattcaaaaggcaaagatgcgtgccatgttcatgcaggagaagtatggcaaggttgacacaagcaaagcgagtgataaactacaagcactggaaacacaaaaaacatctggattagtcaactcaactgtattgcctgtgcccagaaagccccttggatcaactgcacaacttgttgacacaagcccatcaacctctaatcagagtacagttcctcagcctgataagccagaaatctcaggcggtttgaagttaagcataagttcccaaaagaatgttatagagaagttggattccaggagagttccttggaggataccaccaggtatatttttgctttgtgctcctccatttgctattttattgaatgttgaactgcttattggacaatgagaaccagtaaagttgtacagaaaatgattgaagaattaagcatgttgttacctgtgcaagcatccgtgaaatacggagtacaaaaaaaaaaaaaaaaaaaaa

SEQ ID NO: 6244 - protein, 627 aa, Panicum virgatum
  misc_feature: Ceres CLONE 1859363
  misc_feature: Great-hit functional homolog of the protein sequence given in SEQ ID NO 9485
  misc_feature (1)..(57): Pfam Name: Homeobox Pfam Description: Homeobox domain
  misc_feature: Useful for making plants with modulated flowering time
MELVPFKPAAGALVEAGSGAGAGSIPAMVAAQQQMLHEQADQLQRLVVAQCRLTGVNPLAQEMAAGALSIKIGKRPRDLLNPKAVKCMQSLFALKDTIGKKETREISLLCGVTVTQVREFFTSQRSRVRKFVQLSQEKALRVEASKEHDNVCSISTEQIPLDIEAHAEVIEPLRTLEPVVPQSSSQPMGVPQVSSQPMGLPQGLLQPMEVFQNSLQQATAQQNFAAPVMPSGTMGVQPTDAKISSDSVQKEIKQEEVHPGVESEDKKFLESIFALMRKEETFSGQVKLLEWILQINNVTVLSWFVTMGGLTIMSTWLSLAAIEEQTSVILVIFKVLLHLPLHKALPAHMSVVLQTINRLRFYRTQDISSRARNLLSRLSKVLVRSQALKKPQKELICKQRISEILRDESWKSEVDITEEILALTDGANESSKPEPRKTPMLLTAAADETNKRSATQTKSKQKRKVLLVEPPNKKAAVKNVNSVRNISTNNSRPLSADDIQKAKMRAMFMQEKYGKVDTSKASDKLQALETQKTSGLVNSTVLPVPRKPLGSTAQLVDTSPSTSNQSTVPQPDKPEISGGLKLSISSQKNVIEKLDSRRVPWRIPPGIFLLCAPPFAILLNVELLIGQ

SEQ ID NO: 6245 - DNA, 1933 bp, Panicum virgatum
  misc_feature: Ceres CLONE 1859391
  misc_feature: Encodes the peptide sequence at SEQ ID NO. 6246
gcaggagacacagcgcccgccacacgcacgcatcgcctctcctccactacccaaattcttgacattctgttcgcaatggcgctcgccacgaacgccaccgccgccgccgccgcggcagccgccatgtccggcgcggccgcgccgcagccccgtccacgcgcgccggcgttcctcccgctgaggcgccgctgcgccgtccgcgccgtgcacgccgcggagccgtccaaaggccacggcgtcccggcggccgcgaagacctcgtcgccgacggtcgcgcccgagaaggaggcggccccagtcgcggccccggccccgaaggcgctcccgaagtgggcggtggacagctggatggcgaagaaggcgctgcagcagccggagtacccgaacccggcggagctcgaggccgtgctcaagacgatcgaggccttcccgccgatcgtgttcgctggggaggcacgccacctggaggagcgcctcgccgacgccgccatgggccgcgccttcctcctccagggcggcgactgcgccgagagcttcaaagagttcaacagcaacaacatccgggacaccttccgcgtcctcctccagatgtccgtcgtcctcatgttcggcgcccaaatgcccgtcatcaaggttggtaggatggccggacagttcgccaagccgaggtcgaagccgttcgaggtcagggatggagtgaagctgcccagctaccgcggcgacaacatcaacggcgaggcgttcgacgagaagagccgcgtccccgacccccagaggatgatccgggcgtacacccaatccgccgccacgctcaacctgctccgcgcgctggccaccggagggtacgccgcgatgcagcgcgtcacccactggaacctcgatttcaccgagcacagcgagcagggcgacaggtaccgtgagttggcacatcgggttgatgaagccctcggcttcatgtctgcagctgggctaacagcggaccacccgttgatgaagacaaccgagttctggacctcacacgagtgccttctcctaccctatgaacaagctctaacccgtcaggactccacctctggtctcttctatgattgctctgcccacatgctctgggttggtgagcgcactcgccaacttgacggtgcgcatgttgagttcctcaagggtattgccaaccctcttggcatcaaggtgagtgacaaaatgaaccctagtgatctggtgaagctgattgagatactgaatccatcaaacaagcctgggagaattaccatcattacgaggatgggggcggagaacatgagggtcaagctacctcatcttatccgtgctgtccgccaggctggactaattgtcacctggatcactgatcccatgcacgggaacacgatcaaggctccttgtggcctaaagactcgtcccttcgactccattttggctgaggtacgagccttttttgatgtgcacgaacaagagggaagtcacccaggaggtgttcaccttgagatgactgggcaaaatgtaactgaatgcattggtggatcacgcaccgtaacttttgatgacctgagcgaccgctaccacactcattgtgacccaaggttgaacgcatcccagtctcttgagctttcattcatcatcgctgagaggctgaggaataggaggatccggtcatcatctatgctcagcaacatcttatccttgccacattttagtttctgaatgggtagaaaatgccaataagagagatgtgtgtattccatttgttggaggttgctcttatgtaaaactatatgcctatgagctatctacgctccgaggtggatttgtttgatttttttatcttttgcatgggtaaatactatgtaatgatacatatgactgcactcgccgacgctaagttttctatttgtaccaaaaaaaaaaaaaaaaaaaa

SEQ ID NO: 6246 - protein, 547 aa, Panicum virgatum
  misc_feature: Ceres CLONE 1859391
  misc_feature (1)..(438): Pfam Name: DAHP_synth_2 Pfam Description: Class-II DAHP synthetase family
  misc_feature (1)..(545): SWISSPROT Homolog: EC 2.5.1.54 Phospho-2-dehydro-3-deoxyheptonate aldolase 1, chloroplast precursor
  misc_feature (1)..(547): SWISSPROT Homolog: EC 2.5.1.54 Phospho-2-dehydro-3-deoxyheptonate aldolase 2, chloroplast precursor
MALATNATAAAAAAAAMSGAAAPQPRPRAPAFLPLRRRCAVRAVHAAEPSKGHGVPAAAKTSSPTVAPEKEAAPVAAPAPKALPKWAVDSWMAKKALQQPEYPNPAELEAVLKTIEAFPPIVFAGEARHLEERLADAAMGRAFLLQGGDCAESFKEFNSNNIRDTFRVLLQMSVVLMFGAQMPVIKVGRMAGQFAKPRSKPFEVRDGVKLPSYRGDNINGEAFDEKSRVPDPQRMIRAYTQSAATLNLLRALATGGYAAMQRVTHWNLDFTEHSEQGDRYRELAHRVDEALGFMSAAGLTADHPLMKTTEFWTSHECLLLPYEQALTRQDSTSGLFYDCSAHMLWVGERTRQLDGAHVEFLKGIANPLGIKVSDKMNPSDLVKLIEILNPSNKPGRITIITRMGAENMRVKLPHLIRAVRQAGLIVTWITDPMHGNTIKAPCGLKTRPFDSILAEVRAFFDVHEQEGSHPGGVHLEMTGQNVTECIGGSRTVTFDDLSDRYHTHCDPRLNASQSLELSFIIAERLRNRRIRSSSMLSNILSLPHFSF

SEQ ID NO: 6247 - DNA, 2095 bp, Panicum virgatum
  misc_feature: Ceres CLONE 1859554
  misc_feature: Encodes the peptide sequence at SEQ ID NO. 6248
aaaaaagctccggacccttctcccctttccccttcacgcttcgctccgcttcgcccctcgccgacgactatttaaaacccgcgcttctttcccgtcggctttccggtgagaggaaaccattttttaacccccgcgagagacccacagccgagcagggggagctcgatcgagaagcgtctggggactcgggggagcgctccaatggcgtcgtcccacatcatcctgcccaaggaggaggaggaggcggcggcggaggccgggctgggcgtggcggtggaggcggaccacgactccccggcgcagcgcccgttccaggagcaggcgcccgggaaggcggcgctgccgttctcggcgacgtgcgtccggatctcccgcgactcgtacccgaatctccgcgcgctccgcaacgcttcggccctggacctccacgacgacgacgccgccttcgtcaagctcgaggagggcgactacggatacgtgctcgacgacgtcccgcacctgaccgactacctacccgacctccccacttttcccaatcctttgcaagatcatccggcgtattcaactgtcaagcagtattttgtcaatgcagatgatacagtacctgaaaaggtggttgttcagaagaacagtccacgaggagtccacttccgacgtgctggacctcgtcagagagtgtattttgaatcagaagaagtgaaagcttgcattgtaacatgtggaggcctttgccctgggcttaataccgtcatcagagagttggtgtgtggcttgtcccacatgtacaatgttagcaatgtcttcggaatacagaacggatacaagggtttctattcaagcaattatcttcccatgacaccaaagagtgtgaatgatatccacaagcgaggtggtacagttcttggaacatcacgtggtggccatgataccaaaaagattgttgacaacattcaagatcgtggaattaatcaggtgtacattatcggaggagatggaactcagaagggtgcatatgagatatacaaggaaattcgaagacgtggtctacaagtagctgttgctggcattcccaagacaattgataatgatatagcggttatagacaagtcatttggtttcgatactgctgtagaggaggcccagcgtgccatcaatgcagctcatgtggaagcttcaagtgctgaaaatgggataggtttagtgaagcttatgggtcgttatagtgggtttattgccatgtatgctactcttgcaagcagagatgtggactgctgcttgattccagagtctcccttctatttggaaggggagggtggactattcgagtatatagataggaggttgaaggagaacaaccacatggttattgtggtggctgagggagcaggacagaatcttattgctcaaagtatacctgctgcagatcagcaagatgcctctggaaataagctgcttcttgatgttggtctctggttgactcacaagatcaaggattattgcaagggcaagaagatggaaatgactattaaatacattgatccaacttacatgatccgtgctattccaagcaatgcatcagacaatgtctattgcacactgctcgcacatagtgccattcatggtgcaatggcaggatacagctttacagtcggaatggtcaatggcaggcatgcgtatataccatttcatagggtaacatcaacgaggaacaaggtgaggataaccgataggatgtgggcaaggctgctgtcttcaaccaaccagccgagcttcctgagcaaggaggacatcgacgcggccagagaagctgataaggcggccaacaagaggatgaacggagagaacgcgaagaagcaacctgcatcagtgttggcaaatggtgagaaatagtatgattttgacggttcatagctgtgtacagtacccatggctatttggctgaggtccataggccaaaactgcaattcagtgagtattggtttcttttgcatcgttccgattccttggaacggagcacattcgatgccccggaacacgttctcagtagtttacgtaataaatgagatacattttgtaaaaaaaaaaaaaaaaaaaa

SEQ ID NO: 6248 - protein, 562 aa, Panicum virgatum
  misc_feature: Ceres CLONE 1859554
  misc_feature (1)..(254): Pfam Name: PFK Pfam Description: Phosphofructokinase
MASSHIILPKEEEEAAAEAGLGVAVEADHDSPAQRPFQEQAPGKAALPFSATCVRISRDSYPNLRALRNASALDLHDDDAAFVKLEEGDYGYVLDDVPHLTDYLPDLPTFPNPLQDHPAYSTVKQYFVNADDTVPEKVVVQKNSPRGVHFRRAGPRQRVYFESEEVKACIVTCGGLCPGLNTVIRELVCGLSHMYNVSNVFGIQNGYKGFYSSNYLPMTPKSVNDIHKRGGTVLGTSRGGHDTKKIVDNIQDRGINQVYIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQNLIAQSIPAADQQDASGNKLLLDVGLWLTHKIKDYCKGKKMEMTIKYIDPTYMIRAIPSNASDNVYCTLLAHSAIHGAMAGYSFTVGMVNGRHAYIPFHRVTSTRNKVRITDRMWARLLSSTNQPSFLSKEDIDAAREADKAANKRMNGENAKKQPASVLANGEK

SEQ ID NO: 6249 - DNA, 1526 bp, Panicum virgatum
  misc_feature: Ceres CLONE 1859579
  misc_feature: Encodes the peptide sequence at SEQ ID NO. 6250
acgcaggcagcttcacctcctcacctcccgaccgcccgcgtgcccgacgctgacagcatcgccatcgtcggggtccggccgacaaagccgcgccgctggcctcccctccccctctgggcctcttctgcccctgcaccgagctagctagctacccgctcgcccaaatcgcctcctcccttccgccgcagcgcagcaggggaagccggtgcgtggccgtggcagcggcgccgccggcggccgggtcgatagatgaaggtgctctgctccgcgtgcgaggcggccgaggcgcgcgtgctctgctgcgccgacgaggccgccctctgcgcgcgctgcgaccgcgacgtgcactccgccaaccacctcgccggcaagcaccaccgcctgccgctccagccgcccgccgccgcctccgcgcccggctgcgacatatgccaggagtcccacgcctacttcttctgcgtcgaggaccgcgcgctgctctgccggagctgcgacgtcgccgtgcactcggccaacgccttcgtctccggccaccgaaggttcctcctcaccggcgtccaggtcggcctgcagcccgacgcccaggagccgccgccggatcccccgaacgccgccgccgcagcaccagctcccctgccaacaccgccgccggccaagaaggcacgcagcagcccggcgccgctctacagcgacgacgacatcgactggggggccggaggcccggacgtaggcatcgccaggagcctgccggactggtcggtcgtggatgagcagttcggcgctccggtgccgacacccgcggagccggtggtgagcagaaccccctcgaagcggagcccccggcggacgctcgcggcggcgttcaccgtccagggcggctttgcagggggcatgccggactgggcgctggacgagttcttcggcttctccgagttcaacgccggcctcggcttccccgagaatggcacgtccaaggctgacagcgggaagctcgggagcacggacgggtcgccgaccggccggtcgtcgtccggctcggcgcaggatttcttcgggcaggtgccggagttccaccagtggtccgtgccggagctcccctccccgcccacggcctcgggcctccactggcagggcggcccgcgccacggcaccaccgccgccgacatcgccgctgtgtccgtgccggacatctcctccccgaagaaccccttccgttgcttcgccgccggtgccggccagacgcagcctcctcccccgaagcgccggagatgatgtggctccttgggtactggagttgtggtgtagtaggcttgcaagaaacagaaacttgctgggttgtagtatgtacttgcacctagggttgaaaaaggacgggaatattcccgttccgatccattcttttttttatttttttccgtctgttttcgtatttgtgagattctgtttccgtatttacgaaagtagaaatgaggtttctccgtctgtttccgagaaatcacatttttatatggaattgatccgtattt

SEQ ID NO: 6250 - protein, 340 aa, Panicum virgatum
  misc_feature: Ceres CLONE 1859579
  misc_feature (2)..(48): Pfam Name: zf-B_box Pfam Description: B-box zinc finger
MKVLCSACEAAEARVLCCADEAALCARCDRDVHSANHLAGKHHRLPLQPPAAASAPGCDICQESHAYFFCVEDRALLCRSCDVAVHSANAFVSGHRRFLLTGVQVGLQPDAQEPPPDPPNAAAAAPAPLPTPPPAKKARSSPAPLYSDDDIDWGAGGPDVGIARSLPDWSVVDEQFGAPVPTPAEPVVSRTPSKRSPRRTLAAAFTVQGGFAGGMPDWALDEFFGFSEFNAGLGFPENGTSKADSGKLGSTDGSPTGRSSSGSAQDFFGQVPEFHQWSVPELPSPPTASGLHWQGGPRHGTTAADIAAVSVPDISSPKNPFRCFAAGAGQTQPPPPKRRR

SEQ ID NO: 6251 - DNA, 1918 bp, Panicum virgatum
  misc_feature: Ceres CLONE 1860095
  misc_feature: Encodes the peptide sequence at SEQ ID NO. 6252
aactggaccagaccagaccagaccacccagcaggtagagctactagtcgtcgtcgtcttctttttcttcttccctttacctgatgagcgtccttctcccatccttgccttgatccccggcctcctctcgcatcgcattgcattgcattggtccatccattatatgtattagaagcagcagcatcatcagcagtgtggtactgtacctagctcctccacatcgatcgaccacattcattatattccaaattaacaatgcggcacacggcagacagcaggaagaagaagcggaggaggaggatgagtccgccatccccatcctcctcctcctcgagatctgcagcaccaggtcaatggtgctgctactcccagtcccagcagcagctgatgctcctccttgcacttgcactcgcgctcctcctccctcatctggcggtggcggggaggatggcgaggatccagagccatctggacaggatcaacaagcccgccctgcgctccatacgcagcgcggacggcgacaccatcgactgcgtggcggcgcaccagcagcacgctctggaccacccgctcctcaaggggcacaccatccaggcggagccgcccgagatgccagcccgccgcagcagaggacttgaagctgctgctgatgccaagacggcgggcagcagatggggcgcctggcagacctggcaccacggcggtcactgccccaggggcacggtggccgtccgtcggaccaccgccgccgacgtgctgcgcgctggctccatctcccgcttcggccgcaagaagaggaagaagagatcatccgtggacgccgcccgcgcggccaatgcgccggacgtcatctccggcaacgggcacgagcacgccatcgcgtacacggcgccttcttcgcagcagcagccggtgtacggcgccaaggccaccatcaacgtttgggatccctccatccaggaatccaacggcttcagcctctcccagctctggatcctatccggctccttcaacggctccgacctcaacagcatcgaagcaggatggcaggtcagccctgagctgtacggggacagcaggccgaggctcttcacctactggacaagcgacgcgtacgaggctaccgggtgctacaacgcgctgtgcccggggttcgtgcagacgagctcccgcatcgccatcggcgcgtccatctcgcctgtgtcgtcgcccggcggcgcgcagtacgacatgacgctgctggtgtggaaggaccccaagctgggcaactggtggcttagctacggcgaccagctcgtgggctactggccagcccatctcttcacgcacctctccgaccacgccaccatggtcgagtggggcagcgaggtcgtcgacaccaggcccggcggcgtgcacacagccacccagatgggctccgggcgcttcgccgccgaggggttcgcccgggccagctacttccgcaacctcgagacggtggacgccgacaacagcctggcggaggtgcccctggatgccatccagaccctggcggaggacgccgcctgctacgacatacgcaaggcgcacgacgacggcggcggcggacactcgggatcagctggcggcggctggggcacccacttctactacggaggcccgggacacaacccggcatgcccctgaaagaatggacagaataacccttgctgcggctaattccctatatatgttggctaggattagtagtactatgccccaatatatataatcaatcaagctgctaattaatatcggtttttctactccagtagtcgtccttatataggagtattctgcactgcatgcctgctgcatgtaattgtaatcccaagctagcaaggatgatgcatgcatgatggatttccttcactttctcgtaaaaaaaaaaaaaaaaaaaa

SEQ ID NO: 6252 - protein, 469 aa, Panicum virgatum
  misc_feature: Ceres CLONE 1860095
  misc_feature: Great-hit functional homolog of the protein sequence given in SEQ ID NO 9230
  misc_feature: Useful for biocontainment applications
  misc_feature: The plant produces a reduced number of seeds.
MRHTADSRKKKRRRRMSPPSPSSSSSRSAAPGQWCCYSQSQQQLMLLLALALALLLPHLAVAGRMARIQSHLDRINKPALRSIRSADGDTIDCVAAHQQHALDHPLLKGHTIQAEPPEMPARRSRGLEAAADAKTAGSRWGAWQTWHHGGHCPRGTVAVRRTTAADVLRAGSISRFGRKKRKKRSSVDAARAANAPDVISGNGHEHAIAYTAPSSQQQPVYGAKATINVWDPSIQESNGFSLSQLWILSGSFNGSDLNSIEAGWQVSPELYGDSRPRLFTYWTSDAYEATGCYNALCPGFVQTSSRIAIGASISPVSSPGGAQYDMTLLVWKDPKLGNWWLSYGDQLVGYWPAHLFTHLSDHATMVEWGSEVVDTRPGGVHTATQMGSGRFAAEGFARASYFRNLETVDADNSLAEVPLDAIQTLAEDAACYDIRKAHDDGGGGHSGSAGGGWGTHFYYGGPGHNPACP

SEQ ID NO: 6253 - DNA, 2779 bp, Panicum virgatum
  misc_feature: Ceres CLONE 1860284
  misc_feature: Encodes the peptide sequence at SEQ ID NO. 6254
aaaattccgctgccactccattgcggttgtgaatttactccccgtctcggcctttccttcccctgctcgtgctctgccccgcggtccgctgctgcggcaaagaattagcaaggtctcactgcactcattagctatggctgcctcagaagcctcagaagcagcagctgacaaaggattgcctttcggggtggatgcaaccatggtcgatgagtatgcctcccagtcaaagctgctgcaagaattcgttaagatccccagttttggcaaggcttgggtcttcaactccaaggatgaaaacacacccagagcagcggtttcaatcagccaatcagatcttttgggcaataagaggagaatgttccttttgaattctcacatttcaaagagtgcctcaaagcctgtcaatttccagtggtctcctttcccgactgaaataagtggagtgtcagcagttattccatcgccttctggagaaaaacttcttttagtacgcaattctgaggatgattcccctacaaaactagagatttggggggcgtgtcaattagagaatgagatacatattgcaaaatctgttcatggatcactctatactgatgaatggtttgaagggatatcatggaacaaggatgaaactttcatagcttatgttgctgaggagcctcctcaaccaaagccagtgttcaatgattatggattcaagaaggaaggatcatctgaaaaggactgcaagagctggaagggacaaggagattgggaggaaacctggggagaaacctattcgaagaaaaggatacctgcactgtttgtcgtcaacatatccagtgggcaagttcgacctgtgaagggaatacctagatcattaagtgttggccaagtgatttgggccccatcatcttcatgtggattggtttttgttgcatggtcatctgacaatggcttccaagagactccaaggaagcttggtattaaatactgttacaacaggccttgtgctctgtatgctgctcctgatcctttcagagaagaaactgagaaaccatcaaccgtgggcaataaggatgaaactacaactatgatcaaattaacagcacacctgagcagtgcctttttcccacggttcagtccggatggtaagtatcttgtgttcgtctcagcgaaaagtgctgtagatagtggagcacacaacgccacaaattcaatgcacagaattgagtggcctacagatgggaaactggatgggagccttggtatcgttgatgtggtgcccattgtgatgtgccccaaagataactgtttccctggtctgtattgcttcggattgctcagggatccatggcttactgatggacggactatgattctatcttctgtttggggtagcagggaagtaatactttctgtaaatgtcgtgagttgtgaagttttaagagttagtccccaggattcagattattcatggaatgttcttgcacttgacaagaataacattcttgcagtttccagtagccttattacactccctcaaatatactatggaatcatgatttctcagactgaaagccattgggagtggcaggaagtttcaactccttttccaaagccatctgatgagataagctccatattagcagagcataagttcagcatactcaaaatcccaattagcaacccttccgacaaactagcgcatggggctaagctgccttttgaggctatttttgtgtcacataaggattctgccagtaatccaacaattgtggttcttcatggtggaccacactcagtttacccatcaagttattccaaatccttggcttttcttttttcacagggatataatcttcttgtcgtgaactacaggggctcattaggctttggggaagaagcactgcagtcccttcctggaaatattggttctcaggatgtcaatgatgtattgacggctttggactttgttataaagagaggactaatagatccatctagagtcgctgtagttggaggttcacatggaggtttcttgacaactcatttgattggccaggctcctgatacatttgttgcagcagctgctcgaaatccagtatgtaacttacaattgatggtgggtaccactgacatccctgattggtgctttgtcgagatttatggaaaagatgggaaaaagtacttctcagagtctccttcagtagatgatctttgtcaattccaccagaagtcaccaatatcacacatttcgaaggtcaaaacacctacgctctttctccttggagcgcaagatctcagggttcctgtttctaatggcctgcagtatgcaagggctttgaaggagaggggaattgaatccaaaactattgtcttcccagaagatatccatggaatcgacaagcctcagtctgatttcgagagcttcctcaacataggggtttggttcaagaagcacatgagcaaataaacattagtgctctttgattacattcgttatagatgtaccttttcattgtattgtaattttttttcttgaacacgcaggagagctgtgtatctttatattaagagcgagagtagtccaaatacaaggaaacattccacaccttggactagagtgaggaacgtaaagatctagaaactattacataaaaacaccaaccataggaccagaccacaatcataaaaacaccaatgactgtaattgggataaaacatctgacagcatggttcacttgcccaatccaatgttcccaagatggaataccaaaaaaaaaaaaaaaaaaaa

SEQ ID NO: 6254 - protein, 774 aa, Panicum virgatum
  misc_feature: Ceres CLONE 1860284
  misc_feature (1)..(220): Pfam Name: Peptidase_S9 Pfam Description: Prolyl oligopeptidase family
MAASEASEAAADKGLPFGVDATMVDEYASQSKLLQEFVKIPSFGKAWVFNSKDENTPRAAVSISQSDLLGNKRRMFLLNSHISKSASKPVNFQWSPFPTEISGVSAVIPSPSGEKLLLVRNSEDDSPTKLEIWGACQLENEIHIAKSVHGSLYTDEWFEGISWNKDETFIAYVAEEPPQPKPVFNDYGFKKEGSSEKDCKSWKGQGDWEETWGETYSKKRIPALFVVNISSGQVRPVKGIPRSLSVGQVIWAPSSSCGLVFVAWSSDNGFQETPRKLGIKYCYNRPCALYAAPDPFREETEKPSTVGNKDETTTMIKLTAHLSSAFFPRFSPDGKYLVFVSAKSAVDSGAHNATNSMHRIEWPTDGKLDGSLGIVDVVPIVMCPKDNCFPGLYCFGLLRDPWLTDGRTMILSSVWGSREVILSVNVVSCEVLRVSPQDSDYSWNVLALDKNNILAVSSSLITLPQIYYGIMISQTESHWEWQEVSTPFPKPSDEISSILAEHKFSILKIPISNPSDKLAHGAKLPFEAIFVSHKDSASNPTIVVLHGGPHSVYPSSYSKSLAFLFSQGYNLLVVNYRGSLGFGEEALQSLPGNIGSQDVNDVLTALDFVIKRGLIDPSRVAVVGGSHGGFLTTHLIGQAPDTFVAAAARNPVCNLQLMVGTTDIPDWCFVEIYGKDGKKYFSESPSVDDLCQFHQKSPISHISKVKTPTLFLLGAQDLRVPVSNGLQYARALKERGIESKTIVFPEDIHGIDKPQSDFESFLNIGVWFKKHMSK

SEQ ID NO: 6255 - DNA, 1846 bp, Panicum virgatum
  misc_feature: Ceres CLONE 1860313
  misc_feature: Encodes the peptide sequence at SEQ ID NO. 6256
tccggtcctccatctcgccatttatccgctgccccctctcctctcctctcctcgtgctcgccacgccaatccctcccaagattaggagggacagcagcccgagattcggatttaggatttggattctggtgcaggaatcgaaggcgccacgcgctggagtcccggccgaattgcttgggtgagaacgccatgatggcgaacgggaggctccaaaagcaggcgttgctgccgccgcggagcccattccctgcagcggcggctgcggcgccgcacgtcgagctcggcccgatcgcgcggccgcgggacgcgcaccaccgccacggccaccagcgcacgtcgtctgagagcttcctcgccgacgagcagccgtcgtggctcgacgacctgctggacgagcccgagacgccggcgcgggcgcatggccggcccggccaccgcaggtcgtccagtgactcgttcgcgctcttcgaaggcggcggcggcgccgcggcgggcatacacgacaatgtgctcgatggcatgaggggaggaggcggaggacagttggcttcttgggctggcgcgcccgagttcttcccggagcccacctcgtttgggcgacctcagggcaggccgtgggagtcaaggcagatgtaccggcagggtggtggcatgccgattccagggagagagaagaatggagggcgccatggtccgtccagctcatttggtgatcttgagcatggtcatgtgcccaatggggtggacaggaaaggccatggtgatgcagctcatgaccagaggattggagcagagaggaaggagggcctgaggcactcgcagtcggaggcggacaccaagcgagccaaacaacaatatgctcagagatctcgtgtccggaagctccagtatattgcagagcttgaaagaagagttcagtccttgcagacagaggggatagaagttactgctgaaatggattttcttggtcagcaaaatatcatgttagacctggaaaataaagccttgaagcaacggcttgagagtctatctcaagagcatcttattaaacgctatcagcaagagatgtttgagcgggaaattggtcggcttagatcattgttccagcaacagcagcagcagcagcatgtaccacagcagcaggctcctactcacagccgcagtaacagcagagaccttgattcacaattcgcaaacctgtctctgaaacacagcgatcccaattctgggcgtgatgctgtctctggccttcgcatttaagattattttttccagcttggttctctgagcttcacatcttgcttcccttgttacaccactctttgtggctgttgcatcaagagaggagcagcaacagtgaacctggaatcacatcccatggtgaataaagctggaaaggttaataactgtggatccaatattagttctttcagagtgcgcacctgatggtcatccttagctcctgtccattgttgacgcttgaccagtcggaggtgtttagggtctatacgcagattgatgcctttcatggatcctttgtataagtttgaagttagaacactaaggttctaattcattcctttttttagttgattctgttcttgagtttaggcaccatgtggtgcttgtattagttagcttggcatatgaatggaatgtgagctggtcatcttttggttaatgccacatcctagagctgttgtgccagcatgttcaataagctagtgaggtcaaagcgttgtaattcagttccaattcatttgtgatatgcagaacaagatactggatgctcaggttctcgcatttatttgagtggtaaatggtgtacgtgttcttgcatcttgat

SEQ ID NO: 6256 - protein, 356 aa, Panicum virgatum
  misc_feature: Ceres CLONE 1860313
  misc_feature (1)..(49): Pfam Name: bZIP_1 Pfam Description: bZIP transcription factor
MMANGRLQKQALLPPRSPFPAAAAAAPHVELGPIARPRDAHHRHGHQRTSSESFLADEQPSWLDDLLDEPETPARAHGRPGHRRSSSDSFALFEGGGGAAAGIHDNVLDGMRGGGGGQLASWAGAPEFFPEPTSFGRPQGRPWESRQMYRQGGGMPIPGREKNGGRHGPSSSFGDLEHGHVPNGVDRKGHGDAAHDQRIGAERKEGLRHSQSEADTKRAKQQYAQRSRVRKLQYIAELERRVQSLQTEGIEVTAEMDFLGQQNIMLDLENKALKQRLESLSQEHLIKRYQQEMFEREIGRLRSLFQQQQQQQHVPQQQAPTHSRSNSRDLDSQFANLSLKHSDPNSGRDAVSGLRI

SEQ ID NO: 6257 - DNA, 3116 bp, Panicum virgatum
  misc_feature: Ceres CLONE 1860404
  misc_feature: Encodes the peptide sequence at SEQ ID NO. 6258
tcctctttttcatgcgccccctccccccgccggagttgcgtttcatttgaataggcgagcggggaagcatctcataaaccaccctccgctccgccgacccgtccccaaccctagcctccctcccgcgccgccccgacgcgacgccgtccggatctcgtgtgctccagtgcggcggggattcgtccgggcctggattgatttcctctctgcgcggcggatagggcatttcctacagccatggatattactcaaattctgctagctgctcaatctcctgatgctaaccttcgaacagtagccgaaaccaacctcacacagttccaggagcagaatcttccaaacttcctcctctccttatcagtggaactctcaaatgatgaaaaacccccagagtctagaaggcttgcaggtattatccttaagaattctttggatgctaaggattcttcgaaaaaggagctattgactcagcaatgggtcagtgtggatccttctatcaaatcgaagatcaaggagtcattgctgggaacactaggatcttcggttcatgatgcaaggcgtacctcatcccaagttattgccaaggttgcatcaattgagatcccacgtcgagaatggcaagacctcattgccaaattattgggaaacatgacactgccgggtgcatcagctcctttgaagcaagcaacactagaggcattggggtatgtatgtgaggagatttctccacagcacttggagcaggatcaagtgaatgctgttctgactgctgtggtccagggaatgaaccagacagagctcagctctgaagtccgtcttgcagcagttaaagccctctataatgctcttgactttgctgagagtaactttgcaaatgaaatggagaggaattatataatgaaggtgatttgtgacactgctgtatctaaagaagtggaaatcagacaagctgcatttgaatgccttgttgcaattgcatccacatattattcacacttagattattacatgcaaaccatattcaacctgacagctaatgcagtgaaaggagatgaggaaccggttgcacttcaagctgttgagttttggagcgctatttgtgatgaagagattgctctccaagatgaatatgaaggatctgatgatggcaactctactatacattttcgctttattgaaaaggcccttccttcactggttcctatgctgctagaaactttattgaagcaagaggaagatcaagaccaagatgacaatgtctggaacatttctatgagtggtgggacgtgccttggactcatcgctagaactgttggtgatgcaatcgtccctcttgtcatgccatttgttgaggccaacatcacaaagccagattggcattgtcgtgaggcagctacctttgcatttggttctatccttgaaggcccatctgttgaaaaacttgctccactggtccagagtggtcttggtttcttgctcaacacaatgaatgattcaaatacccaggtaaaagatactactgcttggacgcttgggagggtatttgagctcttgcattctcctgctggtgcaaacccaattataaatagttcaaaccttcctcgtatcatggctgtgttgcttgagagtagtaaagatgttccaaatgtggctgagaaagtttgtggagctatttattttctggcccaaggttatgaagatgcagagtccatgtcttctgtgctcacaccttatctacctaatgtcattgctgctctactttctgctgcggatcgtgctgatacgacccatttcaggcttcgtgcttctgcttatgaagcactgaatgagattgttagagttagcaacgtacctgaaacttcaggcattatagggcagctactgcaggagatcatgagaagattaaaccttacatttgatctccatatactttcttctggtgacaaagagaagcaaagcgaccttcaggctttgctgtgtggtgtactgcaggtcatcatccagaaactgagcagcacagatgctaagtccataattgccctgactgctgatcagctgatgactctgtttctgcgggtctttgcctgccacagttctactgtgcatgaagaagctatgcttgctattggcgctcttgcctatgctactggtccagattttgtgaaatacatgcctaacttcttcacgtatctggaagctggcttgcagaattatgaagagtaccaagtgtgctccatctctgtaggagtggtgggtgatatttgccgtgccttggaagataaaattctgcccttctgtgatcgaattatgactgttcttcttaaggatctatcaaactctatgctcaatcggtctgtgaagcctccgattttctcatgctttggagatatagctcttgctattggtgagaattttgagaaatatctgccatatggtatgccgatgcttcagggagctgctgaactccttggtactcttgatcagagtgatgatgatatggttgattatggcaaccagctcagaaggggaatttttgaggcgtactctggtatactccagggtatcaaaggcccaaaagcacagctgatgatcccatacgcaacccatctactgcagttcactgaagctgtcttcagagataggagcagggatgatagtgtgacgaaggctgcagttgctgtcctcggggatcttgctgacacacttggcgcgagctcaaaggatctgttccaggcccacctctttcatgttgagttcttgagggagtgccttgacttggatgatgaagttcgggagactgcgtcatgggctcaggggatgataaaccaagcggtggtctcataatgtgagacggttttgttatgttggctatgggaggtttcttttgtggctgtgccaagtccatttgccacaggtgaacgaaaggataccaatatatatgtagtgtcaggcttaggatccttgtcgtaggcatttgtgcgttgttgttaatctgtcaagccgttgtgtctaattagacttggtggattctgtcagtggatgtcttgaacagccaaacttggttcgtttatcctattgctggtattatcatttttcaaaaaaaaaaaaaaaaaaaa

SEQ ID NO: 6258 - protein, 868 aa, Panicum virgatum
  misc_feature: Ceres CLONE 1860404
  misc_feature (1)..(81): Pfam Name: IBN_N Pfam Description: Importin-beta N-terminal domain
MDITQILLAAQSPDANLRTVAETNLTQFQEQNLPNFLLSLSVELSNDEKPPESRRLAGIILKNSLDAKDSSKKELLTQQWVSVDPSIKSKIKESLLGTLGSSVHDARRTSSQVIAKVASIEIPRREWQDLIAKLLGNMTLPGASAPLKQATLEALGYVCEEISPQHLEQDQVNAVLTAVVQGMNQTELSSEVRLAAVKALYNALDFAESNFANEMERNYIMKVICDTAVSKEVEIRQAAFECLVAIASTYYSHLDYYMQTIFNLTANAVKGDEEPVALQAVEFWSAICDEEIALQDEYEGSDDGNSTIHFRFIEKALPSLVPMLLETLLKQEEDQDQDDNVWNISMSGGTCLGLIARTVGDAIVPLVMPFVEANITKPDWHCREAATFAFGSILEGPSVEKLAPLVQSGLGFLLNTMNDSNTQVKDTTAWTLGRVFELLHSPAGANPIINSSNLPRIMAVLLESSKDVPNVAEKVCGAIYFLAQGYEDAESMSSVLTPYLPNVIAALLSAADRADTTHFRLRASAYEALNEIVRVSNVPETSGIIGQLLQEIMRRLNLTFDLHILSSGDKEKQSDLQALLCGVLQVIIQKLSSTDAKSIIALTADQLMTLFLRVFACHSSTVHEEAMLAIGALAYATGPDFVKYMPNFFTYLEAGLQNYEEYQVCSISVGVVGDICRALEDKILPFCDRIMTVLLKDLSNSMLNRSVKPPIFSCFGDIALAIGENFEKYLPYGMPMLQGAAELLGTLDQSDDDMVDYGNQLRRGIFEAYSGILQGIKGPKAQLMIPYATHLLQFTEAVFRDRSRDDSVTKAAVAVLGDLADTLGASSKDLFQAHLFHVEFLRECLDLDDEVRETASWAQGMINQAVVS

SEQ ID NO: 6259 - DNA, 2550 bp, Panicum virgatum
  misc_feature: Ceres CLONE 1860423
  misc_feature: Encodes the peptide sequence at SEQ ID NO. 6260
agccgctttctctttcaccccgctccgctccgctcccttgcccccccggcccgcccgcctaccctttcgcagcctcgcctcgcctcgccgccgccgccgccgcccgccgccgccgatcgaggtactggcccccctgccctcgccaccgcctcgcgcgcggtctggatctggggtttccctctttctctcgggttgatccggggggaaggagtgcggggggctggtgggtgggcaggggccgagggggttgccgatcctagggctgccgcgggtgaaggcgtcgaccttgccggtgccgccgctcctcgtgctgggttccgattgctgctggttggggctctgcgaccgaggcctcggtgggggagcgattggctactgtgcgctggtggagtggggaaaggaaatgatgcgagaactgatgcgacaataaagcttcccggatggacggatgcgattgcatcgagccactatggccaacggacgatctgctcgtcaagtatcagtacatctcggacttcttcatagccctcgcgtatttctcgatcccgctggagctcatctacttcgtgaagaagtcgtccttcttcccgtacagatgggtcttgatccagtttggcgcgtttatagttctctgtggggcgacccatcttataaacctgtggactttcaccacacacaccaagactgttgctatagtcatgaccatagcaaaggtttctacggcggttgtttcctgtgcaacagctctgatgcttgttcatattatccctgacttgttgagtgtgaaaacaagggagttgttcctgaagaataaagctgaagagcttgatagggagatgggattgataaggacgcaggaggagaccggcagacatgttaggatgcttacccacgaaatcagaagtacacttgataggcatacaattttgaagactactcttgttgagctaggaaggaccttgggtctggaagaatgtgcgttgtggatgccatctagaagtggttcaagtcttcaactttcacatacattgcgccaccagattactgtcgggtcatctgtaccaattaatcttcctgtcgtcaatcaagtgttcagtagcaaccgagcaatcattataccccacacgtctcctttggcacggattcgaccacttgcaggtcgatatgttccgccagaagtggctgcagtgcgtgtacctcttctgcatctttcgaacttccaaataaatgattggccagagctttcagcaaaaagctttgcaatcatggttttgatgcttccatctgacagtgcaaggaaatggcatgtgcatgaattggagctcgttgaggtcgttgctgatcaggtagcagttgcactatctcatgcggctattcttgaagagtccatgcgagcacgtgatctactaatggagcagaatgttgccctggatttagctcgaagagaagctgagatggccatccgagctcgcaatgatttcctagctgttatgaatcacgaaatgagaacacccatgaatgcaataatagccctttcctccttacttttagaaactgagcttacacctgagcagcggttaatggtggaaactgtactgaaaagcagcaatcttttagcaacactcatcaatgacgtgctggatctttccaaactcgaagatggaagccttgaattggaaattaaagcattcaatctccatgctgttttcaaagaagtgatgagtttcatcaaaccaattgcatctatcaagaggctatctgtgtcagttatgttggcaccagatttgccgttaagtgccattggcgatgaaaagagactcatgcaaactattctgaacatatctggcaatgctgttaaatttaccaaggagggacacatcacccttgtagcttccgttgtgaaggctgactctttgagagagtttagaaccccagagtttcatccggctgcaagcgatgaccacttctatttgaaagttcaggtaaaagatacaggctgtggtattattcctcaggatctacctcatgtatttacaaagtttgctcatcctcaaagtggaggaaaccgagggttcaatggtagtggtcttggccttgctatatgcaaaaggtttgttagtctcatgggagggcacatctggctcgacagcgaaggaacaggaagaggttgcaccgcaacattcatcatcaagctcggcgtgtgcgacaacacaaacacctaccagcagcagctgatccctctagtctggccaagcagtgcagactccgattcatctggtccaaaagcgctccccgacgggaaaggatccgcctccctgaagtctcggtaccaaagaagcgtatgagcttactgtaaatgattgacggcgtagccccaagtaggggggaccgattagttccaccacctaattttgtttgtaaccctgtcatagcaggcatataatgtacaaataatgtaaagcaaatggggactgcggctgtgtacctgggtggcaacactgacttgctgcattgagtagtttatcctgccaaaaaaaaaaaaaaaaaaaa

SEQ ID NO: 6260 - protein, 634 aa, Panicum virgatum
  misc_feature: Ceres CLONE 1860423
  misc_feature (1)..(132): Pfam Name: HATPase_c Pfam Description: Histidine kinase-, DNA gyrase B-, and HSP90-like ATPase
  misc_feature (1)..(617): SWISSPROT Homolog: EC 2.7.13.3 Ethylene receptor
  misc_feature (1)..(625): SWISSPROT Homolog: EC 2.7.13.3 Ethylene receptor
MDGCDCIEPLWPTDDLLVKYQYISDFFIALAYFSIPLELIYFVKKSSFFPYRWVLIQFGAFIVLCGATHLINLWTFTTHTKTVAIVMTIAKVSTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPINLPVVNQVFSSNRAIIIPHTSPLARIRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIASIKRLSVSVMLAPDLPLSAIGDEKRLMQTILNISGNAVKFTKEGHITLVASVVKADSLREFRTPEFHPAASDDHFYLKVQVKDTGCGIIPQDLPHVFTKFAHPQSGGNRGFNGSGLGLAICKRFVSLMGGHIWLDSEGTGRGCTATFIIKLGVCDNTNTYQQQLIPLVWPSSADSDSSGPKALPDGKGSASLKSRYQRSV

SEQ ID NO: 6261 - DNA, 2075 bp, Panicum virgatum
  misc_feature: Ceres CLONE 1860507
  misc_feature: Encodes the peptide sequence at SEQ ID NO. 6262
agatcgccaaaacagccgagacttgacaccactcgggtgtgtggtggccttctccctcccgctggccacggcccacgggcagcagccactggttccgtctccaccgctcgtgctctcctgtcaggtgctcgcctcttccctccatctcctgcttacttctctgcagtgttccttgttccgtccgcttgtatgtatgctcgctcttcgcgcgtgcgaaatggccggaggcgaagctttcgggtgcagtgagcgcgagcggccgaagccgcgaagtgttcgggcggcgtggagccggcaattgccggcggccgtcgatcgtcgccatactgtacggactcggtgaccagatattgggaaccggctggtctctgttggttgggaaatggtgaagcgagcagggctgcctgctgcctgagcctgtgtgtatgagtgccgcggtggttatccttatccgagtcatcgactacgacggtgtgcagggcgggagacggcgaggggtgctgcagccgatgtgcaggccgggatccggatcgcgattggattattaagtatggatgggccgaatcaacctgctggttattattgggcctcgctagagtgctggcccactcgatagagcattttgtgctattgatttctcaattctacctgaagattcatcacatctcacatgacatcttaacaactgaacatttctgcattgtttccccagaaaatccgaagaaatggcggcggctgcaaccgcaaccctatccttggcgtcagttccttgcagaaagcatcagctccggcgtggagccagtgccttcaatgcgcaacaattcagtgcttccagctcccactggcagcagcactctgccactctgaggtggggagtgccaagaccacgcgccgcgaagcgtgtcatcgtcgcccaggccggcgccggcagctacaaggtggccatccttggcgcggcgggtggggtcggggagccgctctcgctcctgatcaagatgtccccgctcgtctcggcgctgcacctctacgacatcgccaccgtcaacggtgtcaccgccgatctcagccactgcaacacgccggtggaggtcgccggcttcaccgggaaagaagagctcgccggcagcctggccggcgcggacgtggtggtcatcaccgccggcgtgccccggaagcccggcatgacgctggacgacctgttcagcaccaacgccggcatcgtgaaggagctcgtggaggcggtggcggaccacgcgccgggcgcgctgatccacatcatcaccaacccggtgaactccacggtcccgatcgccgcggaggtcctcaagtggaagggcgcgtacgacccgcggaagctgttcggcgtcacgaccctgggcgtggtccgcgccaacgcgttcgtcgcggcgacgaagggcctcccgctggccgacgtcgacgtgccggtcgtgggcggccacgcggggaccaccatcgtgccgctgctgtccaaggcgcggcccaaggcggcgttcacggacgaggaggtcgaggagctcacggccagggtccagaacgccggcaccgaggtggtggaggccaaggccggcgccgggtccgcgacgctgtcgatggcgtacgccgcggcgcggttcctggaggcgtcgctgcgggggctcgacggcgacgccgacgtgtacgagtgcgcatacgtgcagtcccaggtcgtgccggagctcccgttcttcgcgtccagggtgaagctcgggagagaaggggtcgaggaggtggtgggatcggagctcagggggctctcggagtacgaggcgcgcgcgctggaggccctcaagccgcagctcaaggccagcatcgacaagggcatcgcgctcgtgcagcagcagcaggaggcggcgttgaactgaacctgctgaagaattggccgtcgtcttgtgtcaagtctgggatgctgggctgtgccggttttgtagcactgcacacccaacatccattttctactgaagattggagttggacggaacaatgaaaagaaaagaactctgaatctttgcgagatgcaaaaaaaaaaaaaaaaaaaa

SEQ ID NO: 6262 - protein, 391 aa, Panicum virgatum
  misc_feature: Ceres CLONE 1860507
  misc_feature (1)..(170): Pfam Name: Ldh_1_C Pfam Description: lactate/malate dehydrogenase, alpha/beta C-terminal domain
  misc_feature (36)..(391): SWISSPROT Homolog: EC 1.1.1.37 Malate dehydrogenase, chloroplast precursor
  misc_feature (63)..(383): SWISSPROT Homolog: EC 1.1.1.37 Malate dehydrogenase, glyoxysomal precursor
MAAAATATLSLASVPCRKHQLRRGASAFNAQQFSASSSHWQQHSATLRWGVPRPRAAKRVIVAQAGAGSYKVAILGAAGGVGEPLSLLIKMSPLVSALHLYDIATVNGVTADLSHCNTPVEVAGFTGKEELAGSLAGADVVVITAGVPRKPGMTLDDLFSTNAGIVKELVEAVADHAPGALIHIITNPVNSTVPIAAEVLKWKGAYDPRKLFGVTTLGVVRANAFVAATKGLPLADVDVPVVGGHAGTTIVPLLSKARPKAAFTDEEVEELTARVQNAGTEVVEAKAGAGSATLSMAYAAARFLEASLRGLDGDADVYECAYVQSQVVPELPFFASRVKLGREGVEEVVGSELRGLSEYEARALEALKPQLKASIDKGIALVQQQQEAALN

SEQ ID NO: 6263 - DNA, 1893 bp, Panicum virgatum
  misc_feature: Ceres CLONE 1860555
  misc_feature: Encodes the peptide sequence at SEQ ID NO. 6264
gtaccccatcaccggccggcctcgatcaattctgatccctttgcatgcctagctgctgccgctgcttgctttcttctccgatccgatccgatctgatccgatccttctcaatggtggtcgacgtctgaagaatcatatatacatctgattatagtagtacacccgtgttccttgctcctgctatagatagattattatcattatattggccgttgcagcagctagatagtagctacacacactgctagcagcttgtggcttgcactttgagctagtagcagtgatcgatcatcgatcatgagcatctcggtgaacgggcagtccgtggtgccgccggggttccggttccaccccacggaggaggagctgctcacctactacctcaagaagaaggtggcctcggagcgcatcgacctcgacgtcatccgcgacgtcgacctcaacaagctcgagccatgggacatccaagagaagtgccgcatcgggtcgggcccccagaacgactggtacttcttcagccacaaggacaagaagtacccgacggggacgcgcacgaaccgcgccacggcggcggggttctggaaggccaccggccgcgacaaggccatccacacctccgcccgccgcatcggcatgcgcaagacgctcgtcttctacaagggccgcgccccgcacggccagaagtccgactggatcatgcacgagtaccgcctcgagcttgacgacgccgcccaccccgccaccgccgccggcgatccctactacccctcgccgccgccgtccgccgcaatccgcgccggagaccaggcggcggcgcaggagcaggaggggtgggtcatctgccgggtgttcaagaagaagaacctcctgcaccacggccagagcagcggcggcggtggcgccaccgcgtcggcgacagacggcgcccacgcggcggcctccaagatggcggcgcccatggagggcagcccgagcaactgctcgtcggtgacggtcagcgaccacgccaaggcgccgcaggtgctccaccactccgccagcgacgacgcgctcgaccacatcctccagtacatgggcacctgcaggccctgcagcagcagcaagcaccaccaggccgacaccaagcccgcgctgctggatcaccaccacctggccgcaactactacggcggcggcgtgccacggcagcagcctctacgggaggttcatgaaactcccgcccctcgagcacgccggcggcggcggcgccctgctcccgagcccgggcgagtacggccccgccgacgcgtcggggatcgccgactgggacacgctggatcggctggccgcgtcgtacgagctcaacggcctctccgacgcgtccaagaccatggccgccttcttcgacgatcccaccggcaccgccggcgccgcggccttctccgctgctgccgcgcacgcgaccgtcgccggcgacggcgacctttggagcctcgcacggtcggtgtcgtcgtcgttgcacgcggacttgatgaacaacgtgtagcccagacacgacacagcatacatgcattgccaccgctaactccatctacacgcgtgcgttggccgtcgtatctcacgcacgtgtgtacacagtacacgtacctacgtgaataatccctagggagacagagccggttgctgatgatgtcgtgtgtccaagtgatggagctcgatcgagaggtgtggtgatcgacgatctgtgagctcatagaaaaaacaaggagaaactaaaagacatcaacagaaggacagagtggcagagctaggagaacacatgtattattatctatctatcatttgtacctatagcttaattgctactattataattaaactgcttttggttttctaaaaaaaaaaaaaaaaaaaa

SEQ ID NO: 6264 - protein, 408 aa, Panicum virgatum
  misc_feature: Ceres CLONE 1860555
  misc_feature: The sequence is a functional homolog of  SEQ ID NO 1270 in the  10/374,780 US patent application
  misc_feature: The sequence is a functional homolog of  SEQ ID NO 1423 in the  10/412,699 US patent application
  misc_feature: The sequence is a functional homolog of  SEQ ID NO 160 in the  10/666,642 US patent application
  misc_feature: The sequence is a functional homolog of  SEQ ID NO 194 in the  10/374,780 US patent application
  misc_feature: The sequence is a functional homolog of  SEQ ID NO 634 in the  10/412,699 US patent application
  misc_feature: The sequence is a functional homolog of  SEQ ID NO 638 in the  11/435,388 US patent application
  misc_feature: The sequence is a functional homolog of  SEQ ID NO 898 in the  10/225,066 US patent application
  misc_feature: The sequence is a functional homolog of  SEQ ID NO 898 in the  10/666,642 US patent application
  misc_feature: Useful for making plants with modulated growth and phenotype characteristics
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIHTSARRIGMRKTLVFYKGRAPHGQKSDWIMHEYRLELDDAAHPATAAGDPYYPSPPPSAAIRAGDQAAAQEQEGWVICRVFKKKNLLHHGQSSGGGGATASATDGAHAAASKMAAPMEGSPSNCSSVTVSDHAKAPQVLHHSASDDALDHILQYMGTCRPCSSSKHHQADTKPALLDHHHLAATTTAAACHGSSLYGRFMKLPPLEHAGGGGALLPSPGEYGPADASGIADWDTLDRLAASYELNGLSDASKTMAAFFDDPTGTAGAAAFSAAAAHATVAGDGDLWSLARSVSSSLHADLMNNV

SEQ ID NO: 6265 - DNA, 1827 bp, Panicum virgatum
  misc_feature: Ceres CLONE 1860556
  misc_feature: Encodes the peptide sequence at SEQ ID NO. 6266
cttctactgtccccgaagccttcttgcccgcgtcgcctcgcgcttgcgctgcctcctgttgccgccgcttctattgccattcagtccagtccgttcctggggaggaggaggtggagagggcgcgctgcttcgcgtggcaagcttgcttcgtttaggccttacgaattgccgagggcgacagcgacgtgctcgtcgaccgggcagagaaaatctagggaggcttgggctcgcgagacgcgtacgtgctctgtgggagacagccacttgctctcgctgccaatggctgagatctgctgcgaggaagccaagtccacgccggccaccgccgtggccgcggctgcagcggccgccgtggccgtcgcctcctcggcgctagagaggaggcgacgcaggttggagatgaggcggttccgcatcgcgaccgatctcgacgcgccggccgaggaggacgtccgcgctggcaagcggctgcggctggcgcgcacggcgtccggctcgtccgccgacgccgtcccggattgcaagaggccggccctgccggagcggttgccgaggtacggggtcagctccgtctgcggccggcgccgcgagatggaagacgccgtctccattaggccggacttcctgcccagcgccagcaagcaccacttcttcggcgtcttcgacggccacggctgctcccacgtggccacgttgtgccaggacaggatgcataaggtcgtcgccgatgagcacaacaacgccggctctggcgaagtggcggcgtggaagggtgtgatggagaggagcttcgcgcgattggacgagcaggccacgagctgggctagtcgtcgcagcggcgacgagccggcctgcagatgcgagcagcagatgccctcgcggtgcgatcacgttgggtccaccgccgtggtcgccgtagtcagccccacccacgtcgtagtcggcaacgccagcgactcccgcgccgtcctctcacgcgctggcgcgcccgtcgagctttccgtcgaccacaagcctgaccggcctgacgagctggcgcgcatcgaggcggcgggcggtcgcgtcatctactgggatggcgcccgtgttctcggcgtcctcgccatgtctcgagccataggcgatggttaccttaagccgttcgtgtcgtcggagccggaggtgacggtgacggagcgcaccgacgaggacgagtgcctgatcctggctagcgacggcctctgggacgtcgtgaccaacgagatggcgtgcgaggtcgtccgcgcgtgcttccgtagcaacggtccgccggcgccggccgctcggccggacggcgcggcgccgcccgcggccgacgcggacgccgagaacggatccgcggtggtcaagggcgtgagcaaggcggattccgacaaggcgtgctccgacgcggccatgctgctggcgaagctggcgctggcccggcggagcgccgacaatgtcagcgtggtcgtcgtggatctccgccgggggatatgattcttggagcagagcagaaatcatacgctccatgattgcttgctttagctcctttttttttttcaaatccacaatctaattcttccccattttaaccacccttccattttgatttagtcttaatagtagtagttcctgaccagatgaagatgaatataatagacgcttttcttctctcaaacgaggaattgaagctttagctggaacaaggaacaggaacggcgaaatgctgatctaggcctagcagcattgcagcaaccatgtactaccaatcgataagcacaaccttttggtcgtagattaacatgccaaaaaaaaaaaaaaaaaaaa

SEQ ID NO: 6266 - protein, 405 aa, Panicum virgatum
  misc_feature: Ceres CLONE 1860556
  misc_feature (1)..(306): Pfam Name: PP2C Pfam Description: Protein phosphatase 2C
  misc_feature (1)..(335): SWISSPROT Homolog: EC 3.1.3.16 Protein phosphatase 2C
MAEICCEEAKSTPATAVAAAAAAAVAVASSALERRRRRLEMRRFRIATDLDAPAEEDVRAGKRLRLARTASGSSADAVPDCKRPALPERLPRYGVSSVCGRRREMEDAVSIRPDFLPSASKHHFFGVFDGHGCSHVATLCQDRMHKVVADEHNNAGSGEVAAWKGVMERSFARLDEQATSWASRRSGDEPACRCEQQMPSRCDHVGSTAVVAVVSPTHVVVGNASDSRAVLSRAGAPVELSVDHKPDRPDELARIEAAGGRVIYWDGARVLGVLAMSRAIGDGYLKPFVSSEPEVTVTERTDEDECLILASDGLWDVVTNEMACEVVRACFRSNGPPAPAARPDGAAPPAADADAENGSAVVKGVSKADSDKACSDAAMLLAKLALARRSADNVSVVVVDLRRGI

SEQ ID NO: 6267 - DNA, 1820 bp, Panicum virgatum
  misc_feature: Ceres CLONE 1860598
  misc_feature: Encodes the peptide sequence at SEQ ID NO. 6268
acaccacaagtcacgcagccctctccctccttccttggttcccgtcgaatccccctgctctcctttctttctctctccccccccccccccttgccgttcaggaacctgcttgctctgctcgatcgccctgcgcttggttcttgcgcgtgagagctcagaagcgtgtccttttcgcttccgtttgattctatacctttgccaatccaatcgaacctccttgcttggtcccaaagggaggagaaagatcgaggagaaacgacggcggcgtaaaattccggggcgaggccgggcatggccatggttggtgctctgttcctttccatgagcgccgccgtgccatccgcttgactgaccagtcatcgtctccgtccgtgctcggcaccagctgaactcgcgcctcgaccaatcgccgtcagaacaagacagagagagctggtggcagaagctctctgcagctgcggcggagaactggtcccggagaaatgcggcagatctcgtcgctgctgcagggcctggcccggtcgctgtcggtggggagggacaggagaggggacggcggcgccggcgccggcgacgggaaggccgccgcgccggcggtgctaaggacgtcgggcacggtgtggggcgagggctcggagacgttcgcggccgtgtgctcgcggcgcggcgagaagggcaccaatcaggactgctccatcgtctgggaggggttcgggtgccaggaggacaccatcttctgcggcatcttcgacgggcacggcccgtggggccactacgtcgccaaggccgtgcgcgactcgctgccgccgtcgctgctgtgccactggcaggaggccctcacgctggcgtcgctcatcgacggcgagaagaagctcagcgactgccggttcgacctctcgaagcagtcctacgtggccgcctgcgccgccgtcgacgacgagctccgccgcagccgccgcctcgacgccgtctacagcggctccaccgcgctgtccatcgtcaagcagggcgacctcatggtcatcgccaacgtcggcgactcccgggccgtcctgggcaccaggtccgacgacggcgccctcgctgccatccagctcaccgtcgacttcaagcccaacctgcctcaggagaaggagcgcatccggcggtacaacggccaagtgtactgcctcgccgacgagcccggcgtgtaccgtgtctggcagcccagccgggactcgccggggctcgccatgtcgcgcgcgttcggagactactccgtcaaggactacggcgtcatctcggcgccggaggtgacgcagaggaagatcagcagcagggaccacttcgtcatcctcgccaccgacggggtctgggacgtgctctcgaacgaggaggcggtgcagatcgtggcggggacgccggacagggggaaggcggccaagcggctggtggagtgcgccgtccgcgcgtggaggcgccggcggcggggcatcgccgtcgacgactgctcggcgatctgcctcttcttccactcgccgccgtcgtaggggcgggcgcacacgacacgtgaacctgcctcaatcgacgtcaaggagacaacgagatgcacatctcaagactacgatcgtcgtgcccgtcgcgttcgtggttgggagtgcaattgtcgccgtccacgattcagaacgtgcagcttgtcgcatgatcgcgacactgcagctggtggatgaccaaacaaaaaaaaaaaatcccggctttcacaccgggcttgtcaaaatgtacgagaacgaacaccagccaccagaaaaaggagagaaaagatgcattttgtcctcgtttcc

SEQ ID NO: 6268 - protein, 348 aa, Panicum virgatum
  misc_feature: Ceres CLONE 1860598
  misc_feature (1)..(282): Pfam Name: PP2C Pfam Description: Protein phosphatase 2C
MRQISSLLQGLARSLSVGRDRRGDGGAGAGDGKAAAPAVLRTSGTVWGEGSETFAAVCSRRGEKGTNQDCSIVWEGFGCQEDTIFCGIFDGHGPWGHYVAKAVRDSLPPSLLCHWQEALTLASLIDGEKKLSDCRFDLSKQSYVAACAAVDDELRRSRRLDAVYSGSTALSIVKQGDLMVIANVGDSRAVLGTRSDDGALAAIQLTVDFKPNLPQEKERIRRYNGQVYCLADEPGVYRVWQPSRDSPGLAMSRAFGDYSVKDYGVISAPEVTQRKISSRDHFVILATDGVWDVLSNEEAVQIVAGTPDRGKAAKRLVECAVRAWRRRRRGIAVDDCSAICLFFHSPPS

SEQ ID NO: 6269 - DNA, 2272 bp, Panicum virgatum
  misc_feature: Ceres CLONE 1860617
  misc_feature: Encodes the peptide sequence at SEQ ID NO. 6270
ctccacttccacccaagtacccaaccccggcgcgtggccccgcctcgccgcgcgccaattcgcccgccgctctcgctccctcccccactctctctctctctttcttctcgccgcgtacacgcgcgcccaccccgctcgcgccacctaccctttcacggcctccccagacccccacgatcccgagccaccaccaggtaggcggcccccgccgcggggcggccgggctcgcgccgatggcggcgtccctcgccgccgcctccgcgcgcttcgtcgccggcggcgaggcctggccggcgcggccctgggccgcggccgcgcgcgtccccggcgtcgccgggcggcgccggcgccccgccgcgggcgtgcgctgcggaggggcgagggcgcccggcgccggcggcggggtttttccggaggaggcggaggcggaggcggaggaagggggccggttcgtggggtggttccgggaggcgtggccgtacatccggggccaccgagggagcaccttcgtcgtcgtcgtctcgggggaggtcgtcgccggaccccacctcgacggcattctgcaggatatatcccttcttcatggtcttgggatcaaatttgttctcgttcctggaacgcatgtccagattgataagctcttggctgagagaggaaagaaggctaagtatgctggtcgctaccgtattaccgattcagattcattagaggctgcaatggaggcagctggacgaatacggctaactatagaagcgaagctatctcctggcccaccaatgttaaatctccgccgacatggtgttaacggtcgctggcacgagattgctgataatgttgcaagtggaaattttcttggtgctaagaggcgaggggttgttggtggcattgattatggattcactggtgaagttaagaaaatagatgtttcacggataagagaaaggcttgatagagacagtatagttgttgtgagcaatatgggatactccagcgcaggggaggtcttaaattgcaatacctatgaagttgctacagcatgtgctttagccatagaggcggacaagcttatttgcattgttgatggccaaatatttgatgagcatggccgagtcaatcgtttcatgtctattgaggaggcagatatgttgatcaggacacgtgctaagcagagtgagattgctgcgaattatgtgaaggttgttgatgaggaggacattaatcatgtccgcaacctccagatgaaacaggattcagaacatggtttgaatggaaggagccatattaatgggtatactgattcagaacatggtttgaatgaaaggagccatattaatgggtatactgcatcttttcgcaatggtgtgggtttcaataatggaaatggtctgtctggtgagcaagggtttgctattggtggggaggaacgcttgagcaggtcaaatggttacctttcagagttggctgcagcagcatatgtatgccatggtggtgtccaaagagttcatatcgtggatggtactgtaggtggatcattgttgttggaactattcaccagagatggtgttggaacgatgatagctagggatatgtatgaaggcacaagaatggctagagaggaagatctttcaggtattagaaagatcattcatcctctagaagaatctggtgtcctggtgcgccgaacagataaagagcttcttgaagcactgacatcattcatcgtcgtggaacgagatggttcgatcatagcgtgtgctgctctctttccttatattgaggataaatccggagaagttgctgctattgctgtctccgaagaatgtcgaggacaaggtcaaggagacaagttacttgattacgttgagaagaaggctttatctcttggactggagaaattatttttgcttactacacggacagctgattggtttgttcgtcgcggtttcaaggagtgcttgatcgaatccttgccagcggagaggagaaaacggatcgacctttcacgcgggtccaaatactacatgaagcagctccaggctgcagagatagggcatatggctgtcaacggttttgccatgagaagatgcgtgttacaaacacgcaggtttacagatctagttgttgcacacgagggttgtttgatgacccctgcagcggttgtacattgtagagtttgtgtattttgcaagtaaataatcaatgtattcgcataaaaagaaagtaaataatcaatgcgatggcagttctcgagtaaaaaaaaaaaaaaaaaaaa

SEQ ID NO: 6270 - protein, 652 aa, Panicum virgatum
  misc_feature: Ceres CLONE 1860617
  misc_feature (1)..(77): Pfam Name: Acetyltransf_1 Pfam Description: Acetyltransferase (GNAT) family
  misc_feature (1)..(243): Pfam Name: AA_kinase Pfam Description: Amino acid kinase family
MAASLAAASARFVAGGEAWPARPWAAAARVPGVAGRRRRPAAGVRCGGARAPGAGGGVFPEEAEAEAEEGGRFVGWFREAWPYIRGHRGSTFVVVVSGEVVAGPHLDGILQDISLLHGLGIKFVLVPGTHVQIDKLLAERGKKAKYAGRYRITDSDSLEAAMEAAGRIRLTIEAKLSPGPPMLNLRRHGVNGRWHEIADNVASGNFLGAKRRGVVGGIDYGFTGEVKKIDVSRIRERLDRDSIVVVSNMGYSSAGEVLNCNTYEVATACALAIEADKLICIVDGQIFDEHGRVNRFMSIEEADMLIRTRAKQSEIAANYVKVVDEEDINHVRNLQMKQDSEHGLNGRSHINGYTDSEHGLNERSHINGYTASFRNGVGFNNGNGLSGEQGFAIGGEERLSRSNGYLSELAAAAYVCHGGVQRVHIVDGTVGGSLLLELFTRDGVGTMIARDMYEGTRMAREEDLSGIRKIIHPLEESGVLVRRTDKELLEALTSFIVVERDGSIIACAALFPYIEDKSGEVAAIAVSEECRGQGQGDKLLDYVEKKALSLGLEKLFLLTTRTADWFVRRGFKECLIESLPAERRKRIDLSRGSKYYMKQLQAAEIGHMAVNGFAMRRCVLQTRRFTDLVVAHEGCLMTPAAVVHCRVCVFCK

SEQ ID NO: 6271 - DNA, 2121 bp, Panicum virgatum
  misc_feature: Ceres CLONE 1860807
  misc_feature: Encodes the peptide sequence at SEQ ID NO. 6272
attaactccgcctttgtttgagaaatttctcctttgttcctctgctccttccttctctacaacacaaagatcgaagacaagattcccagtgatgaccccctcttcctccttggcttctgtctccatcgcaagaagaggcgacagacaagaagacgacacgcgattcaggcggcactcccaccattgctgctgacctccaaattgtcttctttcccccgctacctggctccccagatcgaatcacggcctcacgggtcaggcgctccaccctgacccgacgccatgagccactacaccatgcatgcaaccatcaactacgccgcgctgccgcccacgtcgccacaggagctccctctcccgtacctcccgccgcctccgccgccgccgttatcgctcccgccgttgctgtcgccgccgccgccaccaccggcggcggcgtccactgatgcgggctttcagagcaggatcagccccagcgtcctcctcatcatcttgatcttggccgtcatcttcttcatctccggcctgctgcacctcctcgtccggttccttctccgcccggcgccgcgggacgccggcgacgcgtacgggggcgacgcgaacgccaccgcgttccaggggcagctccagcagctgttccacctccacgacgccggcgtcgaccagtccttcatcgacgcgctgccggtgttcctctacggcgccgtggtcggcggcggcgggaaggaccccttcgactgcgcggtctgcctctgcgagttcgaggacgacgaccgcctccgcctcctccccaagtgcagccacgcgttccacgtcgactgcatcgacacgtggctgctgtcgcactccacctgcccgctctgccgccgcagcctcctcgccgacttctccccctgcggcggcggctgcagcccgctggtgttcgtcctcgagtccggctccgagggctccgtctccgatcgcctcgacgcggcgtcctctgcgcgcctcagcttcgtcatggagcaggaggaggcagggcaggaccggaagcacgccgctgcagaggccgcggagaagaaggacgaggtggtcgtccccgtcaagctcggcaagttcagaagccaggccaccgaaggagccggcggcagcgccaaccctggcggccaggacgtgaggcgctgcttctccatggggacctacgagtacgtcatggacgacagctccgtgctccgcgtggccgtgaagccgccggagaagaagcgccccgcgacgcgcatgccggggcaccgcgtcgccatgtcggagtgcgactgccactccaagcgggaaggcttccgcggcttcgacgcgccgctcaagcagcagcagctgcaggcgtccaaggccgcggtggacaagcgggagagcttctcgatctccaagatatggatgcgcggcgggccgaggcggaaggacgcgtcctccggccccgcgatcgccgccgggtcgtgctcgacctcgcgccgcgcgtcctcgttccggctctcctcggcgctccagcgcacggcgagcgacgttggggcggcggcggcggcggcgccgaagcgccggggcgacgcggtgagccccgtgacggagtcggagtacaacgtgtcgacgtgggacaagagcgccagcggcagcgtcgtggactgggacctcgagtccgcgggcggcggccgcggcctgagctccagggccgatgaggcgccttcgttcgctcggcggacgctgctctggatcagaggccacctgtgaagcgaagcggagatctgggcttcttccatcaccagccggttcttcctcctcctctgctcccctgtgtaaccgtgcacgcatgcatgcctgcatctccttctgcaagccaacattgcatcgcaggaactggtggatatgagttcgaattcagaaggattacagattgggattcccagatgttcccaccgggcatttcatctcacacttgtgtgtagtagattagctgtacttgctttggtttttactgtacattcaaacatttgttcagtaggcagggtgatttctgaactgaatatgtgaggctctgtttagttccaaaaaaaaattgtatagtatccgtcacaaaaaaaaaaaaaaaaaaaa

SEQ ID NO: 6272 - protein, 491 aa, Panicum virgatum
  misc_feature: Ceres CLONE 1860807
  misc_feature (1)..(42): Pfam Name: zf-C3HC4 Pfam Description: Zinc finger, C3HC4 type (RING finger)
MSHYTMHATINYAALPPTSPQELPLPYLPPPPPPPLSLPPLLSPPPPPPAAASTDAGFQSRISPSVLLIILILAVIFFISGLLHLLVRFLLRPAPRDAGDAYGGDANATAFQGQLQQLFHLHDAGVDQSFIDALPVFLYGAVVGGGGKDPFDCAVCLCEFEDDDRLRLLPKCSHAFHVDCIDTWLLSHSTCPLCRRSLLADFSPCGGGCSPLVFVLESGSEGSVSDRLDAASSARLSFVMEQEEAGQDRKHAAAEAAEKKDEVVVPVKLGKFRSQATEGAGGSANPGGQDVRRCFSMGTYEYVMDDSSVLRVAVKPPEKKRPATRMPGHRVAMSECDCHSKREGFRGFDAPLKQQQLQASKAAVDKRESFSISKIWMRGGPRRKDASSGPAIAAGSCSTSRRASSFRLSSALQRTASDVGAAAAAAPKRRGDAVSPVTESEYNVSTWDKSASGSVVDWDLESAGGGRGLSSRADEAPSFARRTLLWIRGHL

SEQ ID NO: 6273 - DNA, 1932 bp, Panicum virgatum
  misc_feature: Ceres CLONE 1860833
  misc_feature: Encodes the peptide sequence at SEQ ID NO. 6274
ctcttcctcccctcccaaactctcaaacctccggggccttcgcttcgcttccaacccccatcgatacttcccagcaagctacaagctcctccgctcagcctcatcattccatggccgatccccagacccaggccgaggccctggccgagcccgcgcggatcaacggcgccgcggcggaggccacgctctctggcggcgagctgacctggcgccccgccggcggcggggaggggcaggagcggcggctggagctggagtcggaggtgctcgggtgccgggtcgaggggaggaagctcagggttgcgacctttgccgctggcggcggcggagacggggagcggccctcggcgctagcctgcggcggcgggggcaaagggggaggaggggacgggagccggaggagaggggaggtggtgatggagatggaaagcgacgacgccgcggagcggtggggggacgccatcagggatcgcctcgcctcgctcgggccaaagagactgttcattatagtgaacccttatggtggaaagagaagcggccggagtattttccagaatgatgtcctaccgctcattgaagctgctggcattttttatacaatgcaagaaaccaagcatcgccttcatgctcaagagattgcacattcactggatcttagaaaatatgatgggatcgtttgtgtcagtggagatggtgtcctggtggaggttgttaatggtttgctgcaaagggaggactgggaaacagcaataaaagtgccacttgggatcatcccggcaggtactggaaatggaatggcacaatctttattgcatgccgctggtgaacctttctccatatcaaacgccatatttgcaataatcaggggtcacaaacgcgcacttgatgttacttctgttgtgcaggggaagacaaggttctttagcgttctgatgcttacatggggtctggtagctgatgttgatatcgaatcagagaagtacagatggatgggaagcgctcgccttgaattttatctccttctccgcgtgatcaacctgcgacggtacaatgggcgtgtccttttcgttccagcccccggatacgaagaagttggtgagcccgtggagcaaattcccagttttgaacagaacagagttagcaatggtagccaagaagataaagcaaatgacagaaatggcgaaaggattggttacccaggcccctcaatcgaagaagctgatctcgaatggagatcgctgagcggtccattcgtttcggtttggctcggcaacgtccctttcgctagtgaagatgccatggcagcacccaaagcagagttctccgatgggtacctggatgcagctataatcagggactgcccgcggtgggacgtgcttgggctcctgttccagatgaaggacggcgcgtacgtgaactcgccgtacgtggagtacttcaaggtgaaggcgatccggatcgagccgggcctgcgcgtgggcggcagcgccaagggcggcatcatcgactcggacggggaggtgatcgcgcggggcgacgggccccgcggcggcgaggcggagcacctgatggcgtacggcccgcccatccagctgacggtggaccaggggctggccaccatcttctccccgaggtcgagatgacacggctcttcttcaccatttattagtgatctccacttcattagccccgccattttattatctcgtttgttatagtactgtgtaaatactcacaccacaccacaatgcaagaagcaagagccaaggaggcaaggatgtctgtccgtcgagattctttgtttccaccgtagctactgctttactggcacttggagaaatgggacgtgtgcgagaccagttctacttctctttgctaccacatcaagggtgggccgatacaaatttttttcaaaaaaaaaaaaaaaaaaaa

SEQ ID NO: 6274 - protein, 510 aa, Panicum virgatum
  misc_feature: Ceres CLONE 1860833
  misc_feature (1)..(94): Pfam Name: DAGK_cat Pfam Description: Diacylglycerol kinase catalytic domain ( presumed)
MADPQTQAEALAEPARINGAAAEATLSGGELTWRPAGGGEGQERRLELESEVLGCRVEGRKLRVATFAAGGGGDGERPSALACGGGGKGGGGDGSRRRGEVVMEMESDDAAERWGDAIRDRLASLGPKRLFIIVNPYGGKRSGRSIFQNDVLPLIEAAGIFYTMQETKHRLHAQEIAHSLDLRKYDGIVCVSGDGVLVEVVNGLLQREDWETAIKVPLGIIPAGTGNGMAQSLLHAAGEPFSISNAIFAIIRGHKRALDVTSVVQGKTRFFSVLMLTWGLVADVDIESEKYRWMGSARLEFYLLLRVINLRRYNGRVLFVPAPGYEEVGEPVEQIPSFEQNRVSNGSQEDKANDRNGERIGYPGPSIEEADLEWRSLSGPFVSVWLGNVPFASEDAMAAPKAEFSDGYLDAAIIRDCPRWDVLGLLFQMKDGAYVNSPYVEYFKVKAIRIEPGLRVGGSAKGGIIDSDGEVIARGDGPRGGEAEHLMAYGPPIQLTVDQGLATIFSPRSR

SEQ ID NO: 6275 - DNA, 1701 bp, Panicum virgatum
  misc_feature: Ceres CLONE 1860937
  misc_feature: Encodes the peptide sequence at SEQ ID NO. 6276
atcccgccgcgctgctcttccccgcgatcccgtcgtgctgcccgccggcgatggcgggggcggaggggagggggctgaggcggagccgggtggcgttcgtgctggtggacgggatcggggacgtggcgatcccgtcgctgggcgggcggacgccgctggaggcggcgcgcgcgccgcggctggacgcgctggcggcgaccggggtggcggggctcatggaccccgtggagccggggctcgcgtgcggcagcgacacggcgcacctctccctgctcgggtacgacccgcgcgtgtactaccgcgggcgcggcgcgttcgagtccatgggcgccgggctcgccatggcgcccggcgacatcgccttcaagtccaactttgctacattggatgagaacacgggggttattgtcagcaggagggcagatcggcattttgaggaggaaggacctatcctctgtgctgcgttggatgggatgaagcttccatcatttcctgagtatgaagtcagagtcaggtatgctactgagcacagatgtggtgtggttgtcaaagggccaaagctgagtgggaacatttctggaactgatcccttgaaggacaaccggttgcatctgaaagctgaaccattggatgattcagaagaagctaaaaacactgcagctgttgtcaacgagctttctaaggagattacacgcatactggtttctcaccctatcaacacgaagcgtgcagctgaagggaagaacattgcaaatgttgtgctgttgcgtggctgcggcatccggattgaggtacctgcctttgaaaccaagcatggacttgcaccatgcatggtagctcctactaagatcatagctggcctggggctgtcactgggtattgatatccttgaagcacctggagcaaccggagattatcgcactctcttaacttctaaagctaaagctatagcaaaggcactctctgcccctatgaatacaccacctcgtgtttttgtccctggagaggatgaatataaagctggaagagaaaatgggtatgactttgggttcttgcacataaaggccattgatgatgctggccatgataaggctgtcaagctaaaggtacggggtctagaagctgttgatcgagctattggtcagcttgcaaggcttctttgggaagctgaaaaggcgggacactaccagtacttcctttgtgtcacaggagaccattctactcctgttgaatacggtgaccatagcatcgaacctgtcccatttgcattatgcaggctgagagattatgtgggagccattggggaggataatgtggtggacacaccccttgatgatttcccgctcccttcagtaaaatctggagatgatttggtagacaatatggagtcaaccgagcacaagcctgatcagcttaaagctttcagtggcgattctgtttatgaattcaatgagatcgccactgcgaggggctgccttggacgattccctggaagcgagatgatgggcatcatcaagaagtttatcaaggcgaagaatgattaacgctggtccaagtgctaacctttgtgtaatctattgattatgaggcttccatggctctgtagtaactaataatgacaaacaaacaaacatcgaaaaccatctggatctgagatgaataagcgctgccatggttcctcaaaaaaaaaaaaaaaaaaaa

SEQ ID NO: 6276 - protein, 497 aa, Panicum virgatum
  misc_feature: Ceres CLONE 1860937
  misc_feature (1)..(82): Pfam Name: Metalloenzyme Pfam Description: Metalloenzyme superfamily
MAGAEGRGLRRSRVAFVLVDGIGDVAIPSLGGRTPLEAARAPRLDALAATGVAGLMDPVEPGLACGSDTAHLSLLGYDPRVYYRGRGAFESMGAGLAMAPGDIAFKSNFATLDENTGVIVSRRADRHFEEEGPILCAALDGMKLPSFPEYEVRVRYATEHRCGVVVKGPKLSGNISGTDPLKDNRLHLKAEPLDDSEEAKNTAAVVNELSKEITRILVSHPINTKRAAEGKNIANVVLLRGCGIRIEVPAFETKHGLAPCMVAPTKIIAGLGLSLGIDILEAPGATGDYRTLLTSKAKAIAKALSAPMNTPPRVFVPGEDEYKAGRENGYDFGFLHIKAIDDAGHDKAVKLKVRGLEAVDRAIGQLARLLWEAEKAGHYQYFLCVTGDHSTPVEYGDHSIEPVPFALCRLRDYVGAIGEDNVVDTPLDDFPLPSVKSGDDLVDNMESTEHKPDQLKAFSGDSVYEFNEIATARGCLGRFPGSEMMGIIKKFIKAKND

SEQ ID NO: 6277 - DNA, 2290 bp, Panicum virgatum
  misc_feature: Ceres CLONE 1860998
  misc_feature: Encodes the peptide sequence at SEQ ID NO. 6278
accacacgccgaggcttgctcttcttcttcttgttgttgttgttgttgatagaaaaatagaattcaggggcagccggggcccgagatcggcgaggccggccgtgcttgctgctcgcgccattgacacatcgtccatctgctagcgcagaggtagcgaggtagtagcaatggagacccgggacagcgccccctccaccacgccgctcccctactcctactcgccgctgccggccgccgacgccgcctccgccgaggtctccggcgcccgcgcccgccggaggccgctctgcgccgccgcgctcgtgctgtccgccgcgctgctgctcctcgccgtcgcggcgctggccggcgtccgcatcgcgcccccgcggcccatcgcggtgggagagacggcggcggcggcgaggagcaggggccccgcggccggcgtgtcggagaagacgtccggcgcgtcgggggtgctgcttggcgagggcggcggcaacgccttcccctggagcaacgcgatgctgcaatggcagcgcacgggattccacttccagccgcacaagaactggatgaacgatcccaacggccctgtgtactacaagggttggtaccacctcttctaccagtacaaccccgacggcgccatctggggcaacaagatcgcgtggggccacgccgtgtcccgcgacctggtccactggcgccacctcccgctcgccatggtgcccgaccactggtacgacgccaacggcgtctggacgggctccgccaccaccctccccgacggccgcctcgccatgctctacaccggctccaccaacgagtcggtgcaggtccagtgcctcgccgtgccggccgaccccgccgacccgctgctcaccaactggaccaagtacgagggcaaccccgtgctgctgccgccggcggccatcggctccaaggacttccgcgacccgaccaccgcctggttcgacccctcggaccgcacctggcgcatcgtcatcggctccaaggacgcgcaccacgccggcatcgccgtcacctaccgcaccagggacttggtgcacttcgagctcctccccggcctgctccaccgcgtcgagggcacgggcatgtgggagtgcatcgacttctaccccgtcggcacccgggacgacgcctcccggaacggcgtcgacatgtcggacgccatctccgagaacggcgtcgccggcgacgtggtgcacgtcatgaaggccagcatggacgacgaccgccacgactactacgcgctgggccgctacgacgcggctgccaacgcctggacgccgctcgacccggccaaggacgtcggcatcggcctgcgctacgactggggcaagttctacgcctccaagaccttctacgacccggccaagcgccgccgcgtgctctggggctgggtcggcgagacggactcggagagagcagacgtcgcaaagggatgggcatccctgcagtcgatcccccgcacggtgctgctggacaccaagaccggcagcaacctcctgcagtggcccgtcgaggaggtcgagacgctgcgcaccaactccaccgacctcagcggcatcaccatcgaccacggctccgtgttcccgctcaacctccaccgcgccacgcagctcgacatcgtcgccgagttcgaggtcgaccgccgcgccgtcatggcgctcaacgaggccgacgtcggctacaactgcagcaccagcggcggcgccgccagccggggcgcgctcggccccttcgggctgctcgtcctcgccgacaagcgcctccgcgagcagacggccgtctacttctacgtggccaaggggctggacggcggcctcaccacgcacttctgccaggacgagtcgcgctcctcctccgccaacgacatcgtcaagcgcgtcgtgggcagcgccgtcccggtgctcggcggcgagacgctgtcgctccggatgctcgtggaccactccgtcgtggagagcttcgcgcagggagggaggtccaccgccacgtcgcgcgtctacccgacggaggccatctacgccaacgccggcgtctacctcttcaacaacgccaccgcggcgcgcgtcaccgccaagacgctcgtcgtgcacgagatggactcgtcatacaaccacgactacctttaattagttatctcggatcgatcatcatctccatctttaactgagccatccactacatacggcttgtactgtactactcccttgttaattccggtccaaattaaagcatgcatatgcatgcccctctccaaaaaaaaaaaaaaaaaaaa

SEQ ID NO: 6278 - protein, 658 aa, Panicum virgatum
  misc_feature: Ceres CLONE 1860998
  misc_feature (1)..(326): Pfam Name: Glyco_hydro_32N Pfam Description: Glycosyl hydrolases family 32 N terminal
  misc_feature (20)..(657): SWISSPROT Homolog: EC 3.2.1.26 Beta-fructofuranosidase 1 precursor
  misc_feature (81)..(653): SWISSPROT Homolog: EC 3.2.1.26 Acid beta-fructofuranosidase precursor
METRDSAPSTTPLPYSYSPLPAADAASAEVSGARARRRPLCAAALVLSAALLLLAVAALAGVRIAPPRPIAVGETAAAARSRGPAAGVSEKTSGASGVLLGEGGGNAFPWSNAMLQWQRTGFHFQPHKNWMNDPNGPVYYKGWYHLFYQYNPDGAIWGNKIAWGHAVSRDLVHWRHLPLAMVPDHWYDANGVWTGSATTLPDGRLAMLYTGSTNESVQVQCLAVPADPADPLLTNWTKYEGNPVLLPPAAIGSKDFRDPTTAWFDPSDRTWRIVIGSKDAHHAGIAVTYRTRDLVHFELLPGLLHRVEGTGMWECIDFYPVGTRDDASRNGVDMSDAISENGVAGDVVHVMKASMDDDRHDYYALGRYDAAANAWTPLDPAKDVGIGLRYDWGKFYASKTFYDPAKRRRVLWGWVGETDSERADVAKGWASLQSIPRTVLLDTKTGSNLLQWPVEEVETLRTNSTDLSGITIDHGSVFPLNLHRATQLDIVAEFEVDRRAVMALNEADVGYNCSTSGGAASRGALGPFGLLVLADKRLREQTAVYFYVAKGLDGGLTTHFCQDESRSSSANDIVKRVVGSAVPVLGGETLSLRMLVDHSVVESFAQGGRSTATSRVYPTEAIYANAGVYLFNNATAARVTAKTLVVHEMDSSYNHDYL

SEQ ID NO: 6279 - DNA, 2344 bp, Panicum virgatum
  misc_feature: Ceres CLONE 1861135
  misc_feature: Encodes the peptide sequence at SEQ ID NO. 6280
actgaagaagagaacccaagcaccaccttctcccaaatccccaaatccagttgagtgctccgtccgtcgcccagtcgcgactatggcgtccgctttagatccataggcgtggtaggcgtcctcgcgtcaccaaggcgctgcgggcggacgcgatactcggcgggaaatcagcggcgcgcggattccgccgcccgctgcacttctcacagctcgattgaacctggcagggattgaatcccggcatcctgccacgccggcgccacgcagctcgattggaggcttcgacgcgaggaaccagcagctactctgctccgcccctgcatcccatcccaggagcagcctccttgccgccggccgcctgcaagcagaggttcacattgacataaaactattgccatgtgtttaagtgatgcgtatcatgaggacctgatccagatatccagcagattcctgctttctttgggtccagttcatgtctcaatttgacttcacatttgctcctttccctgccacattgctatagagaaaaagtccctcacatttgacacaactaactatccatgtctgaccatcaaaggcactctggcagctatgaactccatgccactcagccagacgtgcaatgcctagtttgcacaagaccttttactctggacactgagattgctgatagctttgaagctttagcgatttgcagggagtgcaaggtgactgtgcttagtgacaattacagggatgagactaccagagctaatcgacaaacaagacggtcggggcaaagatccagggtcacaagggatgaacccatgggggacgctttcgcacagcagttctcccagttgatcaacctagctagacaaggtcatgaagcagatgttgattctccggcagtcccacatcagtatgcatcacatagttctacgccaaatcgatcccaaagatggcacagttcagatgacgagagtgatggtctcaattactctgattctgtgtttggtgaaattgaatcaaacattagttttggtgacgatgctggggaatcagatgcttctcttgagcaccaaaccacaatgggaagggacattttcattcaacttgacactgagagctacataaacatagatacagatattgatcccatgaatgctggactggatcagtgggattcagatgatccagaagatgatgaagatgaccagtctgaagagtctgatttggatgaagcaggcgacgccatgcaggagcaccggcagcgatggcttgatatcgacccaagtggattggatgagcaggaatccgaagatactgtgttgacttggagaacagctggaagccaaggggtaaacaggactgatttgagggcagacacagaaggccgagaaatcaggagagtttttattgggaatcctggtgattatgttgatgcaagacaattcgaaatgcttcttgaacagtttgctgaggatagctataccacaagaggagctccacctgcagcgacatcttccgtggaaaatcttccatctgtggtcatctccacaagcaatgagataaatggtggtgtaatatgtcctgtctgcaaagatgacatgcctatccaaactatagcaaaacagctaccatgcatgcatttataccattcatcatgcatcttgccatggcttagttctagaaatacatgcccagtttgtcgatatgagcttcctacagatgacacagaatatgagaggtccaagcgtgccacagccaacgagggaagcatccatggggtggagcatactcatccgcaggaaaccattgaagaaacttcttatgaacctgaggttgaaggaagttctaatacagttgggggtacaatggaagagactaatacacatgaacatgctgcttattctgcgcagcagccaaacagagcacgtggccgccatagatggctgtatattgcagcagctccagttgtaagtcttgccagtttagctatattactgtgcttcaccaactctgctggcaatgttagaaggcaactgttgtaccgtaaatcccagagtacaactacgacacagcatgtcgacacaagaagttggtggtctatgttctaaatatccagtacatacctgttgacccaaattgctgtgtgatggcatatgattgttgccagtgttgtgtcatttctgtgtgaagagtttcaagtttaatatgaacttcaaactttgtgttttctgacgagatccaccaaggtgtttttgtaatcaaattcatgaacatatatatttttttcttcataactttgctcagttcaacaaagcacatactgaattactgataaaaaaaaaaaaaaaaaaaa

SEQ ID NO: 6280 - protein, 512 aa, Panicum virgatum
  misc_feature: Ceres CLONE 1861135
  misc_feature: Great-hit functional homolog of the protein sequence given in SEQ ID NO 9620
  misc_feature (1)..(41): Pfam Name: zf-C3HC4 Pfam Description: Zinc finger, C3HC4 type (RING finger)
  misc_feature: Useful for making plants with altered Lignin content
MSDHQRHSGSYELHATQPDVQCLVCTRPFTLDTEIADSFEALAICRECKVTVLSDNYRDETTRANRQTRRSGQRSRVTRDEPMGDAFAQQFSQLINLARQGHEADVDSPAVPHQYASHSSTPNRSQRWHSSDDESDGLNYSDSVFGEIESNISFGDDAGESDASLEHQTTMGRDIFIQLDTESYINIDTDIDPMNAGLDQWDSDDPEDDEDDQSEESDLDEAGDAMQEHRQRWLDIDPSGLDEQESEDTVLTWRTAGSQGVNRTDLRADTEGREIRRVFIGNPGDYVDARQFEMLLEQFAEDSYTTRGAPPAATSSVENLPSVVISTSNEINGGVICPVCKDDMPIQTIAKQLPCMHLYHSSCILPWLSSRNTCPVCRYELPTDDTEYERSKRATANEGSIHGVEHTHPQETIEETSYEPEVEGSSNTVGGTMEETNTHEHAAYSAQQPNRARGRHRWLYIAAAPVVSLASLAILLCFTNSAGNVRRQLLYRKSQSTTTTQHVDTRSWWSMF

SEQ ID NO: 6281 - DNA, 1832 bp, Panicum virgatum
  misc_feature: Ceres CLONE 1861262
  misc_feature: Encodes the peptide sequence at SEQ ID NO. 6282
gcagtcaatcgttcgagtcacgccatacaacacggatagagacgacaacgccgcagcgcgaggacgacgacgacgacgaccaccaccacttctgaggccatggcgccgctgccgtctgggagcgtcgtcggcggggaggcggagctcgttccgacgctctcctcgctggagccggtctacggcgagggctcccagctcgacgaggcgcggctccgcttcgcccgcctcggggaccgcttccaggccgtccacggcgcccgccccgcgctcttcgcccgctccccagggagggtgaatctgatcggggagcacatcgactacgagggctactcggtgctgcccatggccatccgccaggacatgatcgtcgcgatccgcaaggcagacggcggccaggtgcgggtcgccaatgtcgacgacaagtaccccgtctgcgtctacccggccgaccccgacaaggaaattgacataaaaaaccacaaatgggggcactatttcatgtgtggatacaagggtgtatatgaatattgtagatcgaaagggatagatctgggcaaacctgttgcgctcgatgttgttgttgatggcacagtacctcaaggatctggtctgtcaagctctgcagcatttgtctgttcagcaacaattgctatcatgggggtccttgagaaaaacttcccaaagaaagaagttgctcaattcacgtgtctgtctgagcgccacattggaacacagtctggaggtatggatcaggctatatcaatcatggccaaacctggattcgctgagttgatagacttcaacccaatccatgcaactgatgtccaactacctcgaggtggtacatttgttattgcccattgtttggcagagtccaagaaagcagagacagccgcaacaaactacaacaaccgtgttgtggagtgtcgcttagcagcagttgttcttgccatcaaactagggatggataccaaaaaagctgtctcttctgttacaacactctcagatgttgaggggctatgtgtttcttttgcttcgaacgaaggttcatctgaccctggagtagctgtgaagaaacttctgcatgaggagccttatacggcggaagaaatagagaaaattacaggtgaaagcctgacatctgtcttcaagagctcacaaacttccttggatgttataaaagctgcaaagcactacaagctatttcagcgtgctagtcatgtctactcggaagcaaggcgggtttatgccttcagggatactgtctcatcaaagctcagtgaggaagataagcttaagaaactcggtgatcttatgaacgaaagccattatagctgcagcgtgctatatgaatgcagctgccctgagctagaggagcttgtgaaagtatgtagagaccatggagccctgggagcgcgtctcacgggagctggctggggtgggtgtgcagtcgctctagtcaaagaacccatcgtcccgcagttcatcctcaacctaaaggaaatgttctacaaatcaaggatcgaccggggagtgatcaagcagacggatctggggctgtacgtgttcgcgtccaagccgtcgagcggcgcggccatattcaagttgtagggggcgggcggccatattctttcgttcgcccgttgtacatccaagcagcagccagcgactggccagggacgagacgcagaataaactaaattcctcgtgtaactagtctagctccagtggtgtgttcgtccccggtggacacctgaaatgaaatatatttgttgtatcgaattatctcagaccgtgcatatacgagtcgatcgtcgcaggcatgttccttt

SEQ ID NO: 6282 - protein, 503 aa, Panicum virgatum
  misc_feature: Ceres CLONE 1861262
  misc_feature (17)..(503): SWISSPROT Homolog: EC 2.7.1.6 Galactokinase
MAPLPSGSVVGGEAELVPTLSSLEPVYGEGSQLDEARLRFARLGDRFQAVHGARPALFARSPGRVNLIGEHIDYEGYSVLPMAIRQDMIVAIRKADGGQVRVANVDDKYPVCVYPADPDKEIDIKNHKWGHYFMCGYKGVYEYCRSKGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPRGGTFVIAHCLAESKKAETAATNYNNRVVECRLAAVVLAIKLGMDTKKAVSSVTTLSDVEGLCVSFASNEGSSDPGVAVKKLLHEEPYTAEEIEKITGESLTSVFKSSQTSLDVIKAAKHYKLFQRASHVYSEARRVYAFRDTVSSKLSEEDKLKKLGDLMNESHYSCSVLYECSCPELEELVKVCRDHGALGARLTGAGWGGCAVALVKEPIVPQFILNLKEMFYKSRIDRGVIKQTDLGLYVFASKPSSGAAIFKL

SEQ ID NO: 6283 - DNA, 1781 bp, Panicum virgatum
  misc_feature: Ceres CLONE 1861332
  misc_feature: Encodes the peptide sequence at SEQ ID NO. 6284
aagacagtactgattagtaattacgtggtcatcaaaatcaagccatacggctgctccgtggtgattgaggcgttaacgatcctatccatcagtccatcgatccccattcctcttcccttctcttctccaccggatcggatcggatcggatcgatggtgccccggcccctcttcctgtcccccctgctgcttgtgcttgtgctagtgccagcggcgctcccccttccccgcgcctccgccgacatctgcatcgtgggcgccggcatctccggcgcctccaccgccttcttcctcaccaactactccacctcgctccatggagcacagctccgcgtcttcgagcgccatcacagggtgggcggacgcctcgccaccgtcgccgtcgccggcgaccgcttcgaggccgggggctccatcatccacccgcgcaacctccacgcgcgccgcttcgccgacctcctgggcctcgccgtcaaggccggcggcgacgacgattggctagggatctgggacggcaaaagcttcgtcttccagacgctccgcccgctgccgcccggaagctcctggtggcgtcgcaagctgcacggcctcctcaactcgctgctgctgctcaggcgatacggcctgtccctgctcaagatggacaagtttgtccaggaaatgctgcaaaggtttatgctcttctacaatggcttcgagtctcgcccagtctttgccacggttgaggatatgctcaaatggacgggcctctatggcctcacacgcaggaccctcgaggaggagctgcttgatgccggcctcaactctcggactatagcagagcttgtcactgtgatcacaaggatcaactatggccaaagcatgcgtataagtggcctggctggcgctgtttctttagctgggtccgagtcaggattatgggccgtcaaaggaggaaattggcaactagctgacggattgctaaagacctctaacgccaccttgcatctccaagaaggcatagactcaattactgatgctggggattattatgttctgagatccaatactgggagcgaatacaactgtaccgtgacggtagtggcaacaccacttgatgaggtgaatattacgtttagccctccaatatccattccaccgaggaagatgcagcacacacacgcaacctttgtcagaggcctgctgaaccctggatatttcggtctaaactcagcatcagatattccagagctgattggtaccctagagctccctgatatccctttctcatgcatctcagttctgaagaggtacagcaaagatgacatgacctacaagatgttctcacgcgcaaagctggatgatggtttactggatcagatcttcagcacaaggaaagagacgatccggataaattgggctgcttacccgcactatgaagcccccgaagagtttgctcctatattgttggacgggaagcagctgtactacgtgaatacctttgagagcgcagcgagtgccatggagacaggcgctgtgtcagcggagaatgtggcgcggctcatcatttctaggctttctctaacggagcgaggagtcgagcctcctgcccctcatatcaagtcattcacagaagaggaggaagaaggatcccggcgtcggcatgtagacctgtgaaactttgtactggtaggttctagatgggcatggggactctgtgcaacacatgtatagctgctgctgttgagttgcagcgtcatttttggcacattgatttaggtaataaacattgtgtggatggat

SEQ ID NO: 6284 - protein, 500 aa, Panicum virgatum
  misc_feature: Ceres CLONE 1861332
  misc_feature (1)..(50): Pfam Name: Amino_oxidase Pfam Description: Flavin containing amine oxidoreductase
  misc_feature (9)..(334): Pfam Name: Prenylcys_lyase Pfam Description: Prenylcysteine lyase
MVPRPLFLSPLLLVLVLVPAALPLPRASADICIVGAGISGASTAFFLTNYSTSLHGAQLRVFERHHRVGGRLATVAVAGDRFEAGGSIIHPRNLHARRFADLLGLAVKAGGDDDWLGIWDGKSFVFQTLRPLPPGSSWWRRKLHGLLNSLLLLRRYGLSLLKMDKFVQEMLQRFMLFYNGFESRPVFATVEDMLKWTGLYGLTRRTLEEELLDAGLNSRTIAELVTVITRINYGQSMRISGLAGAVSLAGSESGLWAVKGGNWQLADGLLKTSNATLHLQEGIDSITDAGDYYVLRSNTGSEYNCTVTVVATPLDEVNITFSPPISIPPRKMQHTHATFVRGLLNPGYFGLNSASDIPELIGTLELPDIPFSCISVLKRYSKDDMTYKMFSRAKLDDGLLDQIFSTRKETIRINWAAYPHYEAPEEFAPILLDGKQLYYVNTFESAASAMETGAVSAENVARLIISRLSLTERGVEPPAPHIKSFTEEEEEGSRRRHVDL

SEQ ID NO: 6285 - DNA, 1869 bp, Panicum virgatum
  misc_feature: Ceres CLONE 1861399
  misc_feature: Encodes the peptide sequence at SEQ ID NO. 6286
acttcattcccggcttggagcttgcttcctccgctcacctgtcagagtattccttccttttatggtcctcagcttctcattgcgttgcgcggacatgatctgagtggaggccgtgagggctgggcaagctaggttctggtgatcagggatcggagatggcgggcggcggcggcggaagctcgctgctgcgcggcttcctgtcgctcttcttcctcctcttcctccacattggccacgccggctgctgcttctctccgggggctgccgcgccggcgcgggaggaggacgaagcggcggacgcggaagacggtgggaaggtgggaggcggcggcgggagcaacaagaggaggaagatatcgccgttgattttctcgccggcagcgtcgtcctctgccgttaccaacggtagtgccagagcccggcgcgggcacgcgtcgtcggtcgccgccagcctccggttctacctccaccgaattttctcttcatccggggccaaggatggcgccgttgcgggcagggaggagcaggcggcggccaccaccgtgtcctcgccgctcgcgcagtccctggcgcctcaggcttcggcgtcggtggtgctgtcgacgccgtcatcgccgtgcgcgtcgtcgccgttcatgtcgccgctctcggtgcgcttcctcagcgccacccccgtgccgtcctcgccgcagaaactgctgcaggcgaacaggcagtcgtcacagtcgttcgccgcccgcggcgacgtgttcccctgcaaggtgtgcggcgaggtgctgggcaggccgcagctgcttgagctccaccaggcgatgaagcactccctgtcggagctcacccacctcgactccagcatgaacatcatccgcatgatcttcctcgccgggtggaagcccgccgcgtccggcgccgctgaggcccccgccgtccgccgcatcctcaggatccaccacaacccccgcgcgctcgcccgcttcgaggagtaccgcgacctcgtccgcgcgcgcgccgcccggcgccgcggcgagggcggcgccgccgtcgtggaggagcggtgcgtcgcggacgggaacgagcgcctgcgcttccactgctccaccatgctctgctccctgggcggcggcggcgtgtgcgggagcccctactgctgcgtgtgcagcaccctgcggcacggcttcgcggggaagcaggccgacgtggacggcatcgccacctacgcctccgcgtgggccgcgcacgcctccctccccgaggacgtcgagcgcgagttcgcgttcctccaggtgcgccgcgccatgctggtgtgccgcgtcgtggcggggcgcgtcggccgcggcgccgcggacgacaaggtggcctacgactccatggtgcccgcgcgcgccggcgccggcggcgacgacgtcgagctgctggtgttcaaccccagagccgtgctcccgtgcttcgtcatcctctacagcagctagccagtagccaggacgatggccaggccacgacgcggccagcctgcacgatgtactagtgtatagccttttcgcggctcctttgccccattgccagttcggtgtccccgccgctatggtcactcgccgcggcgcggcgtgggcgcggtcgtggggaggctcgcgcgcctgtcccggagctctggatctcctggttggaccgtgcaatcggcagtggccgatgccgtcatctaatttgccggatccgatcgaggttgggaatgatacggagttgagcgaccctaccatgcggatgcgacgcgccagagtcatgtatagtggtgtggttggcatgtttgtgtggctgctactgttgttgggtcccctgtcaactgttttgctacaaaaaaaaaaaaaaaaaaaa

SEQ ID NO: 6286 - protein, 437 aa, Panicum virgatum
  misc_feature: Ceres CLONE 1861399
  misc_feature: The sequence is a functional homolog of  SEQ ID NO 1317 in the  10/666,642 US patent application
  misc_feature: The sequence is a functional homolog of  SEQ ID NO 604 in the  10/666,642 US patent application
  misc_feature: Useful for making plants with modulated growth and phenotype characteristics
MAGGGGGSSLLRGFLSLFFLLFLHIGHAGCCFSPGAAAPAREEDEAADAEDGGKVGGGGGSNKRRKISPLIFSPAASSSAVTNGSARARRGHASSVAASLRFYLHRIFSSSGAKDGAVAGREEQAAATTVSSPLAQSLAPQASASVVLSTPSSPCASSPFMSPLSVRFLSATPVPSSPQKLLQANRQSSQSFAARGDVFPCKVCGEVLGRPQLLELHQAMKHSLSELTHLDSSMNIIRMIFLAGWKPAASGAAEAPAVRRILRIHHNPRALARFEEYRDLVRARAARRRGEGGAAVVEERCVADGNERLRFHCSTMLCSLGGGGVCGSPYCCVCSTLRHGFAGKQADVDGIATYASAWAAHASLPEDVEREFAFLQVRRAMLVCRVVAGRVGRGAADDKVAYDSMVPARAGAGGDDVELLVFNPRAVLPCFVILYSS

SEQ ID NO: 6287 - DNA, 1893 bp, Panicum virgatum
  misc_feature: Ceres CLONE 1861616
  misc_feature: Encodes the peptide sequence at SEQ ID NO. 6288
gactcgagccgcttccttccacggttccacggttccacccaccaccacccggcctccccctcctcctcgctccctctcccgccccggcacgaacgccgcgcgccgagcagggccagcggccggaatgcccgccgcgcctggccccgacgcccacgtcgaggaagctcctggcgccgacgcggacggcgggggaggccggaggtccccgaagccgacgctgaacggagcgccggaggagcggggcggcgggccgcggcaggccacggaccgccgccacgattccgacgctgacgacgaggaggaggaaggagacggcggcgggggcggcggcggcgacgacgacgacgactgcgacagccagtcgtcgcagagcgacggcgagatggacgagtttatgcttgtgaaattaatggatgttcggaaggaagtgcagtgccctatatgcttaggcattattcgaaagacaaggacagtcatggagtgtttgcaccggttttgtagggactgcatagataaatccatgcgacttggaaataatgaatgcccagcgtgccgcactcactgtgcaagtaggcgttccttgagggatgatcctaactatgacgcgttaattctggctttgtatccagatattgataagtatgaggaagaggaacttgctttcagtgaagaggaaagaacccgtaacaaaaagattcaaggatccattgctgagacatttcggagacagacagaagcacttgtgaaaaagcgctccactgcaaaagcagcagatgcagcttcaacaagaaagactcgacggaacatgcgatcaaggaggagagggcgaattagttctcctgatattgtcccaactgattttgaagatgaggatagagaagaaaatggtaatgatggaagcaaggagtcatcatctgttgatgaccgctccccagatgtaaggccgaaaagagctcggaggtggcccgcacggcgttcccctgctaagactactgggagtatcgacaatagcattgaggacaatgacgactcaggaggtgctagagacctggtgactgcttctccgctgcggggagagatgcttgcatgggggaaaaatggcactcgcagccaaacccggcatggaaatgccagtggctccagtggaaggatggccaagggtggccgtgttgctaagttggtggatcagctccgtaatactgatgactttgatagtaagttgagcttgtatcttgtcctgcttccacttgatagacaaagtatgcctaaactggaaaagccctaccttagttgtcagccaacactgtctgttcagcatctctgtcagttcgttgctcttcagttgtctcggcaacccaaagaagtcgagatatacattaggaaaaactccatggatgcatctttgtcagccaataacacctgtaaagatgagataaaaccagatcaatctaatggtttggaaagattgtgggaagagaagtctctttcggagctgtacccttcactcaccacctgtcaaggaaatctggaattgctatactctctgaaagaacaagtgtagatcaaatttcttcacaagttttcatgcactatcaactccgatccatcgccttgaacaccatggtctgcaaggatcttcacctggtgaaagctttgtacataaagcattcgatatagaaaaagggcgcaaaatagccttttatttactgttgcttgttttaaacttgctctgaaatattgtgagatatgtacccggttcattggttaaaaaatgtatggaactgagtagtggcaatccgaagttcctgaactggccaaacatgtgccttgagtattgattgtgccccattggaactgatttaagtaaccgagcaaaaaaaaaaaaaaaaaaaa

SEQ ID NO: 6288 - protein, 478 aa, Panicum virgatum
  misc_feature: Ceres CLONE 1861616
  misc_feature (1)..(40): Pfam Name: zf-C3HC4 Pfam Description: Zinc finger, C3HC4 type (RING finger)
MPAAPGPDAHVEEAPGADADGGGGRRSPKPTLNGAPEERGGGPRQATDRRHDSDADDEEEEGDGGGGGGGDDDDDCDSQSSQSDGEMDEFMLVKLMDVRKEVQCPICLGIIRKTRTVMECLHRFCRDCIDKSMRLGNNECPACRTHCASRRSLRDDPNYDALILALYPDIDKYEEEELAFSEEERTRNKKIQGSIAETFRRQTEALVKKRSTAKAADAASTRKTRRNMRSRRRGRISSPDIVPTDFEDEDREENGNDGSKESSSVDDRSPDVRPKRARRWPARRSPAKTTGSIDNSIEDNDDSGGARDLVTASPLRGEMLAWGKNGTRSQTRHGNASGSSGRMAKGGRVAKLVDQLRNTDDFDSKLSLYLVLLPLDRQSMPKLEKPYLSCQPTLSVQHLCQFVALQLSRQPKEVEIYIRKNSMDASLSANNTCKDEIKPDQSNGLERLWEEKSLSELYPSLTTCQGNLELLYSLKEQV

SEQ ID NO: 6289 - DNA, 2259 bp, Panicum virgatum
  misc_feature: Ceres CLONE 1861623
  misc_feature: Encodes the peptide sequence at SEQ ID NO. 6290
aatccattccccatttttctttttaggtttctcccgttgatttcgcccttccactgtgctgccaccaccacttcgtggggaaccaccctcctcgatcccctcccgaacccaccggcggcggcggaggaggcggaggcgagtggcggcggagaactcccccgaggtcacacctactcggatcggattgccttcgtggttcgtgattggttggtcgcccgcggcaatgggacgaagggcgtggtggtctccatagggaactctcgattgcgtccttgttgtgatggcttcgactgccgcccctgaggtcgtcgcggagaagaaatgcgacaaaaccgtcgcgggtaagagtaacgccgcaccattgacttgccaagggcagtccaaggactcggctgagaacgccagcaaattggggcccgcttcgccatgtgaaatcatgaccagcgatgcgcctacatccagtggggtcaaagaaagcagcaattctgctgatggttctttgaagctggatgacagtgaagatgctgagaagagctccctacggggaagcgttaaggatagctctgtgtctgctaaatgcagtgacagggaaagcagcctgtccaaagccagcgggagcgccaaggttagcgaccaagctgctgatatggttgagagtggcaagagtagcctctatcgggcgagtggtggcagtgatgtgagcgatgagagcacctgcagcagtatatgcagcagtgtcagcaagcctcacaagtccaatgactcaaagtgggaagcgattcaggcggtccgagcgaaagaaggctcagtaagtctaagtcatttcaggctgctcaagaggcttggctgtggtgacattggcagcgtgtatttgtcagagcttagtggcacgaaatgttactttgctatgaaaattatggacaagacatctctagcaagccgcaaaaagctgctgagggcacagactgaaagggagatattgcagtgcctggaccatccttttcttccaacattgtacactcactttgaaacagataagttctcatgcttggtgatggagttctgccctggaggtgacctgcataccctaaggcaaaagcagcctggcaagtatttccctgaacaagctgccaagttttatgtagcagaggttcttttggctcttgaatatctgcacatgcttggtatcatataccgtgatttgaagccagagaatgttcttgtgagagaagatggccatatcatgttgtcagattttgatttatccctccgatgtgctgtgagccctacacttctcagatcttctaaccccagtgcagataaccaaaagagcaatccagcttactgcgtgcagcctgtgtgcattgagcctgcctgcattcagccatcttgtgtcacgacaaccacatgcttctctcctcgctttttctcctccaagtccaagaaagagaaaaaggagaagaaggcaaaggcagacttggcaaatcaggtcagaccactacctgagcttgttgcagagccgacagatgcaaggtctatgtcttttgttggcacccatgagtatttggcaccagagattataaagggcgagggacatggaagtgccgtggactggtggacatttgggatattcttgtatgaacttctttttggcaagaccccattcaaaggttctggcaatagggcaactttgttcaatgtagttggacagcccttaaggttcccagaatcaccagtagtgagttttgccgcaagggatcttattagggggttgctcatcaaggaaccgcagtatcgattagcttataagcgtggagccacagaaataaaacagcatcccttcttcgaaggtgttaactgggcattgataaggtgtgctacaccaccagatatccccaaacccgttgagatccctcgttcagtagcctcgtcaagccagaaggctacatcagcagctgagaaaggttcagactatcttgaattggagttcttttagtggagtcatctatgatctcccatgtgcaagttgtaaagtttatctttttccccttagacttctccttcttctctggattctaataactttatatgttgatgcatatggtcctagtgtcgttctctttcagtttggttctcagtccatttcattaaatgggagcctctatcaggtggaatttgtaatctgtcattggttaccttgcactaggttctctcaataacatggaaacatttttctttcaaaaaaaaaaaaaaaaaaaa

SEQ ID NO: 6290 - protein, 571 aa, Panicum virgatum
  misc_feature: Ceres CLONE 1861623
  misc_feature (2)..(571): SWISSPROT Homolog: EC 2.7.11.1 Protein kinase G11A
  misc_feature (85)..(571): SWISSPROT Homolog: EC 2.7.11.1 Protein kinase PVPK-1
MASTAAPEVVAEKKCDKTVAGKSNAAPLTCQGQSKDSAENASKLGPASPCEIMTSDAPTSSGVKESSNSADGSLKLDDSEDAEKSSLRGSVKDSSVSAKCSDRESSLSKASGSAKVSDQAADMVESGKSSLYRASGGSDVSDESTCSSICSSVSKPHKSNDSKWEAIQAVRAKEGSVSLSHFRLLKRLGCGDIGSVYLSELSGTKCYFAMKIMDKTSLASRKKLLRAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCAVSPTLLRSSNPSADNQKSNPAYCVQPVCIEPACIQPSCVTTTTCFSPRFFSSKSKKEKKEKKAKADLANQVRPLPELVAEPTDARSMSFVGTHEYLAPEIIKGEGHGSAVDWWTFGIFLYELLFGKTPFKGSGNRATLFNVVGQPLRFPESPVVSFAARDLIRGLLIKEPQYRLAYKRGATEIKQHPFFEGVNWALIRCATPPDIPKPVEIPRSVASSSQKATSAAEKGSDYLELEFF

SEQ ID NO: 6291 - DNA, 2062 bp, Panicum virgatum
  misc_feature: Ceres CLONE 1861779
  misc_feature: Encodes the peptide sequence at SEQ ID NO. 6292
gcccaggtcgtcgccaccctcccacctctgcttcctccgccgccgcccaggacggcgtcgacgtcacctacctgcccgtccttgcctcctcctctgccgccacctgctctacctcaacctcctccaccgtggtcccgcgcataagcccgataaaggcttcgcggtcagggcggcggcttcctccccatccccacaccgcgacgcgtgcggaaaccctagccgccggtgatgtcggaccccctctacccgttctcccgcggcgctctccctggcggcgacggcaagccgccgccgccgcggtactcggattttgaggtcgacctcatcgcggcccgctacgcctcttccccgccgcctccgccgtacccctccgccgccgacgccagcgccttcgactcgcacgtcggcgctttcgactcgcacatcggtgccttcgactcgcacgtcggcgccttcgactcgcacatcggcgccttcgacttgtacgtcggtgcggggcgatacgcgggagctctctatcaccaatcttttatgggaagtcatagtactgttggccagaatgaggctttatattcatcaaatactatggctaaacgccctaggcttgaaagcagccttcctatgtatccacaacgaccggggaaaaaggactgtgccttctatatgaggaccagaacctgtaattatggagagacctgcaaatttgaccatccacaatgggttccagagggtggggttccaaactggaaagaggtccctgaagattcttatcctgagcgaccaggggaaccagattgtccttattttgtgaagtctaatagctgtagatttaaatctaaatgcaagttcaaccatccaaaggaaaaggtgaatgcattatgtgctggaacggacaacggatctctaattgctgatagcgccatcttaccagtgaggccttctgaacctgtttgttccttctatgtaaaaacaggaaaatgcaaatttggtgcaaaatgcaagttcaatcatcccaaagatgttgagatagcacctgtgattgcaaaggaaaccatatatacagcaacaactgatgcagcagcacacattggtacagcagatagttcagttcaagcaaaggcgcatgcaccaactgccccagctgaggcacataacgcaaaggggtttcctataagaccaggtgaagttgattgcttgttttatatgaagacaggcagctgcaaatatggttctatttgtcgcttcaaccatccttatcggccagttgtggatgtagcattgatggatccactggttcaagatactcttcctactccagctcccattgactctgcggcggtgttaaatccagctgcaaatattatgcaatgctttgatttttatgcgactcatgtgcctattgaacctctgccaataatgtatcctcagaggcctggagaaactgtttgtgatttttacatgaagacaggatcttgcaagtattctcagaagtgcaagtttcaccatcctatcaaccgctctgtacatgatgccaatgaaaacgaggatcctcagcagcctgtgacgcttactcttgctggccttccaaggagagaggacgctgagatctgtgccttctacatgaggtctggcacgtgcaggtatggcgtgctctgcaagttcgaccaccctcccctacaggaggctatcgccaagctgcaggcaggcggaaaggaaggtgagaaggaggaaggtgaggagaaggaaggtgtggagaagaaaggtgtggaggagaaggaagggttgagcgtcgtcctgcgctaggccgtgatgctgcatcctgtcacctgcctcattatatagattgtaagaaacgcgctggtagttaaaggttgatgttgtccgggttgtggtgggcgtccgatttgtgaagttgagtaccaccggtagagtttattggagcagtgctggtactggtgagttatatcttcgtttttttgccgtagatgacagtaatctggtaggatgtcatgttgggccttgtttggttggaggtgaaaaagttttgatgaaaactttttgc

SEQ ID NO: 6292 - protein, 524 aa, Panicum virgatum
  misc_feature: Ceres CLONE 1861779
  misc_feature (1)..(27): Pfam Name: zf-CCCH Pfam Description: Zinc finger C-x8-C-x5-C-x3-H type (and similar)
MSDPLYPFSRGALPGGDGKPPPPRYSDFEVDLIAARYASSPPPPPYPSAADASAFDSHVGAFDSHIGAFDSHVGAFDSHIGAFDLYVGAGRYAGALYHQSFMGSHSTVGQNEALYSSNTMAKRPRLESSLPMYPQRPGKKDCAFYMRTRTCNYGETCKFDHPQWVPEGGVPNWKEVPEDSYPERPGEPDCPYFVKSNSCRFKSKCKFNHPKEKVNALCAGTDNGSLIADSAILPVRPSEPVCSFYVKTGKCKFGAKCKFNHPKDVEIAPVIAKETIYTATTDAAAHIGTADSSVQAKAHAPTAPAEAHNAKGFPIRPGEVDCLFYMKTGSCKYGSICRFNHPYRPVVDVALMDPLVQDTLPTPAPIDSAAVLNPAANIMQCFDFYATHVPIEPLPIMYPQRPGETVCDFYMKTGSCKYSQKCKFHHPINRSVHDANENEDPQQPVTLTLAGLPRREDAEICAFYMRSGTCRYGVLCKFDHPPLQEAIAKLQAGGKEGEKEEGEEKEGVEKKGVEEKEGLSVVLR

SEQ ID NO: 6293 - DNA, 2711 bp, Panicum virgatum
  misc_feature: Ceres CLONE 1861972
  misc_feature: Encodes the peptide sequence at SEQ ID NO. 6294
gacacgcactaggagagcttcaccgtccgagatggcggcagcagtggcagtgactcgccggatcaatgccagcctccacatcgaggcaaccggcaatggcgcagccgacggggagagccggcgtgacagcgctgcagcttactcgcccgcggccaagcggatcaacgacgccaaggacagtgatgtctgggtggccgtccaggagggagacatgcctggcgactctacccaggccctgctgttccggaccatgaagatcaagggcagcatcctgcatccttacaggttcgtgattcttctgcggttgatcgcggtcatcgcattcttcatatggcgcattcggcacaggaaccatgacggggtgtggctctggttcatgtccatggttggggacgtctggttcggcttctcatgggttctcaaccagctcccgaagctcaaccccatgaagcgcgttccagacatcaccgccatcagagatcagtacgaatgctccacctccggcgaatccaagctgcctggcattgatgtctttgtcaccaccgtcgacccggtggatgagcctatactttacacggtgaactccatcctctccatccttgccactgattacccagtagagaagtatgcctgctacctttcagatgatggtggaacgttaatccactatgaggcaatgtttgaagttgcaaattttgctaagttgtgggttcccttttgccggaagcattgcatagagccaagagccccagagaactactttggggtgaagaggcaaccatacatgggaagtatgcaagaagagttcatgagtgatcacaggcgtgtgcgcagagaatacgaagaattcaaggtgaggatagactctctttttaacaccatctaccaaagatctgaggcatacaacagcaagaataccaaacaagatggtgtcaaggcaacttggatggctgatggaacacaatggcctggcacatggattgagcaagctgagaaccatagaaaaggacaacatgctggaattgtaaaggtcatactaaaccatccaagccataagaaacaactcggaccgccagcaagcattgacaatccatttgactttagcaacgttgacatgcgcctccccatgcttgtctatttatcccgcgaaaagcgccctggctataaccaccaaaagaaggctggtgccatgaatgcgatgctccgtgtctctgccttgctctccaacgcaccctttctcatcaacttcgactgtgatcactatatcaacaattcacaagcttttcgagccgccatgtgctttatgcttgacccccgtgatggccaaaacaccgcctttgtccaatttccacaacgctttgatgatgtcgacccaacagaccggtatgccaaccacaaccgtgtcttctttgatggcaccatgctctccctcaatggtctacaagggccttcctaccttggcactggaactatgttccgtcgtgctgcactctacggcatggagccaccacgatggagagcagacaccatcaaggtaataagcaaggccaaagaatttggccaatcaacattattcataaactcaatgatagatggtgtgaaccaagaactgtctatcacaccaatattccttgaagagtcggtcaacaatgagttgagtaccctgatgacatgtgcttatgaggatgggactccatgggggagagatgttggatgggtgtacaacatcgcaacggaggatgtggtgacaggatttcgcatgcaccggcaaggttggcgctccatctactgctccatagaaccagctgcattccgtggcactgctccaatcaacctcactgagcgtctcctccaagtattacgctggtcaggtggctcccttgaaatgttcttctcccatagcaatgcattccttgctggtcctcggatgcagcacctgcagcgcattgcatacctgaacatgtcaacctatccaatcgtcacaatattcatcctagcctacaacctatttcccgttatgtggctcatctctgagcaattctacatccaaaggcccttcggcccatatatcttatacctcgtaataatcattgcaatgatccatgtgatcggcatgttcgaggtgaaatgggcaggcatcaccttgctggactggtgccgcaacgagcagttttacatgattggcgcaactggtgtgtacccgacagcagtgttttacatggtgttgaagctcatcacagggaagggtattcacttcaggctcacatcgaagcagacagaagcttgctccaatgataagtttgctgacttgtacgtcgtgaggtgggtgccgttgttaatcccaaccattgcagttctggttgtgaatgtcgcagctgttggagtggcaataggtaaggccgcaacctgggggctgttcacagaacaggcacagcacgcaatgcttggaatggtgttcaacgtgtggatccttgtgcttctatacccatttgcactcgggatcatgggacagtgggggaagaaacctgccatcctgtttattctgcagctgatgtccatttgttcagtcgctatcatgtatatcactttccgcgtgccatatacccttcagactggtcagaaattgcaacttcttttggtaaagcggaattaatgactggatcatctatggtggaataaaaaaaaaaaaacaaaaaaaaaaaaaaaaaaaa

SEQ ID NO: 6294 - protein, 873 aa, Panicum virgatum
  misc_feature: Ceres CLONE 1861972
  misc_feature (2)..(785): Pfam Name: Cellulose_synt Pfam Description: Cellulose synthase
MAAAVAVTRRINASLHIEATGNGAADGESRRDSAAAYSPAAKRINDAKDSDVWVAVQEGDMPGDSTQALLFRTMKIKGSILHPYRFVILLRLIAVIAFFIWRIRHRNHDGVWLWFMSMVGDVWFGFSWVLNQLPKLNPMKRVPDITAIRDQYECSTSGESKLPGIDVFVTTVDPVDEPILYTVNSILSILATDYPVEKYACYLSDDGGTLIHYEAMFEVANFAKLWVPFCRKHCIEPRAPENYFGVKRQPYMGSMQEEFMSDHRRVRREYEEFKVRIDSLFNTIYQRSEAYNSKNTKQDGVKATWMADGTQWPGTWIEQAENHRKGQHAGIVKVILNHPSHKKQLGPPASIDNPFDFSNVDMRLPMLVYLSREKRPGYNHQKKAGAMNAMLRVSALLSNAPFLINFDCDHYINNSQAFRAAMCFMLDPRDGQNTAFVQFPQRFDDVDPTDRYANHNRVFFDGTMLSLNGLQGPSYLGTGTMFRRAALYGMEPPRWRADTIKVISKAKEFGQSTLFINSMIDGVNQELSITPIFLEESVNNELSTLMTCAYEDGTPWGRDVGWVYNIATEDVVTGFRMHRQGWRSIYCSIEPAAFRGTAPINLTERLLQVLRWSGGSLEMFFSHSNAFLAGPRMQHLQRIAYLNMSTYPIVTIFILAYNLFPVMWLISEQFYIQRPFGPYILYLVIIIAMIHVIGMFEVKWAGITLLDWCRNEQFYMIGATGVYPTAVFYMVLKLITGKGIHFRLTSKQTEACSNDKFADLYVVRWVPLLIPTIAVLVVNVAAVGVAIGKAATWGLFTEQAQHAMLGMVFNVWILVLLYPFALGIMGQWGKKPAILFILQLMSICSVAIMYITFRVPYTLQTGQKLQLLLVKRN

SEQ ID NO: 6295 - DNA, 2050 bp, Panicum virgatum
  misc_feature: Ceres CLONE 1862004
  misc_feature: Encodes the peptide sequence at SEQ ID NO. 6296
aaccagccggcgtcaattccattccttaattgccaatggcgaccgcttgggccagtacggccttaccgcgggcgccttgggataaactctgcggcaaggaaggcacccggtgcggccttaatagcctcttcagtcctccccccgtggcagctctggtcccgcgggttgtggtagggcaccgccatgggtggtcttgttggccctggcttcgtgctgctttcgtgggtgcttttctccccctgcctgtgctcagtggatgggctgtccaaggtgagggctgttaacttgggaggatggctggtggttgaagggtggattaagccatcactttttgacgggattccaaatggggatatgctagatgggactcaggtgcagctccgctctgttgtgttgaataaatatgttagtgcagccaatgggggtggttcgaatgtgacagtggaaagtgatgtggcctcaacatgggagacatttaggctttggagggtgtcagaaaatgaatttcagcttcgatgtcttggaggtgaatttttgacatcaaacagtgaagatggtttgatcttggcaactgcaagggaaccattgtccactgagactttctacgtcgaaaggaatgatgaaagggtccatatcaaacttctgaatggaggctatgtgcaagcaacaaacgatcatctgcttatttccacttatcaattccaaccaggatgggataataatttagtgacatttgaattggtgattgttgccaatgacctgcatggagactaccagcttgcgaacggttatggttacgagagggcgaagatggtcttggaagagcacagaacaagtttcataacagcaagcgactttgatttcctatctcgacatggaattaatactgtgagaattcctgtcggatggtggataacacaagatccatatccaccttctccatttgtaggagggtctttggcagctctggacctagcattttcatgggcacaatcttatggtttgaaatgtataatcgatctccatgctgctcctggttctcaaaatggaatggaacacagtgcgagcagggatggttccgtggactggacctcacctgaatatgtctcgcaaacattagaagttattgatttcctggcgacaaggtatggaggccatccttcccttttgggcattgagcttctgaacgaaccttctgcagctaccgttcctttagatgttctagtgtcctactatacgaggggttaccaaattgtgcgaaaccattcaacaactgcatatgttattctctgccaaagaatcggaaatgcagacccaatcgaactgtttcaagctggtattggtctttcaaatgtcgtagttgatttacactactacaacttgttcgatccgtactttgccagcatgaactctactcagaatattgaatttatttacaagaatagagcaccacaattgcaagctcttaaggatgcaaatgggcctcttctcttcattggtgaatgggttaatgaatgggacgtgcaaaatgcatctcaatatgagtaccagaagtttggcagagctcagttggatgtttatgcgaacgccacctttgggtggtcatattggacactaaaaaatgacaagatgcattgggacttcgagtggaatattcagaataaatacctcctgttcagtggttcatccctgctgaagacgccaagcttccttctcctgctagcacttggatggggaacttgcctcatcatcatgccaagatagcctggaacatacttggaaggacatgccaagggccctcttgttcctgagccgtttgccctgtcctttgtcctccctgcgttcacatcagcaggcaagatattcatttgtgtacagggtgccgatagaattgttctttttttcccgacgcactttggttgttgacttgtaatcgccaatcgagcaccattgttcttgctcagtacagttcaggatggggacagtcgcgttgggcctctcagaaagtacaaacgggtgtggctgttgcgaaaaaaaaaaaaaaaaaaaa

SEQ ID NO: 6296 - protein, 526 aa, Panicum virgatum
  misc_feature: Ceres CLONE 1862004
  misc_feature (2)..(294): Pfam Name: Cellulase Pfam Description: Cellulase (glycosyl hydrolase family 5)
MGGLVGPGFVLLSWVLFSPCLCSVDGLSKVRAVNLGGWLVVEGWIKPSLFDGIPNGDMLDGTQVQLRSVVLNKYVSAANGGGSNVTVESDVASTWETFRLWRVSENEFQLRCLGGEFLTSNSEDGLILATAREPLSTETFYVERNDERVHIKLLNGGYVQATNDHLLISTYQFQPGWDNNLVTFELVIVANDLHGDYQLANGYGYERAKMVLEEHRTSFITASDFDFLSRHGINTVRIPVGWWITQDPYPPSPFVGGSLAALDLAFSWAQSYGLKCIIDLHAAPGSQNGMEHSASRDGSVDWTSPEYVSQTLEVIDFLATRYGGHPSLLGIELLNEPSAATVPLDVLVSYYTRGYQIVRNHSTTAYVILCQRIGNADPIELFQAGIGLSNVVVDLHYYNLFDPYFASMNSTQNIEFIYKNRAPQLQALKDANGPLLFIGEWVNEWDVQNASQYEYQKFGRAQLDVYANATFGWSYWTLKNDKMHWDFEWNIQNKYLLFSGSSLLKTPSFLLLLALGWGTCLIIMPR

SEQ ID NO: 6297 - DNA, 2007 bp, Panicum virgatum
  misc_feature: Ceres CLONE 1862101
  misc_feature: Encodes the peptide sequence at SEQ ID NO. 6298
cctcctcactcgcctctcgcctcccatggctcgcccgcgccgcctcctctgaccccgcctcctccccggagggcgccgcggggatctcgccggagatggcgcctcccccgcccccgcccccgcctccccccgcgggggagcaccagccgcagctccacggggtggtcatcatcacgctcccgcccccggaccagccctccaagggcaagaccatcacggccttcacctacagcgacggccccggcgcgccgcccccgccgcaggagccggcgatggggtacccggtggcgccggggggcaggaggcggtccaggcgggcgctctcgccccggcgggtcgccgcgatggcgctcgtgctcggcgcgctcggggtggcggcctactactgcttctactcggacgtggccgtgcagttcctgggcatggagcaggaggaggcgcacaaggagcggaacgagaccaggtccttcctgctcaagctctaccccaaggcgcgccagggccgcgcgctgcgggagttcggggacgtcaagctcgcctccaagagggtcgacgacggcgggaggaagggggcgaacaagatggaggtcgggaaggcggggaccaactccacggctttgctcccgatcaagggcaatgtcttccccgatggccagtattatacatctatctttgtcggcaatccgccaagaccgtactttcttgatgttgacactggaagtgacttgacatggatccagtgtgatgcaccatgtacaaactgcgcaaaaggacctcatcctttatacaagccaacaaaagaaaagatagtccctcccagggattcgttatgccaagagttgcaaggagagcagaactactgtgagacctgcaagcaatgtgactatgaaattgaatatgcagaccaaagctcttcaatgggtgtccttgcaagggatgatatgcatctggtcgcaaccaatggtggaagggaaaagctcgattttgtctttgggtgtgcatatgatcagcaaggccagctactgtcttcaccagcgaagactgatgggatccttggacttagcagcgcagcgataagccttcccagtcagctagctagccatgggattatttccaacatttttggtcattgtatcactagagagcaaggtggtggaggttatatgtttctgggtgatgattatgcacctagatggggaatgacatggacttctattcgaagtggcccagataacttatatcacacagaggccaccaatgtaaaatatggagatcagcagctcagtgtgcgtgagaaggcaggaaactcagttcaagtgatttttgacagtggtagctcgtacacatacctcccaaatgaaatatatgaaaatctcattgcagctatcaaatattcctccccgggttttgtccaagataactcggatcggacattgcccttatgctggaaagctgattttcctgtgaggtatctggaagatgtcaagcagttcttcaagcccttgagccttcattttgggaaaaaatggcttttcatgtctaaaacattcactatttctcccgaggatttcttgatcatcagtgataaaggaaatgtctgtttggggcttctcaatggaacagaaatcaatcacggttcaactataatagtcggagatgtttcactgcgtgggaagttagttgtgtatgacaatgaacggaggcagattggctgggcaaattcagactgcaccaagccacaaacacaaaagggctttcccttcttcctctgatgggcatggctcggctcagaataaatttgtctgaagtgtagtggacaccattagcagctgccgttatgtatactatatcctccagggagttgtcactagtcccaccgtatgttgttgtaatacttgtgtataatatgtatactgtgtgtattgtatatatgtactgtctcctctacaggggaatttgataggcaagttacattatgaacatttacaaaaagaaaaaaaaaaaaaa

SEQ ID NO: 6298 - protein, 558 aa, Panicum virgatum
  misc_feature: Ceres CLONE 1862101
  misc_feature (1)..(357): Pfam Name: Asp Pfam Description: Eukaryotic aspartyl protease
MAPPPPPPPPPPAGEHQPQLHGVVIITLPPPDQPSKGKTITAFTYSDGPGAPPPPQEPAMGYPVAPGGRRRSRRALSPRRVAAMALVLGALGVAAYYCFYSDVAVQFLGMEQEEAHKERNETRSFLLKLYPKARQGRALREFGDVKLASKRVDDGGRKGANKMEVGKAGTNSTALLPIKGNVFPDGQYYTSIFVGNPPRPYFLDVDTGSDLTWIQCDAPCTNCAKGPHPLYKPTKEKIVPPRDSLCQELQGEQNYCETCKQCDYEIEYADQSSSMGVLARDDMHLVATNGGREKLDFVFGCAYDQQGQLLSSPAKTDGILGLSSAAISLPSQLASHGIISNIFGHCITREQGGGGYMFLGDDYAPRWGMTWTSIRSGPDNLYHTEATNVKYGDQQLSVREKAGNSVQVIFDSGSSYTYLPNEIYENLIAAIKYSSPGFVQDNSDRTLPLCWKADFPVRYLEDVKQFFKPLSLHFGKKWLFMSKTFTISPEDFLIISDKGNVCLGLLNGTEINHGSTIIVGDVSLRGKLVVYDNERRQIGWANSDCTKPQTQKGFPFFL

SEQ ID NO: 6299 - DNA, 2417 bp, Panicum virgatum
  misc_feature: Ceres CLONE 1862136
  misc_feature: Encodes the peptide sequence at SEQ ID NO. 6300
agccctcgcttccgcctcccctccctccccctcttcttcccttcccttccctttccttccccactcccacttcccaaccctggatccaaatcccaagctatcccagaaccgaaaccgaggcgcgcaagcaattattagctggctagctaggagtgtagctccgagatcatgaagcgcgagtaccaagacgccggcgggagcggcggcgacatgggctcctccaaggacaacatgatggcggcggcgggggagcagaatgaggaggtggacgagctgctggccgcgctcgggtacaaggtgcgctcgtcggacatggcggacgtcgcgcagaagctggagcagctcgagatggccatggggatgggcggcgtgggcggcgccggcgccgccgccgatgacgggttcgtctcgcacctcgtcacggacacagtgcactacaacccctccgacctgtcgtcctgggtcgagaacatgctgtccgagctcaacgcgcccccgcccccgctcccgccggctccgcggctcgcgtccacctcgtccaccgtcacgggtggcgccaccgccggtggagggtactttgatctcccgcccgccgtcgactcgtccagcagcacgtacgcgctcaagccgatcccctcgccggtggcggcgtcggcggacccgtcaacggactcgacgcgggagcccaagcggatgcggactggcggcggcagcacgtcgtcttcctcttcctcgtcgtcatccctggacggcggccgcaccaggagctccgcggtcgaggcggccccgccggcgacgcaagcgtccgcggcggccaacgcgcccgcggtgccggtggtggtggtggacacgcaggaggccgggatccggctcgtgcacgcgctgctggcctgcgcggaggccgtgcagcaggagaacttcaccgcggcggaggcgctggtcaagcaaatccccatgctggcatcgtcgcagggcggcgccatgcgcaaggtcgccgcctacttcggcgaggcgctcgctcgccgcgtgtaccgcttccgccctgccccggacagctccctcctcgacgccgccttcgccgacctcctccacgcgcacttctacgagtcctgcccctacctcaagttcgcccacttcaccgcgaaccaggccatcctcgaggcgttcgccggctgccgccgcgtccatgtcgtcgatttcggcatcaagcaggggatgcagtggccggctcttctccaggccctcgccctccgtcctggcggcccaccgtcgttccgcctcaccggcgtcggcccgccgcagccggacgagaccgacgccttgcagcaggttggttggaagcttgcccagttcgcgcacacaatccgcgtcgacttccagtaccgcggcctcgtcgccgccacgcttgctgaccttgagccgttcatgctgcaaccggacggcgaggacacggatgacgagcctgaggtgatcgccgtgaactcggtgttcgagctgcatcggctgctggcgcagcccggcgccctggagaaggtcctgggcacggtgcgcgcggtgcggccgaggatcgtgaccgtggtcgagcaggaggccaatcacaactccggctcattcctggaccgcttcacggagtcgctgcactactactccaccatgttcgattccctcgagggcgccggcgccggccaatccgccgatgccgctccggccgcggccggcggcacggaccaggtcatgtccgaggtgtaccttggccggcagatctgcaacgtcgtggcgtgcgagggcgcggagcgcacggagcgccacgagacgctggggcagtggcgcaaccgcctgggccgcgcagggttcgagcccgtccacctgggctccaatgcctacaagcaggcgagcacgctgctggcgctgttcgccggcggcgacggatacagggtggaggagaaggacgggtgcctgaccctggggtggcacacgcgcccgctcatctctacctcggcatggcgcctcgccgcgccgtgatcgggcgggtgcggtcttggacgctgatcaggatgcacgtccccgggcatggcgcaccccctccacccagctcgccggcacagctgaagctagacgtcaacgaacgctgaattgcagtgagcgaccgggccacggttcactccggcgtgatgagatggacactttgactccgaccggaccggcctgtgttcgttcttgttcccgatccccccctctcatcacctgcctccaatcggtagcctattgttatgtttaaatgtctattattatgtgtaattcctccaatcgctcatatctcaatctcaataaggacgaaccggatttctttagctcgaatgagaattttgtatacaaggcatcgaatccaaaactgagctatgttcatcaatctgttc

SEQ ID NO: 6300 - protein, 617 aa, Panicum virgatum
  misc_feature: Ceres CLONE 1862136
  misc_feature (1)..(299): Pfam Name: GRAS Pfam Description: GRAS family transcription factor
  misc_feature: The sequence is a functional homolog of  SEQ ID NO 216 in the  10/412,699 US patent application
  misc_feature: The sequence is a functional homolog of  SEQ ID NO 435 in the  11/479,226 US patent application
  misc_feature: The sequence is a functional homolog of  SEQ ID NO 68 in the  10/666,642 US patent application
  misc_feature: Useful for making plants with modulated growth and phenotype characteristics
MKREYQDAGGSGGDMGSSKDNMMAAAGEQNEEVDELLAALGYKVRSSDMADVAQKLEQLEMAMGMGGVGGAGAAADDGFVSHLVTDTVHYNPSDLSSWVENMLSELNAPPPPLPPAPRLASTSSTVTGGATAGGGYFDLPPAVDSSSSTYALKPIPSPVAASADPSTDSTREPKRMRTGGGSTSSSSSSSSSLDGGRTRSSAVEAAPPATQASAAANAPAVPVVVVDTQEAGIRLVHALLACAEAVQQENFTAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPDGEDTDDEPEVIAVNSVFELHRLLAQPGALEKVLGTVRAVRPRIVTVVEQEANHNSGSFLDRFTESLHYYSTMFDSLEGAGAGQSADAAPAAAGGTDQVMSEVYLGRQICNVVACEGAERTERHETLGQWRNRLGRAGFEPVHLGSNAYKQASTLLALFAGGDGYRVEEKDGCLTLGWHTRPLISTSAWRLAAP

SEQ ID NO: 6301 - DNA, 1948 bp, Panicum virgatum
  misc_feature: Ceres CLONE 1862198
  misc_feature: Encodes the peptide sequence at SEQ ID NO. 6302
gcttgccgcttccgctccgcccccgcgtcccccgcctccacacgaacgtgtgtccgcgacatccgcacgcgcgcctcctcccgaaccccgtccacacagaaactcctcgggcgcgcacggcagcagccggccgggttgacttgactccggcggagggttcaggaggcgttcttgcgtgcttctgacggcgctcgggttggcgaggcggccaggctcggctcagatcctccgaaggttggattttggggggagtgcccaattggtggccgcgagcggctcctggcgttgattgcggccgagttctccgcaggcgcgtgcgaggagacttcgctccgctgctgttcttggcagctccgcaccaggaaggcaccgcggcggctgggctcggtcgatgcgtcgccggtagattggccggcagcagcgttggaaggagatggggaactgcatggaaaaatcggctacggtggacaacagcaccgcatatcaatcaaaagtagggagcaaatcaagttcatcatccaacccctctacagccaaaactggctcgactcggtcgtcttggactgtaccctcatacaaagaaagtagagagcttcctactcctaggacagaaggagaaatcttgtcatcatcaaatttgaaggcattctcatttggtgatcttagggctgcatctaggaacttccggtcagacagtcttcttggggaaggaggatttggttatgtcttcaaaggctggattgatgaacaaactcttgccccttcaaagccgggaagtggtatggttgtagccatcaagaagctaaaaccagaaggttttcagggccacaaggaatggctgacagaggttgactaccttggccaactgcaccaccagaatcttgtcaagctcattggttattgctcagatggtgacaaccgactcttggtgtatgagttcatgcctaaaggaagtttggaaaatcatctattcagacgaggtgcggatcctttaccctggggaataagactcaaagttgcaattggggctgctagaggtttatcctttctgcatgatgctgagaaccaagtcatatatcgtgatttcaaggcatctaacattctgcttgactcggagttcaatgccaagctttcagactttggcttggcaaaagcaggtccaactggggatagaacccatgtttctacccaagtcatgggcacacgaggttatgcagctcctgaatatgttgcaacaggtcgcctctcagtaaaagcagatgtctacagctatggtgtggtgctgctggagttactgacaggacggcgagcactagataaatcgaaaccggcatctgagcagaacctcgtcgactgggcaagaccctgcctgcgcgacaagcgccgtctgtaccgcgtcatggactctaagctaggcggacaatacccgaagaaaggcgcacacgcagtcgcaagcattgccctgcagtgcattggcaatgatgccaaggcgcggcctgcaatgtctgaggtccttgagaaactagagcagctgcaggaccccaagtacaacgtcacagcaccacgggtggacccaaagtggacatcttcgtcaggctctgtccccaggtcgcccatgaaggtgcagccctcgccacgacgcctgtcgggttctggttccccgttgccggcagtggcaggctccccgctgccagcgtgtaggaccacgcaggtgcattaggtgcgcgactgatggatgaaagtgacgagtttgtgttgttgtagatgttggttgtaggtgtatatttcgctgtgttgttcccgagcagcgtagttttttgtttgtgaggtgtagtttttttgtttgtggtgtcgtggaaccagattgttgtgaggtgctgaatagtgagaatcaacatcctttgattcgactgatgtttaaattgtttctcagttttgagtgaagacg

SEQ ID NO: 6302 - protein, 428 aa, Panicum virgatum
  misc_feature: Ceres CLONE 1862198
  misc_feature (19)..(419): SWISSPROT Homolog: EC 2.7.11.1 Protein kinase APK1A, chloroplast precursor
  misc_feature (32)..(368): SWISSPROT Homolog: EC 2.7.11.1 Protein kinase APK1B, chloroplast precursor
MGNCMEKSATVDNSTAYQSKVGSKSSSSSNPSTAKTGSTRSSWTVPSYKESRELPTPRTEGEILSSSNLKAFSFGDLRAASRNFRSDSLLGEGGFGYVFKGWIDEQTLAPSKPGSGMVVAIKKLKPEGFQGHKEWLTEVDYLGQLHHQNLVKLIGYCSDGDNRLLVYEFMPKGSLENHLFRRGADPLPWGIRLKVAIGAARGLSFLHDAENQVIYRDFKASNILLDSEFNAKLSDFGLAKAGPTGDRTHVSTQVMGTRGYAAPEYVATGRLSVKADVYSYGVVLLELLTGRRALDKSKPASEQNLVDWARPCLRDKRRLYRVMDSKLGGQYPKKGAHAVASIALQCIGNDAKARPAMSEVLEKLEQLQDPKYNVTAPRVDPKWTSSSGSVPRSPMKVQPSPRRLSGSGSPLPAVAGSPLPACRTTQVH

SEQ ID NO: 6303 - DNA, 1539 bp, Panicum virgatum
  misc_feature: Ceres CLONE 1862208
  misc_feature: Encodes the peptide sequence at SEQ ID NO. 6304
agcggaggagaaaacgagaagaccgtgcggaggcccgcgtcgtgtccgccgagaagccactcgagtcgagtgaaccaaccaaccaaccggcggggagaaccagggaccccctcaccctcaactctcgccggcgccgctctcccctcccccgatggccgccgcgacgatgcgggccgtgcagtacgacgcctgcggcgggggcgccgccgacctcaagcttgtggaacttcccgtccctgcggcaaagaagaatgagcttctgttgaagctggaggcagcaagcatcaatccggtggactggaagctacagaaagggatgctacgccctatcctgcctcgcaaactgccttttatcccagtgactgatgtggcaggagttgtggttgatgttggtccaggagtcaatggattccaggctggagatcaagttgttgccatgctgaactcattttatggaggtggacttgcggagtatgctgtggcatctgagaatctgaccgttaagaggcctcctgaggtgtcccctgctgaaggcgcagggctgcccatcgcagctggcactgcgctccaggctttaaggaccattggcgccaagttcgacggaactggcgagcccttaaatgtgctgatcaccgcagcatctggtggtgttgggctctacgccgtgcagctcgcaaagctggcaggtctccacatcactgccacctgtggcgcgcgcaatgtggaactggtgaagagcttgggcgcggatgaggtgctcgactacaggacgccggagggcgccagcctgcagagcccatcaggcaagaagtacgacggcatcgttcactgcacagtcgggataagctggtcgacgttcgagcctgtgctcgccaacaccggtagggtgattgacatcaccccgaacttcaccgccatcctcaagtcggcgctgcacaaggtgacgtttgccaggaagcggctggtgcccctgctcctgtctcccaacaaagctgacctggagttcctggtccggctgctgaagaacggcaagatgaagacgctgatcgactcgaggttctctctgagcgaagccagcaaggcttgggagaagagcatcgagggccacgccacaggcaagatcatcgtcgagatggaaggctgatccgccattaacaaaagcagggagacgcaaggtagctggctatagacatacagcgttgacggacaagtagtagcagggtgtctgggtatggcttcgtcgtacagaagaatattggtgaggaactgaggatagatgtttataggattgtgctttttccttgttttcgattgtgaggttcttgagtaggttgggggtttgtggatttgcaccgttgatcagtaaagtggcatcgtagtatttcgtagaacatgttccggtcgaccagtagacttgctctttttgggcgttacatttaactttctggtagatatgttgtatatagttggcacggcacgacatacatggtgccttaaataaaatttgcgcttgtgaacgaaaaaaaaaaaaaaaaaaaa

SEQ ID NO: 6304 - protein, 330 aa, Panicum virgatum
  misc_feature: Ceres CLONE 1862208
  misc_feature (1)..(87): Pfam Name: ADH_N Pfam Description: Alcohol dehydrogenase GroES-like domain
MAAATMRAVQYDACGGGAADLKLVELPVPAAKKNELLLKLEAASINPVDWKLQKGMLRPILPRKLPFIPVTDVAGVVVDVGPGVNGFQAGDQVVAMLNSFYGGGLAEYAVASENLTVKRPPEVSPAEGAGLPIAAGTALQALRTIGAKFDGTGEPLNVLITAASGGVGLYAVQLAKLAGLHITATCGARNVELVKSLGADEVLDYRTPEGASLQSPSGKKYDGIVHCTVGISWSTFEPVLANTGRVIDITPNFTAILKSALHKVTFARKRLVPLLLSPNKADLEFLVRLLKNGKMKTLIDSRFSLSEASKAWEKSIEGHATGKIIVEMEG

SEQ ID NO: 6305 - DNA, 1737 bp, Panicum virgatum
  misc_feature: Ceres CLONE 1862231
  misc_feature: Encodes the peptide sequence at SEQ ID NO. 6306
atcgcatccataacattattctcccccaccgcaacgcaagagcagggcctgcagctgcaggggcatacatactgctacgactgagcgagccacgaaaaccatgaagaagaccgtcgtgctgtacccgggcctctccgtcagccacttcgtccccatgctgcagctcgccgacgccctcctggaggcgggctatgccgtcaccgtggccctcatcgaccccagcctgaaaggagacatcgccttggccgcggtcatcgaccgcgtgtcctgctccaagccgtccgtcgtcttccacaagctgccacggatccaggaccctcccaccattgtccacgacgaaaatttcatcgtcaggtacttggagctcgtggcgcgccaccacggtcacctgcacgacctcctcgtctccatggctcctggcagcattcactgcttgatcgtggacatgatgtccatagaggtacttgatgtcaccgacaagctcgggatcccagtatttgccttcttccccatgaatgcctctgtcctcaccgtgtccgttcagcgggtttcatcgacccgtgctgaaggccagccagctggtttcgaagaggaaagagacacgccccaaattttctatggcgtcccacccctgccgccctctcacctctctgataagttgcttgggaatccagggagcgaggcaaaaaaggtaggactgaacatgatgcgcagaatccaagaaaccaaaggaattctagcgaacacgttcgtgtcgctcgaggctcgtgcggtgaaagctcttggggatccacggtggttccccacgatgcctccgctgtactgcgtcgggccattggtcgccgggtacagcgaggccacagaaaggcacgagtgcctgaaatggctcgacgagcaaccagatcacagtgttgtgttcctctgctttgggagcctagggacaggcaaccactccgaggcgcagctcaaggagatcgccgctggcctcgagaggtccggccaccggttcctatgggtggtgagagccccttcccacgatgacctagagaaaccatcagacccctgtgctgacccagaccttgatgcccttctgcccgaggggctcttgggggagaccaatagccgtggtcgcgtagtcaagctatgggcaccgcaggtgaaggtgctccaccaccgggcgacgggggcgttcgtgacgcactgcgggtggaactcggtgctggaggggatcactgcggacgtgccgatgctctgctggcctctgtatgcggagcagaagatgaacaaggtgttcatggtggaggagtacggggttggcgtggagatggtggggtggcagcagggcctggtcacggcggaggaggtagaggccaaggtaaggcttgtgatggagtccgagaaaggggagcagctcagggcacaggtgattgcacacaaagaggctgcagacatggcgtggaaggatggtggatcgtctcgcgcggcgtttggcaagttcttggtggacgttcacgctggccctggggctagcacgccgctgaattactagtaacatgattatgacgttcttacgcgcgttacattattatattacactcctactctctttgaatggagggaataagctatgcagtccttgaggttttcttcatgcgtcatgtaccttgttagttgtttgtacatctttttcttaagcccacatcttttggtattgcgacaatgtaataatgttgattg

SEQ ID NO: 6306 - protein, 482 aa, Panicum virgatum
  misc_feature: Ceres CLONE 1862231
  misc_feature (1)..(138): Pfam Name: UDPGT Pfam Description: UDP-glucoronosyl and UDP-glucosyl transferase
MKKTVVLYPGLSVSHFVPMLQLADALLEAGYAVTVALIDPSLKGDIALAAVIDRVSCSKPSVVFHKLPRIQDPPTIVHDENFIVRYLELVARHHGHLHDLLVSMAPGSIHCLIVDMMSIEVLDVTDKLGIPVFAFFPMNASVLTVSVQRVSSTRAEGQPAGFEEERDTPQIFYGVPPLPPSHLSDKLLGNPGSEAKKVGLNMMRRIQETKGILANTFVSLEARAVKALGDPRWFPTMPPLYCVGPLVAGYSEATERHECLKWLDEQPDHSVVFLCFGSLGTGNHSEAQLKEIAAGLERSGHRFLWVVRAPSHDDLEKPSDPCADPDLDALLPEGLLGETNSRGRVVKLWAPQVEVLHHRATGAFVTHCGWNSVLEGITADVPMLCWPLYAEQKMNKVFMVEEYGVGVEMVGWQQGLVTAEEVEAKVRLVMESEKGEQLRAQVIAHKEAADMAWKDGGSSRAAFGKFLVDVHAGPGASTPLNY

SEQ ID NO: 6307 - DNA, 1804 bp, Panicum virgatum
  misc_feature: Ceres CLONE 1862323
  misc_feature: Encodes the peptide sequence at SEQ ID NO. 6308
gccttctcctgctgcctagcctcgtttgaatcattctccccttccagtctcctcccttcactctgcccccctcccttctcctcctcccccttccaattcttaactgcccgagaccccaaaatcacgcacccagtgcgcgcgccccaaaccctagccacaagtccatggggtgcacgcagggcaagtgctgcctgcctctgccccggcgggggcgcggtgggcccggcggccacgccgaggtgcccggcgcagggatggtgctggagtacgccacgctggccgtggcggggctctacccggactcgccgggccgggagtcccaggacgcgcacctcgtcgccacgcgcttcgcgggggacccggacctccacctcctcgccgtcttcgacgggcacggcgccgcgggcgctgcctgcgccgggttcgcgcgggaagcgctcccgcgcctcctcgccgctgcggcggggggcgggtcgctggccgcggaccccgccgccgcgttccgggaggcgatgctgggcgccaacgcggagatgcacgcggcggcgggggtcgacgacttcatgagcgggaccaccgccgtggcggcgctggtggccggcggcgcgctgcacgtggccaacgtgggggactcgcgcgccgtcgccggggtgtggcgtgctgggcgggtcgtcgccgaggacctctcgtgggaccagaccccgttccgcgccgacgagcgcgcgcgcgtcaaggcgtgcggcgcgcgggtcatgtccgtcgagcaggtggagggcatgcgcgacccggagtccgaggggtgggtgcccgacgagggggacccgccgcgcgtctgggcgcgcgacggcctctaccctggcacggccttcacgcgcagcctcggggacctcgcggccgaggaggttggggtcatcgccgagcctgaggtgaagagcgtggagatcactccagcccacctgttcttcgttgttgcgagcgatggcgtgttcgagttcctctccagccaggaagtggttgatatggttgctatgtatcaagatcctcgagatgcctgctcagcaatcgctgcagagtcatacaaactatggctggagcatgaaaacaggacagatgatataacaataatcattgtgcatatccgggactctgaaattggagcgacaaagtggactgtgttagcatcagagcatcaatagctgtgcacgcagtacagtcagagatacctgtatttgtaccaccagaagcaagtcacttgaacagatgtgctgctaccgaaatgcagtcatcatcctcaggatctccaacagaacgaagcctctcctgcattgttccttctcctacacaccctttgttgatacacggtagaatatcagatgcttccaagcatagtgcttccaagcctatgcgtagtgagcaagctgcatcacaacaagcacaaccttggcagcaggtggatagtggtactgagctggaactgcctatgcagtaaagtatccatccagcctcctgctgaatgtggagtatccaagttaaatggtgaaaagaggccttgccataccccatggccatcctccggagctactaaccatgccatggatgtgatgttggtcagcggcaaaactcagtgttgctcgtgttttcttagagcacctgccgcaaactgacatgggaaggttctgatcgaagtttgggtggggggggggggtcatctaaccaggggattgattaatggtgttgggcgccaccataagtgctgtctgtgaaatggaattattctctgattgaaaaaaaaaaaaaaaaaaaa

SEQ ID NO: 6308 - protein, 343 aa, Panicum virgatum
  misc_feature: Ceres CLONE 1862323
  misc_feature (1)..(287): Pfam Name: PP2C Pfam Description: Protein phosphatase 2C
MGCTQGKCCLPLPRRGRGGPGGHAEVPGAGMVLEYATLAVAGLYPDSPGRESQDAHLVATRFAGDPDLHLLAVFDGHGAAGAACAGFAREALPRLLAAAAGGGSLAADPAAAFREAMLGANAEMHAAAGVDDFMSGTTAVAALVAGGALHVANVGDSRAVAGVWRAGRVVAEDLSWDQTPFRADERARVKACGARVMSVEQVEGMRDPESEGWVPDEGDPPRVWARDGLYPGTAFTRSLGDLAAEEVGVIAEPEVKSVEITPAHLFFVVASDGVFEFLSSQEVVDMVAMYQDPRDACSAIAAESYKLWLEHENRTDDITIIIVHIRDSEIGATKWTVLASEHQ

SEQ ID NO: 6309 - DNA, 2274 bp, Panicum virgatum
  misc_feature: Ceres CLONE 1862395
  misc_feature: Encodes the peptide sequence at SEQ ID NO. 6310
  misc_feature (1917)..(1917): n is a, c, t, g, unknown, or other
aactttgaaaaaaaatctctgtctgtcttctctttcctcatttgtttgcttacagctcatccataacgcaaagccaagatcacattttgattagtgaggaggggtagattagattagcagtagcagggtgtgtcatcatcatcctccatccataccatccattccgcaacgcgtcttcgtttttctgaaaaaaagggagggggagggatttgtgttgccgtgttgggcaacgtctccgccaaagatacaaattcatccatagccatatatgcaggcgtatatttggaatcaataaatatttagttggcgattgatcggagacagatggcgagcgccggattcgtggaggagatgatgagggagcagagcctcctggaggcgacctgcggcgacctcttcgaccacatcgaggacctgctcgacttccccaaggaggagtccgccgccgacgtgctcctcctggacgcgccggcgccggggagtccgctctcggcgcgcatcatcgacgtcggcggcaatgcgccggccgcgcccgcgctggagccgctgatggcgctgcccccgcccgcggcgcaggaggacgccgccgccttcttcgccgccgcgggggcgccagtcttcgacgccaaggacgttggcggccatattggctcgtgcgaggacctggacatggacatggcgcagctggagtggctgtcggggctcttcgacgacgcctccatcccgcacgagccggcgttcccgggggccacctgcgcggcccccatcaagagctccgcgctggcggccaacgccggcgtcgcgctgctgccgccggacaagatggaggacgcgctcttccgtagctccagccccatctcggtgctggagcacaacggcttcaacgccaacaacaacgtcggctccgcctcctcctcctcctcctcggcctcggcctcgtcctcgtccgagtccttctccgggagcggcggcgggtacgcctggtcggcgcccgtgtcgccgcgcccggagccgccggtgctcgtcataccggcgcgcgcgcggagcaagcgctcccgcccgtccgcgttcccgcgcgccgcggaggcgcccaccatcctcgtgccgacgcccatgtactcgtccacctcctcgcactcggaccccgagagcattgccgagtccagcccacaccaggcttttcccaagaagaagaagaaggccaagaagccggcgccccccgcgccgacagcctccgacgcgaacggtgacaacgacggcgacgccgactacgaggaaggcggcgagcgctcgcagcctcagggcgccgtcaggaggtgcacgcattgccagatcgagaagacaccgcagtggcgcgcgggtcccctgggccccaagacgctctgcaacgcctgcggcgtgcgctacaagtccgggcgcctcttcccggagtaccgccccgcggcgagccccaccttcgtgccgaccatccactccaactcccacaagaaggtggtggagatgcgccagaaggccgtccggagcggcgacccgtcgtgcgacctcctgcagttcatccgccgccgggattaaatcgacggtcggtccgtcggtctcgtcccccttagctaagctatatatgtatacatgttagtatgtatgcatgcatatggttgcttcatcagtcgtcagtcgtcgtcgtcgtcttcatcgtggtcatcatcatcatcaccgccatggatccacccatcttcacctgcatgtgtttctgtcagcatccatcaaatccatcgccgggcatcctggcgttagttcattagggcttttttcatcgggggttagtgttattttatctttactttttgtctattggttaattggttcccctgaatgtttttttgtttgtatagagagagaaagagagagaggagggtgggnagaggagggcaggagaaatagatgaatcggagtggttgttgcattgcaattgcagttgcttgcaagttaggtaggtgagaaggagagctaaaccagcagcagagggagacagatttagagaggaaactttgcagctagtcagtcagtcaattagaagaaaagtgtttcagcaagcaaaaggggagtttgttggtttgctaattagaaggaagattctgtcagatcaggttgtagctatcacccatcaggatttgaaacttgaagagagggggacagccatcatccatcatagtctgtatttggagcttggtgtactgaactctgaaaattctttttgcagtccatctatgtttacgg

SEQ ID NO: 6310 - protein, 415 aa, Panicum virgatum
  misc_feature: Ceres CLONE 1862395
  misc_feature (1)..(36): Pfam Name: GATA Pfam Description: GATA zinc finger
MASAGFVEEMMREQSLLEATCGDLFDHIEDLLDFPKEESAADVLLLDAPAPGSPLSARIIDVGGNAPAAPALEPLMALPPPAAQEDAAAFFAAAGAPVFDAKDVGGHIGSCEDLDMDMAQLEWLSGLFDDASIPHEPAFPGATCAAPIKSSALAANAGVALLPPDKMEDALFRSSSPISVLEHNGFNANNNVGSASSSSSSASASSSSESFSGSGGGYAWSAPVSPRPEPPVLVIPARARSKRSRPSAFPRAAEAPTILVPTPMYSSTSSHSDPESIAESSPHQAFPKKKKKAKKPAPPAPTASDANGDNDGDADYEEGGERSQPQGAVRRCTHCQIEKTPQWRAGPLGPKTLCNACGVRYKSGRLFPEYRPAASPTFVPTIHSNSHKKVVEMRQKAVRSGDPSCDLLQFIRRRD

SEQ ID NO: 6311 - DNA, 1721 bp, Panicum virgatum
  misc_feature: Ceres CLONE 1862412
  misc_feature: Encodes the peptide sequence at SEQ ID NO. 6312
atcacacacctggctcaattggtaggcagccgttgcttggcggggcggccatagctagctagctgctttgcttcctcctgccgctgctgctctcgtttcccttcccggcgtctgctcgcccctgctccgccctcggaatctcgccctgcacttattccctagcctacctagcttctacagttcaagctagcgcgcaggcagccagcgaccgagctgcgagcagtgatcggagagacagatcagaggagctcacctgcagctttgaatgctcagagcctgaaagcactcgagcagccttgtcccttgctcgcaaacccttgccgccttttggtcacctcgggctgcgcgcggagcagcacctgtgctctgctctgcctgccctgtcctccacctctcctgttcaccgctctccctcttctcggttctcgctgccctgccaggtagggagcagcctttcctcgacggtcgccgtcctcatttatgtgctcccctctgtccactgctcgcctctctccctacaactctgtgctctgcttgtgtcgtgagtgactcgtgacgtgagcaagtgctctgcgcgcgctgagctaggaggaggaggaaggcggcgaccatggcgtggcgcggccggctcggagaggccggggacagcggcctcgagctcagccttggcctcccggcctacttcgctaagccctcaggttttgacgccggcgaggagcccggtgacgctgctgcttttgctctccaagctggcaaagggaacaacgatgcttccaagacgagggccaggccagcagctgctgctccggtggtggggtggccgccggtgcggtcgttcaggaggaacctggggtcctccaggcagtcgccccagtcgtcgtccgctcaacgtctggacggcggcggcggcgccaagggaggcggcgccggcgagggcgcgcgcaagggcggcctgttcgtgaagatcaacatggacggcgtgccgatcggccggaaggtggacctcacggcgtacggcggctacgccgagctctccgccgccgtcggcaagctcttccgcggcctgctcgccgcccagagggacccggccgccgccgcggtgggcaggcgctgcggcgagggggcggaggaggccgaggagcccgtgatcggcggcgagtacacgctggtgtacgaggacgaggagggcgaccgggtgctggtcggcgacgtcccctgggagatgttcgtggccgccgccaagaggctgcgcgtgctcaggagctccgacctgccggcctcgtcgctgagagcaggcgggggcaggaagagggctgcagccgactgctgaagctggaccatccatgctctgttctgttccatggatcgccagcttgtagaaaaggtcccgggtggaggagaacgggcgtggccttgcccctttttgatgtctttccgtgttgctgctaatagtaacttgctagtaagtagtatatgggatggagggaagaagccatgacggtattagggtcatgtaatgcagtagtgttaggtgttcatgaatctatcccctttcttgcctgcttttgagtacatctcagtggtaaaaaaatgcggaattgtatgcatgaatctagtcttagtgtgttctcgtggttgataccgtaagacagtggagtttttcttttcaaaaaaaaaagacagtggagcttgttctgaactaaaaaaaaaaaaaaaaaaaa

SEQ ID NO: 6312 - protein, 239 aa, Panicum virgatum
  misc_feature: Ceres CLONE 1862412
  misc_feature (1)..(198): Pfam Name: AUX_IAA Pfam Description: AUX/IAA family
MAWRGRLGEAGDSGLELSLGLPAYFAKPSGFDAGEEPGDAAAFALQAGKGNNDASKTRARPAAAAPVVGWPPVRSFRRNLGSSRQSPQSSSAQRLDGGGGAKGGGAGEGARKGGLFVKINMDGVPIGRKVDLTAYGGYAELSAAVGKLFRGLLAAQRDPAAAAVGRRCGEGAEEAEEPVIGGEYTLVYEDEEGDRVLVGDVPWEMFVAAAKRLRVLRSSDLPASSLRAGGGRKRAAADC

SEQ ID NO: 6313 - DNA, 3172 bp, Panicum virgatum
  misc_feature: Ceres CLONE 1862425
  misc_feature: Encodes the peptide sequence at SEQ ID NO. 6314
gtgttctctgtttggaaaggcggagggaagggggaagcgaagttctcggagaggtcgccatcgtcggagttcctccactgtctcggactggcagcggcttggcagctttcctgcaaggctatctaaatggagcctcacaatggcgaggctgatgacttgcctcctccacctcctctagatgcgggtattgaacctcttaaagctgatgaaacaaagaagatgttgaaacctaagagggctctggtcccaaggcagggttttggcaaaaaggggcagccaataaagcttctaacgaaccacttcaaagtttcgctgaagaacactgaagagtttttctatcactactatgtgaatttgaaatatgaagatgatacacctgttgatggcaagggagcagggcggattgtgattgagaaacttcagcaaacctatgctactgaacttgcaaataaagattttgcatatgatggtgagaagagcctgttcacaattggtgctcttcctcaaattaataacgagttcactattgtggtggaagacgcttcaactggaaagactcctgcaaatggcagccctggtaatgacagttcacctggaagtgacaggaaaagggtccgaagaccttacaatacaaagacgtacaaagttgggctgtctttcgcagcaaaaattcctatgagtgcaatcgcacttgctctgaaaggtcaggaatcagagcatactcaggaagcaattcgagtgatcgatattattctgaggcagcattcagcaaagcagggttgcctcttggttcgtcaatcattcttccataacaatccatctaactttgttgaccttggaggtggtgtaatgggctgtagaggattccattctagtttccgtgccacacagagtggactttcacttaatattgatgtgtcaacaacaatgattgtaaaacctggacctgttgctgattttctgatggccaaccagaaggttgacaacccaaacatgattgactggacaaaggcaaagcgctcattgaagaacttgaggataaaaataaccccaacaaatgcagaaaacaagattgttggtctgagtgacagatcttgccgagaaacaatgtttacactaaagcgtagagatggtgactctgaagagatcagtgtttttgactacttcgtaaagaaccgtcgcatagagctcaggtactctggtgactttccttgtatcaatgtgggaaaaccaaagcgtccaacttattttcctatagagctctgtacgcttgtgtctttacaaagatacaccaagtcattgagtacacttcagaggtcttcacttgttgagaagtctaggcagaaaccccaagaaaggatgtctgttctgtctgatgtactgaaacgcagcaactatgattcagagcctatgctaatggcatgtggcatttcaattgctaaaagtttcactgaggttgatggtagggtgctgcaagcccccaagctcaaagctggtaatggagaagacatttttacacgcaatgggagatggaacttcaacaataagaggctcattagagctagcagtgttgaaagatgggcagtagtcaacttttctgcacgctgcaatgtcagagaccttgtccgagatctcatcaagtgtggtggcatgaagggaattaaagtagaagacccttttgatgcatttgaagagcatccttcaatgaggcgggcacctgctgtaaaaagggtggaggaaatgtttgaacaagtgaaatcaaagctgccaggagcacccaagtttcttttgtgtgttcttgctgagaggaagaattctgatgtttatgggccttggaagaagaaatgccttgctgaatttgggattgttacacagtgtgtggcaccaacaagagttaatgatcagtaccttaccaatgtcctgcttaagataaatgcaaagctgggtggcttaaattcaatgctccaagttgaatcatcccctgcaatgcctcttatatccaaggtcccaactatgattttgggaatggatgtatcccatggttctcctggacaatctggtgtaccttccattgctgctgttgtcagttctcgtgaatggcctcttatctcaaaatatagagcatcagtgcgctctcaatcacctaagatggaaattattgactcgttgtttaagccacagggaaaggatgataaaggcctgattcgggagtgtctgattgacttctacaccagttctgggaagagaaagccggatcaaatcataatcttcagggatggtgttagcgagagtcagtttagtcaggtgctgaacattgagttggataaaataattgaggcatgcaagtttttggatgaaacttgggatcccaagttcacattgattgttgcccagaaaaaccaccacacaaagtttttcattcctggggcaccagaaaatgttcctcctggtacagtggtggacaacaaagtctgccatccaaggaactatgacttctacatgtgttcgcatgctggaatgataggaactacgagacctacacattatcacatccttcatgatgagatcggcttcaaccccgatgaccttcaggagctggtgcactcactttcttatgtgtaccaaaggagtacaacagccatatcagttgttgctcccatctgctatgcacatcttgctgctgcccaggtcggacaattcataaagtttgatgagatgtcggagacatcctccagccatggagagcacacatcagcaggcagtgcccctgtgcaggagctgcccagcctccacgagaaggtcaggagctccatgttcttctgctgagctgcacttgcttggacgtgtgctgcgatatgctcctggtgctttctgggtggtctggaacctgtccattcgattgccatttaccatgatgcttttggtggatgtttcagaaccttggtagtttattacgtcggtgacatctgtgttggctcgatgcaccaaaaatggctacgtgcctcaggaagaaccatgttgcgtttggtggatgtttcatcagaaccatagtagttaattaagtcggggccatggggtgtcatgatcccctaaaccggttaccacgtgaatttggaaggcttaaacctatttgaatgtggttgatagctatttgccatcgctacagttgatc

SEQ ID NO: 6314 - protein, 899 aa, Panicum virgatum
  misc_feature: Ceres CLONE 1862425
  misc_feature: The sequence is a functional homolog of  SEQ ID NO 2 in the  11/375,241 US patent application
  misc_feature: The sequence is a functional homolog of  SEQ ID NO 2562 in the  10/374,780 US patent application
  misc_feature: Useful for making plants with modulated growth and phenotype characteristics
MEPHNGEADDLPPPPPLDAGIEPLKADETKKMLKPKRALVPRQGFGKKGQPIKLLTNHFKVSLKNTEEFFYHYYVNLKYEDDTPVDGKGAGRIVIEKLQQTYATELANKDFAYDGEKSLFTIGALPQINNEFTIVVEDASTGKTPANGSPGNDSSPGSDRKRVRRPYNTKTYKVGLSFAAKIPMSAIALALKGQESEHTQEAIRVIDIILRQHSAKQGCLLVRQSFFHNNPSNFVDLGGGVMGCRGFHSSFRATQSGLSLNIDVSTTMIVKPGPVADFLMANQKVDNPNMIDWTKAKRSLKNLRIKITPTNAENKIVGLSDRSCRETMFTLKRRDGDSEEISVFDYFVKNRRIELRYSGDFPCINVGKPKRPTYFPIELCTLVSLQRYTKSLSTLQRSSLVEKSRQKPQERMSVLSDVLKRSNYDSEPMLMACGISIAKSFTEVDGRVLQAPKLKAGNGEDIFTRNGRWNFNNKRLIRASSVERWAVVNFSARCNVRDLVRDLIKCGGMKGIKVEDPFDAFEEHPSMRRAPAVKRVEEMFEQVKSKLPGAPKFLLCVLAERKNSDVYGPWKKKCLAEFGIVTQCVAPTRVNDQYLTNVLLKINAKLGGLNSMLQVESSPAMPLISKVPTMILGMDVSHGSPGQSGVPSIAAVVSSREWPLISKYRASVRSQSPKMEIIDSLFKPQGKDDKGLIRECLIDFYTSSGKRKPDQIIIFRDGVSESQFSQVLNIELDKIIEACKFLDETWDPKFTLIVAQKNHHTKFFIPGAPENVPPGTVVDNKVCHPRNYDFYMCSHAGMIGTTRPTHYHILHDEIGFNPDDLQELVHSLSYVYQRSTTAISVVAPICYAHLAAAQVGQFIKFDEMSETSSSHGEHTSAGSAPVQELPSLHEKVRSSMFFC

SEQ ID NO: 6315 - DNA, 2177 bp, Panicum virgatum
  misc_feature: Ceres CLONE 1862439
  misc_feature: Encodes the peptide sequence at SEQ ID NO. 6316
  misc_feature (1509)..(1509): n is a, c, t, g, unknown, or other
gagaggcacccgtgaaggtcgagatgcaatgctttgcaatgcccgtgattgcattggatcccgttcccgttccgcttggcgccacctccgatgtcgaccgacgaggttcaactcgtcgtattgccttcgtcttcctcgtcctgatgacctgacctgccttatcagcgcggacgcctcaaacattcgggcgaacacgcctctcgcattggccaataattccccccaccattagggcgagcagagcggaaggaagcatctttggcgatttcggtggccgactggatccgccgatttaattggccgtctgccagcgctgaaaaggattgcttttttgccttccttgattcggttcttctggcaagtaactcgctggccgccgacgatgggggaggagggaacttcgccgttgctcaaggaggagtaccatccggggtgccccggctgcgcttacaaccggaggaagggcctcctcaggggattgccgtacaaggggttcctctatgtctggatggtttctctcacggccgctttgccaatatcatcattgttccccttcttgtattttatgataagagacttgaatgttgctaaaagaacagaagatatcggcttctatgccggttttgtaggtgcttcatttatgtttggtagatgcttgacttcaacagcttggggaatagcggcggaccgtattgggaggaaaccagttgtcatgtttggcattttctccgtggttgtgttcaatactttgtttgggcttagtgtcagctattggatggcaattgttacacgatttttgctgggtgctttaaatggtctacttggaccaattaaggcttatgccattgaagtttgccgatcagaacatgaagccctagcattgtcacttgtcagcacggcatggggaataggtctcatcattggtcctgctttaggaggctaccttgcactgcctgcagaaaattttccaaatatcttttcacctgactcattctttggaaggtttccatatttcttaccatgcttatgcacatcagtctttgctgctgttgttctcataagctgcatatggatgccggagactttgcataagcataaagttagtgaaaatgaaaaccagagcattgaagctttggaagctcatctgattgatccaaaagaaaaggttgaagaaagtggaagtttggataccaagaagagcttattcaagaattggccattgatgtcatcaataattatctattgcatcttctccttccatgatatggcttacacagaggtgttctctctatgggctgaaagtgacaagaagtatggtggactcagtttatcatccgaggatgtcggtcaagtcctcgcagttacaggtgccagtcttcttgtatatcaactgttactgtaccctcgtatcaataaagttcttgggcctatcaattcttctcgaattgcagcaatcctgtgtatacctatcctctttgcctacccctatatgacatacctttctcaacntggattatcaatcattctcaatattgcatcggtgataaaaaataatctttctgtaaccatcattacaggcacattcatccttcaaaacaatgccgtgcctcaggatcaaagaggagctgcaaatggattgtctatgacaggaatgtcgtttttcaaggcagttgctccagcaggagcaggcatggtgttctcgtgggcacagaaacgacagcatagttttttctttccaggtgatcagatggtgttctttcttctgaatgtgattgagttgctcggacttgtcctcacattcaaaccctttctggctgtgccagagcaatataataatagaaattagaattcaaattttagaagcttagggatattcaaacagagtcttgcaccggtgaggtaaagggcataatgaccttccacaaagaggaacctgaaagagggagatggatcgagttgtttgcgtgtaactgtaagtgttgtatgcttcgagaaaactgcaagtgttgtatgtagttgcagcaattcagtagaggaaatgtatacttggtaaatggcagccaatcgattgcttgcttttaattaggcaggcattttgtgccgagttgctgcactgtaaagcatcaataattgtttgatcaacatgtctggttctaatttattctgctgattgactc

SEQ ID NO: 6316 - protein, 487 aa, Panicum virgatum
  misc_feature: Ceres CLONE 1862439
  misc_feature: Great-hit functional homolog of the protein sequence given in SEQ ID NO 9326
  misc_feature: Useful for making plants with modulated flowering time
  misc_feature: The plant flowers significantly late compared to wild-type.
  misc_feature (376)..(376): Xaa is any aa, unknown, or other
MGEEGTSPLLKEEYHPGCPGCAYNRRKGLLRGLPYKGFLYVWMVSLTAALPISSLFPFLYFMIRDLNVAKRTEDIGFYAGFVGASFMFGRCLTSTAWGIAADRIGRKPVVMFGIFSVVVFNTLFGLSVSYWMAIVTRFLLGALNGLLGPIKAYAIEVCRSEHEALALSLVSTAWGIGLIIGPALGGYLALPAENFPNIFSPDSFFGRFPYFLPCLCTSVFAAVVLISCIWMPETLHKHKVSENENQSIEALEAHLIDPKEKVEESGSLDTKKSLFKNWPLMSSIIIYCIFSFHDMAYTEVFSLWAESDKKYGGLSLSSEDVGQVLAVTGASLLVYQLLLYPRINKVLGPINSSRIAAILCIPILFAYPYMTYLSQXGLSIILNIASVIKNNLSVTIITGTFILQNNAVPQDQRGAANGLSMTGMSFFKAVAPAGAGMVFSWAQKRQHSFFFPGDQMVFFLLNVIELLGLVLTFKPFLAVPEQYNNRN

SEQ ID NO: 6317 - DNA, 681 bp, Panicum virgatum
  misc_feature: Ceres CLONE 1862445
  misc_feature: Encodes the peptide sequence at SEQ ID NO. 6318
aacccccggcgattgccgaaggccggaacgaaaccaaccccctcgtcgtcctagaagctcccgcgtcccctccccctagcctccgctctccaatggcgccctccctcctcctcgccgccgccgccgcctcgcccttcctcgtcgccggcagcaattgcagccgccggccgctgagcgccgcccccacccgccgggccgggctgcgcgttgccgcgctcaagtacgaccctgccaaggtggcgccgcagtccgaccgggtgctcgtccgtctccagcagatccctgagaaatctgctggaggtgtattgctacctaagtctgctgttaagtttgagaggtatctgatgggtgagattctatcggtcggttctgatgttagtgaagttgaggctggaaagaaggttctattttcagatatcaatgcttatgaggtggacctaggtaccgatgagaagcactgtttctgccgggaatcggatctgttagctgttgttgaatgaattttaccctaaaatttcagacttgggcgacagtgcaccaagcctccaagtgaacgggcttgacctttgtcccaactttgttgtatgccatttgaatgttcatgaattccacaaactgatgagtgttagttaccagtgaattttgaccgccataagcagtaatgaaattacgcttcttccc

SEQ ID NO: 6318 - protein, 135 aa, Panicum virgatum
  misc_feature: Ceres CLONE 1862445
  misc_feature (1)..(87): Pfam Name: Cpn10 Pfam Description: Chaperonin 10 Kd subunit
MAPSLLLAAAAASPFLVAGSNCSRRPLSAAPTRRAGLRVAALKYDPAKVAPQSDRVLVRLQQIPEKSAGGVLLPKSAVKFERYLMGEILSVGSDVSEVEAGKKVLFSDINAYEVDLGTDEKHCFCRESDLLAVVE

SEQ ID NO: 6319 - DNA, 1783 bp, Panicum virgatum
  misc_feature: Ceres CLONE 1862526
  misc_feature: Encodes the peptide sequence at SEQ ID NO. 6320
accagcaaaatcatcagcaagaacccaagctccagtgtgccgggcaaagccgcagctctagctagctaagctagagcggatccaagcccgagccagcacccgcaccgcagatcaccgatcaccatgggctccctcggcggcggcgcgcagggcgacagcaggccgcacgccgtgtgcctgccgtacccggcgcagggccacatcaccccgatgctcaacgtggccaagctgctccacgcccggggcttccacgtcaccttcgtcaacaccgagtacaaccacgcccgcctcgtccggacccgcggcgccgccgccgtggccggcgtcccgggcttccgcttcgccaccatcccggacggcctgcccccctcggaggacgacgacgtcacgcaggacatcccctcgctctgcaagtccaccactgagacctgcctcggccccttccgccgcctcctcgcggagctcaacgacgaccccgcccacccgcccgtcacctgcgtcgtctccgacgtcgtcatgggcttctccatcgacgccgccaaggagctcggcctcccctacgtccagctctggacggccagcaccatcagcttcctcggctaccaacactaccgcctcctcatgagccggggcctcgccccactcaaagatgccgagcagctgacgaacgggttcctggacacggcggtggacgacgtcccggggctgcggagcatgaggttccgggacttcccgagcttcatccgcacgacggacccggacgagttcatggtgcactacgtcctcaaggagacggggcgctcggcgggcgcgtcggcggtgatcgtcaacaccttcggcgagctcgagggcgaggcggtggcggccatggagtcgctgggcctggcgcgcaaggtctacacgctgggcccgctcccgctgctggcgcgcgaggacccgcccaccccgcgctcctccatcagcctcagcctctggaaggagcaggcggagtgcctgcggtggctcgacggcagggagcccggcgccgtcgtctacgtcaacttcggcagcatcaccgtcatgaccaacgagcagctggtggagttcgcgtgggggctggccaacagcggccgccagttcctgtggatcatccgccgcgacctcgtcaagggcgacagcgccgtgctgccgccggagttcctcgccgccacggccgaccgcgggctcatggcgagctggtgcccgcagcaggaggtgctggaccacccggccgtcggcgcgttcctcacgcacagcggctggaactccaccctagaggccatgtgcggcggcgtccccgtcatcagctggcccttcttcgccgaccagcagaccaactgccggtaccagtgcaacgagtggggcgtcggcatggagatcgacgccaacgtccgccgcgacgccgtggcgggcctcatcacggagctcatggagggggagcaggggaaggagatgaggaggaaggcccgggagtggcgggacaaagcgatcgaggcggccaagcccgggggggcgtctcaccgcaacttggacgagctggtccgcgacgtgctcctgcccaagaactagacagcagcaggctccccacatctgctgcctactctcacccgtgttcggctggtgtgccagggtctagtagttatgttcattttaatttgttcgggggtaacagacaaatcactgttagcgtggtagtgtaaaccaataatgtacaagcctctccgttttgtactggtatattgctgaaaaaaaaaaaaaaaaaaaa

SEQ ID NO: 6320 - protein, 487 aa, Panicum virgatum
  misc_feature: Ceres CLONE 1862526
  misc_feature (1)..(114): Pfam Name: UDPGT Pfam Description: UDP-glucoronosyl and UDP-glucosyl transferase
MGSLGGGAQGDSRPHAVCLPYPAQGHITPMLNVAKLLHARGFHVTFVNTEYNHARLVRTRGAAAVAGVPGFRFATIPDGLPPSEDDDVTQDIPSLCKSTTETCLGPFRRLLAELNDDPAHPPVTCVVSDVVMGFSIDAAKELGLPYVQLWTASTISFLGYQHYRLLMSRGLAPLKDAEQLTNGFLDTAVDDVPGLRSMRFRDFPSFIRTTDPDEFMVHYVLKETGRSAGASAVIVNTFGELEGEAVAAMESLGLARKVYTLGPLPLLAREDPPTPRSSISLSLWKEQAECLRWLDGREPGAVVYVNFGSITVMTNEQLVEFAWGLANSGRQFLWIIRRDLVKGDSAVLPPEFLAATADRGLMASWCPQQEVLDHPAVGAFLTHSGWNSTLEAMCGGVPVISWPFFADQQTNCRYQCNEWGVGMEIDANVRRDAVAGLITELMEGEQGKEMRRKAREWRDKAIEAAKPGGASHRNLDELVRDVLLPKN

SEQ ID NO: 6321 - DNA, 1333 bp, Panicum virgatum
  misc_feature: Ceres CLONE 1862540
  misc_feature: Encodes the peptide sequence at SEQ ID NO. 6322
ccgtaccggcgaggaacaacagacgagggaggaggaggaggcgaagcggaaatggggctccgccaccgcgcctcctcgctccggctgctatccctggctctcgggctcgccgtcttgctcgtctcagtgtcggcgcagcagaagttcgggatcaactacgggcagatcgccaacgacctgccggacccgacgcgggtggcggggctcctccagtcgatgaacgtgaacaaggtgaagctctacgacgcggaccccagggtgctgacggccttcgccaacaccggtgtcgagttcatcatcgccgtgggcaacgagaacctgcagaccatggccgccagccccgccgcggcgcgccagtgggtggccacgcacgtgcagccctacatcccgtccacgcgcatcacctgcgtcaccgtcggcaacgaggtcttctccagcaacgataccgtcatgatgtccagcctcctccccgccatgaaggccgtctacgccgcgctcggcgacctgggcctcggcacccaggtcaccgtgtcgtcggcgcactccgtgaacgtgctcgccaccagcttcccgccgtcgtcgggcgcgttccgggaggacctcgccgagtacatccagcccatcctcgacttccacggccagacgggctcgccgttcctcatcaacgcctacccgttcttcgcctacaaggccaaccccggcagcgtgtcgctgccgtacgtgctgttcgagcccaacccgggcgtgcgcgaccccaacaccaacctcagctacgacaacatgctctacgcccagatcgacgccgtgtacgcggcgatgaaggccatggggcacacggacgtgggcgtcaggatctccgagaccgggtggccgtccaagggcgacgacgacgagaccggcgccactgtgcagaacgccgcggcgtacaacggcaacctgatgcagaggatcgccatgaaccaggggacgccgctcaagcccaacgtgcccatcgacgtgtacgtgttcgcgctgttcaacgaggacatgaagccggggccggcgtcggaacggaactacgggctgttctaccccaacggctcgccggtctacgcgatcaacgccggctccggctccggcggcgggtcgctgaacccgtactacacgtccatgttctcctcctcgtccaaattggcggtaagcacaacatttttgacagagcgtgtgatactattattgctgctgcaagcaattgtaatactcctacagtcctagtgttagccagtgataccttgtaatcttgtacacgaaaaacacgcatttcaattcaaccatggggtaggcctggattcag

SEQ ID NO: 6322 - protein, 400 aa, Panicum virgatum
  misc_feature: Ceres CLONE 1862540
  misc_feature (1)..(319): Pfam Name: Glyco_hydro_17 Pfam Description: Glycosyl hydrolases family 17
MGLRHRASSLRLLSLALGLAVLLVSVSAQQKFGINYGQIANDLPDPTRVAGLLQSMNVNKVKLYDADPRVLTAFANTGVEFIIAVGNENLQTMAASPAAARQWVATHVQPYIPSTRITCVTVGNEVFSSNDTVMMSSLLPAMKAVYAALGDLGLGTQVTVSSAHSVNVLATSFPPSSGAFREDLAEYIQPILDFHGQTGSPFLINAYPFFAYKANPGSVSLPYVLFEPNPGVRDPNTNLSYDNMLYAQIDAVYAAMKAMGHTDVGVRISETGWPSKGDDDETGATVQNAAAYNGNLMQRIAMNQGTPLKPNVPIDVYVFALFNEDMKPGPASERNYGLFYPNGSPVYAINAGSGSGGGSLNPYYTSMFSSSSKLAVSTTFLTERVILLLLLQAIVILLQS

SEQ ID NO: 6323 - DNA, 1887 bp, Panicum virgatum
  misc_feature: Ceres CLONE 1862607
  misc_feature: Encodes the peptide sequence at SEQ ID NO. 6324
atcatcctcttcctcacagctgcttgctgcttagccgcccttcgctgctctctgctcctccgaattcgatggacctgcaggcggagctgcggcgcccggcggcggcccacgaggcggcgctgagggccgtgcagaagccgcccgccaagccctggcgcgggggaggcgccgcttcgaccccgcccccgccgcccaaggtgtaccgcgtcgagccccgggagttccgggacctcgtgcagaggctcaccggcgcgccggggagcggcgtggcgcggccgcagcatcatcagctgccggcggcggtgcagccgcaccagccggtggccgttcgcgctacaggggaccaccaccagcagcagcagcagctttacggctcgccgtggttctccttcccgctggccggggtggacggcgccaacgccggcggcctcatgtagtcgtcgtgacgcaacgcacgcatcaagggaagagaagggaagggatcgatgtagcaaatcaaagctttctccttttttttttcttggttattacaggacagagtagtttgtttctgagacaaggaagggaatcgagcatacaagaatcaacagcagcagtcacctcaccacgcatgcattagacaggcaggcagacatacatagatgaattaattaatgatgttgaataataatgtcaatagtcatattctagttagttattctctgttaattactactactaccagcaagtaccggtgttcatatagacagacttggtatatcactgtaacaagtgtatgtgtaatgttgaaggatgaaggtgttgaatccacccatcctggtctcatgcttcggtccacgcaaccgcccagcccctccagcggcagcggcacctcggcggcgccggcgtccggctccgacgccaagatggtcggcggcggcgcgccgagcggggccaagctgctgcagatcctcaacgtgcggttggtgggcagcggcgagcgcgtggtggtgctgtcccacggcttcgggacggaccagtcggcgtggagccgcgtgctcccctacctcacccgcgaccaccgcgtggtgctctacgacctcgtctgcgccggcagcgtgaacccggagcacttcgacttccgccgctacgacacgctcgactcgtacgtcgacgacctgctcgccatcctcgacgcgctccgcatcccgccctgcgccttcgtcggccactccgtctccgccatgatcggcatcctcgcctccatccgccgccccgagctcttcgccaagctcatcctcatcggcgcctcgcccaggttcctgaacgacaacgactaccacggcgggttcgagctgccggagatccagcaggtgttcgacgccatggcggccaactactcggcgtgggcgacggggtacgcgccgctggcggtgggcgcggacgtgccggcggcggtgcaggagttcagccgcaccctcttcaacatgcgcccggacatctccctccacgtctgccgcacggtgttcaacacggacctccgcggcgtgctgggcatggtgcgcgccccctgcgtggtggtgcagaccacccgcgacgtctccgtcccggcctccgtcgccgcctacctcaaggcccacctcggcggccgcaccaccgtcgagttcctccagaccgagggccacctcccgcacctcagcgcccccggcctcctcgcccaggtgctccgccgcgcgctcgcccggttctagcgacgcggcgatcggtatttttaccgcctcgatttttaccctttgccaagaatcaaaaatggcgcgacccgcgccgctgctgctgtgtgtgccatgactgtagtctgtagtagaacttgttctggtgctcgaattttttttaactttttactggagc

SEQ ID NO: 6324 - protein, 358 aa, Panicum virgatum
  misc_feature: Ceres CLONE 1862607
  misc_feature (1)..(218): Pfam Name: Abhydrolase_1 Pfam Description: alpha/beta hydrolase fold
MMLNNNVNSHILVSYSLLITTTTSKYRCSYRQTWYITVTSVCVMLKDEGVESTHPGLMLRSTQPPSPSSGSGTSAAPASGSDAKMVGGGAPSGAKLLQILNVRLVGSGERVVVLSHGFGTDQSAWSRVLPYLTRDHRVVLYDLVCAGSVNPEHFDFRRYDTLDSYVDDLLAILDALRIPPCAFVGHSVSAMIGILASIRRPELFAKLILIGASPRFLNDNDYHGGFELPEIQQVFDAMAANYSAWATGYAPLAVGADVPAAVQEFSRTLFNMRPDISLHVCRTVFNTDLRGVLGMVRAPCVVVQTTRDVSVPASVAAYLKAHLGGRTTVEFLQTEGHLPHLSAPGLLAQVLRRALARF

SEQ ID NO: 6325 - DNA, 2629 bp, Panicum virgatum
  misc_feature: Ceres CLONE 1862638
  misc_feature: Encodes the peptide sequence at SEQ ID NO. 6326
ctgcttctttccccttctctcccttggtcttccttccctggcggcgccgacgagtggggcgagcggcggcgccattcgtcacgtcttagcccagccctttgccggcgacgaggatccgccagatggattctcttgcgagctgagccgattgatccagtagaaggaatggggcagaggatggaggaagaggacaacgtggtgcggtcgctgaaagacctcccggtgcagaacccccccggggagaagttctcggccgccgacctcacctggctcaagtacgcgagctccgagcaccgctgggacgacgtcgcgatcatccgttacgaccggttggaggccttcctcagcggcgagagcagcaaccccgagtgccccacccgcttccacatcgagcgcagccgcaagcgcgaggagggcagcctcagggagtaccggagcgatgactacctcttccacaggatatattggtgctcatttggccctgagaactatggggagggagggacaatcttgcctagcagaaagttcaggctcaacacgaggaaccgtgctgcacgcccacagtcgatgcgaggctgcacttgccatttctctataaagcagctgtacgcccgccctgccctgctgctcgtcatctaccacgagaggcgccatgtcaacaagtctggcttcatatgccatgggcccctcgataaggatgccatcgggcctggtgctaggaggttgccgtacgttgggagtgaaatccagcagcagaccatgtcattgatctatcttggtgttccagaagagagcattctgcaggcacatatagaagggatacagcgttactgtagctcagatgccagggttgatagccatgcttcacagtatgtccagaagcttgggctgatcatcaagaggtctacacatgagttggatcttgatgatcaagctagcatcagaatgtgggtcgacagaaataagaaatcggtattcttctaccaggactcgaccgacacggatgcattcattctgggaattcagacagaatggcaatgccagcaaatgatgcgctttggtcatcagagccttttggcttctcattcctcatttggtgtaagcaagctaaagtatccattgcacacactacttatatttgactcaatgcagcatgctcttcctgttgcatggattataacccgctcagttactaagaaggataccctgaaatggatgagggcacttactgatcggatacactctatagattccacctggagaatcagtgggttcatcattgacgatccagcttcagagctggacccaatcagggatgtgtttgcctgcccagttttgttctctttgtggcacatcaggagaacctggcttaaaaatataatgaagaaatgcagcaacattgaggtacagcgggaaatttttattcaactaggcaaaattgtgtacggtatctggaatgagaaaaatcccatgaatgccctagagctgttgtttcaagactttgttgatcaaaccgccttcatgaaatatttcaagtcattttgggttcccaaattggagatgtggatcgactccatcagaaatcttccattagcaagtcaggaatcatgtggtgccattgaagcttaccatttaaagctgaaggctaaagcatatgatgatgtgctgctggatggtctccaacgagtagactggttagtgcacaagctcacaacagagctgcattcgagctactggatcaatctatttgcagatgagagcggttcatttcctggggtgaaagcagagtatatcgcatccacttcatggcaaagggcattgcagatacctgatgaagctgtacactttgacaacaacgaacctcattcagccaaagtggccagccagaaggatcccagtcagatgtggacagtatggaatcctggttctgaattctctctctgtgattgttcatggtcaatgcagggtaacctgtgcaagcatgctctaaaggttaacatgatgtgcggggcgcgcaaggacttccagccctcgctgtcattgcagtcgtttcagcgtgtcctgcttggtctgtggcaaaaaccaatggacgattcatactcactcgacctgtcagtagcattggtcacacaaatgcaggagaggatccaacatgtagccgagcttgccacctccaatggcatcgcccaagttgcagagaaattgccaatccaatggacaagaagaagggggagaaggacagccgccaagcgcaccagcccaatcattcttcctcactctaacagcagtttgcaaagagattcgaaaccaacaaagaacaggaagaggaagaggttgtctaccttctcgggataacaatgtgctgcctcccagagtcatattgtggcccctcttcgtaattagacgactaactgtcttcttttctctattttttacttgtgttacttctgttctgagtgaacttatgctcctacttgtgagttgtaaacctaggtcttggatgatatcagcttccatgttctggtccttcctagtattagtaataacatactccagtattattcaggcagtaaaaggaagcccctggagcagtttctcttgttcccgcgaaaaaaaaaaaaaaaaaaaa

SEQ ID NO: 6326 - protein, 729 aa, Panicum virgatum
  misc_feature: Ceres CLONE 1862638
  misc_feature (1)..(36): Pfam Name: SWIM Pfam Description: SWIM zinc finger
MGQRMEEEDNVVRSLKDLPVQNPPGEKFSAADLTWLKYASSEHRWDDVAIIRYDRLEAFLSGESSNPECPTRFHIERSRKREEGSLREYRSDDYLFHRIYWCSFGPENYGEGGTILPSRKFRLNTRNRAARPQSMRGCTCHFSIKQLYARPALLLVIYHERRHVNKSGFICHGPLDKDAIGPGARRLPYVGSEIQQQTMSLIYLGVPEESILQAHIEGIQRYCSSDARVDSHASQYVQKLGLIIKRSTHELDLDDQASIRMWVDRNKKSVFFYQDSTDTDAFILGIQTEWQCQQMMRFGHQSLLASHSSFGVSKLKYPLHTLLIFDSMQHALPVAWIITRSVTKKDTLKWMRALTDRIHSIDSTWRISGFIIDDPASELDPIRDVFACPVLFSLWHIRRTWLKNIMKKCSNIEVQREIFIQLGKIVYGIWNEKNPMNALELLFQDFVDQTAFMKYFKSFWVPKLEMWIDSIRNLPLASQESCGAIEAYHLKLKAKAYDDVLLDGLQRVDWLVHKLTTELHSSYWINLFADESGSFPGVKAEYIASTSWQRALQIPDEAVHFDNNEPHSAKVASQKDPSQMWTVWNPGSEFSLCDCSWSMQGNLCKHALKVNMMCGARKDFQPSLSLQSFQRVLLGLWQKPMDDSYSLDLSVALVTQMQERIQHVAELATSNGIAQVAEKLPIQWTRRRGRRTAAKRTSPIILPHSNSSLQRDSKPTKNRKRKRLSTFSG

SEQ ID NO: 6327 - DNA, 2070 bp, Panicum virgatum
  misc_feature: Ceres CLONE 1862651
  misc_feature: Encodes the peptide sequence at SEQ ID NO. 6328
accacaacccctcccctttcccttctcctccaagcaaagccgcccgtcccgccgcccgggcaaaaaccctagccccgtgatgtccggctccggcgcccccccgggccgcggctccggcggcggaggcggctcccgcagcttcgacttcggcggcgacgacgtgctctgctcctacgacgacttcgctgccacatccgagcccaagcgccccgatccggccgacaaggattttcatgacagcagattggggagacagtttgtgaaagcttatgaacaagaaagttatggaaaggaggatgtactttctgctgttgagaaatgcatgaaaaagtatgctgataatttgctacgatctcttgagggaatcactagtcggctttcacaactggagatctattgctataagcttgagcgatccataggtgaacttcgaagcgatgttcttcgtgatgagactgatcatagattgaagtctcttgagaagcatctacatgaagtgcacaggtctgtccaaattcttagggacaaacaggagttagctgaagctcagaaggaactggccaaattccaacttacactagatacacctaaaaagaaggaagatgtaccaacaccatctattcctgagccaaagaaacttgaagaaaagcctgatacatcgggccagcaattggcccttgttttgcctcatcaggtgaacccgccatcacttgcacctagagcctctgaatcagtccaacagtacaaggatcaacctgtgcagcaagcagcacctgcccctcctgtgtctcagcaggaccgctatgttcttagccaagccatcgtctactatccacagcgccaggacacacaggggcagcaattgcaaccagagttgcagtacttgccagcaaggcccccagctcaagatgttccggtccatgcttcatcccgatcgcctcaggccggaaatcaaacacagctgcagtcttaccctccttatcagcagcagtggcaccagcaatcctcccagccaactcctgcaccagtggctcagccacagcagactctttcgcagccatttcctccatctgcacagcagccccagttgtctaatgtgcagcagtttcctccacaaccagggcagcagccccaatctggttctcaacaataccctctgccaccagtgcaaccacatcaatctaacccacagcttccttcacaggcaatgcaaccacagcaccaccctgtgcaaactcagatgagacctcaaaccccaccaaattaccctcattatccaccccagcagcctgtgaaccccacccctgaagctctgcctggcaatgtggctatgcaaggacaatacaacactgctgctccgtcaggtgcgaaccattctgaagcaccatattcatatggaggacctggcttcccgccgtctcagccaccgccgcagatcccaccttcaagtcagagttcctatgggccacctccaagcaaagggtcctatgctggtggtcctgcacaattcgcaccacagggcaatccgcaaggctacggtgcaggttatggctacccgccgagcggccctccagcagtccagccaccacagatccccccaggtggtggcatgagccatccagggtctcatatgatgcgtggccatccctatggagaaatgattgagaaggcaatcgccatgggatatcctagggaccaggtgctgaacgtgacccagaggatggccgagagcggccagcagatggatttcaacaccctgctcgacaggctgaacgaagctgggtccggagcaccccctcgagcatggtgaatttggtccaactttgggtctttgggtgtcgttcgcggatgtgtgctatgacttatgaccgttatcacttagctaagtaaataagatttgagctgatgccgtgtactgcttgtctgtacgatgtacatatataatttgtgagtttcatctaattgctgcggcacgtgtactacgaacgtatcattccagttggactactcagatctatactgaagcaaaattattgacagggatcttgtcaaaaaaaaaaaaaaaaaaaa

SEQ ID NO: 6328 - protein, 576 aa, Panicum virgatum
  misc_feature: Ceres CLONE 1862651
  misc_feature: Great-hit functional homolog of the protein sequence encoded by LOCUS At4g28300
  misc_feature: Useful for making plants with altered cell wall content and/or composition
MSGSGAPPGRGSGGGGGSRSFDFGGDDVLCSYDDFAATSEPKRPDPADKDFHDSRLGRQFVKAYEQESYGKEDVLSAVEKCMKKYADNLLRSLEGITSRLSQLEIYCYKLERSIGELRSDVLRDETDHRLKSLEKHLHEVHRSVQILRDKQELAEAQKELAKFQLTLDTPKKKEDVPTPSIPEPKKLEEKPDTSGQQLALVLPHQVNPPSLAPRASESVQQYKDQPVQQAAPAPPVSQQDRYVLSQAIVYYPQRQDTQGQQLQPELQYLPARPPAQDVPVHASSRSPQAGNQTQLQSYPPYQQQWHQQSSQPTPAPVAQPQQTLSQPFPPSAQQPQLSNVQQFPPQPGQQPQSGSQQYPLPPVQPHQSNPQLPSQAMQPQHHPVQTQMRPQTPPNYPHYPPQQPVNPTPEALPGNVAMQGQYNTAAPSGANHSEAPYSYGGPGFPPSQPPPQIPPSSQSSYGPPPSKGSYAGGPAQFAPQGNPQGYGAGYGYPPSGPPAVQPPQIPPGGGMSHPGSHMMRGHPYGEMIEKAIAMGYPRDQVLNVTQRMAESGQQMDFNTLLDRLNEAGSGAPPRAW

SEQ ID NO: 6329 - DNA, 3061 bp, Panicum virgatum
  misc_feature: Ceres CLONE 1862653
  misc_feature: Encodes the peptide sequence at SEQ ID NO. 6330
ggtgcttagcaggcaggagctctgcaactgcaaggctgcagatccggccccgttccccccatttgccggcgcggttcctccgtgcgtgctccgcttgctcgctgctctggtctcggcgggggcggccgttgctcgggttggtcggtgccgtccctcccttcgtctcgcgggttgcgagggctcgatctgcgcggggctcgctgcgggcttcctccttcttgctccagcagactgctagtatagtaccctcttgcttatgcttttgcgtggcgttgctgcgcaggcaggggactgggtggtaggctgaccgcgaggagggagccatggctcagatcttgctccacggcacgctccacgtcaccatcttcgaggcggagtcgctctccaacccgcaccgcgcatccggcggcgcccccaagttcatccgcaagcttgtggaggggatcgaggacaccgtgggtgtcggcaaaggcaccaccaagatatatgccaccattgatctagagaaagcccgggttgggcgtacccggatgatctccaacgagcccgtcaatcctcgctggtacgagtcgttccacatctactgcgcccacctcgccgccgatgtcatcttcaccgtcaagatcgacaaccccattggggcgtcgctcattgggagggcttacctgcctgtccgggacctcctgaatgagggggaaatcgataaatctcttgaaatctgtgatgagaaccgtgagcctattggtgacagcaagatccatgtcaagcttcagtactttgatgttgccaatgaccgcaactgggcaagaggtgtccggagcaccaagtatcctggtgttccttacacctttttctcacagagacagggatgtaaggttactttataccaagatgctcatgtcccagacaactttattcccaagatcccgcttgctgatggcaagaactatgagccacacagatgctgggaggatatctttgatgccataagcaatgctcaacacttgatttacatcaccggctggtctgtgtacaccgagatcaccttggttagggacaccaacaggccgaaacctggaggcgatgttactcttggggagttgctcaagaggaaggctagtgaaggtgtccgggtcctcatgctagtgtgggatgataggacttcagttggcttgctgaagagagatggcttgatggccacccatgatgaggagactgcaaattacttccaaggctcggatgtcaactgtgttctgtgccctcgcaaccctgatgactctggcagctttgttcaggatctgcagatatcaactatgttcacacaccatcagaagatagtagtcgtcgaccatgagatgccaaaccagggctcccagcaaaggaggatagtcagcttcgttggtggtattgacctctgtgatggaagatatgatacacagtatcactccttatttaggacaattgatactgcccatcatgatgatttccaccagcctaactttgggactgcgtcaatcaagaaaggtggtccaagagagccatggcatgatattcattcacggctggaagggccaattgcttgggatgtcctttacaactttgagcagaggtggaggaggcagggtggtaaggacctccttgttcgtctcagggatctttctgacattattattcccccttctcctgtgatgttcccagaggacagagaaacatggaatgtccagctcttcagatccatcgatggtggtgcggcttttggcttccccgagactcctgaggaagctgctagagctgggcttgtgagtggaaaggatcaaatcatcgacaggagtatccaggatgcatacatacatgccattcggagggcaaagaacttcatctacattgagaaccagtacttccttggaagttcatatggctggaagcctgagggcatcaagccggaagatattggtgctcttcacttgattccgaaggagctttcattgaagattgttagcaagattgaagctggggaacgatttattgtttatgttgtggtgccaatgtggcctgagggtgtcccagagagtggttctgttcaggcaatccttgactggcaaaggagaacaatggagatgatgtacactgacatcacacaagctctccaggccaagggaattgttgcaaaccccaaggattacctcaccttcttctgcctaggtaaccgagaggtgaagcaggagggggagtatgaacctgaggaacaaccagaacctgacactgattacagccgggctcaggaggccaggaggttcatgatctacgttcacaccaaaatgatgatagttgacgatgagtacatcatcatcggttccgccaacatcaaccagaggtccatggatggtgccagggactctgagattgccatgggtgcataccagccgtaccacctggcaaccaggcagcctgcccgtggccagatccatggcttccggatggcgctgtggtacgagcacctgggcatgctggacgatgtgttccagcgcccggagagcatggagtgcgtgcagaaggtgaacaagatcgctgagaagtactgggatatgtactcgagcgatgacctggagcaggacctcccgggccacctcctcagctaccccattggcattgactctgaaggcaacgtcaccccgatgccagggatggagttcttccccgacacccgtgcccgtgtcctcggcaccaagtcggattacctcccacccatcctcaccacatagagggcagactgggagtgccatgccttctctcttgtctggcctcagcttggtgtctctttgtgtttcagacaccgaaggttcagattgtagtgttgttatagttattgagtgataataagtgcattgtgcatggttgggacgataggatgaagagttgtttattactaatactgcatacagattgtgttgtgtccctgtctggtgtagcttgtgtggcttgctgcgttgcagtgccgtttgtaagatgagactccagcaatttcacacggttgcttgtccaaaaaaaaaaaaaaaaaaaa

SEQ ID NO: 6330 - protein, 812 aa, Panicum virgatum
  misc_feature: Ceres CLONE 1862653
  misc_feature (1)..(39): Pfam Name: PLDc Pfam Description: Phospholipase D Active site motif
  misc_feature (1)..(812): SWISSPROT Homolog: EC 3.1.4.4 Phospholipase D alpha 1
  misc_feature (1)..(812): SWISSPROT Homolog: EC 3.1.4.4 Phospholipase D alpha 1 precursor
MAQILLHGTLHVTIFEAESLSNPHRASGGAPKFIRKLVEGIEDTVGVGKGTTKIYATIDLEKARVGRTRMISNEPVNPRWYESFHIYCAHLAADVIFTVKIDNPIGASLIGRAYLPVRDLLNEGEIDKSLEICDENREPIGDSKIHVKLQYFDVANDRNWARGVRSTKYPGVPYTFFSQRQGCKVTLYQDAHVPDNFIPKIPLADGKNYEPHRCWEDIFDAISNAQHLIYITGWSVYTEITLVRDTNRPKPGGDVTLGELLKRKASEGVRVLMLVWDDRTSVGLLKRDGLMATHDEETANYFQGSDVNCVLCPRNPDDSGSFVQDLQISTMFTHHQKIVVVDHEMPNQGSQQRRIVSFVGGIDLCDGRYDTQYHSLFRTIDTAHHDDFHQPNFGTASIKKGGPREPWHDIHSRLEGPIAWDVLYNFEQRWRRQGGKDLLVRLRDLSDIIIPPSPVMFPEDRETWNVQLFRSIDGGAAFGFPETPEEAARAGLVSGKDQIIDRSIQDAYIHAIRRAKNFIYIENQYFLGSSYGWKPEGIKPEDIGALHLIPKELSLKIVSKIEAGERFIVYVVVPMWPEGVPESGSVQAILDWQRRTMEMMYTDITQALQAKGIVANPKDYLTFFCLGNREVKQEGEYEPEEQPEPDTDYSRAQEARRFMIYVHTKMMIVDDEYIIIGSANINQRSMDGARDSEIAMGAYQPYHLATRQPARGQIHGFRMALWYEHLGMLDDVFQRPESMECVQKVNKIAEKYWDMYSSDDLEQDLPGHLLSYPIGIDSEGNVTPMPGMEFFPDTRARVLGTKSDYLPPILTT

SEQ ID NO: 6331 - DNA, 1898 bp, Panicum virgatum
  misc_feature: Ceres CLONE 1862662
  misc_feature: Encodes the peptide sequence at SEQ ID NO. 6332
aagcagcacgcatcatcatccactcatcccttcttcatcctgatccatcatccatcaactgtccaagaagtgcaagcaaaatcctgtttccaggaacgagtttgtgcagccatcctgatccatcatccatcaatggcgaccccgactgtggtcttgctgccggtatggggcgccggtcacctcatgcccatgctagaagccggcaagcggctgctcgctgctagcggcggccgcgcgctgtcggtcaccgtgctcgtcatgcggccgccgacggagcagcaggcgtccgaggtcgagggccacgtgcgccgcgccgaggaggaggcggcggccgccggcctcgacgtccgcttccaccgcctccccgccgtggagcccccgacggaccacgagggcccagtggagttcgtctcccgggtcgtggagctccacgtcccgcacgtccgggcggccgtctccggcttgccgtcggtcgccgcgctggtgctcgacctcttctgcaccccgctcatcgacgtggcccgcgagctcgtcgtgccggcgtacgtctacttcacctgcaacgccgccgcgctctccttcttcctgcgcctgccggcgctgctcgaggaggtggccggcgagttcgaggagatgaagggcgcggcggacatacccgggctgccccccgtgccgccgctctgcctgccgacgccggtcatggagcgggcgacgccggagtgcgcgtggtacgcgtaccacggcaggcggttcgcggacgctgacggcatcatcgtcaacacggccgccgagctcgagcggggcgcgctctccgccattgccggcgggcggtgcacgcgcggggcgcccgcgccggcgctctaccccgtcggcccggtgatctcgttcccgccgcccgccgagccgccgcacgactgcgtgcggtggctggaggcgcagccgccggcgtccgtggtgttcctctgcttcgggagcggcgggttcttcacggcggcgcaggcgcacgaggtggcccgcgggctggagcgcagcgggcaccggttcctctgggtgctgcgcggcccgccggcggcggccgggtcgcggcagcccacggacgccgacctcgcggagctcctcccggagggcttcctcgagcggacccggggcaggggcctcgtgtggccaacggcggcgccgcagaaggagatcctggcgcgcgcagccgtgggcggcttcgtgacgcactgcggctggaactcgatcctcgagagcctgtggtgcggcgtgcccatggtgccgtggccgctgtacgcggagcagcacctgaacgcgttcgcgctggtagccgccgcgggcgccgccgtggcgatggaggtggacaggaggaggggcaacttcgtggaggcggcggagctggagcgcgcggtgcgggcgctgatgggcggcggcgaggaggggaggagggcgaggcaacgtgccgcggagatgaaggcggcgtgccggagcgccgtcgaggacggcggctcgtcggccgccgcgctgaagagactctcgagcgatatactactatgtcggcaactgccatcgtcttcccttggcacggcatcatagttccatgattccatccgtccagaacatgtatttcttcactcaatttggaacatgattccgtcacacaatcttatactcgtagatttaatttacaaccatatttgaaatctaggctgtgtttagatgaggtgaaaagggggagaaaaaatcgcatcagtcattgtagcacactgtagcattttttgtttgtttgtggtaaatattgtcctaccatgacctaactaggctcaaaagattcgtctcgcaatgtacatcaaaactatgcaattagtttttttatttaactaaaaaaaaaaaaaaaaaaa

SEQ ID NO: 6332 - protein, 486 aa, Panicum virgatum
  misc_feature: Ceres CLONE 1862662
  misc_feature (2)..(151): Pfam Name: UDPGT Pfam Description: UDP-glucoronosyl and UDP-glucosyl transferase
MATPTVVLLPVWGAGHLMPMLEAGKRLLAASGGRALSVTVLVMRPPTEQQASEVEGHVRRAEEEAAAAGLDVRFHRLPAVEPPTDHEGPVEFVSRVVELHVPHVRAAVSGLPSVAALVLDLFCTPLIDVARELVVPAYVYFTCNAAALSFFLRLPALLEEVAGEFEEMKGAADIPGLPPVPPLCLPTPVMERATPECAWYAYHGRRFADADGIIVNTAAELERGALSAIAGGRCTRGAPAPALYPVGPVISFPPPAEPPHDCVRWLEAQPPASVVFLCFGSGGFFTAAQAHEVARGLERSGHRFLWVLRGPPAAAGSRQPTDADLAELLPEGFLERTRGRGLVWPTAAPQKEILARAAVGGFVTHCGWNSILESLWCGVPMVPWPLYAEQHLNAFALVAAAGAAVAMEVDRRRGNFVEAAELERAVRALMGGGEEGRRARQRAAEMKAACRSAVEDGGSSAAALKRLSSDILLCRQLPSSSLGTAS

SEQ ID NO: 6333 - DNA, 2648 bp, Panicum virgatum
  misc_feature: Ceres CLONE 1862668
  misc_feature: Encodes the peptide sequence at SEQ ID NO. 6334
ttcgatgtgagcttagcggagctgggagctgcagtaggtaaactcgtatctagccaaagctgtggctatggtgtcgctgaggccatcatcaccccatgagcccctcctcctcgggcaccaatcctccatcgttcttcggcacaatccaggtctgctgttcctgccaacacgaacgcgacatgccgtacatgctgcgcgtggcggcagcagcattaggagaagggagaagccggtggaggagaggatcagggagcagcttctcaacaccgagccgcccccgcagtcgtcgtcgtacgacacggcatgggtcgccatggtgccggcgccggggtcccctcaggcttcgcgcttcccgaagtgcgtggactggatcctgcggaaccagcgcggcgacggctcgtgggggccgcaggctgatggctccggcgacggcccgtggtcactgagcaaggacgcgcactcgtcgacgatggcgtgcgtcctcgcgctccggacgtggggcgtcggcgacgagcacgtcggcaaagggctcagcttcgtcgggcacaacgcgtccttggtgacggacgacaggagcgacacgccggcagggttcaacgtcatcttccccggcatgctcgcgcacgccatgggcatggggctggagatcccactggcccctgcttacgtcgacgccatcctccgattacgcgacacggagctgaagagaatgggttctgcaagtaaagctttcattgcctacgtagcagaaggcatggggaacctgctagactgggatcaggcgatggtgtaccagaggaagaacggatcgttcttcaactcaccggcaacaacggccgcagctgcgatccacagctacaacgggagagcactcgactacctggattccctcatcagcaaattcggcagctcagtgccgactgtgtatccgcggaacgcgtactcccggcttcgcatggtggacacgttggagaagatcgggatctgtccgggcttttccggtgaaatagacagcatacttgacaccatatacagctcctggctagccaacgatgaggagataacgcaggacatggcgacgtgtgccatggcgttccgcctcctgcgtttgcacggatacgatgtcgcgtctgatgggttgatccaattcagcaaagaatccagcttttacgattcggtccaagggcacctaaaagatagcgaagcactactagaactgtacaaagcgtcacaggttcagatctttgaggaggagccaatcctggaaaacattggctcttggtcagctaaacttctggacgaacaactgtgttccaacaagatttcaagatctgtagaccccggtgaggtggaacatgtgctcaaatttccctcctattcaaccgtggaccgactggagcacaggaggaacattgaacagtcaaagacagggggcttccagatgctaaaatcagcataccgcgcttgtcaggtagatgaagcaatggtcgcgctggcatctgaagggttccattcctcccaggctttgtaccgacaagagcttcagaagctcaagagctgggtgaaagagatgaggctggacgagctggagttcgcgagagcgatgatgccgttggtctgcctgttcgtacctgcttccaccatgtacccccctgagctatccgatgctcgccttgcgtacgccatggagatcatcctagtgaccacagtggatgacctgttcgacgtcgggggatcaaaggaagagatggagaacctcgtcacgctgatcgagaagtgggatgcgcacgaagaagttggcttttgctccgagagcgtggagattgttttccgcgccatctaccacacgagcaacctgctaggcgccaaggccgcggcggtgcagaaccgcagcatcatccaccacatcgccgagctctgggcagacctggcgagggccgtgatggccgaggcagagtggatgatgacaggccacacgccatccatggaggagtacatggcggtcggggtgccgtccaccgggctgggcccgatcgccctaacgccgctctacctcgtcgggccggagctcaccgaggaggtggtccggagccgggagtacggcgagatgttccggcacgttgccacctgcacccgcctcctgaacgacttccagacgtacgagagggaggaggagcaagggaagacgaacagcgtcctgctgctggctcgtcgccatggcggctccattgaggcagccagggcggaggtgcggagcaccgtcgcggcgtccaggagggagctgctgaggctggtggttagggatggcggcgtgatgccccgactggtgcggcagcagttctggaacgtttgcaagcttgcccacaagacgtacagggaggaggatggcttcgcgtcgaccagggagacgatgcacgcggcgaacgcggtggtgcacgagccgctgttctggcggcgaggagggaacatcgactctccggatgccgccgcgtcaatataagttgtgatgttctttgctgctcgtgtgatacacttctgaaatataagttcataatttgctccatatgactttggtggaaagtgttaagtgaacctcttcggtagtacagaaatgatctttgatttctgaaaaaaaaaaaaaaaaaaaa

SEQ ID NO: 6334 - protein, 810 aa, Panicum virgatum
  misc_feature: Ceres CLONE 1862668
  misc_feature (2)..(270): Pfam Name: Terpene_synth_C Pfam Description: Terpene synthase family, metal binding domain
MVSLRPSSPHEPLLLGHQSSIVLRHNPGLLFLPTRTRHAVHAARGGSSIRRREKPVEERIREQLLNTEPPPQSSSYDTAWVAMVPAPGSPQASRFPKCVDWILRNQRGDGSWGPQADGSGDGPWSLSKDAHSSTMACVLALRTWGVGDEHVGKGLSFVGHNASLVTDDRSDTPAGFNVIFPGMLAHAMGMGLEIPLAPAYVDAILRLRDTELKRMGSASKAFIAYVAEGMGNLLDWDQAMVYQRKNGSFFNSPATTAAAAIHSYNGRALDYLDSLISKFGSSVPTVYPRNAYSRLRMVDTLEKIGICPGFSGEIDSILDTIYSSWLANDEEITQDMATCAMAFRLLRLHGYDVASDGLIQFSKESSFYDSVQGHLKDSEALLELYKASQVQIFEEEPILENIGSWSAKLLDEQLCSNKISRSVDPGEVEHVLKFPSYSTVDRLEHRRNIEQSKTGGFQMLKSAYRACQVDEAMVALASEGFHSSQALYRQELQKLKSWVKEMRLDELEFARAMMPLVCLFVPASTMYPPELSDARLAYAMEIILVTTVDDLFDVGGSKEEMENLVTLIEKWDAHEEVGFCSESVEIVFRAIYHTSNLLGAKAAAVQNRSIIHHIAELWADLARAVMAEAEWMMTGHTPSMEEYMAVGVPSTGLGPIALTPLYLVGPELTEEVVRSREYGEMFRHVATCTRLLNDFQTYEREEEQGKTNSVLLLARRHGGSIEAARAEVRSTVAASRRELLRLVVRDGGVMPRLVRQQFWNVCKLAHKTYREEDGFASTRETMHAANAVVHEPLFWRRGGNIDSPDAAASI

SEQ ID NO: 6335 - DNA, 1861 bp, Panicum virgatum
  misc_feature: Ceres CLONE 1862682
  misc_feature: Encodes the peptide sequence at SEQ ID NO. 6336
ctcctccgcgtcgtcgtcgcgtgcgcgcgcacacccagcgtccctccctgaccagctgtacacacacacacatacacacgcgaaaaggcacagcccagccgcgctgccgccgctgcacagctgggcgcggcccgtggcggagctcggagacccctccctcctttaattagggtggccgctgagccgagcccggccatagagccggctccccggcaggccgcgacccctgccctgccccggacaccccatcctgccctcgccctgcgctccgtctccgtccctccgtcttcccgccgcggtctctctctttcctcttgctagagagggaagagagagcggcagggaggcggcggacgaggacgaggaggggggaggaacaacaagcacagcagcagccagcagggcccggccgcgatccgtcctcgctcccgctccccggccgaccaaatcattctccaggcgccgcaccgacgacgacgacatggccgctgccgggcacgccgtcgtgcccaagttcggatcctgggacgccgagaacatcggctacacagtcttcttcgacaaggtgcgcgacaacaagcccgcgcctcccaacaagccgcccgccgctggcgccagcgacgacttcgacccgtacgagcactacgagaacctcagcaggaaggtgccgtcgcgcccgccgagctcgcacggcggccacggccatgcgccggcgcccgccaccaaggcgcccgcgcccggcggcggcggagggtacgacttggacccgtacgagcactacgagagcctcagcagccggaacgtgccctcccggccgccgagctcgcacggccacgcgccggccggctacgactactacgaccgttacgagcactacgacaatctcagcagcaggaacgcgccgggccgcccgccgaactcccacggccacgcgccgccgccgccgcagcaccagcaccagcaccagcaccccggcggccacgggtaccaccaccggcggaccgggagcaacggcagcaacgcggcgtccgaggctagcagccgcggcagcaagttctcgccgcccaggccgtaccagcccaggtacagcagcaacaactacccggcgcagccgcaatccggcggccacggcgccgcccagtaccaccaccgccagcagcagcacggcgccgcccacgcccagtaccaccaccaccagcagcagcagcacggcgcgccgagggcggcgtcccccacgccgtcgccgccgcggcactaccagcccccgcccccgcggcggcccaagccgtcggccgtgccccggttcggcgtctgggacgagcagaacgcggcgatggcggcgcaggggttcaccgtgcagttcgagaaggtgaagcggcaccgggaggaggccaggacggcccccgcgccgcggccgcaggagacgctgcctcccgatcacgcggcgggggcggcgggggcgcggcggcacgcgaagaggaagcccaagaggtccttcatgtccaggatgtaccggtgcctgttcccaagggtcagagagtgggagtgagtgatcgggtgaggccgcagctcggtaaattactagtagtggtataatccgacgttcattaccactcaatcatcaattctactcgatttcttcctcacagactgtactattctagttctacttgaaaatttgttcgttctttggtcattacttctgtatactgtatgtataagctcccagtattattagtacaaattgcacaaaagatcatgttggagtacgtcttagaatctgtttggtagagctccactggttttccgatagaagtgaatttgtggctcataaactttcgaaaaaaaaaaaaaaaaaaaa

SEQ ID NO: 6336 - protein, 355 aa, Panicum virgatum
  misc_feature: Ceres CLONE 1862682
  misc_feature (7)..(83): Pfam Name: NOI Pfam Description: Nitrate-induced NOI protein
MAAAGHAVVPKFGSWDAENIGYTVFFDKVRDNKPAPPNKPPAAGASDDFDPYEHYENLSRKVPSRPPSSHGGHGHAPAPATKAPAPGGGGGYDLDPYEHYESLSSRNVPSRPPSSHGHAPAGYDYYDRYEHYDNLSSRNAPGRPPNSHGHAPPPPQHQHQHQHPGGHGYHHRRTGSNGSNAASEASSRGSKFSPPRPYQPRYSSNNYPAQPQSGGHGAAQYHHRQQQHGAAHAQYHHHQQQQHGAPRAASPTPSPPRHYQPPPPRRPKPSAVPRFGVWDEQNAAMAAQGFTVQFEKVKRHREEARTAPAPRPQETLPPDHAAGAAGARRHAKRKPKRSFMSRMYRCLFPRVREWE

SEQ ID NO: 6337 - DNA, 2314 bp, Panicum virgatum
  misc_feature: Ceres CLONE 1862735
  misc_feature: Encodes the peptide sequence at SEQ ID NO. 6338
acaatccattattccttcccattcgcttcgcttattccccactccctcccccgcaccctcgcctcgctccctccaccaccacccgccgccgccgccgcgtcctgggccggggagggtcgccggctcggctcggctctgctgctaggcgaggcgaggcgctctcgggcgtggcgggtggtcttatctgtgtgtgcgagggaggaagaggccgcgggtgccacggcgctcctcgcgcgggaggcgctcccgatgcggcgggatcgcgcgcccggcgcccggggcccgccgtgattcggcccgattcggcggggaggctgggatcccggcgctgccttggcgggggagctccgtgggatttccagcgccgattcggcgggccctcgacgggagcggcgggcgggccggcgcgggcggtgaaggttagccgcagccgatctgagttctcccgcggcctccgagtgtagggcggctcggggagggcacgaggacgcgaagaagcgaggccatggggctcgcgccgccggagctggggcagttcgacgggtgggagagctccggggaggaggagcgggagcgggagcgctggggctggtgccgccgcagccgccgcggcagcagcaggcaccgcgcgtcccccaaggccgccgccagcgacgacgacaccaccgtcgccaccggctgctgcatccgcctctggcccgtggggagctgccagccgccgccgaggtccaaggccgacacatccaccagcagcgccagcacgcacggcgcagagaagtcaacagaaaatggcagcaggaaccaaccggctgcattagtagtctcaggttctacaactactagtaatgctgagagcagttcatctgcttctaaagttggagatgaaataaaagttgcctctcagctgcgcaaattcgcattcaatgatctaaaatgtgcgaccaggaacttcaggcctgaaagtcttcttggagaagggggttttggatgtgtttttaaggggtggattgaagagaacggaactgcacctgtgaaacctggtacaggtctcacagttgctgtcaagacgctcaatcatgatgggcttcaagggcacaaagaatgggtggctgaagttgattttcttggaaaccttcaccatcctaacttggtcagattgattggatattgtgttgaagatgaccaaagattgctggtgtatgaattcatgcctcgtggcagtttggataaccatctattcagaaggtctcttccgctcccatgggccatcagaatgaaggttgctcttggagcagcaaagggtcttgctttccttcatgaagaagcagaaagaccagtcatttatcgtgattttaaaacatctaatatactgctagacgcggagtacaatgcaaagctctcagattttgggcttgccaaagatggccctgtaggtgataaaacccatgtctctactcgagtaatggggacctatgggtatgcagcaccggagtatgtcatgacaggtcatttgacatcaaagagtgatgtctatagctttggggtagtgctcctcgagatgatgtcagggcgcaggtcaatggacaagaaccgtcccaacggggagcacaacctcgtcgaatgggcacgccccctcctaggagagcggcagcgcttctacaagctaatcgacccccgcctagagggcaacttctctgtcaaaggtgcccagaaggcagcgcaactagctcgtgcttgcctcagccgtgaccccaaggcacggccgctgatgagccaggtggtggaagccctcaagccgctgctgaacctcaaggacatggccagctcctcctatttctaccagacgatgcaggcagagcggatggcgcactcgagtagcatgaacgggaggggcctcaagtcacagggcccgttcgcagcgcggaatgggcagcagcctgtgaggagcctctctgatggcccccgcgcctcccccttccgctactcgccaaagccgaacgtgaaatgactggaggcatgggcgtggctccggtaccttgggtgaaatggcgggttttagttctggtggtgaaacttggtgggggtggtggctggtttggggctgaatgttggcgtcgaacctgaattgctgcttgttgtagattgacatgtgcacaaaggatataggtgaaaaggaggtgtaggtatgaggtctcctttgtggatggtttcgttgaggttttagctgaatgctgatggaccgtttctatatatgttttgccccaatcaaggtagcttgggtgatttcccggcacaaaaaaaaaaaaaaaaaaaa

SEQ ID NO: 6338 - protein, 500 aa, Panicum virgatum
  misc_feature: Ceres CLONE 1862735
  misc_feature (106)..(490): SWISSPROT Homolog: EC 2.7.11.1 Protein kinase APK1B, chloroplast precursor
  misc_feature (91)..(435): SWISSPROT Homolog: EC 2.7.11.1 Protein kinase APK1A, chloroplast precursor
MGLAPPELGQFDGWESSGEEERERERWGWCRRSRRGSSRHRASPKAAASDDDTTVATGCCIRLWPVGSCQPPPRSKADTSTSSASTHGAEKSTENGSRNQPAALVVSGSTTTSNAESSSSASKVGDEIKVASQLRKFAFNDLKCATRNFRPESLLGEGGFGCVFKGWIEENGTAPVKPGTGLTVAVKTLNHDGLQGHKEWVAEVDFLGNLHHPNLVRLIGYCVEDDQRLLVYEFMPRGSLDNHLFRRSLPLPWAIRMKVALGAAKGLAFLHEEAERPVIYRDFKTSNILLDAEYNAKLSDFGLAKDGPVGDKTHVSTRVMGTYGYAAPEYVMTGHLTSKSDVYSFGVVLLEMMSGRRSMDKNRPNGEHNLVEWARPLLGERQRFYKLIDPRLEGNFSVKGAQKAAQLARACLSRDPKARPLMSQVVEALKPLLNLKDMASSSYFYQTMQAERMAHSSSMNGRGLKSQGPFAARNGQQPVRSLSDGPRASPFRYSPKPNVK

SEQ ID NO: 6339 - DNA, 1728 bp, Panicum virgatum
  misc_feature: Ceres CLONE 1863054
  misc_feature: Encodes the peptide sequence at SEQ ID NO. 6340
ttcttgagggtatcctccaaatctgtctccaagaaaaatacagccaaatacctcacccctccaaaccttcccctttttcacatagaatactccactccaccctccctttcccaatctctctcctctctctactactgcagatatcacaagcttttcctgctgttcctgctgcacctgcagcttctccatctgcagtgcaaagcagctgctaaattccccataagcgcgtggctccctgccccctcactttcttggaaccccagcgcaacacgaggatcattatcactcactacagtggcgtcctagatttccacttgtgcgcacacagcggcggcaggcgtgcatagtggtgatgcacaggtgagctgctgcggccgccgcttgctccatggaggatctgtacagcatccacccggggatctcgcgggccggcggcgcggcgagcgaggcgtccgtcaccggcgtcggcggggcggcgccgccgtcggatctgacggagctcatgaaggcgcagatcgccagccacccgcgctacccctccctcctctccgcctacatcgagtgccgcaaggtgggagcgcctccgcaggtggcatcgctgctggaggaggtcagccggcagaggcgcggcggcgccggggagatcggcgtcgatcccgagctcgacgagttcatggactcgtactgccgggtgctggtgcggtacaaggaggagctgtcgcggccgttcgacgaggccgcgtcgttcctgagcagcatccaggcgcagctcagcaacctctgcagcggcggcagctcgccggcggcgacgaccgccacgcactccaatgacatgatggggtcctcggaggatgagcaatgctcaggggacactgatgtgccagacatagggcaagaacacagctcccgcttggctgaccatgagctcaaggaaatgctgctcaagaagtacagtggatgcctcagtcgtcttcgatcagagttcctgaagaagcggaagaaagggaagctaccaaaagatgcaaggacggtgttgctggagtggtggaacacgcactaccgctggccttatcccacggaagaagataaggtgaggctcgcagcgatgactggcctcgacccaaagcagatcaacaattggttcatcaaccagaggaagaggcattggaagccgtccgaggacatgcggttcgcgctcatggagggcgttgctggtggatcttctgggacaacactctacttcgacactggcacaatcggaccctgaaccagctcatccactacttcttgggcacaaaactggccagctaaatcagtagcctgacctggcttgtgaagatcatcaatctgccgggtcaaaattgacaataaatatatgtcatcctgaaattgatcgaatcatcccgctgcctcattattttgcaagatcatgtgtatatggtgtcgtcgtaatgaaacaaaatgtatgtacgagcaaatttgggagacctgcaaaagcattttattagtagtttcgtgtattggctgcaatactgggctacccaatttaattgttagataggctgaagggcttataaaggtaaatatacctgtgctgttccgttgttctgtttgtctatatttggtacttattttcatttgcagccttcggatgtttagcaattactgtatctgtgtatcagttaagtggttcaaagaaattgtggtcaaaaaaaaaaaaaaaaaaaa

SEQ ID NO: 6340 - protein, 292 aa, Panicum virgatum
  misc_feature: Ceres CLONE 1863054
  misc_feature (1)..(59): Pfam Name: Homeobox Pfam Description: Homeobox domain
  misc_feature: The sequence is a functional homolog of  SEQ ID NO 2674 in the  10/374,780 US patent application
  misc_feature: The sequence is a functional homolog of  SEQ ID NO 76 in the  10/225,066 US patent application
  misc_feature: Useful for making plants with modulated growth and phenotype characteristics
MEDLYSIHPGISRAGGAASEASVTGVGGAAPPSDLTELMKAQIASHPRYPSLLSAYIECRKVGAPPQVASLLEEVSRQRRGGAGEIGVDPELDEFMDSYCRVLVRYKEELSRPFDEAASFLSSIQAQLSNLCSGGSSPAATTATHSNDMMGSSEDEQCSGDTDVPDIGQEHSSRLADHELKEMLLKKYSGCLSRLRSEFLKKRKKGKLPKDARTVLLEWWNTHYRWPYPTEEDKVRLAAMTGLDPKQINNWFINQRKRHWKPSEDMRFALMEGVAGGSSGTTLYFDTGTIGP

SEQ ID NO: 6341 - DNA, 1987 bp, Panicum virgatum
  misc_feature: Ceres CLONE 1863099
  misc_feature: Encodes the peptide sequence at SEQ ID NO. 6342
atcacgatctacagttccatcctcccccaatcccccgcctccgccatactgcgccgcacgttctggtccccgcgccgccgtgccgccaggcacgcggatcgccgccccccacaccgacgcgcgaccccccttcactctagctacgttctggatcggctcgcccccgccgcggccgccgccctcatggcgtcgtaccgccccgagcatccaaatccggccgcccgacgcccgcggcccgtcgtgctcctcatgctcgccttcttcgccctccagctcctcatcttcctctccttccgcgccgtgcggccccctcccgccccggcctccgccgccgacactgcggccgccgtgccggtgctggcgtcggcacccgcgcaccgggacgggaatgcttcgagctgcggcggcgggctggtgtacgtctacgacctcccggcggccttcaacgaggacctcctgcggatgtgcgacaagctcgcgccgatgtacccgctgtgcccctacctcgccaacgacgggctcgggctccccgcggggggtaccaacctgtcgtcgctcctgccgcgggagctgctcgggtcgtggtacgcgtccgaccagttcgcgctggagcacatcgtccaccgccgcctgctctcgcaccgctgccgcacggcggacccggcgcgcgccgccgccttcttcgtgcccttctacgccgggctcgccgtggggcgccacctgtgggcggccaacgccacgggcgctgacagggacagggactgcgccgcgctgctgtcgtggctccacgcgcagccgtggtaccggcgctcccgcggctgggaccacttcatcgcgctgggccgcatcacgtgggacttccgccgcacgtcggacgacgcctggggcggcagcttcctcaccatgcccggggtggccaacatcacccgcctcgtcatcgagcgcgacccctgggacgacatagacgtcggcgtcccgtacccgaccgggttccacccgcgcgccgccgccgacgtgcgcgcgtggcagcggcacgtcgcgcggcgcccgcggcccatgctcttcgccttcgccggcgcgccgcggtcggccatcaggggcgacttccgcgcgctgctgctgggggagtgccaggcggccggccccgccgcgtgcggcgcgctggactgcgccgagggcaggtgcatcaggaacaacgcgctcgtcatggatctcttcatgggcgccaggttctgcctgcagccgcgcggggacagcttcacgcgccgctccctgttcgactgcattgtggccggcgccgtccccgtgctgttctggcggcggagcgcgtaccggcagtacgggtggtacctgcccgtgggcgacgggcgcgaggcggagtggtccgtgttcatcgaccgcgagaagctccgcgcggggaacctcacggtgcgcggcgtgctggcggctatcccggagccgcgggtgcggctgatgcgggagcgcgtggtggagatgatcccgaggctggtgtacgccgcggccgaccgggggaaggggctcggcggcggcatggaggacgccgtggacgtcatggtcgacggcatgctgcggcgggtcgccgagcagcgcccgagatggcggccgacgtgatctcagctgctgcagtgggaccaaactgatcatacgttttcacagtttttttcgttttccattctgaattctttcgtgtgaagaatttcactcgcgcgaaaaaagattaccgcgcgtagcctccaagaagttgagttaaagcggctctagctgtaaatttacacgcgcagtacaacgaaatcagagacgtgcgaagaaaatcgtgtatgaagactcggtgcaccggagcaccgtaaatgttgaagtttgcgaacagttgactggctgcgccagattagattcttgtaatagtagcaaatttgacccgggaatgtatagttgtgctcaatgtttcgaaaaaaaaaaaaaaaaaaaa

SEQ ID NO: 6342 - protein, 482 aa, Panicum virgatum
  misc_feature: Ceres CLONE 1863099
  misc_feature: Great-hit functional homolog of the protein sequence encoded by LOCUS At5g62220
  misc_feature: Useful for making plants with altered cell wall content and/or composition
MASYRPEHPNPAARRPRPVVLLMLAFFALQLLIFLSFRAVRPPPAPASAADTAAAVPVLASAPAHRDGNASSCGGGLVYVYDLPAAFNEDLLRMCDKLAPMYPLCPYLANDGLGLPAGGTNLSSLLPRELLGSWYASDQFALEHIVHRRLLSHRCRTADPARAAAFFVPFYAGLAVGRHLWAANATGADRDRDCAALLSWLHAQPWYRRSRGWDHFIALGRITWDFRRTSDDAWGGSFLTMPGVANITRLVIERDPWDDIDVGVPYPTGFHPRAAADVRAWQRHVARRPRPMLFAFAGAPRSAIRGDFRALLLGECQAAGPAACGALDCAEGRCIRNNALVMDLFMGARFCLQPRGDSFTRRSLFDCIVAGAVPVLFWRRSAYRQYGWYLPVGDGREAEWSVFIDREKLRAGNLTVRGVLAAIPEPRVRLMRERVVEMIPRLVYAAADRGKGLGGGMEDAVDVMVDGMLRRVAEQRPRWRPT

SEQ ID NO: 6343 - DNA, 1737 bp, Panicum virgatum
  misc_feature: Ceres CLONE 1863234
  misc_feature: Encodes the peptide sequence at SEQ ID NO. 6344
ctctctctctctctctctctctctctcgtcatttccgtttccgtctccccctctcctcgcccacacgtccaaaaccgaaggagcaaaccaacaaacccgggccgagtaacgcagggggcgcggggcgttgcggtgctggtgcgacgcgcagtgctgtgcagctcatggaggcggcggcggcggccgagtacggctactacggcggcggcgcggccccccgcgagaggaagcccgcggggtgcggggaccatttcgtcgtcgacgacctcctcgtgctcccgtacgacgacgacgaggaaggggatggggaggcggcgcccggggatggggaggcgccaccgtgcctgcagcccgtcaaggaggagggcggcctcgggaatttctcggccgactcgtcaaccgtcacggcgctggacagctgcagcaactccttctcggggctgggcgacggcgacttcgcgggggaattctgcgagccgtacgatcaattggcggagctggaatggctgtccaactacatgggtgagggcgacgatgccttcgccgccgaggaccttcagaagctgaagctcatttccggcgggttctcctcggcggtgaacgtgccaccggctcccgtggcccctgcggccccggcttcggctgcctcagcggcgcagcccggtatgttcctcccggaggcgccggtccccgccaaggcccgtagcaagcgctcccgcgtggcgccaggcaactggtcgtcgcgcctcctcgtgctccccccgcccccggcctcgccgccgtcgccggcgtccatggccatctccccggcggagtccggagtctcggcccaggcgttccccgccaagaagccgtcgaagccgtccaggaagaaggacgcgcctccggtgccgcaggcgcagccctcgagcgcgcccggggcgcagccgggcggctcggcggcgtcggcggaagggcggcggtgcctgcactgcgagacggacaagacgccgcagtggaggacggggcccatgggccccaagacgctgtgcaacgcgtgcggggtgcggtacaagtcgggcaggctggtgccggagtaccggcccgcggcgagccccaccttcgtgatgtcgaagcactccaactcccaccgcaaggtgctggagctgcgccgccagaatgaggtgcagcaccagccgccgcacgtgatcgccggcggtgggcctggcgggataatgcacatgccgagcccgctgctgttcgacgggcccgcggcgccgcccgtcatcgccggcgacgatcatttcctgatccaccaccacttaggggcagactaccggcagcttatctagacaagagtctagcttgtgctagaattgatcggttagcccagtaataattaatgcagctaaaccccaagaactccccaaaaaaactatggaagaactactaatcttctattaggagttcttttccccagttttcctcctctttctttatgcttactagttcgcgtgcttctgttcagctcttcgaaattttcgtgtcgatttctgtttgtgacctgttttcttttcagcttacattcgctcctaaccttcttattagaaccctgtcctgagtttaattccttagcttttttttcattttgttagaattatgtaattcagcctctcaaggctattattagtttgttctcttccagtagttcccaatctgctgccagaacatgaaaaggaaaagtgaaaatttcgcctc

SEQ ID NO: 6344 - protein, 388 aa, Panicum virgatum
  misc_feature: Ceres CLONE 1863234
  misc_feature (1)..(36): Pfam Name: GATA Pfam Description: GATA zinc finger
  misc_feature: The sequence is a functional homolog of  SEQ ID NO 1655 in the  10/374,780 US patent application
  misc_feature: The sequence is a functional homolog of  SEQ ID NO 1657 in the  10/374,780 US patent application
  misc_feature: The sequence is a functional homolog of  SEQ ID NO 290 in the  10/374,780 US patent application
  misc_feature: The sequence is a functional homolog of  SEQ ID NO 6 in the  10/225,066 US patent application
  misc_feature: Useful for making plants with modulated growth and phenotype characteristics
MEAAAAAEYGYYGGGAAPRERKPAGCGDHFVVDDLLVLPYDDDEEGDGEAAPGDGEAPPCLQPVKEEGGLGNFSADSSTVTALDSCSNSFSGLGDGDFAGEFCEPYDQLAELEWLSNYMGEGDDAFAAEDLQKLKLISGGFSSAVNVPPAPVAPAAPASAASAAQPGMFLPEAPVPAKARSKRSRVAPGNWSSRLLVLPPPPASPPSPASMAISPAESGVSAQAFPAKKPSKPSRKKDAPPVPQAQPSSAPGAQPGGSAASAEGRRCLHCETDKTPQWRTGPMGPKTLCNACGVRYKSGRLVPEYRPAASPTFVMSKHSNSHRKVLELRRQNEVQHQPPHVIAGGGPGGIMHMPSPLLFDGPAAPPVIAGDDHFLIHHHLGADYRQLI

SEQ ID NO: 6345 - DNA, 2128 bp, Panicum virgatum
  misc_feature: Ceres CLONE 1863270
  misc_feature: Encodes the peptide sequence at SEQ ID NO. 6346
aaccctctggcacagctaaccagcttcctcgcctttttctcttccatctcctcgccttcgctgctgcattccaacgccccgacggaaaataaaggccaagaagtggtgctagtggagtaaaaccacgcgcccgagaggagagggacaggttggtggaagacgcgcatccggaaggagcgcaccaggggctccggcggtcaattcgggcggcgagcgcgccgcttcacgcgggcggcagcggcggcggcggcgccggaattgtggcggacgaagcggctgcttggtgcggcgggagcttgcgggtagggcagtctcggttggtcaaggggcgaaggtgttgtttggggcgtggatctggccggaggcgcgcgatgtggaggagggattaaggccggattggggcaaaggcgcgatcttgggggttcccatgggcggatgcttctcgcaggaggagcaccggctccagagcaggccagctgaagctgctggaccagatggtttgaagaagtctaaatctgattctaaagctatagcaagtgttcttgctcctccaaaagatgttgtggacttacaagtagaaggatatggaaatgttaatattttcacatacaatgaactgagggcagccacaaaaaacttccggccagaccaaattcttggagagggtggatttggagttgtttacaaaggtgttattgatgaaaatgttagagcaggttttccatctagacaggttgctgttaaagaactaaacccagagggctttcagggagacaaggaatggttggccgaagttaactatcttgggcaacttagtcatccaaatctagtcgaactgattggctattgctgtgagggttcacatagacttcttgtctatgagtacatggcttgtggcagcctggaaaagcacctttttcgccgggtttgccttaatatgccatggtcaacacggatgaagattgcgctgggtgccgcaagagggcttgagtaccttcatggagccgagagatccattatctatcgggatttcaagacttcaaacatcttattagacgcggactacaatgccaagctttcagactttggcctcgcaagaacaggacctagtggagaccaaacccatgtgtcaactcgggtcatgggaacttatggatatgcagctccagaatatgtgatgactggccatctgacggcacgaagtgatgtttacggcttcggcgtcgtgcttctagagatgattattggaaggagggctgtggacaagacccggccaactcgtgagcataacctagttgattgggcacgccctctccttgtccacaaccggaagctgttcaggatcattgatccaagaatggaagggcagtactccaccaaggctgccattgaggtggcaagccttgcataccgttgcctgagtcagaaccccaaagggcgaccaaccatgagccaagtcgttgagacctttgaggcggtccagaacatgcctgaatgccaagacatactcctccagaacagtatcacaggtgctgtgacactctacgaggtcccgaaggagcctgcagagagtgtcgagaaggagaaggccaagcaggaaccggcagtaaagactgccgctgtgccacctgtgaacggaaagccagtcccccagagcaggcggacacggcctgggaatggccggagcaagagcgagccgtcattggagtgcaagatgtacatcccgtcaccggactccgacggacagcagctcggcctggaggcgcttgcatccccttccagagacggaagtatacaggaccctcctgatgaggatttgtacaagatataacatcagatcattttttccccaatgatttgagccatcgttggtcatcttttgcgccgccatccatgttctcaagaagtcagccagtgttattttttccctatgatggccacgctagggttcttgttcttccgattagcaattgtatgtagatgagagttgtgatggaaagcatgtaatgtgagtgcctgccatgatgacgctgtaaaaacttgagacggttctttctgggaaaatttccacaccaaaaatggaagtggagagatgtgtcctgacagtcaaaaaaaaaaaaaaaaaaaa

SEQ ID NO: 6346 - protein, 467 aa, Panicum virgatum
  misc_feature: Ceres CLONE 1863270
  misc_feature (1)..(354): SWISSPROT Homolog: EC 2.7.11.1 Protein kinase APK1A, chloroplast precursor
  misc_feature (55)..(356): SWISSPROT Homolog: EC 2.7.11.1 Protein kinase APK1B, chloroplast precursor
MGGCFSQEEHRLQSRPAEAAGPDGLKKSKSDSKAIASVLAPPKDVVDLQVEGYGNVNIFTYNELRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKTRPTREHNLVDWARPLLVHNRKLFRIIDPRMEGQYSTKAAIEVASLAYRCLSQNPKGRPTMSQVVETFEAVQNMPECQDILLQNSITGAVTLYEVPKEPAESVEKEKAKQEPAVKTAAVPPVNGKPVPQSRRTRPGNGRSKSEPSLECKMYIPSPDSDGQQLGLEALASPSRDGSIQDPPDEDLYKI

SEQ ID NO: 6347 - DNA, 1523 bp, Panicum virgatum
  misc_feature: Ceres CLONE 1863312
  misc_feature: Encodes the peptide sequence at SEQ ID NO. 6348
cgtaaaccctaatccctcctgaatctttccccgcctccatctcgcgctcgattcgaatccgagccccctcgcttgctcctgctgctgctgctgctgcaatggaggacccagctgtcgaggaggccgaggtgagcggtgccgcagagttcgcgccggcgcttatcgccgcccatccccacggaaactccgtcgccgtcgccatcgggccggagctccgcgtgtttgatctcaaggctggttctcaagttttgttgtcacatgattgtggcggccgttctcattcagacgctataagagctatttgctttagtgtgagtggtgctttatttgcatccgctggtgatgacaaacttgtgaaggtttggaagactgattcatggcgctgcatccggactataacatcagagaagagggtcagtgcagttgctattagcaacgatgacctgtatgtaacttttgcagataaattcggcgttgtttggttagtcacgttgggggaagatggtacagaacaggtttcagttgataacaaacctgtgtcaattcttggtcactactgtagtatcatcactagtatgaagttttcgccagatggcaggttcattgctactgctgatagggacttcaaaatacgagttacattattcccaaagaatcctctaaagggggcccacaaaatacagtgcttttgccttgggcatacagactttgtgtcatgcatcgccttcacaagcatgtctgaaaaccagagctttcttatatcaggaggaggtgattcaactgttcgcctgtgggactacataaatggattgctccttgatacatgccaagtcagagacaagatgggagaactcttagaaccaaatgaaacagatgatagcactctagccattgcagatatatgtccgagtaatggtgactcattggttgctgtagctattcaaagtttcaatggcgtaatgcttttagcatgtgatgtagtagaaaagaagttatctttcctaaaggtgattacaatggaaaagagctatattcctactagcttagcatccagcttctcatcagaactcctatggactgtcatgggtgcatcaaacatgcccaaccaggcttcctcccagttattaacccgtttaaggatcattccctgcttccaaaaggatctgatatcatccgataacagtcctgcagtccttgaagatagtgcagtaccgcacggtgagaagctccttttggcgctgcaaggaagcctcgacattgcaaagcaagaagaggtcttagcttcagtgctggctgcgctgaaggtttctatgcataagatgctggtgaagaagcactactcggaagagaggagggagcagaggaaaaggggcaggaacgacaagaagatcaagaactagctcgatctctggttttcaagatccaacaagacaatagcagagttcccttgtaatgccgtgctgtaccattactagtttgaaacacaagaattgaattaccaactttgagagtaaatttgtcag

SEQ ID NO: 6348 - protein, 433 aa, Panicum virgatum
  misc_feature: Ceres CLONE 1863312
  misc_feature: Great-hit functional homolog of the protein sequence given in SEQ ID NO 9280
  misc_feature: Useful for making plants with altered protein content
MEDPAVEEAEVSGAAEFAPALIAAHPHGNSVAVAIGPELRVFDLKAGSQVLLSHDCGGRSHSDAIRAICFSVSGALFASAGDDKLVKVWKTDSWRCIRTITSEKRVSAVAISNDDLYVTFADKFGVVWLVTLGEDGTEQVSVDNKPVSILGHYCSIITSMKFSPDGRFIATADRDFKIRVTLFPKNPLKGAHKIQCFCLGHTDFVSCIAFTSMSENQSFLISGGGDSTVRLWDYINGLLLDTCQVRDKMGELLEPNETDDSTLAIADICPSNGDSLVAVAIQSFNGVMLLACDVVEKKLSFLKVITMEKSYIPTSLASSFSSELLWTVMGASNMPNQASSQLLTRLRIIPCFQKDLISSDNSPAVLEDSAVPHGEKLLLALQGSLDIAKQEEVLASVLAALKVSMHKMLVKKHYSEERREQRKRGRNDKKIKN

SEQ ID NO: 6349 - DNA, 2179 bp, Panicum virgatum
  misc_feature: Ceres CLONE 1863500
  misc_feature: Encodes the peptide sequence at SEQ ID NO. 6350
gacttgggaacagcgctggcttttttgctccgtccagccactggtgtgtagcaaggctagctcagacatggctgcccaagaggagggagcgcaggcgacgcagatcgaggccgtgaggaagaagaagccgcaagggtggaagtgcatgcccttcatcatagcaaacgagacgttcgaaaaggcagcctcattcggagtggcagcgaacctgacaacgtaccttgtgaagcgcttcaacatcgggcaactccaggcgaccaacgtaaccaacatcttcttcgccacgctcaacttcacaccattgctaggcgccttcatctccgattcctacctgggaaggttcagaaccctagcctatgggtgcttcgcgaccctcctggggatactgggggtgactttgacttcgtcacttcctgccctcaaaccagagatatgcaatcaaacagcccaattaggtggacactgcaatggtccatcaacactgcagctgggagtgctatacctttcactagggctgctaactattggtggtggagcaatacggccctgcagcttacctttcggagtagaccaatttgatcagactgatgaaaagagtcgaaagggcctaaatagctattataattggtactatagcacaagtactgctgctctggtgttctctatgactgttctcatctacatccagacaaatgtcagctgggcaataggatttggcatacccacattgttcatgtttttcgcaattatcatcttcttcgccggtgccagattttatgtccatgtaccaccagaggggagcatcttatctggatttgcgcaagtttttgtggcatcatttaaaaagagaagactcaatcttccatgttctcatgacataagcaaacaagagttgatgctctacaaccctcccacaaggggcagccgcattttcagactgccacttacttcacaattcaggtttctgaacaaaggtgcaattatgctggatggtgatataaacgatgatggttctgcaagaaactcatgggaactctgcagtatccagcaaatagaggaagccaaatgtttgataagacttgtgcctatttctttttctggcatcctatgtttcgttgcaatggctcaacaattcacctttatagtattgcaagcgttcaccatggactgtcacctagggccacactttgaaattcctgcaggttctgtttcatccatctcacttattgccctaaccgtgttcatccccatttacgaccaacttatggtaccacttgcaagaaagttgactgggctggaaggtggaattacagtcctacagagacagggtgtaggattggcactttctccaatttctatggtggtagcaggacttattgagcataaaaggagggattcagctttgtctaatggaggtatatcatctatgacagtttggtggcttgcaccccaactggttttaatgggtattgctgaggccttcaatgcagttggacaaatagaattctacaataagcagtttccagagcatatgcaaaccctagcaggatcccttttgttctgtactattgctggagcaagctacatgagcactgcgctggtaagcatcacaacaaaggttagcggcagaaatggtaacacaggctggttaacagaaaatatcaacgatggcaaacttgattattactattattttattgccatcctgggagtgctgaatcttttctacttccttgtatgctctcactattatcaatataaggtcgtgtcattccatgctgaagaatccatcaaaacacatgtcaaggaagaagcagctacagagatagagatcgtcacaagtgcaccaagcaaatgaaaatttcaatggcgatctataatatgcagacttagtgacaattaaggttcagtttgtaagatgccttatagtaacatattatcttatgaagaagtgaactacggttcagccagccatggtgactctgttatccaaacaacagtaaataaaggtctattattttggaacttcattaagttttaacgaagtctgtcatacttcagtagaagctaatatcgcctgtaatatgtgtaacatgtaagcacaggcagagtacaccaatttcttcacagattttactgcagtttgtatgtagaagtctaaaaaaaaaaaaaaaaaaaa

SEQ ID NO: 6350 - protein, 596 aa, Panicum virgatum
  misc_feature: Ceres CLONE 1863500
  misc_feature: Great-hit functional homolog of the protein sequence given in SEQ ID NO 9476
  misc_feature: Useful for making plants with modulated nitrogen use efficiency
MAAQEEGAQATQIEAVRKKKPQGWKCMPFIIANETFEKAASFGVAANLTTYLVKRFNIGQLQATNVTNIFFATLNFTPLLGAFISDSYLGRFRTLAYGCFATLLGILGVTLTSSLPALKPEICNQTAQLGGHCNGPSTLQLGVLYLSLGLLTIGGGAIRPCSLPFGVDQFDQTDEKSRKGLNSYYNWYYSTSTAALVFSMTVLIYIQTNVSWAIGFGIPTLFMFFAIIIFFAGARFYVHVPPEGSILSGFAQVFVASFKKRRLNLPCSHDISKQELMLYNPPTRGSRIFRLPLTSQFRFLNKGAIMLDGDINDDGSARNSWELCSIQQIEEAKCLIRLVPISFSGILCFVAMAQQFTFIVLQAFTMDCHLGPHFEIPAGSVSSISLIALTVFIPIYDQLMVPLARKLTGLEGGITVLQRQGVGLALSPISMVVAGLIEHKRRDSALSNGGISSMTVWWLAPQLVLMGIAEAFNAVGQIEFYNKQFPEHMQTLAGSLLFCTIAGASYMSTALVSITTKVSGRNGNTGWLTENINDGKLDYYYYFIAILGVLNLFYFLVCSHYYQYKVVSFHAEESIKTHVKEEAATEIEIVTSAPSK

SEQ ID NO: 6351 - DNA, 2631 bp, Panicum virgatum
  misc_feature: Ceres CLONE 1863653
  misc_feature: Encodes the peptide sequence at SEQ ID NO. 6352
acggttttatcccatcctctccagcgaaggcgcccccccatccaatctctctccctcccacaccgaaaaggccgcgcgcggcgacacggcctgatccaccccacctccacgttcgccacgtgcgcgccacctccctcgccgcggccgcctccgtcgcaagatcgcgagcccgccgttcgcagggcgcggcagcgagtaggaggcgggcgggccatggggacgctcctccggccggggcccgccgcgtcgccaatctccatcgcctcctcctcggcccacgcggtggctggcgggggacgcgcatggagctcgcggcatcgggtgtcggtggcggccttccggtccccgagcccgcaggttctggcgacgaggtggcggcggcggagtgatacggctgtgcgctcggatgttgtcgccggcggcgcggccgccgccgcagccggggattccacgcaggcgctgtcagatctgcaagtggcttcaagagtcagaggggtttgcttctatttggtgactgcagttgcagcaatcgttttgtttgttgctatggttgtggttcatccactcgtgttgctatttgatcggtaccgcagaagagcgcagcactacattgcgaagatttgggctactttgacgatttccatgttctacaaggttgaggttgagggaatggagaatctacctccaaatagtagccctgctgtctatgttgctaaccatcagagcttcttggatatatatacccttctaactctagggaggtgcttcaagtttataagcaagaccagtatctttatgttccctattataggttgggcaatgtatttcctgggtgtgattcctctgcggcgtatggacagcagaagccaactggattgtctcaaacggtgtgtggacttggttggaaaaggagcttctgtattcttctttcccgaggggacccgaagtagagatggcaagttaggtgtatttaagcgaggcgcattcagtgtcgccacaaagaccggtgctcctgtgatacctattactcttatcgggactgggaaattgatgccttctggaatggaaggcatcctcaattcaggttcagtaaaggttattattcacagacctattcaagggaataatgcagaaacattatgttccgaagcaaggaatgtgattgcggacactcttcttctacatggttatggagtgcactaaagcaattgggtgctttggtctatttccaagaagacattccaaggcacaagtacttgaggcaaagcttgttgccaggtactgatgctaactacccactctgatatttcgagaagctaggcaatatttgatcttgaggagttctggttgctctttgtggaatagttttgtttatgttttcacccaaaaaaagtttgtttatgctctgtaattgcccgagatccttctgtgctgaagatatttgaggctgttctccactgattgacgctggagttatacttgaaaataatggaactgattaactctggaattatacttgctctttgtccttctatccttttgatttgatatataagttattagtactcccaagtcccactggtcacaaatattagaagtttaggacaccgatattgtctacaagatgcaacttttaccagcaaattctgaaaagatatatttattttttttttaaaaatagaattatatcatggaattatttacatgatgaatatagtagcaccaaccttgtcttgccaaactatttataattttaactatttgtggtcaaaggtaaacaagtttgacctagggcaaacctaaaactacttgtgtttgggaccggagtatgaaatgtgctcttcctgtgggcagcaacttcaaatatcaggtgcattgtctccgcaggtgcaaattagcttgtacatcagtgctctgaagaatgtgattttggtgcatgttcacacatgtgcagtgttcttacattcaaacagatgtagcacagtgaacactacgcatgatctcttactagcaaatattagcatcaaccttgtcttgccaaactatttataattttaactatttgtggtcaaaggtaaacaagtttgacctagggcaaacctaaaactacttgtgtttgggaccggagtacgaaatgtgctcttcctgtgggcagcaacttcaaatatcaggtgcattgtctccgcaggtgcaaattagcttgtacatcagtgctctgaagaatgtgattttggtgcatgttcacacatgtgcagtgttcttacattcaaacagatgtagcacagtgaacactacgcatgatctcttactagcaaatattagccaataaaagatcacatgcctgattcgtcaaatattagccatatgatctcttccatatggcttgtatgattgtatcaggttttatgtgattttatctttgctgcaggatgtaaaggcgggagggaggaaaaaaaggctggagctggattggtagttgtaacttgcggtccaatgttgtgatccccccttccctttatttttctgttgtgtaacagtaacagcgatgtaaaaggcagagagatcatcttcattcgatggaaaataaagccaatgtgaaatttgccattttaaaaaaaaaaaaaaaaaaaa

SEQ ID NO: 6352 - protein, 329 aa, Panicum virgatum
  misc_feature: Ceres CLONE 1863653
  misc_feature (1)..(128): Pfam Name: Acyltransferase Pfam Description: Acyltransferase
  misc_feature (58)..(323): SWISSPROT Homolog: EC 2.3.1.51 1-acyl-sn-glycerol-3-phosphate acyltransferase 1, chloroplast precursor
MGTLLRPGPAASPISIASSSAHAVAGGGRAWSSRHRVSVAAFRSPSPQVLATRWRRRSDTAVRSDVVAGGAAAAAAGDSTQALSDLQVASRVRGVCFYLVTAVAAIVLFVAMVVVHPLVLLFDRYRRRAQHYIAKIWATLTISMFYKVEVEGMENLPPNSSPAVYVANHQSFLDIYTLLTLGRCFKFISKTSIFMFPIIGWAMYFLGVIPLRRMDSRSQLDCLKRCVDLVGKGASVFFFPEGTRSRDGKLGVFKRGAFSVATKTGAPVIPITLIGTGKLMPSGMEGILNSGSVKVIIHRPIQGNNAETLCSEARNVIADTLLLHGYGVH

SEQ ID NO: 6353 - DNA, 2015 bp, Panicum virgatum
  misc_feature: Ceres CLONE 1863684
  misc_feature: Encodes the peptide sequence at SEQ ID NO. 6354
attccccgcccgcacaccaccactgacttccacccaccaaggtcagcctcccaaatactaatagcattaggcagctgcctgccggcctcccgatccgccgatcggccggtcctctttcccggcgaggcggcagccatggcgcgcggcggggacaacctgcaggtgctgagcgcgctggacgcggccaagacgcagtggtaccacttcacggccatcatcgtggccggcatgggcttctttaccgacgcctacgacctcttctgcatctccctggtcaccaagctgctgggccgcatctactacaccgacaccgccaagcccgacccgggctcgctcccgcccaacgtcgccgccgccgtcaacggcgttgccttctgcggcacgctcgccggccagctcttcttcggctggctcggcgacaagctcggccgcaagagcgtctacggcatgacgctcatgctcatggtcatctgctccatcgcctcgagcctctccttcggccacacgcccacgggggtcatggccacgctctgcttcttccgattctggttggggttcggcatcggcggcgactacccgctctcggcgaccatcatgtccgagtacgccaacaagcgcacccgcggcgccttcatcgccgccgtcttcgccatgcagggcttcggcatcctcgccggtggcattgtcacgctcatcatctccgccgccttccgcgccggctacccggcgccggcttaccaggagaacgccgccgcctccaccgtctcgcaggccgacttcgtgtggcgcatcatcctcatgctcggcgccgctcccgcgctgctcacctactactggcggatgaagatgcccgagacggcgcgctacaccgcgctcgtcgccaagaacgccaagcaggccgccgccgacatgtcccgggtgctccagacggagatcgtcgacgagcaggagaagctcgacggcatggtcacctccgccggcaacagcttcggcctcttctcccgggagttcgcgcgccgccacgggctccacctcctcggcacggccagcacctggttcctcctcgacatcgccttctacagccagaacctgttccagaaggacatcttcaccagcatcaactggatccccaaggccaagaccatgagcgcgctcgaggaggtgttccgcatctcccgcgcccagacgctcatcgcgctctgcggcaccgtgccgggctactggttcaccgtcgcgctcatcgacgtcgtcggccgcttcgccatccagctgctgggcttcttcatgatgaccgtcttcatgctcgggctcgccatcccgtaccaccactggacgacggccggcaaccacatcggcttcgtcgtcatgtacgccttcaccttcttcttcgcaaacttcgggcccaacagcaccaccttcatcgtgcccgccgagatcttcccggcgcggctgcggtcgacgtgccacggcatctccgccgccgcggggaaggccggcgccatcatcggggccttcgggttcctgtacgcggcgcagaaccaggacaagagcaaggcggaccacgggtaccccgcgggcatcggcgtccgcaactcgctcttcgtgctcgccggggtcaacatgctcggcttcttcctcaccttcctcgtgcccgagtccaaggggaagtcgcttgaggaaatgtccggcgaggccgaggacggcgccgaggaggcgcccgccggcggcggccgcgccgtgcggccgtccgagacacagatggtgtagaacgattgacgcgtgcgccgggttgcatatggagatacgtgtaggcccggccggttcacttgttctcgttttcctatgtgcgactcagtcaaaactggtacactcctattttgtgcagtagtaggtgcgtggtggcacatgtgcatctgtcttatttttatctatctactatatatatcaagtacacaaacacattggtgtgaacaagcacaaactcttaagacgatagacgatgccagttcccaagc

SEQ ID NO: 6354 - protein, 543 aa, Panicum virgatum
  misc_feature: Ceres CLONE 1863684
  misc_feature: Great-hit functional homolog of the protein sequence given in SEQ ID NO 9539
  misc_feature: Great-hit functional homolog of the protein sequence given in SEQ ID NO 9545
  misc_feature: Great-hit functional homolog of the protein sequence given in SEQ ID NO 9551
  misc_feature: Great-hit functional homolog of the protein sequence given in SEQ ID NO 9557
  misc_feature: Useful for making plants with modulated phosphate use efficiency
MARGGDNLQVLSALDAAKTQWYHFTAIIVAGMGFFTDAYDLFCISLVTKLLGRIYYTDTAKPDPGSLPPNVAAAVNGVAFCGTLAGQLFFGWLGDKLGRKSVYGMTLMLMVICSIASSLSFGHTPTGVMATLCFFRFWLGFGIGGDYPLSATIMSEYANKRTRGAFIAAVFAMQGFGILAGGIVTLIISAAFRAGYPAPAYQENAAASTVSQADFVWRIILMLGAAPALLTYYWRMKMPETARYTALVAKNAKQAAADMSRVLQTEIVDEQEKLDGMVTSAGNSFGLFSREFARRHGLHLLGTASTWFLLDIAFYSQNLFQKDIFTSINWIPKAKTMSALEEVFRISRAQTLIALCGTVPGYWFTVALIDVVGRFAIQLLGFFMMTVFMLGLAIPYHHWTTAGNHIGFVVMYAFTFFFANFGPNSTTFIVPAEIFPARLRSTCHGISAAAGKAGAIIGAFGFLYAAQNQDKSKADHGYPAGIGVRNSLFVLAGVNMLGFFLTFLVPESKGKSLEEMSGEAEDGAEEAPAGGGRAVRPSETQMV

SEQ ID NO: 6355 - DNA, 2345 bp, Panicum virgatum
  misc_feature: Ceres CLONE 1863688
  misc_feature: Encodes the peptide sequence at SEQ ID NO. 6356
aagtcaactctccgcgctagcttaatgctccctccattataaccacccaaccctcccccctcccccctccccccaccctctcttctccgcttccggctccgctcccgtcccgccatgggcaactcgctcgcctgcttctgctgctccggcggcggcgccggccgccgccgccacgtggcgcccgccgcgctcccctccgacccggcctacgacgagggcctgggccactccttctgctacgtcaggccggataaggtgctcgtgcccttctccgcggacgacctggtcgccgacgccaaggcggccgccgcggcggaggaggccaccacgttccgggccatctcgggggcggcgctcagcgccaacgtctccacgccgctctccacgtccgtgctcctcctgctgccggacgaatccgccgcgtcctcggccgccgccgcctcctccgggttcgagagctccgagtccttcgccgccgtgccgctgcagcccgtcccgaggttcccgtcggggccgatctgcgcgcccgccggcggcgggttcctctccggcccaatcgagagggggttcctctccgggccccttgacgccgcgctcatgtccgggcccctcccgggcgccgccgcctccggtcgcatgggaggcgccgtgcccgcgctccgccggagcctctcccacggcggccgccgcctgcggaatttcacgcgcgcgcttctcgcgcgggcggataagtttcaggattcgatggatctcggctcgccggacgccgccgcagccgtggccgcctgcggcgccgattcagccgggctgcagtgggcgcaggggaaggccggcgaggaccgcgtgcacatcgtggtgtccgaggagcgggggtgggtgttcgtcggtatctacgacggcttcaatggtccggacgccacggatttcctcgtctcccacctctacgccgccgtgcaccgcgagctccgcggcctgctctgggaccagtgcgagcaagaggagcagaacgaccaacaccccgagcaaccgaccagcaccacggcatcagatcaccaggaccaggctgcccatcgccgccgcgcccgccgatcgagacccccgcgcggcgccgacgaggaccaacggcggtggaagtgcgagtgggagcgcgacctctccagcctgaagccaccaactcagcggccccctcggagcaacagcgagaacgaccacctcgccgtgctcaaggcgcttgcacgcgcgcttcgcaagactgaagaggcctacctggacgtcgccgacaagatggtcggcgagttcccggagcttgcgcttatgggctcttgcgttctagccatgcttatgaaaggagaggacatgtacgtcatgaatgtaggcgacagccgggctgtcttgggaacaatgaacagtgttgatctcgagcagatcagcgagggttcatttgacggattggttggggattgctccccgctcttgtcagctgtgcagcttacatccgaacatagcacttcggcgcgagaggaagtttgcagaatacgcaacgagcatcctgatgacccgtccgcaatctcaaaggaccgtgtgaagggctcgcttaaggtgacaagagcgttcggagctggtttcttgaaacagcccaagtggaatgatgcactgttggagatgttcagaatagactacgttgggtcgtccccatacatcacatgcaatccttcactcttccaccataaacttagcacaagggacagattcttgatactatcttcagatgggctttaccaatatttcaccaacgaggaggcggttgctcaggtagaaatgttcatcgcaacaacccctgaaggcgaccctgctcagcatctggtggaggaagttcttttccgagccgccaacaaagcaggcatggactttcacgaattgatcgagataccccagggggaccgtcggcgataccatgacgatgtgtctgtcattgtaatatctttggagggtagaatctggagatcatgtgtgtaaatagatcagccatactagattagagaaacaaacgtacagagaaacagagggggttcttgcagacctttgagcagttcttgcggctactccactcctccccagctgccgctgtacaatatcaatgaagcactgggttggacatgggctttggatctcggcgtatccagctgaaccacgatgaaatcccctggccgacgccgtcgccgccgccgccgtatgaggtgttcatgtaaaagaggatttgttcaattattaataactataaaatcacgatcaattggtcagctttctttgactttttttcctttcaaaaaaaaaaaaaaaaaaaa

SEQ ID NO: 6356 - protein, 633 aa, Panicum virgatum
  misc_feature: Ceres CLONE 1863688
  misc_feature (1)..(345): Pfam Name: PP2C Pfam Description: Protein phosphatase 2C
MGNSLACFCCSGGGAGRRRHVAPAALPSDPAYDEGLGHSFCYVRPDKVLVPFSADDLVADAKAAAAAEEATTFRAISGAALSANVSTPLSTSVLLLLPDESAASSAAAASSGFESSESFAAVPLQPVPRFPSGPICAPAGGGFLSGPIERGFLSGPLDAALMSGPLPGAAASGRMGGAVPALRRSLSHGGRRLRNFTRALLARADKFQDSMDLGSPDAAAAVAACGADSAGLQWAQGKAGEDRVHIVVSEERGWVFVGIYDGFNGPDATDFLVSHLYAAVHRELRGLLWDQCEQEEQNDQHPEQPTSTTASDHQDQAAHRRRARRSRPPRGADEDQRRWKCEWERDLSSLKPPTQRPPRSNSENDHLAVLKALARALRKTEEAYLDVADKMVGEFPELALMGSCVLAMLMKGEDMYVMNVGDSRAVLGTMNSVDLEQISEGSFDGLVGDCSPLLSAVQLTSEHSTSAREEVCRIRNEHPDDPSAISKDRVKGSLKVTRAFGAGFLKQPKWNDALLEMFRIDYVGSSPYITCNPSLFHHKLSTRDRFLILSSDGLYQYFTNEEAVAQVEMFIATTPEGDPAQHLVEEVLFRAANKAGMDFHELIEIPQGDRRRYHDDVSVIVISLEGRIWRSCV

SEQ ID NO: 6357 - DNA, 1671 bp, Panicum virgatum
  misc_feature: Ceres CLONE 1863737
  misc_feature: Encodes the peptide sequence at SEQ ID NO. 6358
tcgagctggcggcgcgcacgacggcacgaggcaagcagcgcgcagtgcgagagagagtgttcgtgtgagctcctcgatcgccggacgcggccatggaggcggtggaagccgtggtggcggccggcgtggagccgttcccgacggtggacaagtgcgacgcgtcgggtcgcgggtcgcacgccgtggcggcggacctggacggcacgctgctccggtcccgcagcgcgttcccgtactacgccctggtggcgttcgagaccggcggcgtgccgcggctcctgctgctgctgctcctgtccccgctggccgcggcgctgcgcgtggtggcgtcggaggccgcgtgcgcgcgggtgctggtgttcgcggccacggcgggggcgcgggtgcgcgacatcgagtccgcggcgcgcgccgtgctgccccggttctacgccgcagacgtgcacccgggagcgtggcgcgtcttctcggcgtgcgcccggcgccgcgtggtgctcacgtcgacgccccgggtcatggccgagccgttcctcagggagtgcctcggcgccgacgccgtcgccggcaccgagctcgccacgtggtgcggccgcgccacgggcatggtggacgcgcgccggggcgtcctcgtgggccgccgcaaggccgaggcgctgcgggagatgttcgccgccgacggcggcgacgcgcccgacgtcggcctcggggacagccgctccgactacgccttcatgagcatgtgcaaggaggcgtacatcgtaccgcgggcggcggtggagcccctgcccatggaccagctcccgcgccccgtcatcttccacgacggccgcctggtgcgccgcccgacgccgctggcggcgctgctcgtcgcgctctggttccccgcgggcttcgcgctcgcctgcctccgcatcgccgcgggcgcgctgctgcccatgccgctcgtctactacgccttctgggcgctgggcgtgcgcgtgctcgtccgcggcgcgccgccgccgccgcgtgccgagcgcgccgcgggccgccggggcgtcctcttcgcctgctcgcaccgcacactgctcgaccccatcttcctgtccgcggcgctgggccggcccgtggcggcggtcacctactcgctctcgcggctgtccgagttcctgtcgccgatccggacggtgcggctgacgcgggaccgcgcggcggacgcggccatgatccgggagctgctggcggagggcgacctggccatctgccccgaggggaccacgtgccgggagcccttcctgctgcgcttctcggcgctcttcgcagagctcacggacgaggtggtgccggtggccatggagaaccggatgagcatgttccacggcaccacggcgagggggtggaaggggatggaccccttctacttcttcatgaacccgagcccggcctacgtggtcaccttcctcagcaagctcccggcggagctcacctgccccggcggcaagaccagccacgaggtcgccaactacatccagaggctcatcgccgacacgctctcccacgagtgcaccagcctcaccaggagggacaagtaccgggcgctcgcgggcaacgacggcgtggtggcggtggcacccaaaagccagctagattaatttctttttttaaaaaaaatgaagattggattgcattgtt

SEQ ID NO: 6358 - protein, 512 aa, Panicum virgatum
  misc_feature: Ceres CLONE 1863737
  misc_feature (1)..(120): Pfam Name: Acyltransferase Pfam Description: Acyltransferase
  misc_feature (15)..(505): SWISSPROT Homolog: EC 2.3.1.15 Glycerol-3-phosphate acyltransferase 6
  misc_feature (15)..(510): SWISSPROT Homolog: EC 2.3.1.15 Glycerol-3-phosphate acyltransferase 4
MEAVEAVVAAGVEPFPTVDKCDASGRGSHAVAADLDGTLLRSRSAFPYYALVAFETGGVPRLLLLLLLSPLAAALRVVASEAACARVLVFAATAGARVRDIESAARAVLPRFYAADVHPGAWRVFSACARRRVVLTSTPRVMAEPFLRECLGADAVAGTELATWCGRATGMVDARRGVLVGRRKAEALREMFAADGGDAPDVGLGDSRSDYAFMSMCKEAYIVPRAAVEPLPMDQLPRPVIFHDGRLVRRPTPLAALLVALWFPAGFALACLRIAAGALLPMPLVYYAFWALGVRVLVRGAPPPPRAERAAGRRGVLFACSHRTLLDPIFLSAALGRPVAAVTYSLSRLSEFLSPIRTVRLTRDRAADAAMIRELLAEGDLAICPEGTTCREPFLLRFSALFAELTDEVVPVAMENRMSMFHGTTARGWKGMDPFYFFMNPSPAYVVTFLSKLPAELTCPGGKTSHEVANYIQRLIADTLSHECTSLTRRDKYRALAGNDGVVAVAPKSQLD

SEQ ID NO: 6359 - DNA, 2907 bp, Panicum virgatum
  misc_feature: Ceres CLONE 1863849
  misc_feature: Encodes the peptide sequence at SEQ ID NO. 6360
ggtgctgaatgcagatctgacgctaccttcttctattcctgttcgtctttcctctgctgtgcacatggtcgttaagcttgattcttcttggttatttctttttagctagtatcttatttaagaccttggtgacaagctggtacaaaattaacaagttttggtgccatctcatcaacttctatgatagaaggagtctttccgaaggagtagtcccatgcatgacttaacttatcctactaaattgcgtccctccagtcagtagtcataaaagtctccaagtcttcagagagaatccactcagaatggatttgacaacatctgaagaatatgcttcccaatccaagttactgcaagaattcaccaaagtcccaagcattgacagtgcttgggttctcaaaaataacaacgatggcatatccacagcaatgttctccattagccagtcagacctactggcgaacagaaccagaaaatacagtatgtactgtcatattaagggggctggtaccaactctagggatttccagtggtctcctttccccactgaaatgactggagtgtctgtcatcgtcccatccccttcggggtcaaagcttcttatagtgcgaaacggggagaaaggttgccctactaagcttgaaattgttgatcaatcacatgtggagaaggagatacatgtaggtcagtctatgcatggtccgctttataccgatgaatggtttcatggtatttcctggaatcaagaagagaccttgatagcatacattgctgaagctccaccccaaccaagaccagttttcagtgattctggatatagaaagggagactcttctgatgaagactgtaatacctggaaaggacaaggggattgggaagaggactggggtgaaagatactccaaaaaagggagaccctcattgtttgttcttgacattgccagtggagaagtgcgagcggctgaaggcattgcaacatcattgagtgttggccaagttgtttgggttctcccttcttcaagtggcagtcaaaagtatttggttttcgttggatggttagagcacaacgggtttcataacactgctagaaaacttggtatcaagtactgttctaacaggccatgtgctctttatgcaattgctagccctttcgaaagaccagagactgaaaataaaccagtttgcgatggtaaatcagactccgctgcatcagcacacaacttaacagcaagcatcagtagtgctttctttccacgtttcagccaggatggaaaaatcctactcttcctttctgcaaaacaggctgtaaatagtggagcacataatgcaacggattctctgcataagatcaactggctttctgattggaaaatggataaacaacttgatgttactgaagtggtgcctattgtaatgtgccctgaagatggttgtttcccgggtctttactgctcatccattctatccaatccttggctttctgatggatgcacgatgatactaacatctgcttggaggagtaccgaagtgatattatcaataaatgttttaagtggaaaagtaacaagaattactccagaagactcgcattactcatggagtgctcttgcgatagacggtgacaatgttcttgctgtgtcaagtagtcccatcgaccctcctcatatcaggtatggacgccaagtgacaccagagggtcaagcacgcagatggacttgggatgaagttgatagtccgttgaggacagccagcgatagggttaagtccttgttgtcgcatcacagtgtcactatacttcaaattcctgttgctaacccctctgatgacctctctgatggtggcaaacttccatttgaggccatttttgtgtcctgcaaggacagttcgcacagtccaactgttgtagtccttcatggtggcccacactcagtgtctgtgtcaagctacgtgaaatcatcagcctttcttgcttcacttggattcaatctgctaattgtaaattatcgaggtacaccgggttatggagaggaggctttacaatcgcttcctggaaaagtaggatctcaggacgtccgagactgtcttacagccatagatcacgtcatcaacgaaaagctaatagatgcttccaaagtagctgttgttgggatttcacatggtggattcttgacaactcatctgataggccaggctccagacagatttgttgcgggagctgctcggaatcctgtgtgcaacctggcactgatgattggcaccactgacatcccagactggtgttacatggtggcctgcggaactgaagcgaagcaatatgcctccgaatccccttcacccgaccatcttcgcctcttctatgagaaatcgccgattgctcatgtctcaaaagtgaaagcgccccttcttatgcttcttggaggagctgatcttcgagtacccgtttctaatggcctacagtacgcaagggccctcagagaaaggggtggccaggtcaaaattatgatgttcccagaggacatacacgaaatcatcataccacggtccgattttgaaagtttcctcaacattggagtttggttcaagacacatctaaaataggtgcagatgcggccgcgtgaagcagagtgtggtgatacattcggttgaagcgctaggcttggggaggcctcaaactttctcatgaaacaagcagattcgtactggcctcgtacgtgaatctggtttccgttttattagagagaataagccgaaagaagagaagccgaacagagtgaaatgaattaaactcctccattaatattgttagctattcagtcatgatgctttaattcatgactcagacatattgtcctcagttttcatccagtccttttttataaggattttctttcaaaaaaaaaaaaaaaaaaaa

SEQ ID NO: 6360 - protein, 763 aa, Panicum virgatum
  misc_feature: Ceres CLONE 1863849
  misc_feature (1)..(218): Pfam Name: Peptidase_S9 Pfam Description: Prolyl oligopeptidase family
MDLTTSEEYASQSKLLQEFTKVPSIDSAWVLKNNNDGISTAMFSISQSDLLANRTRKYSMYCHIKGAGTNSRDFQWSPFPTEMTGVSVIVPSPSGSKLLIVRNGEKGCPTKLEIVDQSHVEKEIHVGQSMHGPLYTDEWFHGISWNQEETLIAYIAEAPPQPRPVFSDSGYRKGDSSDEDCNTWKGQGDWEEDWGERYSKKGRPSLFVLDIASGEVRAAEGIATSLSVGQVVWVLPSSSGSQKYLVFVGWLEHNGFHNTARKLGIKYCSNRPCALYAIASPFERPETENKPVCDGKSDSAASAHNLTASISSAFFPRFSQDGKILLFLSAKQAVNSGAHNATDSLHKINWLSDWKMDKQLDVTEVVPIVMCPEDGCFPGLYCSSILSNPWLSDGCTMILTSAWRSTEVILSINVLSGKVTRITPEDSHYSWSALAIDGDNVLAVSSSPIDPPHIRYGRQVTPEGQARRWTWDEVDSPLRTASDRVKSLLSHHSVTILQIPVANPSDDLSDGGKLPFEAIFVSCKDSSHSPTVVVLHGGPHSVSVSSYVKSSAFLASLGFNLLIVNYRGTPGYGEEALQSLPGKVGSQDVRDCLTAIDHVINEKLIDASKVAVVGISHGGFLTTHLIGQAPDRFVAGAARNPVCNLALMIGTTDIPDWCYMVACGTEAKQYASESPSPDHLRLFYEKSPIAHVSKVKAPLLMLLGGADLRVPVSNGLQYARALRERGGQVKIMMFPEDIHEIIIPRSDFESFLNIGVWFKTHLK

SEQ ID NO: 6361 - DNA, 1861 bp, Panicum virgatum
  misc_feature: Ceres CLONE 1863992
  misc_feature: Encodes the peptide sequence at SEQ ID NO. 6362
atctttagtccactccgtcgccccgccaacctcgccgccgccgccgccgctgcagccgcgcccccaccgaaccgcaccccttgacggcatggcctccccggcgccggcgacccccgcggccgccgcggcccactcccctcccccgcgcatcgggctcgcgggcctcgccaccatgggccagaacctcgcgctcaacatcgccgagaaggggttcccgatctccgtctacaaccgcaccgccgccaaagtggactccacgctcctccgcgcgcgcgacgagggcgcgctcccggtgctcggacaccgcgacccgcgcgggttcgtgctctccctctcccgcccccgcaccgtcgtgctgctcgtgcaggcgggcccagctgtcgacgccaccatcgacgccctcaccccctacctcgagcccggtgatgccatcgtcgacggcggcaacgagtggtaccagaacacggagcgccgcatcgaggaggctgcggcgcgcgggatcctgtacctcgggatgggcgtgtccggcggggaggagggcgcgcggaacgggccctcgctcatgcccggcggccacgttgacgcctacaacaacatcagggacatcctcgagaaagccgcggcgcagacggaggatggggcgtgcgtcaccttcgttgggcccggtggcgccggcaacttcgtcaagatggtgcacaacgggatcgagtatggcgatatgcagctcatcgcggaggcctatgacgtgctccgcagagttgggggcctgtcgaattcggagattgcggatgtgtttgctgagtggaacaagggggagcttgagagcttcttggttgagatcaccgcagacatcttcactgtgcctgaccccctggatgggagcggtggggcgttggttgacaagattctcgacaagactgggatgaaggagactgggaaatggacggtgcagcaggcggcggagctagcggtggctgcaccaaccattgctgcatcgttggacgggaggtacttgtccgggttgaaggacgagcgcgtcgctgctgcaggggtgttggaggaggaggggatgccagccgggctgttggagaaaatcaatgttgataagaaagtgctggtggatagggtgaggcaggcgctttatgcatcgaaaatttgcagctatgcacagggcatgaatttgatacgggccaagagcgaggagaaaggatggaaccttaaccttgctgagcttgctcggatttggaagggtgggtgcattatccgtgcaaggtttcttgataggatcaagagggcctatgacaggaaccctgagctggccaatttgatcgtcgaccgagagtttgcaagggagatggtgcagcgacagaatgcatggagatgggttgtggcacgggcagtggaggctggcattagcactccaggaatgactgctagtctttcctacttcgatacttacaggtccagtcgattgcctgcaaatctgatccaagcacagagggacctgtttggggcgcacacctatgagcgaattgaccgtccgggttcattccacactgaatggaccaagctggcaaggaggagcaatggtgcagccatttgaagacttggttggtatcagcagtgctgtcagttactctgggtgatatctctttgtgggttctctttcatttcaatattgttgtctttatggtcctagatctgagttgtgtacttcgaataatgatgtattgtgctgtttgcacgtggagaacattgtgtagcttcagttttactttggtctaggtacacccagtttgatacgcttaattttggtatggaataactaatgtttggtatggaaaaaaaaaaaaaaaaaaaa

SEQ ID NO: 6362 - protein, 504 aa, Panicum virgatum
  misc_feature: Ceres CLONE 1863992
  misc_feature (1)..(299): Pfam Name: 6PGD Pfam Description: 6-phosphogluconate dehydrogenase, C-terminal domain
  misc_feature (1)..(175): Pfam Name: NAD_binding_2 Pfam Description: NAD binding domain of 6- phosphogluconate dehydrogenase
  misc_feature (20)..(492): SWISSPROT Homolog: EC 1.1.1.44 6-phosphogluconate dehydrogenase, decarboxylating
  misc_feature (20)..(494): SWISSPROT Homolog: EC 1.1.1.44 6-phosphogluconate dehydrogenase, decarboxylating 2
MASPAPATPAAAAAHSPPPRIGLAGLATMGQNLALNIAEKGFPISVYNRTAAKVDSTLLRARDEGALPVLGHRDPRGFVLSLSRPRTVVLLVQAGPAVDATIDALTPYLEPGDAIVDGGNEWYQNTERRIEEAAARGILYLGMGVSGGEEGARNGPSLMPGGHVDAYNNIRDILEKAAAQTEDGACVTFVGPGGAGNFVKMVHNGIEYGDMQLIAEAYDVLRRVGGLSNSEIADVFAEWNKGELESFLVEITADIFTVPDPLDGSGGALVDKILDKTGMKETGKWTVQQAAELAVAAPTIAASLDGRYLSGLKDERVAAAGVLEEEGMPAGLLEKINVDKKVLVDRVRQALYASKICSYAQGMNLIRAKSEEKGWNLNLAELARIWKGGCIIRARFLDRIKRAYDRNPELANLIVDREFAREMVQRQNAWRWVVARAVEAGISTPGMTASLSYFDTYRSSRLPANLIQAQRDLFGAHTYERIDRPGSFHTEWTKLARRSNGAAI

SEQ ID NO: 6363 - DNA, 1531 bp, Panicum virgatum
  misc_feature: Ceres CLONE 1864034
  misc_feature: Encodes the peptide sequence at SEQ ID NO. 6364
cctactcggccgccgccgccgccaccgccgccgctctccctccctccctggctccttcacactcccatcccatcaccaacccccagccgaactcgcaaatgctctctgccaccatcgccgcgcaccccgccgccgccataaccctgcggcaacggcactcgctccgccatcgccagccactccgcgttcccatcggcgccgcggcgccgaggcggcggatggcaacggcgaggcccttagtggtcaaggccgtcgctagccagggcgtccccgcggtgcccccgaagctctccttcccgatactggtgaatagttgtactggaaaaatggggaaggctgtggcagaagcagctgtatcagccggtcttcagttagttcctgtatcattcagtgccatggaggtccctggtggaaggcttgaaatctgcgacagagaaattcaaattcatgacccttctgaaagtgaaaaagttctcccttccattattgaagagtacccagatctcatagttgtcgattacaccgtgcctgatgctgtcaatgccaatgctgaactctattgcaaattgggtttgccatttgtgatgggcacgacaggtggaaataggcaactgctgcacaaaacggtgcaggatgcaaatgtttatgctgtgatatccccacagatgggaaaacaggtcgttgcttttcttgctgccatggaaatcatggcagagcaattccctggtgcattttcaggttacaaactggaggtcatggagtctcatcaagcaacaaagttggacgtttctggaactgcaaaagctgttatctcttgctttcagaaattgggtgtctcatttgacatggatgaggtaaaactagtaagggatcctgaggagcaggttaaagtggttggtgtcccagaagagcatcttgcaggtcatgcgttccacatgtaccatctcacttcacctgatgggacagtttcgtttgagtatcagcacaatgtatgtggccgttcaatatacgcagaaggaactgttgatgctgctatgtttctttacacaaagataaaatctggagccagcaagaaactgtatgacatgattgatgtcttgagagagggcaacatgagatgagacgagacctgtgcgggcgatagatgtatgcttatgtggccccaattcacaagctgaaattccaccatgaatttggtcgcctttccgatccacccaccctgcatggtaatgctcagaagtatcaatttttgtgttaggcacttttcagtttcggattagcatcttcctttagaggacaaaacgtagtggttaggtgcttgaataaatggatgtttttgcttgaatggtgtccctggtgcttagatatcaggcatggctgcttgtgcttttcctggtgtcctctgcataggagactagcgattatgacacttgcaaagttgcaatgtttctccttgtcgctgtgctgaggtctcgtgggttcagtgcatacttgatgggtattggggatcgaaaaaaaaaaaaaaaaaaaa

SEQ ID NO: 6364 - protein, 340 aa, Panicum virgatum
  misc_feature: Ceres CLONE 1864034
  misc_feature (1)..(143): Pfam Name: DapB_C Pfam Description: Dihydrodipicolinate reductase, C-terminus
MLSATIAAHPAAAITLRQRHSLRHRQPLRVPIGAAAPRRRMATARPLVVKAVASQGVPAVPPKLSFPILVNSCTGKMGKAVAEAAVSAGLQLVPVSFSAMEVPGGRLEICDREIQIHDPSESEKVLPSIIEEYPDLIVVDYTVPDAVNANAELYCKLGLPFVMGTTGGNRQLLHKTVQDANVYAVISPQMGKQVVAFLAAMEIMAEQFPGAFSGYKLEVMESHQATKLDVSGTAKAVISCFQKLGVSFDMDEVKLVRDPEEQVKVVGVPEEHLAGHAFHMYHLTSPDGTVSFEYQHNVCGRSIYAEGTVDAAMFLYTKIKSGASKKLYDMIDVLREGNMR

SEQ ID NO: 6365 - DNA, 2475 bp, Panicum virgatum
  misc_feature: Ceres CLONE 1864059
  misc_feature: Encodes the peptide sequence at SEQ ID NO. 6366
aaaggttcctcgcatcaggggcggcggcgccgtccggacttcgtgtggggggtatcgccgcttcatagccgcagctaagcacgtaagcgacgtttgcttgccctcctctctcagtcttccctaggagcgtggatcacagatcttgatgcagagttgttgtcgtatgctcttcagttggattcaaggcttttcttgtcatttgtagttctctgaacggaatcattgtgttattgggaacgagaaggagtatggagtggtgcgattgatgaacctgtaagggattgcaacatagaaagtcagaaccataagtcttgtcattacaagctcgaatggcaatgcatcctggttctcgtaatgagcttgactttggtgatatgttctctaactccaatccacccaccggtcgcatgattaatttctccctccagcaacaatcacaagttcaatttttcccttcatatggactccatagccataatcctcctgccaaaccacatccatctgcatctccatccctggtcatgcctggtggcatcacgccaagtccagcatcaaccaccacaaccgagctggacaactccgaggacttatctgaaaccatcacagatgatgcggtccttgcatacatcaatcagttccttcttgaagacgaggattatgagtcttttcctgttaccagtgcacctgtggaggattcggccctcctcgccgttgagaagcccttcattgacatccttaagtctgctaagcctgcacaggcatatgaagggaaatcttggatgactggtcattgtgaaattccaggaatgggaggtttggatgatgtggtcagacgtactcagaaatcttgccaatcaccttgtgaaatggtgaaggagggttcagtttgtgctgctcataaaggtcggaagaacccgcatgatgatggattggagatggaggagcggaagagcaaacaatccgcactgtgtgaggaggagacggtccgagagatgtttgacgaagtacttttgtgtactgatgagaattgtgagttccggtcaccactgccagttgacgcacaaattagcagtggatatgtgaaaggatcaggaaatagaagaggacgaaggaagggaagatctggtgctggcccggaggaagaggcagttgatctcacgaccctacttatacattgtgctcaggctgcagctattgatgatcaccggaattcaaatgagttgctgaaacagattaggaagcattcttctgctactggaggtgcaggccagaggctggctcactactttgctaatgggcttgaggctcgtctggctggctctggtagcaccatctaccatcaaattgctgcaacgagaacttgtactggtgatatactgaaagcattcggtttgtatgctaaagcatgcccatttatgacaatatctcactatttcgcaaattcgaacatcttgaatgtttctaagagtgcgtcaaggttgcacattattgattacgggatacggtatggtttccagtatcccgtactcatgcaacggttctcaaagagatgtggtggacccccaagccttcgaatcactggtgttgactttccccagccaggattccgccctgcagagcgtatagaggcaacagggcgacgactacatgagtatgcccgtatgttcaatgtcccctttgaatatcacgccattgttggcaagtgggataccttccaggttgaagatctcaacataaatagcgatgagcttcttgttgtcaattgcctttaccgaatgaggaacataatggatgagacggtgacagatgacagcccgaggacaagggttttgaacacaatcagaaagttaaatccccatttgtttgttcatggggttatcaatggtacttacaatgcacccttcttcgtgacacgattcaaggaggctatgttttttttctcttcacattttgatatgcttgaagcaaatgcctcacggatggatgaacataggctgcttattgaaagagaatacgttggacgggaagctctgaatgtgattgcctgtgagggtatggagaggatcgaaaggccggagacgtacaagcaatggcacatgaggaacctcagagcaggtttcaggcccctacctcttaacaaggaggtaatgaagagagcaagatacaaggtgagcaagagctatcacagggacttcctcgttgacgaagataacaagtggatgctacagggttggaagggccgtgtcatctttgctctttctgcatggactagttagacatgttaatactgctaggctcagctatgacatctttcatgaatttatcatttatttatcaattcattttgttgtatgatcttaatgtttatgaattagccctttgtgcgtgtgacaaaattttgaagttcaaatcgtctgcaatataatatgcttcctgcttgcaggagttcccaaacaaaaaaaaaaaaaaaaaaaa

SEQ ID NO: 6366 - protein, 648 aa, Panicum virgatum
  misc_feature: Ceres CLONE 1864059
  misc_feature (1)..(309): Pfam Name: GRAS Pfam Description: GRAS family transcription factor
  misc_feature: The sequence is a functional homolog of  SEQ ID NO 1324 in the  10/374,780 US patent application
  misc_feature: The sequence is a functional homolog of  SEQ ID NO 1471 in the  10/412,699 US patent application
  misc_feature: Useful for making plants with modulated growth and phenotype characteristics
MAMHPGSRNELDFGDMFSNSNPPTGRMINFSLQQQSQVQFFPSYGLHSHNPPAKPHPSASPSLVMPGGITPSPASTTTTELDNSEDLSETITDDAVLAYINQFLLEDEDYESFPVTSAPVEDSALLAVEKPFIDILKSAKPAQAYEGKSWMTGHCEIPGMGGLDDVVRRTQKSCQSPCEMVKEGSVCAAHKGRKNPHDDGLEMEERKSKQSALCEEETVREMFDEVLLCTDENCEFRSPLPVDAQISSGYVKGSGNRRGRRKGRSGAGPEEEAVDLTTLLIHCAQAAAIDDHRNSNELLKQIRKHSSATGGAGQRLAHYFANGLEARLAGSGSTIYHQIAATRTCTGDILKAFGLYAKACPFMTISHYFANSNILNVSKSASRLHIIDYGIRYGFQYPVLMQRFSKRCGGPPSLRITGVDFPQPGFRPAERIEATGRRLHEYARMFNVPFEYHAIVGKWDTFQVEDLNINSDELLVVNCLYRMRNIMDETVTDDSPRTRVLNTIRKLNPHLFVHGVINGTYNAPFFVTRFKEAMFFFSSHFDMLEANASRMDEHRLLIEREYVGREALNVIACEGMERIERPETYKQWHMRNLRAGFRPLPLNKEVMKRARYKVSKSYHRDFLVDEDNKWMLQGWKGRVIFALSAWTS

SEQ ID NO: 6367 - DNA, 1926 bp, Panicum virgatum
  misc_feature: Ceres CLONE 1864178
  misc_feature: Encodes the peptide sequence at SEQ ID NO. 6368
acttccgagcaatttcctcgtcatttctgtaatccccacctcggctctcatctttctctcactcggagaagagggagggggaaaaagcgcaagcgagatgggcgccgggagcagccgcgccgatacgccgtcgcgccgccgggcgcgcctcggcctcggcgggtgcttcggagcgggatcctccgccgccgcagccgctcgtgacggcgggagcttcgccgcggacgcgccctcgtcctcgcgcgctaacgaggtacaatctcagcaatcagggcgatcagtgaatggagtgaattttcatgcttctctagctgcaaaggatctccaggtctccagtgagtcaaatccaagactgcattcgtcttcaagcaccataagccatcatctcagattcaatcacctcaattgtcatgaaaacaaggaagatagcctggggactgaaaatgctgaaacaagtggccttgaaagctcatccagaaaagctgtcatggttacgggaagtttcagtagtgaagctgttaatgttgacatagcatcgagagaaggaataggttctataggatcagagctcggaaatgttgctaatacagtccccactgatgaaattggtggttcaatttctgaatctgatatgcacccctcgttgatgacatctgaaaggatcctgtctgacttagaaggagagatcgctcctcaagcaacttcatccacaactgttctgacaagtgaaggatctgatatatctcaatctagcttgacacctatgtcccctaactcctcaactgcatcatccgggatacgagaaccaacaccagattcaatccctaccagagcagatgttcccatattcagtggaccacatggtcagactggtgggagtatattacatgatgatatgatgagcattttctcaaatgatggtctaggacgctctagagattcaagcagcagtgaaacaaggaggagtcacagaagggttctatgggatacattttccaggcgcggctctagaggttatcctgaatctgatgctgttgacctgggattttacagcacatggctagaccttggcgatgacctttttggagagttggaggagtcaagatattttcatcgcagacgccatggttcaataagagtaagccagtattcaagatcccggattagggagcatcgtcacgctgtttttgatagtggcaatgaacaaagcactgcagcttgtcctttggggattcatcaagctggccgatgcacctgtgattctttcttgattgctgaagaatctagtgcccgagcaagtatatcaagaattgtcatgttaactgaggcgttatttgaggtgttggatgaaattcaccgtcaacctgcgtcactttcactttctatggtctctgttcaggctcctgaatctgtagttaattcattgccatgtaagagctacaaaaagcttgcgacaccccaatgcagtgatgacatggaacagtgccatatctgcttaactgaatatgaggatggggaacagataagaactcttccgtgcaaacacgagtttcacctgcagtgtgttgacaaatggctgaaggaaatacacagggtgtgcccgttgtgccgtggggatgtctgtgaagttgcctcctgaagtccttggcgccgccgtgcctccagccgccaccactgctccatggtggaaggctggagccggttcagtcatgccacggtgatccctgtcgcctttgacagttgacgccgcaagagtctcgctgccgaagagaatggccagatcctgcgtctaatgcagcatttcctgtcaaagttttaagataccaccccaagacttgtatatagcttttgtagcctccccgtgtacgacagcctgtatatatgtgtaaattctagattcaatttcaaaaaaaaaaaaaaaaaaaa

SEQ ID NO: 6368 - protein, 513 aa, Panicum virgatum
  misc_feature: Ceres CLONE 1864178
  misc_feature (1)..(42): Pfam Name: zf-C3HC4 Pfam Description: Zinc finger, C3HC4 type (RING finger)
MGAGSSRADTPSRRRARLGLGGCFGAGSSAAAAARDGGSFAADAPSSSRANEVQSQQSGRSVNGVNFHASLAAKDLQVSSESNPRLHSSSSTISHHLRFNHLNCHENKEDSLGTENAETSGLESSSRKAVMVTGSFSSEAVNVDIASREGIGSIGSELGNVANTVPTDEIGGSISESDMHPSLMTSERILSDLEGEIAPQATSSTTVLTSEGSDISQSSLTPMSPNSSTASSGIREPTPDSIPTRADVPIFSGPHGQTGGSILHDDMMSIFSNDGLGRSRDSSSSETRRSHRRVLWDTFSRRGSRGYPESDAVDLGFYSTWLDLGDDLFGELEESRYFHRRRHGSIRVSQYSRSRIREHRHAVFDSGNEQSTAACPLGIHQAGRCTCDSFLIAEESSARASISRIVMLTEALFEVLDEIHRQPASLSLSMVSVQAPESVVNSLPCKSYKKLATPQCSDDMEQCHICLTEYEDGEQIRTLPCKHEFHLQCVDKWLKEIHRVCPLCRGDVCEVAS

SEQ ID NO: 6369 - DNA, 1866 bp, Panicum virgatum
  misc_feature: Ceres CLONE 1864199
  misc_feature: Encodes the peptide sequence at SEQ ID NO. 6370
acgcgtagtctctcttgctgatccgatccccataagtccagccaaagctgtgtggtcatggacaagaagcgggtggccatcgtcggcgccggcgtgagcggcctggccgcgtgcaagcacctcctggagcgcggctgccgccccgtggtgttcgaggccgacaccgtcctcggcggcgtgtgggcgcgcgtgccggactgcacggcgcttcagacgccgcggccgctgtaccagtactcggacttcccgtggccggaggccgtcacggaggtgttcccggaccaccgccaggtgatggcctacctggacgcgtacgcgcgccgcttcggcgtgctcggccgcgtccggttcggccgccgggtggtcgggatggagtaccgcggcgtcggcgaggaggacgtggcggcgtgggaggagtgggccgggaacggcgaggctttcggctccggcgacggagagtggcacctcacggtggccgacgacgaggggcacgttgagatacacaaggcagactttgtcattctctgcattgggaggttcagtggtgtgcccaacatacccacattcccgcaaggcaaaggtccagaaacatttgatggccaggtgatccactccatggactactccaagatgggcaccaagaaagcaacagagatggtcaagggcaagcgtgtcaccatcataggctatctgaaatctgcaattgacatcgctgctgaatgcgctgtagcaaatggcactgatcatccatgtactatggtggtccgaacaaagcattggatcataccagactactttgcatggggaatccatatatcattgctatacctaaatcgatttgcggaactcctcattcacaagcctggagaaggatttctcctttggatcatagcgacactattggctccattgaggtggctattttctaagtttgctgagagctactacgccatcccaatgaagaaatatgacatggtgcctgatcatagcctgtttgaggcattagctacatgtttggtggccatagaaccgaaggggttttataagaggctggaagaaggcagcatagttgtcaagaaatcaaagtcgttcagcttttgcaaggaaggtgttcttgtggaaggtgaatcctcaccgataaagagtgatattgtgatctttggaaccgggttcaggggagatcagaagatcaaggacatgtttacatcagaatacttcagaagtatcgcggttgggtccacatccacaactgtacctctatacagggagtgcatacaccccaagataccacagcttgcagttctaggttactcagagagcattgcaaatctatacacctcagaacttcgggccaagtggctggcgcatttcttggatggtggcatcagattaccaagtgtgacagcaatgcagaacgatgtccttgaatgggagaagtacatgaaaaggtatgctggtaggtactttcgcaggtcctgcgttggactccttcacatctggtacaatgatcagctgtgccgggatatggggtgcaaccctagaagaaagaaagggtttttcacggacttatttggaatttacggtcctggggattacgctgaacttcaccccaaaaaagactagaccttgggcttcaactcttgcggcagttatcttgaacatcttttctgatttgagtattactattataatggctgaataaagtaggttgtcacctgtaggctatggcacaataatcaggatgtaaaaaataggacatgtacgatccatatgagcttctctatagctcagaagttactaccattaacttcgtttttagggtttgagtgtaacaattatatactctgcactttggttgagaattct

SEQ ID NO: 6370 - protein, 521 aa, Panicum virgatum
  misc_feature: Ceres CLONE 1864199
  misc_feature (1)..(502): Pfam Name: FMO-like Pfam Description: Flavin-binding monooxygenase-like
  misc_feature (1)..(36): Pfam Name: DAO Pfam Description: FAD dependent oxidoreductase
MDKKRVAIVGAGVSGLAACKHLLERGCRPVVFEADTVLGGVWARVPDCTALQTPRPLYQYSDFPWPEAVTEVFPDHRQVMAYLDAYARRFGVLGRVRFGRRVVGMEYRGVGEEDVAAWEEWAGNGEAFGSGDGEWHLTVADDEGHVEIHKADFVILCIGRFSGVPNIPTFPQGKGPETFDGQVIHSMDYSKMGTKKATEMVKGKRVTIIGYLKSAIDIAAECAVANGTDHPCTMVVRTKHWIIPDYFAWGIHISLLYLNRFAELLIHKPGEGFLLWIIATLLAPLRWLFSKFAESYYAIPMKKYDMVPDHSLFEALATCLVAIEPKGFYKRLEEGSIVVKKSKSFSFCKEGVLVEGESSPIKSDIVIFGTGFRGDQKIKDMFTSEYFRSIAVGSTSTTVPLYRECIHPKIPQLAVLGYSESIANLYTSELRAKWLAHFLDGGIRLPSVTAMQNDVLEWEKYMKRYAGRYFRRSCVGLLHIWYNDQLCRDMGCNPRRKKGFFTDLFGIYGPGDYAELHPKKD

SEQ ID NO: 6371 - DNA, 2057 bp, Panicum virgatum
  misc_feature: Ceres CLONE 1864214
  misc_feature: Encodes the peptide sequence at SEQ ID NO. 6372
ggtccaaactccaaaccaaatccagcggaagcacctatcctccccgtcgcgcaccctatcctcccctccagagtccccaccaccctctccctctaccgctcccgcttccgaccaccgcaccggcgggctgctcggcgccacacgccaggctggggatggccgccgcgctcgcgagctcgccgctcgttcacctaaccgcctcccgcctccgcctccccaggctccgggcctccgtctccagctccgccccaggctgctcgagaggcgtgtgcctgggatggaggctggcggcggggtggagggccgggaggcggtgcgaacggctccggtgcttctcctccgacgggggcggcggggaggagggggagaagcggggcgaagaagaggcctcggcatccgcggccccaggggaggagctggggtccgagcggagccggtcggggagcttctcttcgtcgtcctcatcggccgggactcctggtgtatcaagcgagccaccactgttgagttttagtgttgataatatcgatacagttaaactgttggaacttctaggcccggaaaaggttgatccagctgatgtcaaggcaattaaggaaaagctgtttggctacacaacattctggttgaccaaagaagaaccttttggtgatcttggtgaaggagttcttttcattgggaatctccgtgggaaaagagaggaaatctttgcaaaacttcaacgacaactacgtgaacttactggtgacaaatacaatctttttatggtggaggaacccaattcagaaggggatgacccacgtgggggaccgcgtgttagttttggtttgcttaggaaggaagtttctgagcctggaccgactaccctatggcaatacgtcatttcattattactcttccttctcactatgttctcctgtgttgagctcggaatcgcatcaaagattagcagtcttccaccagaaattgtttcatattttactgatccaaatgctaccgggccccctcctgatatgcaacttttactcccatttgtggaatcagctttgccggtggctcatggcgtcttggctatccaaatattccatgaaattggacactttttagcagcatttccaaaaaatgtgaaactgggcattcctttcttcattccaaacttcacgcttggaacttttggtgcaattactcagttcaaatccattctgccagataagaagacaatgtttgacatatcaatggctggtcctgtggctggagctgcactttccttttcaatgttctttgtaggcttgctactttcttcaaatcctgttggggcaaatgatttagttgaagtacctagccacttattccagggttccttgttgcttgggcttattagcagagccacacttggatacagagctatgcacgctgccacggtttcgatccatcctcttgtgatcgcaggctggtgtggtttaactactactgccttcaatatgcttcctgttggatgtcttgatggtggaagagcattacagggggctttcggcaaggaggctttgtttggatttggcctcacaacatactcattacttggactaggagtgcttggaggaccattatctcttccttggggcctgtacgtgctaatatgtcagagaacacctgagaaaccatgcttgaacgacgtaagcgatgtcggaacatggaggagggcagccttgatagcttcggtgtttcttgttgtattgactctcattccattgtgggatgaacttgcggaggaactaggtgtagggcttgttacatcgttctgagatacagggtgctcactgatagaattaggccatgatgatgtagctcaattttgtatcaaaatgtagcgtctagaagtgttgcaaaggcatatgacattcccggccgtgaatgtgacgcgtctcgtgcaagttggttttgcacgaactgtaaatcataaatctgaaacatcctgtggatatgctacaactacaatatgcgattttgaatacaatgtgaacaaattttgtgacagtcaaaaaaaaaaaaaaaaaaaa

SEQ ID NO: 6372 - protein, 548 aa, Panicum virgatum
  misc_feature: Ceres CLONE 1864214
  misc_feature (1)..(183): Pfam Name: Peptidase_M50 Pfam Description: Peptidase family M50
MAAALASSPLVHLTASRLRLPRLRASVSSSAPGCSRGVCLGWRLAAGWRAGRRCERLRCFSSDGGGGEEGEKRGEEEASASAAPGEELGSERSRSGSFSSSSSSAGTPGVSSEPPLLSFSVDNIDTVKLLELLGPEKVDPADVKAIKEKLFGYTTFWLTKEEPFGDLGEGVLFIGNLRGKREEIFAKLQRQLRELTGDKYNLFMVEEPNSEGDDPRGGPRVSFGLLRKEVSEPGPTTLWQYVISLLLFLLTMFSCVELGIASKISSLPPEIVSYFTDPNATGPPPDMQLLLPFVESALPVAHGVLAIQIFHEIGHFLAAFPKNVKLGIPFFIPNFTLGTFGAITQFKSILPDKKTMFDISMAGPVAGAALSFSMFFVGLLLSSNPVGANDLVEVPSHLFQGSLLLGLISRATLGYRAMHAATVSIHPLVIAGWCGLTTTAFNMLPVGCLDGGRALQGAFGKEALFGFGLTTYSLLGLGVLGGPLSLPWGLYVLICQRTPEKPCLNDVSDVGTWRRAALIASVFLVVLTLIPLWDELAEELGVGLVTSF

SEQ ID NO: 6373 - DNA, 1635 bp, Panicum virgatum
  misc_feature: Ceres CLONE 1864268
  misc_feature: Encodes the peptide sequence at SEQ ID NO. 6374
atctctctgctctggttaagctactatataccgttctcctccttctggcttgggcttccatgaccgagccgcgcgagcccgtgacctctttttcctcaagcctcgctcgccgactcctggccgcaatctctgtatcttggcatgcattctgcgttcctgctcgtgctcgacctcaatcctatccaacgcagcactgcagcgatcccagttcccatcgccgaatccgcgtcccactcatcctcaacctcaaccactccgaattcaattcggagcctttctcgattcgctacccttatttgatcatcccatgaccacgagactcctgtgattccccccacgcagacctcgctggacaattgccagagcccccttgctcagccccatccaggccagccatgaagtttaccaagaagtacgcgacgtacatgagggggatggaggcggagctcccggccgtggggctcaagcgcctcaagaagatgctcaagaaatgccgctccgactccgaccaccgctcgcacctgcaggatgccgctgcctcacccgccgccgcccggtgccccgggcattgttctgcatgtgatgggagtttctttccatctcttctgaatgagatgtcggtcgttgttggctgcttcaacgaaaaagccaagaagctgctggaactgcacttggcgacaggcttcaagaaatacaccatgtggttcaccaacaagggtgacaatagccatgggagattaatgcagcaaggcaaagacttggttacgtatgcaattataaatgccgtggccatgaggaagatcttaaagaagtatgacaagatacattactcaaagcaaggacaagaattcaaagcccaagctcagattttgcacattgagatacttcaatccccatggctctgtgagctgatggcattctacatgaacttgagaaggagcaagaagaataaggctgcaatggagctctttggcgactgttccctcatattcgatgacgagagaccaacgctctcatgcaacctctttgactctatgcgtgtcgacattagcttgacatgttccatttgcttggacacagtgtttgatccagtctctctttcctgtggtcacatattttgctacttgtgctgctgttctactgcatctgtgaccattgttgatgggctgaagtccgcatatcacaaatcaaaatgtcccctgtgtcgacagcaaggggtctttcctgatgctgtgcacctcgaggaactcaacatgctactgagccacagttgtccagagtattgggagaagagaatgcaatcagagcgagttgagcgggttcgcctagctaaggagcattgggagtcacagtgcagagcattcttgggcatctagatagtgagcttctaccagtggaaactggaaatttgattcgatttgttaagattgtttgttggtagatcctgctctatcacaactcttttgataataaagttggatctaccgtctgttgatagaatttacatgtaagaggttagcttggctgcagaaatagaacaactgtagtggctattcaagtgcaattgcatatgtgtttatatgtaacacccttgattcacctttgtgattttatcctaaagtctgaagtagttcc

SEQ ID NO: 6374 - protein, 326 aa, Panicum virgatum
  misc_feature: Ceres CLONE 1864268
  misc_feature (1)..(49): Pfam Name: zf-C3HC4 Pfam Description: Zinc finger, C3HC4 type (RING finger)
MKFTKKYATYMRGMEAELPAVGLKRLKKMLKKCRSDSDHRSHLQDAAASPAAARCPGHCSACDGSFFPSLLNEMSVVVGCFNEKAKKLLELHLATGFKKYTMWFTNKGDNSHGRLMQQGKDLVTYAIINAVAMRKILKKYDKIHYSKQGQEFKAQAQILHIEILQSPWLCELMAFYMNLRRSKKNKAAMELFGDCSLIFDDERPTLSCNLFDSMRVDISLTCSICLDTVFDPVSLSCGHIFCYLCCCSTASVTIVDGLKSAYHKSKCPLCRQQGVFPDAVHLEELNMLLSHSCPEYWEKRMQSERVERVRLAKEHWESQCRAFLGI

SEQ ID NO: 6375 - DNA, 2736 bp, Panicum virgatum
  misc_feature: Ceres CLONE 1864313
  misc_feature: Encodes the peptide sequence at SEQ ID NO. 6376
atgccgccgcggccggcgaccacgagccaagaacacgcgcggcgtccctgagccatcaggccagcaaaaacgattcctttctctctctctctctctctctctctctctctcagatcccagctccccaagcgtgcgcgcgaattctctctgtcctctcgcctcgcccagcgccgtgctcttgtgctaaagatccatggaggggtgccagttgctagtaggttgtaggatggagatggaggaggagacgttctttgactcgcgagaggagctcacggcgtcgccggctcccagcccgggaccggcattgccgtggtcgggcagcctcgacagcgtggggcagaggagggagcggttcttgagaagcatgggcctggagtgcagcccgagcccgcggcaagccgatgctgtggccaccgtgggcgatgttgagaagaaggaggtggtgctgcaggaatttgggagattatggtctcagtcggatgagaacgactgctccatgtcgagttggtccacggaggatacggggagctatgaggacggtgcctctgatgacaattccattagtggatccagcagggatgatgctagcagcaaggtgggcaggagtttcagttcattgtccttcatccagaggctcatgagccgcagtggtaagctttctggtgttcccaaggcgattgagaggaggagaaatggatggcttcggaggctgggcttgaggtccggtgtcctcgatcatggaggcgatgaagctagcaccagctcctcagagagtgaacaaaacaggggtggaaggtatgaaagggtcaaggttcggtgctaccggaagcggtcaaaggaattgtcagcagtttatcaaggccaagtgatcaaggcccatgatggtgccatcctgactatgaaatttagtcctgatgggcagtttcttgcaagtggtggtgaagatggagttgtcagggtgtggggtgtcacacaatctgaggactgcaaaattcccatggatgatccttcctgtgtttacctcaaagctcatcgcatgagtggattggctcctgccgatgctgacaatgagaagaaatgcaaagtcaagggtttgaagcaatccgctgattctgcttgcattgtgattccaaccatggtgttccagatctcagaggaaccattgcaagagttccatggtcactctggtgatgtactggatctgtcgtggtctaacaataagcatctattgtcagcatcaacagacaaaactgttcgcttgtgggaacttggatctgcaaattgcgtcactgtttttccacacagcaacttcgtgacttgtgtccagttcaatccagataatgagaatcgattcatcagtggatcgatagatggcaaaatccgtgtatgggatattcctagatgcagtgttgtggattgggtggatattagggacattgtaacagcgatttgttaccgacctgatggaaagggagcagtggttggaaccattactggaaattgtcggttttatgatgcatcagataatctgctgcggtttgaaacacaaattgtgctcaacggcaagaagaaatcttctcttaaaagaatcactgcttttgagttctgcccaagcaacccaagtaaattaatggttacatctgccgactcgaaggttaaaattcttgatggaaccattgtgactcagaattatagtggacttcgaagcggatcctgccagttatttgcaacattcactccagatgggcagcatatagtttctgctagtgaagactcaaatatttatgtctggaaccatgaagaccaagaagaggcttcattgaaacatgcaaaaaccatatggtcatcagagcgcttccactccaacaatgcagccattgcaataccatggaatggccaaaaaacaagaaacccagtttctttcgcctctcaaattttgccaccacaaagtgacagtttctggtgcatgagcaaggctgtcaagtgcagttcaagccgcagtgaagattctgccatcaacaattttgtgtcaagatttgctcctggtattttcaatttgaatcaggagttctccactgagcccacttgcagaagctcagctacctggcctgaggaaattctgccttctcactcaattcgtgcaattttggatgaatcacaatacaagttcctaaggaactgtttccagagcacatcaaactcttggggtcaagtgatagttactgcaggatgggacggcaagattaggtcattccagaattatggcctaccagcgcatcaatgatcagcttgagcatttggtgaaagtatactgcagttttggcacctcacatggcctgaagagaagtacccgctccccagctatgctggtccagcgtgtggtttcttggtacaagacatcacatgctcagtgctcctgctgaattgtacatggaccagtgttgtacataatcaacctggtagtccttggagatctccgcatcagcagctgttcatggcatgaacagtagattgtacctattgtagaaaatttttagcgtagatcagatttgtaccccccccccccccaaatcaattgctcattgatataccacagaaatgttagttccagccagttgagtgtaaatccccctcccattatattgcgggagctcaaccggcagcaactgtcagatacatatgttcaatccaatatacaaaattcattcgttttttgaaaaaaaaaaaaaaaaaaaa

SEQ ID NO: 6376 - protein, 696 aa, Panicum virgatum
  misc_feature: Ceres CLONE 1864313
  misc_feature: Great-hit functional homolog of the protein sequence encoded by LOCUS At5g53500
  misc_feature: Useful for making plants with altered cell wall content and/or composition
MEGCQLLVGCRMEMEEETFFDSREELTASPAPSPGPALPWSGSLDSVGQRRERFLRSMGLECSPSPRQADAVATVGDVEKKEVVLQEFGRLWSQSDENDCSMSSWSTEDTGSYEDGASDDNSISGSSRDDASSKVGRSFSSLSFIQRLMSRSGKLSGVPKAIERRRNGWLRRLGLRSGVLDHGGDEASTSSSESEQNRGGRYERVKVRCYRKRSKELSAVYQGQVIKAHDGAILTMKFSPDGQFLASGGEDGVVRVWGVTQSEDCKIPMDDPSCVYLKAHRMSGLAPADADNEKKCKVKGLKQSADSACIVIPTMVFQISEEPLQEFHGHSGDVLDLSWSNNKHLLSASTDKTVRLWELGSANCVTVFPHSNFVTCVQFNPDNENRFISGSIDGKIRVWDIPRCSVVDWVDIRDIVTAICYRPDGKGAVVGTITGNCRFYDASDNLLRFETQIVLNGKKKSSLKRITAFEFCPSNPSKLMVTSADSKVKILDGTIVTQNYSGLRSGSCQLFATFTPDGQHIVSASEDSNIYVWNHEDQEEASLKHAKTIWSSERFHSNNAAIAIPWNGQKTRNPVSFASQILPPQSDSFWCMSKAVKCSSSRSEDSAINNFVSRFAPGIFNLNQEFSTEPTCRSSATWPEEILPSHSIRAILDESQYKFLRNCFQSTSNSWGQVIVTAGWDGKIRSFQNYGLPAHQ

SEQ ID NO: 6377 - DNA, 1921 bp, Panicum virgatum
  misc_feature: Ceres CLONE 1864364
  misc_feature: Encodes the peptide sequence at SEQ ID NO. 6378
ggtgaggcttttgctaggttttggcacaaccgccgcacaaacgctcgcgtctcctcccctcccggcggctgccgtttccgctcgactcgccggagcggaccacccgtcgaagcctagatggcgaagggcgacgacgcgctggcgcggaagcgcaaccgggtgcgccgcaagcgcctgcgcagcagcgagaacgccgtctccgcgcgggtcgcggcaatcatcgcctccaagcgccgccgcaagtccggcaagcgccgcggctgcgagggcatgtgcttctcgctccccacgcccgaagaccccttcaacgagcgccacgggaagaagcgcaaggacgaggagccgaccgacgacacacctgacgccgccgtcgtggccaaagatgacggccccaagaagaaggacgcgaacactaaaaagcagccgccggcgaaggccaagtcgaaggccatgcgcgagcgagcgacggaaccggaagagggccgtgtggacttcgaccggccgtccaagttcctggtagtctgccttaacgccatccgggatactgtagcgcccgaggacggcggcggcagcatccatggcgccggcgactggggcgtggagctctggaggtgcttctccgcgccggcgccgtcagacattctcgatactagcggctcgtgcgccacggtggagcagacagcgtggctcgtctccaccgcctgcgacatcgtcgtcgggaaggagaggcttgggatggtcgtctcctgccccttcctgctgtacctcgtcccgtcccaggaaaaggccgcgcgagtgcgatcgatatgcaaacccctgaagcctcttgggattcattcagtgagcttgcatcctggtgcttccattgaacaccagatctctggactaaaaacttgtgagccggagtttcttatagctacccctgagaggcttcttgaacttgtgtctttaaaggcgattgacatatcaagtgtatcaatgatggtcattgatggattgaaatatttcctggacctcggtgtcagtgacaaaatattttctattagagacgccatatcaagcaattttcagatcacagtcttcactgacccatctgacaaaagcgttgcaactatggctaaaaatctactccgcggaagaattacaaaactctttatcaacaattctgtttcttcacgaagtgcttttgtaacgcagcaagtacacttctgtccatcggtggagctgaaaacatcgaaggtcaaggaaatccttgagcagattttgcagagacacgctaaaaagtcatcaaaggttctgctagtagctgcaagcaagaaaaatgcacagcacctatcatcatcacttaaactggaaaattgcacagtgactgatgactcacatggcaactcttttaccatatgcagcagtgtgggactaatgaatgtacatgttaaagaccgggagaacatggcgatgacagatgtagaggaatttgagactgtgttgttggttgatttgcctccttcagtcgatgaatacattgagatcctcactggggttgctcctcagacgattggaggggaggtccatagtatcttctgtagcactgatgctccagctgcgaaacctttggctgagcttcttgcaaactgcaggcaggtggtgcctgaatttctcaaaaaaatggagtcttcatagcagactcgattaccctatcagagtagccagattatatcgtggtgatttgggttagttgctgccatttgtggcgcttcttttcaccaatcaattttgaaatttctggatgtagttctcatttgtaattgtaagcactacaatgatattcaggcctctgccttgatgtactacactactactagctcttgtgaaatgtgaatgccttgaagcccattttctggaaaaaaaaaaaaaaaaaaaa

SEQ ID NO: 6378 - protein, 520 aa, Panicum virgatum
  misc_feature: Ceres CLONE 1864364
  misc_feature (3)..(128): Pfam Name: DEAD Pfam Description: DEAD/DEAH box helicase
MAKGDDALARKRNRVRRKRLRSSENAVSARVAAIIASKRRRKSGKRRGCEGMCFSLPTPEDPFNERHGKKRKDEEPTDDTPDAAVVAKDDGPKKKDANTKKQPPAKAKSKAMRERATEPEEGRVDFDRPSKFLVVCLNAIRDTVAPEDGGGSIHGAGDWGVELWRCFSAPAPSDILDTSGSCATVEQTAWLVSTACDIVVGKERLGMVVSCPFLLYLVPSQEKAARVRSICKPLKPLGIHSVSLHPGASIEHQISGLKTCEPEFLIATPERLLELVSLKAIDISSVSMMVIDGLKYFLDLGVSDKIFSIRDAISSNFQITVFTDPSDKSVATMAKNLLRGRITKLFINNSVSSRSAFVTQQVHFCPSVELKTSKVKEILEQILQRHAKKSSKVLLVAASKKNAQHLSSSLKLENCTVTDDSHGNSFTICSSVGLMNVHVKDRENMAMTDVEEFETVLLVDLPPSVDEYIEILTGVAPQTIGGEVHSIFCSTDAPAAKPLAELLANCRQVVPEFLKKMESS

SEQ ID NO: 6379 - DNA, 1867 bp, Panicum virgatum
  misc_feature: Ceres CLONE 1864641
  misc_feature: Encodes the peptide sequence at SEQ ID NO. 6380
aaagtgggcatcacgcgctccattaggcggccagcttcctcctcattccttcccactatctgccgtctttgacgcctgcctccgccgccgcctcgccccaaatctgcgtgtttggccaaagcccacgggaagcgcttgtctttgctgagctgctcgcgggcggagctctggctacttgacttcgggtttgttcccccatctgaggccaagattcggagcgtcgccgagggaaggcgatgaaggggaagggcggcgcgatggacaggaggtcctccaccaggtggaggatgctggtgctctgcgcattcagcttcggcctcggcatgctcttcacagaccggttctggacagcaccagataccaacaaccatatcatgtctcaacgccggaggcaagatcaagagctgcaacttgtatcagaggattgcaatacaaagaggaagcatggggaagacaaggatataatggaagaggtaaccaagacccatgaagctatactatcattggataaatccatctcaacgctgcagatggagcttgcagcaaagaggagcacactggagctgctccgttctagtggttcgccagtaacctctgaaactagccaaccaagaaaaaaggcatttgttgtcattggtgtcaacaccgctttcagcagccgtaagcgccgtgattcagtccgggagacatggatgcctcaaggtgaaaagctgcaacaattagaggaacagaagggaatagttatccgcttcactattgggcacagtgctacatccaatagtatactggacaaggctatagactcagaggatgcccagcaccatgactttcttagactggaccatgttgagggatatcatgaactatcagctaagacaaaaattttcttctcaaccgctgtcggcatctgggatgctgacttctacgtcaaggtcgatgatgacgtgcatgtgaacttaggaatgcttgccactacccttgctcggcataaatcaaaaccaagaacatatattggctgcatgaagtcaggcccagttcttgctgacaagaatgtgaagtaccatgaacctgagtactggaaatttggggaggaaggaaataaatacttccgtcatgctacggggcagatatacgccatttcgaaagatcttgcgacttatatttcaatcaatcagcctatcttgcacaaatatgcaaatgaagacgtatcacttggatcatggttcattggtttggaagttaatcacattgatgaaaggaacatgtgctgcggaactccacctgattgtgagtggaaagggcaagctggcaatgtctgtgtagcgtctttcgattggagctgcagtggcatatgcaagtctgtcgagaagatcaaggatgtacatgctcgctgtggtgaaggagattccgcagtttggagcgcccttatctagcacataccctcctttgcccgtaaatatgtagcgtagttggtaagctctcatggtggacctgaatatgcaactgcccaagtgaactcaacaagaccaaggtccaaggatcatgccccgtcgaatataatctggaactgcatcaaacaggatgttgccaatggtgcctttggcttcacgattctacggcaacatgtgggttgtgggatgcttgttgaaatattttgttagatggcttgatgcctgtcaccattagcaactttggtgggattaagagtgtgagaccaatgtgggggttgcaattgatgttactaatcttgcaagaagtgggagagtttcagcttgtgcgtatggaggtagagttcatgtaatgtagagaacattgtttcaagcaaattttgacaaattctttttgctaaaaaaaaaaaaaaaaaaaa

SEQ ID NO: 6380 - protein, 398 aa, Panicum virgatum
  misc_feature: Ceres CLONE 1864641
  misc_feature (1)..(199): Pfam Name: Galactosyl_T Pfam Description: Galactosyltransferase
MKGKGGAMDRRSSTRWRMLVLCAFSFGLGMLFTDRFWTAPDTNNHIMSQRRRQDQELQLVSEDCNTKRKHGEDKDIMEEVTKTHEAILSLDKSISTLQMELAAKRSTLELLRSSGSPVTSETSQPRKKAFVVIGVNTAFSSRKRRDSVRETWMPQGEKLQQLEEQKGIVIRFTIGHSATSNSILDKAIDSEDAQHHDFLRLDHVEGYHELSAKTKIFFSTAVGIWDADFYVKVDDDVHVNLGMLATTLARHKSKPRTYIGCMKSGPVLADKNVKYHEPEYWKFGEEGNKYFRHATGQIYAISKDLATYISINQPILHKYANEDVSLGSWFIGLEVNHIDERNMCCGTPPDCEWKGQAGNVCVASFDWSCSGICKSVEKIKDVHARCGEGDSAVWSALI

SEQ ID NO: 6381 - DNA, 1733 bp, Panicum virgatum
  misc_feature: Ceres CLONE 1864732
  misc_feature: Encodes the peptide sequence at SEQ ID NO. 6382
atccagtccgaccaaatcctgcgcgtccgtactctgcttcccctccggccacggcggcgctgctctccggtaggcctcctccgccgcatctaccctgtgccgtattgctttgcttctcgagttgcctggatgtaagcgcgtactgggttaggatcgggttgcgccatgcccgtttcttccccacgatttgatgccttctctgtcgattcttagcaggtcggaagatgttggatcttccgctacaaatccaagcattgaggataaagattagtttccctttctgttaaatttctctcacagtttggcgagctgttaatttccccccaaatttaagcagctgctgttttgaaggtttcttctccgggaaaaaaatttcaaatcccgaaaccgaccgagattgcagtagccgcagatgctgctacccatcaagttcccgggcccataaattatactcgacttgtgatttcgtttgtcaatcctagctattgcattctgcgtgcatgtggtttctgacccgtgaattggaaccgcagaaatctctaggcgacgaatcgaatcgaatcgagcaggtaccaggtagaggaggaaccaggcggccatggctgagcacctggcgtcaatctttggcacggagaaggaccgcgtgaactgccccttctacttcaagatcggcgcgtgccggcacggcgaccggtgctcccgcctgcacaacaagccgtccatctcgccgacgctgctgctctgcaacatgtaccagcgcccggacatgatcaccccgggcgtggacgcgcagggcaaccccatcgacccggagcggatccaggaggacttcgaggacttctacgaggacatcttcgaggagctgagcaagcacggcgagatcgagagcctccacgtctgcgacaacctcgccgaccacatgatcgggaacgtgtacgtgcagttccgcgaggaggagcaggccgcccgcgcgctgcaggcgctgcagggccgctactactcgggccgccccatcatcgccgagttctcgccggtcacggacttccgggaggccacctgccgccagttcgaggagcacagctgcaaccgcggcggctactgcaacttcatgcacgtgaagcaggtcggccgggacctgcggcggaagctgttcggccacctgcaccggtcccgccggagccacagccggagcagccgcagcccgagcccgtaccgccaccgccggagctcgtcgcggtcgagggaccgcgacggcgactacgactactactaccactaccgtagtggcggtggcagccggaggagcagcgagaggcaccgcagccacgacaacgacgggagccgccgccggcgcgggcggtcgaggagccggagcccggtgagggaaggcagcgaggagcggagggcgcggatcgagcagtggaaccgcgagagggaggccgcgcaggtgtgagcagagcagctgctgtggctatgctcggctgcagttcgccgcagtgatgatgtccgcttggttagtttgcaaggtcgctgaaaatttcatcttgtactagtagttagtcaggatcatgtcgtaaattgaactcaaatttcgggggtttcaattgtgaccatagtgtacttgtggttgtcattgaacttgctctggatgtatcgatggaacctaatttccagtttcagtatgagcttgtgctgatgatcggtgctctgtagaaaaaaaaaaaaaaaaaaaa

SEQ ID NO: 6382 - protein, 284 aa, Panicum virgatum
  misc_feature: Ceres CLONE 1864732
  misc_feature (1)..(27): Pfam Name: zf-CCCH Pfam Description: Zinc finger C-x8-C-x5-C-x3-H type (and similar)
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAARALQALQGRYYSGRPIIAEFSPVTDFREATCRQFEEHSCNRGGYCNFMHVKQVGRDLRRKLFGHLHRSRRSHSRSSRSPSPYRHRRSSSRSRDRDGDYDYYYHYRSGGGSRRSSERHRSHDNDGSRRRRGRSRSRSPVREGSEERRARIEQWNREREAAQV

SEQ ID NO: 6383 - DNA, 1737 bp, Panicum virgatum
  misc_feature: Ceres CLONE 1864765
  misc_feature: Encodes the peptide sequence at SEQ ID NO. 6384
gtgagctagcggagcacctttggctgtgctccgacactgcgtccatcaggagctcatccttttgcatccaactgctattagcctagcaacgacatcacattctaactcccaagctagctttctggctagtataggccaatcaagctccatccatgccggcaaatatgatctccaagatccttgagaaggctgtccatccactggatgttattgcacctcatgtgaaaagtgaagctgctcggaccagcgttcttcgcaatccgaacatggaaaagcttcagaagggctacttgttcccggagattagcaggaagcatgaggctcacctgaagaagaaccctgacgctaaggtcataagcttgggtatcggtgacacaactgaacccattccaagggtcatagcgtcggctatggctgagtatgcacttgcgttatccactccagaaggatatcagggttacggaccggagcaaggtcaaatgaacctgcgcaaggtcatagctgacaaagtgtacccaaacatggggataaaggagtctgaggtgttcatctcggacggagcgcagtgtgacattgcacgactgcagatgctgttcgggcccaacgtgaccatcgccgtccaagatcccaccttcccgggctacgtggacaacggcgtgatcgtggggcagaccggcgaggcggacgaggccggcaggtacgccggcatctcctacatgcggtgcgcgccggagaaccacttcttcccggacctctcccgcgtgccgcgcaccgacgtcatcttcttctgctcgcccaacaacccgacgggccacgccgcgtcggccgcgcagctgcgggagctcgtggacttcgcgaggcggaacgggtccatcatcgtgttcgacgcggcgtacgcgtggtacgtgtccgacgacgacgacggcgacggcagcaacaccaacagcaagaagccgcggtccatctacgaggtgcccggcgcccgggaggtggccatcgagatctgctccttctccaagttcgccgggttcacgggcgtccggctcggctgggcggtggtgcccggcgagctccggtacgcggacggctcgcccgtggcgcgcgacttcgaccgcatcgtgtgcacctgcttcaacggcgcctccagcgtcgcgcaggcgggggggctcgcctgcctcgccacggaggaaggccgggacgccgtgcgccgcgtggtgggcgtgtacaaggagaacgcgcgggtgctggtggacacgttcgcgtcgctcggcaaggaggtgtacggcggcgccgactcgccctacgtgtgggtgcgcttcccggggcgccgctcctgggacgtgttcgcggagatcctcgacaagacgcatgtcatcaccgtgccgggcagcgggttcggccccggcggcgaggggttcgtcagggtcagcgccttcaacagcagggacagggtgctggaggccgccgccaggctcaggaaatacctcgcctgagtctgagtgcccaactacacggatcacggagcgcatagcacttactccgtagttatatatataaacataccgatacgtgatcaataacattgctaggcgctgatgatgcgctgaaaactgtactggtagttatactggtactcttcaatccgcaaaaatgcacgagctacacatgtatctccattgctttatttgaaactacttataagagtaatttcaatttttaaaaaaaaaaaaaaaaaaa

SEQ ID NO: 6384 - protein, 446 aa, Panicum virgatum
  misc_feature: Ceres CLONE 1864765
  misc_feature (1)..(370): Pfam Name: Aminotran_1_2 Pfam Description: Aminotransferase class I and II
MPANMISKILEKAVHPLDVIAPHVKSEAARTSVLRNPNMEKLQKGYLFPEISRKHEAHLKKNPDAKVISLGIGDTTEPIPRVIASAMAEYALALSTPEGYQGYGPEQGQMNLRKVIADKVYPNMGIKESEVFISDGAQCDIARLQMLFGPNVTIAVQDPTFPGYVDNGVIVGQTGEADEAGRYAGISYMRCAPENHFFPDLSRVPRTDVIFFCSPNNPTGHAASAAQLRELVDFARRNGSIIVFDAAYAWYVSDDDDGDGSNTNSKKPRSIYEVPGAREVAIEICSFSKFAGFTGVRLGWAVVPGELRYADGSPVARDFDRIVCTCFNGASSVAQAGGLACLATEEGRDAVRRVVGVYKENARVLVDTFASLGKEVYGGADSPYVWVRFPGRRSWDVFAEILDKTHVITVPGSGFGPGGEGFVRVSAFNSRDRVLEAAARLRKYLA

SEQ ID NO: 6385 - DNA, 1652 bp, Panicum virgatum
  misc_feature: Ceres CLONE 1864766
  misc_feature: Encodes the peptide sequence at SEQ ID NO. 6386
gcaggcttgcagccgtacaagcgcagcaggtacgtgtgcttcagagctgggggtctccttctcttggagctacgagctgcgaattctccgctcgcctcatcctgctgcctcttcgtttcctcgctagctgggcagccccaaagccaaagcggaattcatgggttcggggcggtgtgagagattagcttccgctccctacaggagcacttgtgtgtgtctctgttgcgactcagcttcttgccttcttgcatagtttcatgaccggaccaaaatggctaggttaaatttggaacaggaatggtttgggggggagggatagatcagatgtagcgcatagatgcttcgaacacctgcaggaactgtacggcggtgcgactataaaaggacccttgacgctgctaatgcaaaggttgaaggaatctatctgacagatctgagaggtttccccatactgctagtgagacaaccacacatggtcgggtagaaaaaagatgaaatactagttaattactcatcactaagcaggtgctcccgctctatgctcttgtttattcgttgttgcagagtaacagaaatggatgcagatggtagctccaagagaagtcgcccagttcgtcgcgctgtgaagaaactcaagttcaaaccgaaagtgccaccgcagaagccaaagaaattgaccactgaaatgccacaacaggaagaaccaaaaccaatcgatgaacggttgatgaagatactgaggacttgtcaggtgcctgcaaacagtgcgccaaatacaaaagatgttgtcagcttgtttccagctcaatcaggagtgcacaagcaaaatcaatcaaagccactccaagtccccagatcctttcctgttactgttaattcaggaaagtttgacagcgaagagagcgacgacgacgataatgaagatgttgagtttcaggatactcagccaagttcaattgaatgcgaagcttcaacacgtccagcagaggagcttcatttgcttcaagaacaagatagcaaagaaagaatgttcctcttccagctcccaaaatctcttcctttgcccagaaggtcctccaatatagttgaaaggaaaggaagggccactggcgaggaggtgaaggaaggatccaaccttcagcagctgcctcagggttatttgggcaaaatgctggtatacaaaagtggcaaggtcaaaatgaagttaggagatgtcatgtttgatgtgaatcgaggagcagagagtaggatgccacaacatatagtggctctgaacactcaagagaaacattgttgcttacttggggagattgagaagcggcatgtcattgtgactccggatgttgattctttgttgaatgacaagtagagattaggttgacaggttgtgatatgtagcaacttggttacatatgagttgtaggattgtagttgagcagggttaggttatgatctgtagcaattgtatcaaccttgtcaagtggtgtgtaggctttcatctgtgcatgattgtgtgcagtttactgtgattgtactagattagtcctagaaccgcttctcgcatttgaacgtttgtattgactttgtagaataggaagagataaaaatcagatcatcttctctcatgttatcaaaaaaaaaaaaaaaaaaaa

SEQ ID NO: 6386 - protein, 276 aa, Panicum virgatum
  misc_feature: Ceres CLONE 1864766
  misc_feature (55)..(126): Pfam Name: RNA_pol_Rpc4 Pfam Description: RNA polymerase III RPC4
MLLFIRCCRVTEMDADGSSKRSRPVRRAVKKLKFKPKVPPQKPKKLTTEMPQQEEPKPIDERLMKILRTCQVPANSAPNTKDVVSLFPAQSGVHKQNQSKPLQVPRSFPVTVNSGKFDSEESDDDDNEDVEFQDTQPSSIECEASTRPAEELHLLQEQDSKERMFLFQLPKSLPLPRRSSNIVERKGRATGEEVKEGSNLQQLPQGYLGKMLVYKSGKVKMKLGDVMFDVNRGAESRMPQHIVALNTQEKHCCLLGEIEKRHVIVTPDVDSLLNDK

SEQ ID NO: 6387 - DNA, 1844 bp, Panicum virgatum
  misc_feature: Ceres CLONE 1864801
  misc_feature: Encodes the peptide sequence at SEQ ID NO. 6388
aagaacaaccagccactacgcgcgcttgttggggtcggagagctcgtatagttagctagctagcgcaggaaggttgaaatggcgagcctcaacgtgctgctcctccctgagcccggctccggccacctcatgtcgctcatcgaagccgggaagcgcctgctgggccacggcggccgtagtcacgcccacgagttcacggtgaccgtcctcgtcgtgcggccgccgacgccggagtccgcgacggaggtggacgcgcacgtccggcgcgtcgaggcgtccggcattggcgtccggttccaccacctcccggccgaggcgcccccgacggattgcggcggcaacctgcaggcgttcaagtcgcggtacctggagctctacaagccgcacgtcagggccgcggcgcgggagctccgcgcctcggcgctcgtgatcgacttcttcgccaccaccgtgctcgacgtggcgcgggagctcgccgtgccggcgtacgtctacttcacctccacggccgggctgctcgcgctcacgctgcggctgccggccctggagcgggaggtcgacgccgacttcgaggagtacgagggcacggtggacgtcccgggcctgccgcccgtgcccgcgggctccatccccggattcatgggccgcaagagcagccccaacttcacgtggttcgtgtaccacggcaagcggttcatggacgccgacggtatcatcgtcaacacggcggccgagctcgagccggagctcctcgccgcgatagccgagggccggtgcgtgccgggacgacggccggcgccgccactgtacccgatcggcccggtgctggacctcggtggcgcgtccgacgaggcgtgcgtccggtggctcgacgcgcagccgcgagcgtcggtggttttcctgtgcttcgggagcctggggtggttcgacgccgcgaaggcgcgcgaggtcgccgcggggctggagcggagcgggcaccggttcctgtgggcgctgcgcggccctcccgcggccgggtcgcggcacccgtcggacggcgacctggacgcgctccttccggaggggttcctggagcggaccgagggcaggggcctggtgtggccccggtgggcgccgcagaaggcggtgctcgcccacccggccgtgggcggcttcgtgacgcactgcgggtggaactcgacgctggagagcctgtggcacggcgtcccgctggcgccgtggccgctgtacgcggagcagcacctgaacgcgttcgagctcctggccggcatgggcgtggccgtgccgctgcaggtggacaggaagcgggacaacttggtggaggccgcggagctggagcgggcggtgcggagcctgatgggtggtgggtcggaggaggggcggagggcgcgggagaaggccgcggagatgaaggccgcgtgccggaaggccgtggcggagggcgggtcgtcgcacgccgcgctggagaggctgcgggaggcgatccgcgagggtgcgggggcggggacagcgaccgcataggctaggtcgtttgttccggacgttggcaagcacgcacgtccatcggcggcgtccgcttcgtggtgaatgggacgttcgctgtctgggcttgtgagcgtcaaaactcacggcgtgcagctgcagcttatggtcctagtaagtagggtgttgggtttctttcaaaaaaaaagtagggtgttgggtgtgttgcgttgtctgatctgatactagctacagtggacagtgttgatcatggatgttctgctcggtggcatctttatccagtgattccgtcgctatctatatatatcttgtttcccgctcaaaaaaaaaaaaaaaaaaaa

SEQ ID NO: 6388 - protein, 480 aa, Panicum virgatum
  misc_feature: Ceres CLONE 1864801
  misc_feature (7)..(151): Pfam Name: UDPGT Pfam Description: UDP-glucoronosyl and UDP-glucosyl transferase
MASLNVLLLPEPGSGHLMSLIEAGKRLLGHGGRSHAHEFTVTVLVVRPPTPESATEVDAHVRRVEASGIGVRFHHLPAEAPPTDCGGNLQAFKSRYLELYKPHVRAAARELRASALVIDFFATTVLDVARELAVPAYVYFTSTAGLLALTLRLPALEREVDADFEEYEGTVDVPGLPPVPAGSIPGFMGRKSSPNFTWFVYHGKRFMDADGIIVNTAAELEPELLAAIAEGRCVPGRRPAPPLYPIGPVLDLGGASDEACVRWLDAQPRASVVFLCFGSLGWFDAAKAREVAAGLERSGHRFLWALRGPPAAGSRHPSDGDLDALLPEGFLERTEGRGLVWPRWAPQKAVLAHPAVGGFVTHCGWNSTLESLWHGVPLAPWPLYAEQHLNAFELLAGMGVAVPLQVDRKRDNLVEAAELERAVRSLMGGGSEEGRRAREKAAEMKAACRKAVAEGGSSHAALERLREAIREGAGAGTATA

SEQ ID NO: 6389 - DNA, 2632 bp, Panicum virgatum
  misc_feature: Ceres CLONE 1864850
  misc_feature: Encodes the peptide sequence at SEQ ID NO. 6390
aactccgagcaagccataactgcaagaaaagcaacggcagcaagaaaccttggaaccaccggagcagagatcgcggcggcgatggcggccaaggggaggacggagctggaggtgggcgccgacggcgtcgccgtcatcaccatctgcaacccgccggtcaactcgctctccatcgacgtcttatatagcttaaaggaaagctatgaagaagcccttcggagaaacgatgtcaaagccattgttgttacagggaagggaggaaaattttctggaggatttgatattagttccttcggtggtcttcagggaggccaaacgatgcaaccaaaggttggttatatagcaattgatatcctcacagataccctagaagctgcgacaaagccatcagtggcagcaatagatggtcttgctcttggcggtggattagaagttgccatggcatgccatgcacgtattgcaactccaatggctcaattaggtcttccagaacttcaacttggaattattccaggatttggaggaacacaacgactcccacgtcttgttggactgacaaaatctctggaaatgatgttgctatctaaaccaatcaagggtggtgaggcacatgaactgggtttggttgatgccttagtttctcctaatgatttggtgaatactgctcgtcaatgggctttggatatatatgaacttaggaggccatggatcaaaagcctttacaagactgacaagctagaacctcttggagaggctcgggaaattctgaagtttgcaagagctcaagctcaaaagcaagcagctaatcttcaccacccacttgtttgtattgatgttgttgaagaaggcatagttgcaggaccaagagcagggctctggaaggaagcaactgctttccaggacctgcttttttcagatacatgtaaaagcttgctccatgtgtttttttctcagagggcaacatcaaagattccaggtgctacagacttggggttgatgcctaggaaaataagtaaagttgccatattaggtggtggacttatgggttcaggaattgcaaccgcaatgatattaagtaactatcctgtgatacttaaagaagtaaatgaaaagtttctaaatgctggaattgacagaatcaaagccaatttgcagagccgggtgcggaaagggaaaatgactgacgagagatatgagaaggctatgtctcttgtcacaggtgtccttgattatgaacatttcaaagatgtggacctagttattgaggcagttattgagaatgtgaagttgaagcagcaaatattttctgacttggagaagtactgtccttcccattgtatccttgctactaacacatctacaattgatcttaatctaattggagagaaaacaaagtctcaagatcgtattgttggtgcacacttctttagtcctgcgcatgtgatgccacttctggaaatagtccgtacccagcacacctcaccacaagttgttgttgacttgttggatgttgggaagaagataaaaaagacaccgatagtggttgggaactgtacgggctttgcagttaacaggatgttctttccgtacactcaatcagcactcttttatgttgatcttggtatggatgtttataagattgatcgtgcctgtaccaaattcggaatgcccatgggtcctttcagactggcagacctggttggatttggtgtggctgtggccactggtatgcaataccttgaaaatttcccagagagggtctacaaatcaatgctacttcctctcatgatggaggacaatagggcaggtgaggccacgcaaaagggattttacaagtacgagggaaagaggaaggccacacctgatcctgaaatcatgaaatatattgaaaagtctaggaaaatggcaggagttacaccagatcctgaggtttggtttctttatcatttgctgaagctaagtgagaaagacatagttgagatggtgtttttcccggtgataaatgaagcctgccgggtccttgatgagggtatcgcagtcaaagcttctgaccttgacattgcctccatctttggcatgggattcccaccttacaggggaggtgttatgcactgggcggattccatcggtgcaaagtacattcatggaaagttggaagagtggacaaaccggtatggcggcttcttcaagccttgttcttaccttgctgatagagctgcaaaagggtttcctctgagcgcactggcaaataaagttcaggctcggctataagatgtagtggatgtgcggaataacttctgctataagatgaatggaggaaactaaactgaataacagaactccagtggatgtgcggaataacttctgtcaaatactaggtgccacttttcccccttttttttcattttctttctatcggatgtgccactatattaggatacaagaaaatgaagcgcagaagcacatggagtgtaccatgaagtagacaagtgttactgttgttggaatgcctatcgttcattaagttggatatatttgagacctctcatgtggtaataaatgtagccaagctatatcgtgcagtctcttttttagattgtgcgaagtcctcaaaaaaaaaaaaaaaaaaaaa

SEQ ID NO: 6390 - protein, 729 aa, Panicum virgatum
  misc_feature: Ceres CLONE 1864850
  misc_feature (1)..(171): Pfam Name: ECH Pfam Description: Enoyl-CoA hydratase/isomerase family
  misc_feature (3)..(729): SWISSPROT Homolog: EC 4.2.1.17 Glyoxysomal fatty acid beta- oxidation multifunctional protein MFP-a [ Includes: Enoyl-CoA hydratase
  misc_feature (4)..(729): SWISSPROT Homolog: EC 4.2.1.17 Glyoxysomal fatty acid beta- oxidation multifunctional protein MFP-a [ Includes: Enoyl-CoA hydratase
MAAKGRTELEVGADGVAVITICNPPVNSLSIDVLYSLKESYEEALRRNDVKAIVVTGKGGKFSGGFDISSFGGLQGGQTMQPKVGYIAIDILTDTLEAATKPSVAAIDGLALGGGLEVAMACHARIATPMAQLGLPELQLGIIPGFGGTQRLPRLVGLTKSLEMMLLSKPIKGGEAHELGLVDALVSPNDLVNTARQWALDIYELRRPWIKSLYKTDKLEPLGEAREILKFARAQAQKQAANLHHPLVCIDVVEEGIVAGPRAGLWKEATAFQDLLFSDTCKSLLHVFFSQRATSKIPGATDLGLMPRKISKVAILGGGLMGSGIATAMILSNYPVILKEVNEKFLNAGIDRIKANLQSRVRKGKMTDERYEKAMSLVTGVLDYEHFKDVDLVIEAVIENVKLKQQIFSDLEKYCPSHCILATNTSTIDLNLIGEKTKSQDRIVGAHFFSPAHVMPLLEIVRTQHTSPQVVVDLLDVGKKIKKTPIVVGNCTGFAVNRMFFPYTQSALFYVDLGMDVYKIDRACTKFGMPMGPFRLADLVGFGVAVATGMQYLENFPERVYKSMLLPLMMEDNRAGEATQKGFYKYEGKRKATPDPEIMKYIEKSRKMAGVTPDPEVWFLYHLLKLSEKDIVEMVFFPVINEACRVLDEGIAVKASDLDIASIFGMGFPPYRGGVMHWADSIGAKYIHGKLEEWTNRYGGFFKPCSYLADRAAKGFPLSALANKVQARL

SEQ ID NO: 6391 - DNA, 2073 bp, Panicum virgatum
  misc_feature: Ceres CLONE 1864852
  misc_feature: Encodes the peptide sequence at SEQ ID NO. 6392
ttttggaaggaacaaagcccagagccagccttttcccccctctcggcctctattctctctcgatctctggctctctctcgtctctggtctctccgcctcctcgccctctcctccgcggctccgcaggcaggcggcggctgctcggccggggaatcaccttggctactcagtagccgctcggccccagcgggtcgggggacggcgggcgggcacgggcggccacaggaacctgttcggcctcaggaggcagggcggcaggcgggcacgggcggccgagcgcgggcgtggcgcagcagccgagccgccggagcaggcactgcagcacgcacgggaatcgagaaggcgaatcgagttcgccatggctgctcctcgcgtgccgcttccccagctgctgctcctcgtcgtcgccgcgctcgtcgcagctgcccccgtccggagggcgtccggggccggggagttcgacgtccgccgccacctctcaaccgtcaccaggtacgatgtggccagagggtctagtagtgtcaagtctatgccaccaatcccagatgggagccgtgtgatccacctcaatctagtggcaagacatgggactcgtgctcctaccaagaagcgaatcaaggagctggatagattggcaataaggctggaagctcttatgaatgaggcaaaacaaggtctcaacagtgattctctgaagaaagttccatcctggataaagggctgggagtcacgttggaagggtagaactaaaggtggtgagctgactagtgaaggagaagaagagctctacaacttagccaccagagtgaaggagaggtttcaagacctatttgatgatgaataccaccctgacgtatattcaataagagcaactcaggtttctcgggcatctgctagtgcagtagcatttggtttgggattgctttctgggaagggaaagcttggaccagggaagaaccgtgccttttctgttctgagcgagagtcgtgcaagtgatatttgtctgagattctttgatagctgtgaaacatacaaggcatacaggaaaaggaaggagcctgatgtcgaaaagcaaaaggagccgattctagagcatgtcacagctgcacttgtgaatcattatcacctcaattttacaactcaggatgtctcttccctctggtttctttgtaagcaggaagcatctttattgaatataaccaatcaagcttgcgggctttttaatgaagctgaggtttattttctagagtggacagatgatttggagggttttgttctaaaaggctatggtgagtcaattaactaccgtatgggactgccattgctcaaggacgttgtccagtcaatggaagaagcaatcatagctaaagaagaaaaccaccctgatggtacgtatgaaaaggcaaggctccggtttgcacatgcagaaactgttgttcctttcagctgccttcttggtctttttcttgaaggttcagattttgaaaagatacagcaggaggaagcattggacataccccctatgccaccacagggaagaaactggaagggcagtgttgtagctccttttgctggtaacaatatgctggttttatatcaatgcccaggcaaaacttcagatgccagcacttctgggggtcaaaataactcatacttggttcaagttctacacaatgaagtcccagtttcaatgccagggtgcggcaacaaagatttctgtccattcgaggagttcaaggagaagatagtcaaaccacacctgaagcatgactacaacatgatatgcaagatcaatccccctgtggcgagcgaggaacctgcatcgttcaccaccaaggtgtccagtttcttcgttggattgttctcgcagaaagggtaccgcgccgtgagcgctgaaagcgtcaagaccgagttgtaagccacgctagcaaccatctgccaccgtcaccatctggcgcaaacctgcaactgtgtctgcgtgcgagcacgagcaaggaaggaacgagattaaccgacgcactaacccgaggtgtttttgttcggccgagtggaaactcgaaagtgtagtctttc

SEQ ID NO: 6392 - protein, 519 aa, Panicum virgatum
  misc_feature: Ceres CLONE 1864852
  misc_feature (1)..(374): Pfam Name: Acid_phosphat_A Pfam Description: Histidine acid phosphatase
MAAPRVPLPQLLLLVVAALVAAAPVRRASGAGEFDVRRHLSTVTRYDVARGSSSVKSMPPIPDGSRVIHLNLVARHGTRAPTKKRIKELDRLAIRLEALMNEAKQGLNSDSLKKVPSWIKGWESRWKGRTKGGELTSEGEEELYNLATRVKERFQDLFDDEYHPDVYSIRATQVSRASASAVAFGLGLLSGKGKLGPGKNRAFSVLSESRASDICLRFFDSCETYKAYRKRKEPDVEKQKEPILEHVTAALVNHYHLNFTTQDVSSLWFLCKQEASLLNITNQACGLFNEAEVYFLEWTDDLEGFVLKGYGESINYRMGLPLLKDVVQSMEEAIIAKEENHPDGTYEKARLRFAHAETVVPFSCLLGLFLEGSDFEKIQQEEALDIPPMPPQGRNWKGSVVAPFAGNNMLVLYQCPGKTSDASTSGGQNNSYLVQVLHNEVPVSMPGCGNKDFCPFEEFKEKIVKPHLKHDYNMICKINPPVASEEPASFTTKVSSFFVGLFSQKGYRAVSAESVKTEL

SEQ ID NO: 6393 - DNA, 1823 bp, Panicum virgatum
  misc_feature: Ceres CLONE 1865079
  misc_feature: Encodes the peptide sequence at SEQ ID NO. 6394
cgattctctcttcttccctctccaattctctcgatccgcagctagcctagctagtgacgttcttgccggtcaatggtgcggctgatggcaggcaaggtaggaagcaatggcagcggcggcggccgggagtccggcaagaagccggcgctcctcctggggcggtacgaggtggggaagctgctggggcagggcaacttcgccaaggtgtaccacgcgcgcaacgtgcgcacgggcgaggaggtggcgatcaaggtgatggagaaggagaagatcttcaagtccgggctgacggcgcacatcaagcgcgagatcgccgtgctccggcgggtgcgccacccgcacatcgtgcagctctacgaggtcatggccaccaagctgcgcatccacttcgtcatggagtacgtgcgcggcggcgagctgttcgcgcgcgtcgcgcagggccgcctccgggaggacgacgcgcggcgctacttccagcagctggtgtcctccgtcgccttctgccacgcgcgtggggtgtaccaccgcgacatcaagcccgggaacctcctcgtcgacgacgccggcgacctcaaggtctccgacttcgggctctccgccgtcgccgaccagatgcgccacgacgggctgttccacaccttctgcggcacgccggcgtacgtcgcgccggaggtgctctcccgccgcgggtacgacgccgccaaggctgatctctggtcctgcggcgtcgtgcttttcgtcctcatggccgggtacctcccgttccaggaccgcaacctcgtcggcatgtaccgcaagatccacaagggcgagttccgctgccccaagtggttctcgcccgagctcaagcacctcctccgccgcgtcctcgacaccaacccgcagcgccgcgccaccgccgacgagatcatggacaacgagtggttcaagatcggcttccgccgtttctccttccgcatcgaggacgaccgctcattcacctgcttcgagctggacgacgacgccgacagcgtcgacgcgtccacctcgccgcccgagcccgagacgccacggacagacgtggccgccaagcgatcagtaagaaaggcgggcgggctgacgtcgtgcgggtcggcgccgtcgctgatccagctggaagcgcgcagcgggctcggcgggagcagccggcggcggtcgagcctgaacgcgttcgacatcatctcgttctcgagggggttcgacctgtcgggcctgttcgaggacggcgaggccgcaggtagcggcggcggcggcccggagcagcagcgccaccatccggcggcggcgcggttcatgtcggcggctccggtggagcagatcctggcggcgctggagggggccgcgtcggcggccggcctggtggtgcgcgagctggacgacgggtcggtcagcatggaagggacgcgggagggcgagcacggcgcgctggtggtggccgcggagatctacgagctcacggcggagctggtggtcgtggaggtgcggcgcaagtccggcggcgccgccgagtacgaggagttcttccgggcgcagctcaagcccggcctgcacgacctcgtctgcgacgagccgacgacgctggtccaatccgacgagcggtctcggagcctctgagctgtgatcgtgtccgattcatgcgtgcacgcccgcatgcccatgcgcgcacgttcgtcgtcggccatcgtatgtggcttcgtgccgcgtacaatttcaataattgataaatacttgccatgtatacaagtgtacaactacatgcagaattgtacgtacgtacacgtacgaatgaaaagggggttgggttt

SEQ ID NO: 6394 - protein, 519 aa, Panicum virgatum
  misc_feature: Ceres CLONE 1865079
  misc_feature (20)..(315): SWISSPROT Homolog: EC 2.7.11.1 CBL-interacting serine/threonine-protein kinase 11
  misc_feature (22)..(290): SWISSPROT Homolog: EC 2.7.11.1 CBL-interacting serine/threonine-protein kinase 15
MVRLMAGKVGSNGSGGGRESGKKPALLLGRYEVGKLLGQGNFAKVYHARNVRTGEEVAIKVMEKEKIFKSGLTAHIKREIAVLRRVRHPHIVQLYEVMATKLRIHFVMEYVRGGELFARVAQGRLREDDARRYFQQLVSSVAFCHARGVYHRDIKPGNLLVDDAGDLKVSDFGLSAVADQMRHDGLFHTFCGTPAYVAPEVLSRRGYDAAKADLWSCGVVLFVLMAGYLPFQDRNLVGMYRKIHKGEFRCPKWFSPELKHLLRRVLDTNPQRRATADEIMDNEWFKIGFRRFSFRIEDDRSFTCFELDDDADSVDASTSPPEPETPRTDVAAKRSVRKAGGLTSCGSAPSLIQLEARSGLGGSSRRRSSLNAFDIISFSRGFDLSGLFEDGEAAGSGGGGPEQQRHHPAAARFMSAAPVEQILAALEGAASAAGLVVRELDDGSVSMEGTREGEHGALVVAAEIYELTAELVVVEVRRKSGGAAEYEEFFRAQLKPGLHDLVCDEPTTLVQSDERSRSL

SEQ ID NO: 6395 - DNA, 1879 bp, Panicum virgatum
  misc_feature: Ceres CLONE 1865088
  misc_feature: Encodes the peptide sequence at SEQ ID NO. 6396
tgtaaaatattatataaaaaataaaataaaagctcgacgtcgtcacctctctcgccgtcgaggaatcacggcgggcggcggcgtcggcggcggccgggggtcctggccgctcaccaccatgcccgaccccaccacaaaacccccctcgccgcgcccccgccgccgccgcaggctctgcggcctctgcctcggcaccgcgctcctcgccctcctcgtctccgcgctcgtccacgccgtcgccccgccgcggcgccgcgcccccgcccccgcccccgcgcgcttctccgtcatcatagacggaggcagcacgggcacccgggcacacgtcttcgccgcgggggccgacggccgcccggatctggcgcgctctgccgtgatgcgcgtctccccgggcctctcgtccttcgcagccgacccggcgcgggccggggagtcgctacggccgctcatagaattcgcgagggagaaggttggcagcgcggggggcgcccctgcagaggcggaggtgcggttgatggccaccgccgggctgcgtctgctcgaggaccgcgcccgggaggcgatcctggcgtcctgcagggacgtgctccgggccgctggattccggttcgaggacgcgtgggccaaggtgatcccaggctctgatgaaggtgtctatgcttgggttgcggcaaattatgctcttggcagacttggaggggatcctaacaaaaccgttggaataattgaacttgggggcgcttcagctcagctgacctttgcttctgatgaagtacttcctcccgaactgtcaaataattttacttttggtgaaacaacatacactctctataccaacagctttttaaactttggtcaaaatgcagctcaagactcgttacatgaagtactgaggtcaagaggatcttccaaaaatagtacacttgttgatccttgtgctcctagaggatattcacacaatgaagaagtaatggtgaggccaagtggtgcttcaagatcaacactagagaaccaatatgttgatagtggaaacggaaactttacagaatgcagatccacttccctgcttttactgcaaaaaggaaaagagaagtgccagtatcaacaatgccaactgggatctactttcgtacctgagctgcgaggatacttcctggcaactgaaaatttctattttacttcaaagttctttggacttaagaagtcttcatcactatctgattttgcacttgctggagaacaattttgcaaccaggatttatacactcttagagaaaagtaccctaataggtcagatgaagatttctcacggtattgcttctcatcggcatacattgtggctctattacatgacagccttggtgtaccactggatgacaagaggattgagtattccaaccaggttggagacattcaggttgaatgggccctaggagctttcatcacattgatgcaaaatacaagttcaaagccatcagacgctgctgtaacatccacccatagcaatagaccattgtttgctgtggtggggatatttctattatgtggagttttttatgtgtcaaaatggaggaagcccaagacaaagattatatacgacttagagaaaggccgatacatcataacacgcatcagctgacgctgacccttgtgcagatgaattatatttatacgacaggaatagatgttgtgtaacaacaatgtacaagttcaattctttgtgttcttgatcttaggtagcagagttgggcgggtggagcatggaagatagtgtatttgtgcgtacagaagaatgtgttgaacaatttgtcatgtgctaattgtattctttttgatgaataaatatagtagattgctacgaaaaaaaaaaaaaaaaaaa

SEQ ID NO: 6396 - protein, 506 aa, Panicum virgatum
  misc_feature: Ceres CLONE 1865088
  misc_feature (2)..(340): Pfam Name: GDA1_CD39 Pfam Description: GDA1/CD39 (nucleoside phosphatase) family
MPDPTTKPPSPRPRRRRRLCGLCLGTALLALLVSALVHAVAPPRRRAPAPAPARFSVIIDGGSTGTRAHVFAAGADGRPDLARSAVMRVSPGLSSFAADPARAGESLRPLIEFAREKVGSAGGAPAEAEVRLMATAGLRLLEDRAREAILASCRDVLRAAGFRFEDAWAKVIPGSDEGVYAWVAANYALGRLGGDPNKTVGIIELGGASAQLTFASDEVLPPELSNNFTFGETTYTLYTNSFLNFGQNAAQDSLHEVLRSRGSSKNSTLVDPCAPRGYSHNEEVMVRPSGASRSTLENQYVDSGNGNFTECRSTSLLLLQKGKEKCQYQQCQLGSTFVPELRGYFLATENFYFTSKFFGLKKSSSLSDFALAGEQFCNQDLYTLREKYPNRSDEDFSRYCFSSAYIVALLHDSLGVPLDDKRIEYSNQVGDIQVEWALGAFITLMQNTSSKPSDAAVTSTHSNRPLFAVVGIFLLCGVFYVSKWRKPKTKIIYDLEKGRYIITRIS

SEQ ID NO: 6397 - DNA, 1659 bp, Panicum virgatum
  misc_feature: Ceres CLONE 1865094
  misc_feature: Encodes the peptide sequence at SEQ ID NO. 6398
gaaaataaatctttgttcacatcgaagtctccgcctctgcactcccatcccaccccgttcccacctcccatggcggccccggcgccggcgccggcggccacacacctccagcccccgttcctcctgcttccttccccgccgcggccgcaccctcctctccggctccgcttcctcctgccgtctccgccgcccctacgcctgcgccgccgcttcccgctcctcgcggccgccgctgtctccgccggcggcgggggcggggaggaagccgccaggaaggcggacaaggcccggcaactacagaagcgggtccttgtgggagttgccatcggggtgggcgcaggcggcatcgtgatcgccggcggctgggtcttcgccgccgccgtgtcagctgccgtccttgctggctcccgagagtacttcgagctcgtccgcagcactgccggtggtggtgggaccccgccgccgcgctacgtgtcccgcgtgtgctcagccatctgcgctctcatgcccatcctgacgctgtactatggacgcatggatgttaccgtgacgttttctgcattcgttattgcaatatcattgctattgcaaaggggaaatcctcgttttgctcagctaactagttcagtttttggattattttactgcggctatcttccttctttctgggttaagcttcgctcaagactagctgcccctgccttgaatacaagaatagcatacaattggccaattcttctaggtggacaagctcactggacggttggacttgtagcaaccttggtggctattagtagcatcattgctgcagacacatcagcttttctttgtggaagggcatttggccatacacctttgactaacataagccctaagaagaccttggagggtgctttagctggtctcgctggctgtgtactgaccactgtgctgctgtcaactgtcttaagctggccaagatctctgttgagtgctacagcttatggaatcctgatctttctgggttcattatttggggatcttgttgaatctctgattaagcgtgatgctggtgtgaaggactctggatctctcattcctggtcatggtggaatacttgaccgagttgacagctacgttttcacggggggactttgttactcttttgtcagagtagctctacccttgtatggggtctgattacagcagcttcccgttcattgtcaacatgtctttcttctacatctacccttttatgggatcttattacagcagctggccgctcgttgtcaacatgttttttcttctaccatcactccatcagcaatgtggtcgcaaatttttaacataatgatgagtgtcaccgagatgccccagatcaatcttcatcactggacagtgtggtcctgcccaagcaaattaagtggcatgtatctgactgttaaatgattcaaccagagaaggctgctaactcagacagtttcttacattgggtttgtgcttgttcttcccagctgtaatctgtttgttgcaaacttttcagtttggttgtacatagtttgttttatagagtaaatggaaaggctaatttttcgtcacaaagaagtgtataatttttcatctcaaaagttgttaaagtgtaccaaaccatatcagtcgatatctgttgttttcatggtt

SEQ ID NO: 6398 - protein, 369 aa, Panicum virgatum
  misc_feature: Ceres CLONE 1865094
  misc_feature (1)..(271): Pfam Name: CTP_transf_1 Pfam Description: Cytidylyltransferase family
MAAPAPAPAATHLQPPFLLLPSPPRPHPPLRLRFLLPSPPPLRLRRRFPLLAAAAVSAGGGGGEEAARKADKARQLQKRVLVGVAIGVGAGGIVIAGGWVFAAAVSAAVLAGSREYFELVRSTAGGGGTPPPRYVSRVCSAICALMPILTLYYGRMDVTVTFSAFVIAISLLLQRGNPRFAQLTSSVFGLFYCGYLPSFWVKLRSRLAAPALNTRIAYNWPILLGGQAHWTVGLVATLVAISSIIAADTSAFLCGRAFGHTPLTNISPKKTLEGALAGLAGCVLTTVLLSTVLSWPRSLLSATAYGILIFLGSLFGDLVESLIKRDAGVKDSGSLIPGHGGILDRVDSYVFTGGLCYSFVRVALPLYGV

SEQ ID NO: 6399 - DNA, 1894 bp, Panicum virgatum
  misc_feature: Ceres CLONE 1865109
  misc_feature: Encodes the peptide sequence at SEQ ID NO. 6400
aggccgccgtcccgcgcgctccagagcccagactagagcacaagcaaaggcaagcgcagcgcggcgacgcccgcaacgacgcggccgggcacgcgacaaggagagaaggcaactcttgtcgatcggagagcgcgccgctccaccgacgcaagcaagcgcgctcgctcggttggccgctggcggcgtcgaccggcctcgagctctcggttttctttcgttcctctactgctgatcggatcggagcgacctgctagccgcgtcgatcggcctgccgccgtcgtgtcgtccatggccatggcggagcggttcggagctcggtggctgccgttccgcttcgtcctcgccgtcgtgctcctcgtcctgacgacagatcgagcatcagtgctgctgagggctgaagcgactccgatcggcatcaactacgggcagatcgccgacaacctcccctccccggcccgggtgtcgtggctgctccggtcgatgcaggtcagcaaggtgaagctctacgacgcggacccctacgtgctgagcgccttcctcgacaccggcgtggagttcgtggtgggcatcggcaacgagaacgtgtcggcgatggtggacccggcggcggcgcgggcgtggatccagcgccacgtgcagccgtacctccccgccacgcgcatcacctgcatcaccgtcggcaacgaggtgttcaagggcaacgacaccgagctcaaggccaacctgctccccgccatgcagtccgtgtaccaggcgctcgccgcgctgggcctgcagggcacggtgaacgtcaccacggcgcactccctcgacatcatgggcagctccttcccgccctccgccggcgcgttccgcgccgacgtcgcgccgtacctgcagccgatcctgagcttcctgtccatggcgaggtcgccgttcctcatcaactgctacccctacttcgcctacaaggccgaccccggcaacgtgccgctggagtacgtgctcttccagcccaacgccggggtcaccgacaccaacaccaggctcaactacgacaacatgctctacgcccaggtggactcggtgtacgccgcgatccaggcgctggggcacgccgacatcgacgtcaaggtctccgagaccgggtggccgtccaggggcgaccccgacgaggccggcgccacgccggagtacgccgggacgtacatcggcaacctcctgcggaggatcgagatgaagcagggcacgccgctgcggccgtcggtgcccatcgacgtctacgtcttcgcgctgttcaacgagaacctcaagcccgggccggcatccgagcggaactacgggctcttctaccccgacggcacgccggtgtacaacgtcggcctgcgggggtaccttccacccatggattactcgcagggcacgagaaaggcggttcatttgcttgccctcatcctcatagccgttgctgcgatcgctctcagcttatcctgagaggatatactggtgacgactgcgttaaagttgatgaagaaagcgtggagcccaaggatttcttgctgctgggattacacctgcagacctcaagggaatctccagaagacgaacatcatcagctatgatttcgattggtgcagacacacacagccagccaaaacagatggattgtttttttagcatccaggagccaaaattggctccacactgatagactgatagtgaagtagaactgactgaagattggggacgataagtggccattgcacgcattgtttttttaatagaattttctctttgatttattcgggagatgtcttctttacgcaactgtacatttgtatatgggtcgaacagacaggacattaattcaggtcaaggctggccattgttacctcaaaaaaaaaaaaaaaaaaaa

SEQ ID NO: 6400 - protein, 394 aa, Panicum virgatum
  misc_feature: Ceres CLONE 1865109
  misc_feature: Great-hit functional homolog of the protein sequence encoded by LOCUS At2g27500
  misc_feature (1)..(319): Pfam Name: Glyco_hydro_17 Pfam Description: Glycosyl hydrolases family 17
  misc_feature: Useful for making plants with altered cell wall content and/or composition
MAMAERFGARWLPFRFVLAVVLLVLTTDRASVLLRAEATPIGINYGQIADNLPSPARVSWLLRSMQVSKVKLYDADPYVLSAFLDTGVEFVVGIGNENVSAMVDPAAARAWIQRHVQPYLPATRITCITVGNEVFKGNDTELKANLLPAMQSVYQALAALGLQGTVNVTTAHSLDIMGSSFPPSAGAFRADVAPYLQPILSFLSMARSPFLINCYPYFAYKADPGNVPLEYVLFQPNAGVTDTNTRLNYDNMLYAQVDSVYAAIQALGHADIDVKVSETGWPSRGDPDEAGATPEYAGTYIGNLLRRIEMKQGTPLRPSVPIDVYVFALFNENLKPGPASERNYGLFYPDGTPVYNVGLRGYLPPMDYSQGTRKAVHLLALILIAVAAIALSLS

SEQ ID NO: 6401 - DNA, 1027 bp, Panicum virgatum
  misc_feature: Ceres CLONE 1865175
  misc_feature: Encodes the peptide sequence at SEQ ID NO. 6402
gggtttagcagcgccgggcggcgactcctcactaccccttccgctccgctcggcacctctcctcgcggcgagcacccatggctgcttcctccgcctccctcctcgcccgccgcctcctcctctcccgccgcctcctctcctccccactccgccccttctccgccgccacgacaccctactcctccccctcgcttaacgggtccgacgccgagtccgaccccaagctcgagcgcgaccgggcccccggggatcaggaccgccagcaggcgcccaacagcccgcgcccgcccaacaccacccgccccctcgagaacggcctcgacaccggcatctacaaggcgataatggtggggaaggtcgggcaggagccgatgcagaagcggctgcggaacgggaggaccgtcgtgctcttctcgcttggcaccggtggcatccgcaacaaccgccgcccgctggaccgcgaggagccgcaccagtacgccgaccggtgctccgtgcagtggcaccgcgtctgcgtctacccggagcgcctcggcaccctcgcgctcaaccacgtcaagaccggcactgttctctatttggaaggaaatcttgagaccaaagtgttctgtgatccaattactggtctggttagacgcataagagaaatagctgtgcggggaaatggtcgtctcttgtttctgggtaatgacgccaatgctcccaagttaggtgaagtcaagggtgtgggctacttctgatactgatttatgtttaactgatgacaccagttgtatgtcaactgggatgcatctatcacaatggtgcggcatgtatgtcattgaaatctgagagtgaatcaacaaattttggcagcgatttcaagtcttttgctgcattgaattttatcatattcctgttttcgtcaagctctcaacaccatgtacatgccttataattgttgagcagcagcatatagggtgtgtaacttaacctcagacatgttttacagagtgttttctttctacaaaaaaaaaaaaaaaaaaaa

SEQ ID NO: 6402 - protein, 220 aa, Panicum virgatum
  misc_feature: Ceres CLONE 1865175
  misc_feature: Great-hit functional homolog of the protein sequence given in SEQ ID NO 9611
  misc_feature: Useful for making plants with altered alkaloid content
  misc_feature: Useful for making plants with altered terpenoid content
MAASSASLLARRLLLSRRLLSSPLRPFSAATTPYSSPSLNGSDAESDPKLERDRAPGDQDRQQAPNSPRPPNTTRPLENGLDTGIYKAIMVGKVGQEPMQKRLRNGRTVVLFSLGTGGIRNNRRPLDREEPHQYADRCSVQWHRVCVYPERLGTLALNHVKTGTVLYLEGNLETKVFCDPITGLVRRIREIAVRGNGRLLFLGNDANAPKLGEVKGVGYF

SEQ ID NO: 6403 - DNA, 593 bp, Panicum virgatum
  misc_feature: Ceres CLONE 1865230
  misc_feature: Encodes the peptide sequence at SEQ ID NO. 6404
agtgcccactacacacacgacgcgcaccaccagcacgccgacgactgaacgaggcgagaaccggccgaggcggaggcgatgggcggcggcggcggcggcgcgcacggcggcaccacctacaagggctacaccatcccgcacaacaagcgctggcataccgtcgccggcaagggcctctgcgccgtcatgtggttttgggttttctacagagctaagcaggacggtgctgtgctcttgggcttgcgccatccttgggatgggcatgatgatcactctcatggacatggacatggacatggacatggacatgaggcatcatcatcgtcatcgtcgtcttctcattgagttcactacaacttgcagctgacggtgatgcgatgcttggcatgttccgactaaagtttcatttaataaattctgccccgttgcatgggagtcatgttgtttgcgagttgcttagcacaaactgtttgcctgacaattgtgcttgtgtatttgatttcaagcttcagttgatatgttgtgggaaagaattcggtgtatgtcgcttctcgttgtgaccactacttgtgcccattgctctgctttttccc

SEQ ID NO: 6404 - protein, 88 aa, Panicum virgatum
  misc_feature: Ceres CLONE 1865230
  misc_feature: Great-hit functional homolog of the protein sequence given in SEQ ID NO 9351
  misc_feature: Useful for making plants with modulated flowering time
  misc_feature: The plant flowers significantly late compared to wild-type.
MGGGGGGAHGGTTYKGYTIPHNKRWHTVAGKGLCAVMWFWVFYRAKQDGAVLLGLRHPWDGHDDHSHGHGHGHGHGHEASSSSSSSSH

SEQ ID NO: 6405 - DNA, 884 bp, Panicum virgatum
  misc_feature: Ceres CLONE 1865286
  misc_feature: Encodes the peptide sequence at SEQ ID NO. 6406
aacaaagaaaaaggaaaaagaagagaggcggacagccggcgatggtcacgactgccgtcacggcggtcgccggcgccgtgccgccgcctccgaaaggaaaagctgtgactgtagcctcaacactacctcccaccctcaccagaaggcatctcctcgttgcgggcgccaccgcctccgccctccgcacggcagccgcctccgctgcgccccccaaattcgcggagatccccgactccggcggcgtgaaggccctggacctccgggagggttccggtgaggtcccggccgacggcgaccaggttgcaattcattactatggaagattggcagcaaaacaaggatggcgctttgattccacctatgatcataaggacgagactggtgatcccatgccgtttgtcttcaccattgggtctggaaaagttatacctggtattgaagcagcagtgaagtccatgagagttggtggtcttcgccgtgtgatcattccaccatcacagggatatcagaacacatcacaagaacctatccctcctaacttctttgatcggcagaggctatttactactatattcaaccccacacgtctggcaaacggcgagggttccactctcggtacacttatcttcgacatcgagctaatcaacattaggcaacgctcatagctgttctgctttgcaaggatagaagactgatcaacccctcattgaaatcttttggctccatgctcatcactcttgtgactgaaagaaactctatgcaagaattggttcatgttctgtgcttaatcccttctgtaatacatgtgaaacacagtaatatactattactgatacacaatacaaagaaaagtcaagtgagtgcaaaaaaaaaaaaaaaaaaaa

SEQ ID NO: 6406 - protein, 207 aa, Panicum virgatum
  misc_feature: Ceres CLONE 1865286
  misc_feature (1)..(126): Pfam Name: FKBP_C Pfam Description: FKBP-type peptidyl-prolyl cis-trans isomerase
MVTTAVTAVAGAVPPPPKGKAVTVASTLPPTLTRRHLLVAGATASALRTAAASAAPPKFAEIPDSGGVKALDLREGSGEVPADGDQVAIHYYGRLAAKQGWRFDSTYDHKDETGDPMPFVFTIGSGKVIPGIEAAVKSMRVGGLRRVIIPPSQGYQNTSQEPIPPNFFDRQRLFTTIFNPTRLANGEGSTLGTLIFDIELINIRQRS

SEQ ID NO: 6407 - DNA, 1022 bp, Panicum virgatum
  misc_feature: Ceres CLONE 1865501
  misc_feature: Encodes the peptide sequence at SEQ ID NO. 6408
aaaaaccccctcgccgcctcccgaaatctctccaaatccggagccaatggcgccgttccctcccaccccgaccgcgcccaaaaccatcgccgacttcttcgtgcgccccgccaagcgcctccgcgccgccgctcccgccgcggcgagcgcatccctctcctcctcctcctcgctctcgccggagcagcgccgccgcgccgacaccaacctcgcgctcgcccgcgcgcgccgcaacctccgtctcgccgagtccagagccaaagcgtcggggggcgccgcgaagctggaggagctcctcgtggaggagacgtgggtggaggcgctggacggggagctgcgcaagccctacgcgctcgagctctgccgcttcgtcacccacgagcggctgcacggcccgctgcccgtctatccgccgcagcacctcgtcttccacgcgctcaacaccaccccgttccaccgcgtcaaggctgtcatcattggccagggtgttcttatgctcaatactgtactaactgtgagggagcatcaagcaaactcacatgccaagaaaggatgggaggagtttactgatgctgttattaagaccatatcacaaaagaaatcagggctagtctttcttctttggggaaattctgctcaatcaaagacaagattgattgacggaacaaaacaccacattttgaaatcagctcacccctcaggcctgtctgcaaaccgaggtttctttggatgcaggcacttctccaaaacaaatcagatcctagagaagctgggactatctgcaatcgattggcagctatagacaattccaagaccacatgtgatctggctgtttgagcttgacagccaccgtgtgaggtggagcgggagcacctgcgttataaggtcttaatgggcaaggaccatcctgttcggccatagtaatttggtagcgactttaaattatatggccggtatgagtgccaactctactaacgctttgtatagctcttcttttgcatcaaaaaaaaaaaaaaaaaaaa

SEQ ID NO: 6408 - protein, 251 aa, Panicum virgatum
  misc_feature: Ceres CLONE 1865501
  misc_feature (68)..(162): Pfam Name: UDG Pfam Description: Uracil DNA glycosylase superfamily
MAPFPPTPTAPKTIADFFVRPAKRLRAAAPAAASASLSSSSSLSPEQRRRADTNLALARARRNLRLAESRAKASGGAAKLEELLVEETWVEALDGELRKPYALELCRFVTHERLHGPLPVYPPQHLVFHALNTTPFHRVKAVIIGQGVLMLNTVLTVREHQANSHAKKGWEEFTDAVIKTISQKKSGLVFLLWGNSAQSKTRLIDGTKHHILKSAHPSGLSANRGFFGCRHFSKTNQILEKLGLSAIDWQL

SEQ ID NO: 6409 - DNA, 1087 bp, Panicum virgatum
  misc_feature: Ceres CLONE 1865667
  misc_feature: Encodes the peptide sequence at SEQ ID NO. 6410
aacaataaaggctgggtcgaagaggaaggggaagcttggaccgagcaagcgagagaggagggccggccgagcgagagggagagaggaattaatgggtgaggaggccagctgcaacgccgtcagcgtgatggaggccgccaagcagcagcagccgccgcccaaggagaacggcctcgccgctgccggggaggccgcggccgcggccgacccccgcctgcagggcatctccgacgccatccgcgtcgtcccccacttccccaaagaaggcatcatgttcaacgacatcaccacgctgctgctgcgccccggggtgttcaaggacgccgtcgacctcttcgtcgagcgctaccgcggcatgggcatcgacgccgtcgccgggattgaggccaggggcttcatatttggcccggcaatcgcattggccattggcgccaagttcataccgctgcgcaagcctaggaagctcccaggtgaggtgatctccgagaaatatgttcttgagtacgggactgattgtttagagatgcacgttggagccatcgtgcctgctgagcgtgtcatcatcgtcgatgacttggttgcgaccggaggtaccctttgtgctgcgattaggcttctcgaacgtgctggagctgatgtggtcgagtgtgcatgtctcattgggctcccaaaatttaagaacttatacaagcttaatggaaagcctgtctacgtactggtggagtcccgtgaatctgataaataagaagtgctggtcaggtggtgtcatgttatccttttcagctgcgggtgcggcacaccaagtgcttcccttgattcgtttctgcgtgttcttaagcttagcggcacacttcttttgctcatttcctatccgacacccgtatttttcaggaatgctggtgggatggctaggtgctaagtctttgtgtgtgtgtgggtggggggagttatagaagagtgtagtcttgtagccttggtagtttttttttcagagtactgatggagcttgtagttgtactgccgagaacacatggttattagatgatgaatcaaggttgctgctgttcaaaaaaaaaaaaaaaaaaaa

SEQ ID NO: 6410 - protein, 217 aa, Panicum virgatum
  misc_feature: Ceres CLONE 1865667
  misc_feature (31)..(217): SWISSPROT Homolog: EC 2.4.2.7 Adenine phosphoribosyltransferase 2
  misc_feature (37)..(215): SWISSPROT Homolog: EC 2.4.2.7 Adenine phosphoribosyltransferase 1
MGEEASCNAVSVMEAAKQQQPPPKENGLAAAGEAAAAADPRLQGISDAIRVVPHFPKEGIMFNDITTLLLRPGVFKDAVDLFVERYRGMGIDAVAGIEARGFIFGPAIALAIGAKFIPLRKPRKLPGEVISEKYVLEYGTDCLEMHVGAIVPAERVIIVDDLVATGGTLCAAIRLLERAGADVVECACLIGLPKFKNLYKLNGKPVYVLVESRESDK

SEQ ID NO: 6411 - DNA, 927 bp, Panicum virgatum
  misc_feature: Ceres CLONE 1865724
  misc_feature: Encodes the peptide sequence at SEQ ID NO. 6412
gagagcagccctcgcttctcagcccgtcatccaagaaagagctagcgcatcgcaccggcgtctgagaaatggcgtgcggggcccacctcgccggcgcctgccgcgcgctcctcctcgccgggctcctcgcggccgccgcgtccttccttccggcagccgagccgtcctgcccccgaggcggctaccagcagcgtctgactgatgaccaagcgcccctgatgtgcgcagacacttcgctggtgaaggacgtcggccggatgcaccagagcagctacgggatcgacggcttctcgcacataaccgtcgccggcgcgctcgctcacgggctcaaggaggtggaggtgtggcttcagactatagttccaggcggaaggacgccgatccaccggcactcctgcgaggaggtcttcgtagtcctcaaagggaaaggcacgctcctgctgggctcaagcacgctcaagtacccagggcagccccaggagatccccatcttccagaacagcacgtttacggtccccgtgaacgatccgcaccaggtagtgaattctgacgagcatgaagatctgcaagttcttgtggtcatttcacgcccaccggtaaagatatttctatacgatgattggagtatgcctcatacagcagcgaagctgaagttccccttcgtctgggatgaggactgcttgccagctcctaaagatgaactctaggtccaaaagcgtttcatccattttaatcagcttcatccatgatcctgctagaacgaaggccacacctatgtgtgcactgtcatgtgattctgtattgtgcctctgtaggggaatagtatttttgtcacggttaatgaactgaagaactagcttttggaataaattaacaacagtcaatgtatgttgtttccaggttttacaaaaaaaaaaaaaaaaaaaa

SEQ ID NO: 6412 - protein, 212 aa, Panicum virgatum
  misc_feature: Ceres CLONE 1865724
  misc_feature (8)..(166): Pfam Name: Auxin_BP Pfam Description: Auxin binding protein
MACGAHLAGACRALLLAGLLAAAASFLPAAEPSCPRGGYQQRLTDDQAPLMCADTSLVKDVGRMHQSSYGIDGFSHITVAGALAHGLKEVEVWLQTIVPGGRTPIHRHSCEEVFVVLKGKGTLLLGSSTLKYPGQPQEIPIFQNSTFTVPVNDPHQVVNSDEHEDLQVLVVISRPPVKIFLYDDWSMPHTAAKLKFPFVWDEDCLPAPKDEL

SEQ ID NO: 6413 - DNA, 594 bp, Panicum virgatum
  misc_feature: Ceres CLONE 1865870
  misc_feature: Encodes the peptide sequence at SEQ ID NO. 6414
atgtttatcctggccaaggattcacagatacagaggccattataggggttgaagccagctcaaaatagcctcaccgttccaggtgacaactggctcctctaatggatagcagcagaagcagcagccgggacaagaagtccaaagataacgatcgtcatgaagcaaaagaagctaatagcactgcacagaattttgttgacttcacagaagcagaggaagatcttgtttccagaatgcacaggcttgtggggaacagatgggagcttatagcaggaagaattccaggaaggacagcagaagaagtagagatgttttggtccaaaaaacaccaggaaaaatgaaaacggggccattactttatattgatctataaactatgtattaatatcacttgaaaatgtgcttataaataatgttaaccatgcaaagatgaaaaaagccatatagtattatgagctcactcgaggagcgatgtggattggcacttccaagttaagttagcagtgttatctgtgttcattttgtaattgcatcttgttataacatgatgtcaattttacaatagcaaagtattaaaaaaaaaaaaaaaaaaaa

SEQ ID NO: 6414 - protein, 79 aa, Panicum virgatum
  misc_feature: Ceres CLONE 1865870
  misc_feature: Great-hit functional homolog of the protein sequence given in SEQ ID NO 9748
  misc_feature (1)..(46): Pfam Name: Myb_DNA-binding Pfam Description: Myb-like DNA-binding domain
  misc_feature: The sequence is a functional homolog of  SEQ ID NO 1049 in the  10/412,699 US patent application
  misc_feature: The sequence is a functional homolog of  SEQ ID NO 1050 in the  10/412,699 US patent application
  misc_feature: The sequence is a functional homolog of  SEQ ID NO 1064 in the  10/666,642 US patent application
  misc_feature: The sequence is a functional homolog of  SEQ ID NO 1065 in the  10/666,642 US patent application
  misc_feature: The sequence is a functional homolog of  SEQ ID NO 2133 in the  10/666,642 US patent application
  misc_feature: The sequence is a functional homolog of  SEQ ID NO 328 in the  11/435,388 US patent application
  misc_feature: The sequence is a functional homolog of  SEQ ID NO 330 in the  10/714,887 US patent application
  misc_feature: The sequence is a functional homolog of  SEQ ID NO 558 in the  10/374,780 US patent application
  misc_feature: The sequence is a functional homolog of  SEQ ID NO 559 in the  10/374,780 US patent application
  misc_feature: Useful for making plants with modulated biomass
  misc_feature: The plant is abnormally small.
  misc_feature: Useful for making plants with modulated growth and phenotype characteristics
MDSSRSSSRDKKSKDNDRHEAKEANSTAQNFVDFTEAEEDLVSRMHRLVGNRWELIAGRIPGRTAEEVEMFWSKKHQEK

SEQ ID NO: 6415 - DNA, 544 bp, Panicum virgatum
  misc_feature: Ceres CLONE 1865912
  misc_feature: Encodes the peptide sequence at SEQ ID NO. 6416
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (455)..(455): n is a, c, t, g, unknown, or other
  misc_feature (456)..(456): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (470)..(470): n is a, c, t, g, unknown, or other
acctcatcgatcgagccagccgtccagccagtcgcctatatcctcgcctgctgcgcgcgtctctctgctctcctagggagatctcgcgcagcgcggtaacccaccttcccacctcgtcgccgtcgcagatggccggcctcaggatgaagctcgtcgccgccgccgccgtggccgccgcgctcgtggcgtccgccgccgccgccaccgaggcccccgccccggcgcccgcctccgacaccgccaccgcggcgcccctcgccgcggcgtccctcgcccccgccatcttcggctacctcttgtgctcaatcccccgcccgtcccccgtgggacctgctgagacgactattcgctctggcgtggcgtgagtcgagcccgtgtggggaggatgtccggagggagtgtgcatgtgcaagttcggctgcgcggggtgcggtgagcgatcggannntgcgggnngcaacacgnnnntntcgatggggccgatcctggactcactccaataaaaaaaattaatgagatcgttgatatgattccctacaccgcc

SEQ ID NO: 6416 - protein, 78 aa, Panicum virgatum
  misc_feature: Ceres CLONE 1865912
  misc_feature: Great-hit functional homolog of the protein sequence encoded by LOCUS At4g26320
  misc_feature: Useful for making plants with altered cell wall content and/or composition
MAGLRMKLVAAAAVAAALVASAAAATEAPAPAPASDTATAAPLAAASLAPAIFGYLLCSIPRPSPVGPAETTIRSGVA

SEQ ID NO: 6417 - DNA, 956 bp, Panicum virgatum
  misc_feature: Ceres CLONE 1866037
  misc_feature: Encodes the peptide sequence at SEQ ID NO. 6418
aggtcacaaccctagctgcccccaaatccatggatcccaccaaatccagcacccctccgcctcctccagtcatgggcgcccccgttgcctaccctccggcggcttaccctcccgctgcggccgccggcgccggcgcctacgccccgcagctctacgcgccgcccgccgcagctgcagcccagcaggcggccgctgcgcagcagcagctgcagatgttctgggcggagcagtaccgcgagatcgaggccaccacggacttcaagaaccacaacctcccactcgcccgcatcaagaagatcatgaaggccgacgaggacgtccgcatgatcgccgccgaggcccccgtcgtgttcgcgcgcgcatgcgagatgttcatcctcgagctcacccaccgcggctgggcgcacgccgaggagaacaagcgccgcacgctccagaagtccgacattgccgccgccatcgcccgcaccgaggtgttcgacttcctcgtcgacatcgtgccgcgcgacgacaccaaggacgccgacgcggccgccgcagcagctgccgcggctgcggctgccgggatcccgcgccccgccgccggtgtgcctgctaccgacccgcttgcctactactatgtccctcagcagtaatgtatcatcgtcgccttcttagtcatttccgaagcgcagaatgtgttgtcgtgttgtttcgtgactgtcgtagttgctactgctgttgttgcggcgtaataagacttgttgatgattgatgggcctccccctgagcttaagaattgagctgtttcattctagagtctcgagtaagtttgttgtaatgggggatgccctttgattgggttggtagtgtatgcctaagcctaactcatccgatgctgtaatccgacaagtattatgcgggtgtttggtaattatggtgcaatttctgttattcaaaaaaaaaaaaaaaaaaaa

SEQ ID NO: 6418 - protein, 201 aa, Panicum virgatum
  misc_feature: Ceres CLONE 1866037
  misc_feature (1)..(65): Pfam Name: CBFD_NFYB_HMF Pfam Description: Histone-like transcription factor (CBF/ NF-Y) and archaeal histone
MDPTKSSTPPPPPVMGAPVAYPPAAYPPAAAAGAGAYAPQLYAPPAAAAAQQAAAAQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDTKDADAAAAAAAAAAAAGIPRPAAGVPATDPLAYYYVPQQ

SEQ ID NO: 6419 - DNA, 1151 bp, Panicum virgatum
  misc_feature: Ceres CLONE 1866271
  misc_feature: Encodes the peptide sequence at SEQ ID NO. 6420
aagcttctctcctctgctccgcccctccaccgcctttgggcctctctctctctctctccacacgaggaaagctccgagctttctctctctacccgggggagaagcgaggaagccggcgccgcctggtggcgctgggggctggcggctccaaggaatcgagttcttggagggccgttccatggcggcgcaccggggggacctggggcggcagctcccgctgagaggccccctcaaggccctcgaggccgacatccaccacgccaacgccatggcggatgccattcagaggaactatggtggagcatgcgtgcagatgaggctgtcgttcagctccctggctccattcttcctgtacctcatccagtggctggattggggatgctgctacgctcttcccagttatttaggactctttcacattctcatatgcaaggtttatgcagatggggatagctcggtgtcaacatatgaaaggcgggcaagccttagggaattctatgcttcttgcattgcagcaatcatctaccctattctgcagcagctggagagtagtctgattgagagggacctgaaagggaagggtcgatacaaagacatagtgagtaggaggcgtatggaggattggaaaaggctttctggcaaggatgtggagagggaggatgaatgtggcatttgcatggagacatgcaccaagatggtcctgcctaattgcagtcatgcaatgtgcataaaatgctatagggactggtataaaagatcagaatcttgccctttctgccgaggaagcctcaaaagaatccgctcaagagacctttgggtgcttacaaattacaatgacgtcattgaccctgcaaatttagaaagagaaaacgtgaggcatttctatagttatattgacagcttgcctcttatacttcctgataatattttctttttctactaccattacctaatataatccagaagcaccatacattgaatgtgtaaattttcaaatcagatgaagctaacatagttctttggtagatgaatggcactcctatctttgacgaacatgcatttgtatttacttgtagggtagctatgtaacacgaacgcaacagtgcataaaatttgtaggtgatattcattaaaaaaaaaaaaaaaaaaaa

SEQ ID NO: 6420 - protein, 259 aa, Panicum virgatum
  misc_feature: Ceres CLONE 1866271
  misc_feature: Great-hit functional homolog of the protein sequence given in SEQ ID NO 9295
  misc_feature (1)..(38): Pfam Name: zf-C3HC4 Pfam Description: Zinc finger, C3HC4 type (RING finger)
  misc_feature: Useful for making plants with altered Lignin content
MAAHRGDLGRQLPLRGPLKALEADIHHANAMADAIQRNYGGACVQMRLSFSSLAPFFLYLIQWLDWGCCYALPSYLGLFHILICKVYADGDSSVSTYERRASLREFYASCIAAIIYPILQQLESSLIERDLKGKGRYKDIVSRRRMEDWKRLSGKDVEREDECGICMETCTKMVLPNCSHAMCIKCYRDWYKRSESCPFCRGSLKRIRSRDLWVLTNYNDVIDPANLERENVRHFYSYIDSLPLILPDNIFFFYYHYLI

SEQ ID NO: 6421 - DNA, 574 bp, Panicum virgatum
  misc_feature: Ceres CLONE 1866375
  misc_feature: Encodes the peptide sequence at SEQ ID NO. 6422
cccagatccccacgccacgcacgcgcacctccccgtccgtccgtccctcccacagccggtggtgcctcgtcggcgcgtgctgctctgccccgccaccgcaccgccgcctcgctagttcgacgccaccccacccgccggggacaaccatgactacttcaaggcggcttgctgacaggaagaccgcaaagttccagaagaacatcaccaggaggggttcagtgcctgaaaccactgtcaagaaggggaatgactaccctgttggacctgtagtgcttggcttcttcatcttcgttgtcatcggatcatcgttgtttcagataatcaggacggcaaccagtggcggaatggcttaagaaccgaccgaactaatcagagtccagagatatgtttgttatacatgcatccaatccagaattgggtagcagctaaatgtccagtgctgtcatacttatactgtattcgttttgtctcgagagtgctgagtctgaaactagtgtctgaagaactgtaaagcaaaatcatgtgcctcaaaagtgttaaatggataattatcagatagtataatgtttcattc

SEQ ID NO: 6422 - protein, 68 aa, Panicum virgatum
  misc_feature: Ceres CLONE 1866375
  misc_feature: Great-hit functional homolog of the protein sequence given in SEQ ID NO 9418
  misc_feature: Useful for making plants with modulated nitrogen use efficiency
MTTSRRLADRKTAKFQKNITRRGSVPETTVKKGNDYPVGPVVLGFFIFVVIGSSLFQIIRTATSGGMA

SEQ ID NO: 6423 - DNA, 693 bp, Panicum virgatum
  misc_feature: Ceres CLONE 1866394
  misc_feature: Encodes the peptide sequence at SEQ ID NO. 6424
agaggaagaagaatccagaaatcactgacactgaggcctgaccggatctgccgccctccccgtcgccagaggcaatggcgagtcccaactccggaatccccatcaaggctgaacaagattccgatggctcagcccaaagcactgtggatatgactgcttttgtgcaaaatcttctgatgcagatgcaaaccaggttccaagctatgtcggagaacatcattacaaagatagatgagatgggtttgagaatagatgaattggagcagagcatcaatgacatcaaggctgagatgggcagcgacgggatgacaacaccgtctaagacaaaagatgaaggttcaaaacctgcagacagttctgcatgaacgcaggacagcagaagaagctgatagcatcatgattcgtatcatacaccagtgttatattggtatcttaggcattcgtgactaacaaatacctgctatgaggtctcatatgagagaaggttgttactgatgtgatacttctgatgctttgtcggtttactatgatttttctgtaaactgtattcatcttcgttctgtgtggacctattggtgcatatgtacaaagcatgtacatgcatgccatgtcagctgctagaacgctagtatctggtgtttgtgacaagtatctggtgaggttcctgccttttaaaaaaaaaaaaaaaaaaaa

SEQ ID NO: 6424 - protein, 96 aa, Panicum virgatum
  misc_feature: Ceres CLONE 1866394
  misc_feature (1)..(54): Pfam Name: HSBP1 Pfam Description: Heat shock factor binding protein 1
MASPNSGIPIKAEQDSDGSAQSTVDMTAFVQNLLMQMQTRFQAMSENIITKIDEMGLRIDELEQSINDIKAEMGSDGMTTPSKTKDEGSKPADSSA

SEQ ID NO: 6425 - DNA, 1178 bp, Panicum virgatum
  misc_feature: Ceres CLONE 1866521
  misc_feature: Encodes the peptide sequence at SEQ ID NO. 6426
acccaagtcaaaacagaaacctctagctccaggccaattcctcgaccgcatcgccgaccgaccgaccgcctccatggccacctccgccgctctcgccgcgctctccgccacggccaccgccgccggcaagctcctgctcctcccgcgcccctcgtccgccgcctcctccctctccttcgcctcgcgccgcctgggcgccgcggggtccctccgggcccgcgggctccccgggtccccggtccgggccgcagcgtcgtccgcgtcggcgccccccgcggcggcggccaagaccatcgcggtcggggaccggctccccgacgcgactctctcctacttcgactcccccgacggcgagctcaagacggtgacggtgcgcgacctgacggcggggaagaaggtggtgctcttcgcggtgcccggcgcgttcacgcccacctgcacccagaagcacctcccggggttcgtcgccaaggccggggagctccacgccaagggcgtggacgccgtggcctgcgtctccgtcaacgacgccttcgtgatgcgcgcgtggaaggagagcctcggggttggcgacgaggtgctgctcctgtccgacgggaacggggacctcgcccgcgccatgggcgtcgagctcgacctctccgacaagcccgtcgggctcggcgtccggtcccggcggtacgcgctgctggccgaggacggcgtcgtcaaggtgctcaacctcgaggagggcggcgccttcaccaacagcagcgccgaggacatgctcaaggcgctctgagttgcgaccccctcctctcctcgctcgccatggtttgtgcctcccttacctgaaaaaaagttagctttcgtttctgaatgatgaataatcgttgcgtcaacgacggtggtgtcttgtgttggttgctgccgccgccgccgagagtttggtgactggcgaattctgcacacttcacctcagcgtaactactgtgtaagagttgtcatcttgatgcgaagtttctagcgaacatgatagctcctttgtgattgtgaacgtgctctgtttggcatcttctgatggcatatcactattatcagttttgtgtcgaggtgcaatggttgcagctgcactttttttgtgcaaaccaaagagggcgaccgcccagttttaatcggaaaaaaaaaaaaaaaaaaaa

SEQ ID NO: 6426 - protein, 235 aa, Panicum virgatum
  misc_feature: Ceres CLONE 1866521
  misc_feature (1)..(161): Pfam Name: Redoxin Pfam Description: Redoxin
  misc_feature (2)..(235): SWISSPROT Homolog: EC 1.11.1.15 Peroxiredoxin-2E-1, chloroplast precursor
  misc_feature (3)..(235): SWISSPROT Homolog: EC 1.11.1.15 Peroxiredoxin-2E-2, chloroplast precursor
MATSAALAALSATATAAGKLLLLPRPSSAASSLSFASRRLGAAGSLRARGLPGSPVRAAASSASAPPAAAAKTIAVGDRLPDATLSYFDSPDGELKTVTVRDLTAGKKVVLFAVPGAFTPTCTQKHLPGFVAKAGELHAKGVDAVACVSVNDAFVMRAWKESLGVGDEVLLLSDGNGDLARAMGVELDLSDKPVGLGVRSRRYALLAEDGVVKVLNLEEGGAFTNSSAEDMLKAL

SEQ ID NO: 6427 - DNA, 639 bp, Panicum virgatum
  misc_feature: Ceres CLONE 1867381
  misc_feature: Encodes the peptide sequence at SEQ ID NO. 6428
gcttcattcagctgagtgtgctcgatcatcaagcaatcaacaaagcctcccaattatcttttcatcagatcatcttccttcttccaagatgtcttgcagctgcggatcaagctgcaactgcggctccaactgcaagtgcagcaagatgtaccctgaccttgaggagaagagcagcggcggcgctcaggccaccatcgtcctcggcgtgaccccggagaagaaggccggccagttcgaggcagcggcggagtccggcgagaccgcccacgcctgcaagtgcggtaacagctgcagctgcgacccctgcaactgctgatttcgatggggaacatcagaacacacctgcatgcatgctagctactacctactactctgcttgtgtgtgacgatgattgaacaagaataaggatgagcctgagccatcatgtctcatggatcggtttggctccggcctcatcgagcatgcatgcgtctgcccctgtgtgtgctttgctaccttcccttaccctgtgctgcttggcgtccgtcctgtgtctgtatgtgttgatcattgcaaataaaccatgcaggcatacatctctgcatgtgtctctgtaatgatcggtccagagtgatgaatatataaaactggtttgcttt

SEQ ID NO: 6428 - protein, 75 aa, Panicum virgatum
  misc_feature: Ceres CLONE 1867381
  misc_feature (1)..(74): Pfam Name: Metallothio_2 Pfam Description: Metallothionein
MSCSCGSSCNCGSNCKCSKMYPDLEEKSSGGAQATIVLGVTPEKKAGQFEAAAESGETAHACKCGNSCSCDPCNC

SEQ ID NO: 6429 - DNA, 1003 bp, Panicum virgatum
  misc_feature: Ceres CLONE 1867419
  misc_feature: Encodes the peptide sequence at SEQ ID NO. 6430
acagtatctgcaagccgcgtcgccgagccagtcatgcgtatcttcgtgctctccggccagagcaacatggccggccgcggcggcgtgcatcatcggcgctgggacggcgtggtgccgccggagggcacgccggacccgtccatccagcgcctctccgcctcgctggactgggaggaggcccgggagccgctccacgccgacatcgacaccacgaagacctgcggcgtcgggcccgggatggtcttcgcccgcgctgtgctcccgtgcctgcaggaggacgccctcggcgaggggggccggaccgggatcgggctcgtgccgtgcgccgtcggcgggacggctatccgggagtgggctcgcggggagcgcctgtacgagcagatggtgtgccgggcgcgcgtcgtggccgggtacggcgagatcgaggccgtgctgtggtaccagggggagagcgacgcggagtctgacgccgcaacggcggcgtaccgccggaatatcgaggggctcatcgccaatgtcagagcggatcttgggatgccggagttgccttttattcaggttgctcttgcatccggcgataaaaggaacattgacaaagtgagaagtgctcaatttagcgttaacctgcccaatgttgtaactgttgatgcaatgggtcttgcgttgaacgaagataacatgcatcttaccactgagtcacaagtaaagcttggtaacatgcttgcagaagcctacatcaagaacttcttaacaacttgttaggtgaatgccattaggctgttccttcttcaatccacagtgaatatgtttgacaaaggcactgcagtacaagacagcaagacaattatgtgctcgagatcctaatcaaatgatattcgggagttcaccctagaggctcaaaactcatgtagtgtataatatttcaaattcagttcataacgtttccctccatatataaaataattgctacccgtttagtttcgaaaaaaaaaaaaaaaaaaaa

SEQ ID NO: 6430 - protein, 242 aa, Panicum virgatum
  misc_feature: Ceres CLONE 1867419
  misc_feature: Great-hit functional homolog of the protein sequence encoded by LOCUS At4g34215
  misc_feature: Useful for making plants with altered cell wall content and/or composition
MRIFVLSGQSNMAGRGGVHHRRWDGVVPPEGTPDPSIQRLSASLDWEEAREPLHADIDTTKTCGVGPGMVFARAVLPCLQEDALGEGGRTGIGLVPCAVGGTAIREWARGERLYEQMVCRARVVAGYGEIEAVLWYQGESDAESDAATAAYRRNIEGLIANVRADLGMPELPFIQVALASGDKRNIDKVRSAQFSVNLPNVVTVDAMGLALNEDNMHLTTESQVKLGNMLAEAYIKNFLTTC

SEQ ID NO: 6431 - DNA, 570 bp, Panicum virgatum
  misc_feature: Ceres CLONE 1867447
  misc_feature: Encodes the peptide sequence at SEQ ID NO. 6432
aaaaagaaatggtgtcgtcgtctcgacgcagcaccataggagggagggcgccacgatgctgagccccgcgctggcgtgctgcaagctctacatctccgaggcccgcaacgcgccggcgctgcgcgccatcgagcgcgccgcggcggggctccgtccggcggccgtgctcgtcaacgcgttcgccgacgacgcctacaaccgtgtcggctacacgctcgtctccccactagcgggcgccggcggtgactcggccccgccaccgctgcatcgcgcggcgttcggcgtggtcgcggcggcgctcgaggccgtcgacttcggcgtccacgccggcgcgcacccgcggctcggcgtcgtcgaccacatcgccttccatcccctggccggcgcccacctcgacgacgttgccgcgctcaccagggccgtggcggctgacatcggagacaagcttcaaggttactctgtccttcccaatcacccgaaatgtgattagcgcattgataaacttctcatggatgactgttcttaacaagaaattcaacaacaaaaaaacatcttttatgctataattac

SEQ ID NO: 6432 - protein, 144 aa, Panicum virgatum
  misc_feature: Ceres CLONE 1867447
  misc_feature (2)..(125): Pfam Name: FTCD_N Pfam Description: Formiminotransferase domain, N-terminal subdomain
MLSPALACCKLYISEARNAPALRAIERAAAGLRPAAVLVNAFADDAYNRVGYTLVSPLAGAGGDSAPPPLHRAAFGVVAAALEAVDFGVHAGAHPRLGVVDHIAFHPLAGAHLDDVAALTRAVAADIGDKLQGYSVLPNHPKCD

SEQ ID NO: 6433 - DNA, 551 bp, Panicum virgatum
  misc_feature: Ceres CLONE 1867461
  misc_feature: Encodes the peptide sequence at SEQ ID NO. 6434
cccatctcatcgatcgagccagccatccatccatccatccatccagccagccgcctctcctcgcctgctgcgcgcgtctctctgctctcctagggagatctcgcgcagcccggaaacccgtcgacccagctcgtcgtcgtcgcagatggccggcctcaggatgaagttcgtcgccgccgccgccgtggccgccgcgctcgtggcgtccgccgccgccgccatcgaggcccccgccccggcgcccgcctccgacgccgccgccgcggtgcccctcgcggcggcgtccctcgccgccgccgccttcggctacctcttctgctagaaccatcggccgttccccgtgggtcctgctgatatgatgattcgttttggcgtgagtcgagtccgtgtccgtggcgtgtcgggaggatgtcggtgggcgtgtgtatgtacgagttcggcggcggtgggggtggtgtgcgagcggtgggggcgtgcgtcgacgcgccgttctctgtggcgtcgatcatgtactcactccgtttctggttattgatgagttcatttatttg

SEQ ID NO: 6434 - protein, 58 aa, Panicum virgatum
  misc_feature: Ceres CLONE 1867461
  misc_feature: Great-hit functional homolog of the protein sequence encoded by LOCUS At4g26320
  misc_feature: Useful for making plants with altered cell wall content and/or composition
MAGLRMKFVAAAAVAAALVASAAAAIEAPAPAPASDAAAAVPLAAASLAAAAFGYLFC

SEQ ID NO: 6435 - DNA, 637 bp, Panicum virgatum
  misc_feature: Ceres CLONE 1867518
  misc_feature: Encodes the peptide sequence at SEQ ID NO. 6436
ctgcccagccggggtccgcgcgcgcggacgcggtcacgctccggccgttcgacctcgccgacgtcgacgccatgatggcgtgggcgtcggaccccgtggtcacggcgttcatgacgttggacgcctacacgtcccgggaagccctgctcgccttcatgcgcgacgccgtgctgccgcacccctggttccgcgccgtctgcctcggcggcggcgagcccgtgggcgcggtgtccatgacgccgacggacgaccggtgccgcgccgagctctgcgtcgtgctggcgcgcgcgcactgggggaagggtgtggccacggcggccctgaagcgcgcggtcgccacggtgttcggcgacctcgacggcgtggagcgcgtcgaggcgctcgtggacgccgacaacgcggcctcgcagcgggcgctcgagaaggccgggttccagcgggaagccgtgctgcggagctactgcgtggtcaagggaaggctcagggacatggtgatctacagcttcatctccaccgaccctctcgtagactgatccagaaaaggttagctgctcatgtacctagagatttcacaacatggttggattggatgacccaaagtcttgcaaaagaaactatatggcattgcagcttgcag

SEQ ID NO: 6436 - protein, 153 aa, Panicum virgatum
  misc_feature: Ceres CLONE 1867518
  misc_feature (2)..(78): Pfam Name: Acetyltransf_1 Pfam Description: Acetyltransferase (GNAT) family
MMAWASDPVVTAFMTLDAYTSREALLAFMRDAVLPHPWFRAVCLGGGEPVGAVSMTPTDDRCRAELCVVLARAHWGKGVATAALKRAVATVFGDLDGVERVEALVDADNAASQRALEKAGFQREAVLRSYCVVKGRLRDMVIYSFISTDPLVD

SEQ ID NO: 6437 - DNA, 907 bp, Panicum virgatum
  misc_feature: Ceres CLONE 1867799
  misc_feature: Encodes the peptide sequence at SEQ ID NO. 6438
atccacggtcgagccagcagcagctcggctcagctaatcgcctcaccttcggacgggaccagcgctagctatagcctagctagccagcgagcgatggcgggcaacagggcggccggcgtcgtcctcctggcggtggccgcgctcctcgccctggcggcggcggatgatgagcacctgcaccactggaggtgcttcaggtcgtgcgcgagggactgccgagacgaggacgccgttgacgacggcgccggcgccctcaacaacgtctccgccggcgtcccccacaagtgcaagaccgggtgcctgcacgagtgcttcgaggacctgccggcactctgctaccagcagtgcgtcgtcagcacctgcctctgcctgccgccctatagcaaggagaagctggcgtgcatgaagagctgctgcgacaagtgcttccaccacggcccgcctgcgcccggccccggcccgaagcccaagccgccgccgcccagcccgaagccacctgccccgaagccgcccaacccgaagccgcctgccccgaagccgcccagcccgccgaagccgaagccaccaacgccgaagccgaagccaccgtcgcccaaggggccgctgccgccgaagaagccgccgtgtccccccggccgcgagaccgcgaacgccaacaactgatacggtgggcccgccgccggcgagaataacacgtcgtagtattgacgtcgtgcgatcaagtatggcatgcgtcgtcgtatatgtgtacgcagtgcgagtccgaattaattgcggctgccgctggtaatatatataataaggataagaaatgatatgtctccccgtcgatgtaaaccgggcatataaactgtatgaatcaaaatacactcgatcctcaagtattcaaaaaaaaaaaaaaaaaaaa

SEQ ID NO: 6438 - protein, 189 aa, Panicum virgatum
  misc_feature: Ceres CLONE 1867799
  misc_feature (71)..(150): Pfam Name: Peptidase_M10_C Pfam Description: Peptidase M10 serralysin C terminal
  misc_feature (112)..(174): SWISSPROT Homolog: EC 3.4.21.10 Acrosin precursor
MAGNRAAGVVLLAVAALLALAAADDEHLHHWRCFRSCARDCRDEDAVDDGAGALNNVSAGVPHKCKTGCLHECFEDLPALCYQQCVVSTCLCLPPYSKEKLACMKSCCDKCFHHGPPAPGPGPKPKPPPPSPKPPAPKPPNPKPPAPKPPSPPKPKPPTPKPKPPSPKGPLPPKKPPCPPGRETANANN

SEQ ID NO: 6439 - DNA, 551 bp, Panicum virgatum
  misc_feature: Ceres CLONE 1867808
  misc_feature: Encodes the peptide sequence at SEQ ID NO. 6440
accagttgcccacgatcgctgccgcccaggacagctttgcctctgcttcgtcttcctccctcctctgactctgctggactctgctcgaccttccgttccatttccccccatggtgcggcttctgctcgcgctggcgcttcttctcgtcggacggtgggccgatgcagcgacggtgaaatacaccttcccggtggggagcatgcaaatcaatcagctctgcagcacaaccagtattattgcagttaacggtcaattgccaggcccgtcgatagaagtgaacgaaggtgacgcggttgaggtcaaagtcatcaacaattcaccatacaacgtaaccatccactggtaactcctagtactactacttaaactctagaaacttctccttcgtcaccgccgccgtgttggcgatagacgcgttcttttgggaaaaataaataaatagagagataaaaaataatagggttttgtcagaaaagaaaagacagccttacagttgctgtgagttgtttgtttttcttagaaacctctgagtcgccccacgacatcaagac

SEQ ID NO: 6440 - protein, 78 aa, Panicum virgatum
  misc_feature: Ceres CLONE 1867808
  misc_feature (2)..(52): Pfam Name: Cu-oxidase_3 Pfam Description: Multicopper oxidase
MVRLLLALALLLVGRWADAATVKYTFPVGSMQINQLCSTTSIIAVNGQLPGPSIEVNEGDAVEVKVINNSPYNVTIHW

SEQ ID NO: 6441 - DNA, 635 bp, Panicum virgatum
  misc_feature: Ceres CLONE 1867965
  misc_feature: Encodes the peptide sequence at SEQ ID NO. 6442
cagttgcttccgggagcttccagcagaaaaccggggccctgaaagtgattctcggcaacgctcgctgctgcctcctcgagctatacttggagctcttcctgcccctggtacacacagatcatcgtctcacagctctccaggagtccaggatgccggagctggagccgccgttccggccgagggagaagcttctggagctgcagaggcacttccagaacgtccacaagcacacctacctcaagggccggtacgacgccgtcacgtccgtcggcatccccctcgccctggccgcctccagcttgttcctcatcggaagaggcgtctacaacatgtcccatggcatgggaaagaaggaatgaaggtctagtgttatcgtgccatcatcgattgtcatgtcagtgacttggcatctttaattagtatgctgttcgtcgtctacgcgtgcctggtatctcagtctggtgactttgttgtaaaatagttctgattttctttatgtcgagcttccgatgtggtgtactagtttgctctctcgacctgctccccataatagtttacatttacatgatgcaaaaagtctctaacgacttggataaacggttactataaaatacaaaaaaaaaaaaaaaaaaaaa

SEQ ID NO: 6442 - protein, 69 aa, Panicum virgatum
  misc_feature: Ceres CLONE 1867965
  misc_feature (1)..(54): Pfam Name: COX7a Pfam Description: Cytochrome c oxidase subunit VIIa
MPELEPPFRPREKLLELQRHFQNVHKHTYLKGRYDAVTSVGIPLALAASSLFLIGRGVYNMSHGMGKKE

SEQ ID NO: 6443 - DNA, 2144 bp, Panicum virgatum
  misc_feature: Ceres CLONE 1868103
  misc_feature: Encodes the peptide sequence at SEQ ID NO. 6444
gtcttgccgaccccccccccccccccccccccgcgccggctgccgccaccacccctcctctcccccccccccttcgtctccaccctcgccgcgcgccgattctccggcaaagggaagcttctggatctcgcatcgcccgtctcgtcacgagatggcggtggcgctgcggctccctggggtcgcgcgggggtctccggccgcgctcgccatccgcgccgccgccaagctcgggagggagcaggactcggtccgcgcctgttgcgccaggccgcctgcgcaatgctggaggcggagccggctgctggtgcgctgccagacggccgccgcggctcttctcaacaatgaggaggccacggcggcggcggcggcgcacaagccccgcacgggcttcaccgtcgtcatgaagttcggcggctcctcgctcgcgtcggccgaccggatgagggaggtggccgacctcatcctcagcttccccgaggagacgccggtcattgtcctctccgccatggggaagaccacgaataacctcctgctggctggggagaaggcggtgagctgcggcgccccgaaggcgtccgaaattcccgagctcgcggtaatcaaggacctgcatcttaggacgattgatgagcttggattagataggtcggttgtttcaggcttattggatgaattggagcaacttcttaaaggagttgctatgatgaaagagctgactcgtaggacaagagattaccttgtttcctttggtgaatgcatgtctacaagattatttgctgcatatttgaataaacttgggaaaaaggcacgacagtatgatgcatttgatatcggctttataaccactgatgatttcaccaatgcggatattcttgaagtcacttatcctgctgtggcaaagaggctaaatggagattggatggatgaccctgccattcccatagtcactggttttcttgggaagggatgtaaatcatgtgctgtcaccactttaggcaggggtggtagtgacttgactgctacaactattggcaaagctttgggattaagagaagtccaggtttggaaggatgtagatggtgtgttgacatgtgatcctaatatttatgcaaatgcgatacccgtgccctacttgacttttgatgaggctgctgaacttgcctactttggtgcacaggttttgcatcctcaatcaatgcggcctgctagggaaggtgatataccagttagagttaagaactcgtacaattgtcatgcgcctgatacagtcatcactaaagccagagatatgagcaagagtatattaaccagcattgtgttgaaatcaaatgttaccatgcttgacatagtgagcacaaggatgcttggccagtatggttttctagcaaaggtcttctcaatatttgaagatttgggcatctctgttgattgtgtcgctactagtgaagtcagcgtatcattgacactagacccgtcaaaactatggagtcgtgaattgatccagcaggaacttgatcatgttgttgaagagcttgaaaaatttgcggttgtccatctgctccagcatagatcaatcatctccctgattgggaatgtacaaaggtcatcattgattcttgaaaaggcattcaatgttctgcgaagaaatggtgttaacgtacagatgatctcacaaggggcatccaaggtgaacatttccttggtagtcaatgacagtgaggcaaaacagtgtgtgcaagccctccattcggcattctttgagaacggcttcatgtcagagattgagggagctgatgttccccagaacggcgcctctctgaattcaaaccgcgcgatctatggaaactagtggactctgcaactgtattctccccaattgtagtaccattgataggttgagtggtgattcgtagcaatttatttaggtcacccaaacgaattccttgctgttgtaagagcttaccaggaacagtttgcatggtatgccattgtttaccatgtcatcgggtgctaccaagtagtaaccaatggtcttggggatctgccaggttttcaaagcatcccccagcctatgtgtatcagaaagttgtattgcgcatgaatgttataagagttattgcactcaaaaaaaaaaaaaaaaaaaa

SEQ ID NO: 6444 - protein, 565 aa, Panicum virgatum
  misc_feature: Ceres CLONE 1868103
  misc_feature: Great-hit functional homolog of the protein sequence given in SEQ ID NO 9701
  misc_feature (1)..(284): Pfam Name: AA_kinase Pfam Description: Amino acid kinase family
  misc_feature (50)..(537): SWISSPROT Homolog: EC 2.7.2.4 Aspartokinase 3, chloroplast precursor
  misc_feature (65)..(544): SWISSPROT Homolog: EC 2.7.2.4 Aspartokinase 1, chloroplast precursor
  misc_feature: Useful for making plants with altered alkaloid content
  misc_feature: Useful for making plants with modulated nitrogen use efficiency
MAVALRLPGVARGSPAALAIRAAAKLGREQDSVRACCARPPAQCWRRSRLLVRCQTAAAALLNNEEATAAAAAHKPRTGFTVVMKFGGSSLASADRMREVADLILSFPEETPVIVLSAMGKTTNNLLLAGEKAVSCGAPKASEIPELAVIKDLHLRTIDELGLDRSVVSGLLDELEQLLKGVAMMKELTRRTRDYLVSFGECMSTRLFAAYLNKLGKKARQYDAFDIGFITTDDFTNADILEVTYPAVAKRLNGDWMDDPAIPIVTGFLGKGCKSCAVTTLGRGGSDLTATTIGKALGLREVQVWKDVDGVLTCDPNIYANAIPVPYLTFDEAAELAYFGAQVLHPQSMRPAREGDIPVRVKNSYNCHAPDTVITKARDMSKSILTSIVLKSNVTMLDIVSTRMLGQYGFLAKVFSIFEDLGISVDCVATSEVSVSLTLDPSKLWSRELIQQELDHVVEELEKFAVVHLLQHRSIISLIGNVQRSSLILEKAFNVLRRNGVNVQMISQGASKVNISLVVNDSEAKQCVQALHSAFFENGFMSEIEGADVPQNGASLNSNRAIYGN

SEQ ID NO: 6445 - DNA, 2328 bp, Panicum virgatum
  misc_feature: Ceres CLONE 1868123
  misc_feature: Encodes the peptide sequence at SEQ ID NO. 6446
gacggagcggagcagcagcagcagcaaattggaattgaatggcaccggctctcattagctggacccgtcgtagctggtggtggtcttgtagccatagcatttggaggtagccatagcattccattcctcccacagtcccacctcgtcgccttcctcctcctccctcctctctttctggtctggtctcccccaagagccctgccccgccccgccccgccccgcatggagccaggcgcgccgtggcgcgatccgcgccaggggtacgcctacggggtcggatcggcgctgcaaatgcagctacagcagagggccgacgcggccgccggcggaggggtgctcaagaggagcctcggcgagctggagaggtggcagcaccagcagcagcagcacgtcgcggcgcagcaggcgctctacctccgcgccgtgaggcagcgcaccgcggcggcggcggatatcgccgccttgctcggcgggggcccgacccagccgctggttctctccgggtccagcaacggagggggcctggcgtcgccttcgtcgacgctgtcgtcgctcaccaccgcgtcgagggcggcggtgccgctgatgcacccgcagccgcagaggcaggtgccgctcatgacgtccttgccgcagacgcaggccttcggcctgtccagggcgccgccgcctcagccggcggcgtcgagcgagctgctcattttgcaggagctcgagaagcagctgctggacgacgacgacgacgagccggtggcggcgatgagcggcaccggctccgcggtgaccaactccgagtgggaggagacgatacagcagctcaactccatcaccgccgcgccgacgcccgggctccctgcatcggcggccccgaacaataacaacggcgccaacgcggggatgacgaggtcgccttccaactcgtcgtcctccacggcctcttcctccgcgtcctgctcgccgccgaccccgggggccgcgtcgcggcagctcctgtctggagccgcggtcgctctcgccgacggcaaccacgaagcggcggccacccatctggctgccctcaagcgcgcggccaaccagcacggcgacgcggagcagcggctgattgccatgatggtggccgcgctgtcctcccgcattgtcccgaccgcctccgccctaactcaacacctcgccgagctctgcggcgccgagcagcgcgccgggtccgagctcctccacgacatctccccgtgcttccgcctcgccctccacgcagccagcgtcgccatcgtcgaagctgtgggcgaccaccgcgccatccacctcgtcgacttcgacgtcagcccgcagcagcacgcggccctcatccagtacctcgctgaccgccgcgtgccgggcacctccctgaaggtcaccgccgtcaccgacccaggctcgccgtacacgcagtctcaaactgcaacgctcgccgccatcggggagccgctgaagcagctcgccgagcgagctggcatcgagtaccgctttaaagtggtcagctgcagggctgcagagctggatgcgtccaagctcgactgcgcgcccggggaggcgctggcggtcaacctcgccttcgcgctctcgcacgtccccgacgagagcgtctctccggcgaacccccgggacgagctcctccgccgcgtccgcgcgctgagcccgcaggtggtggcgctcgtggagcaggagctgaacacgaacacggccccgctggccgcgcgcttcacggacgcgtgcgcgcactacggcgccatcctggagtcgctggacgcgacgctggggcgggagagcgcggagaagaaggccagggccgaggcggccgtggcgaggaaggcggcgaacgcggccggccgtgagggccccgaccggctggagcggtgcgaggtcttcggcaagtggcgcgcccggttcggcatggcggggttccgcccggtggcactcggcccgggcattgcggaccaggtcgccgcccgcgtcggcccggcgccgcccgggatcaccgtcaaggcggagaacggcgtgctccggctctgctggatggggcgcgtggtgaccgtcgcctccgcgtggcgctagaccgccgccgggcggagccggcagaccgccccggcgcgggcgccattattgccgccaccaaaatcgtcagttacttaattcgcgcaattcctttcctcgtttctctctttttaccttgattgggtaaggagtgatgagagtttgtcattgatctggtaaaatccatccttagctgtagcgactcataattcttataactgctcatagtagtatatggaaaagagtaagttatatcgc

SEQ ID NO: 6446 - protein, 622 aa, Panicum virgatum
  misc_feature: Ceres CLONE 1868123
  misc_feature (1)..(290): Pfam Name: GRAS Pfam Description: GRAS family transcription factor
MEPGAPWRDPRQGYAYGVGSALQMQLQQRADAAAGGGVLKRSLGELERWQHQQQQHVAAQQALYLRAVRQRTAAAADIAALLGGGPTQPLVLSGSSNGGGLASPSSTLSSLTTASRAAVPLMHPQPQRQVPLMTSLPQTQAFGLSRAPPPQPAASSELLILQELEKQLLDDDDDEPVAAMSGTGSAVTNSEWEETIQQLNSITAAPTPGLPASAAPNNNNGANAGMTRSPSNSSSSTASSSASCSPPTPGAASRQLLSGAAVALADGNHEAAATHLAALKRAANQHGDAEQRLIAMMVAALSSRIVPTASALTQHLAELCGAEQRAGSELLHDISPCFRLALHAASVAIVEAVGDHRAIHLVDFDVSPQQHAALIQYLADRRVPGTSLKVTAVTDPGSPYTQSQTATLAAIGEPLKQLAERAGIEYRFKVVSCRAAELDASKLDCAPGEALAVNLAFALSHVPDESVSPANPRDELLRRVRALSPQVVALVEQELNTNTAPLAARFTDACAHYGAILESLDATLGRESAEKKARAEAAVARKAANAAGREGPDRLERCEVFGKWRARFGMAGFRPVALGPGIADQVAARVGPAPPGITVKAENGVLRLCWMGRVVTVASAWR

SEQ ID NO: 6447 - DNA, 2267 bp, Panicum virgatum
  misc_feature: Ceres CLONE 1868182
  misc_feature: Encodes the peptide sequence at SEQ ID NO. 6448
acgcacgcccgcccgcctctccacttgtccccatccatccacccatcccccgtcacctacctggctacctcccacatcgccacccaaaaccctaaaccccgttccgtacccgccgccgcgatgcagtccctggcgctcacctccccctccctcccggcggccggccccgtccccggccgccgccgccgcctccagcgcgtccgcgccaccgccgtctccaacgagcccaagctcaacaagtacagcgcgcgcatcaccgaacccaagtcgcagggcgcctcgcaggccgtgctctacggcgtcggcctcaccgacgccgacctccgcaagccgcaggtcggggtctcctccgtgtggtacgaggggaacacctgcaacatgcacctgctccgcctcgccgaggccgtccgcgatggcgtccgcgacgccggcatggtcggcttccgattcaacaccgtcggggtcagcgacgccatttccatgggcacccgtggcatgtgctacagcctccagtcgcgcgacctcattgcagacagcatcgagaccgtcatgggcgcgcagcactacgacgccaacatctccatccccggatgcgacaagaacatgccaggtacgataatggcaatgggacggcttaatcggcctagtatcatgatatatggcggaactattaagcctggtcactttcagggcaattcttatgacatagtatctgctttccagtgctacggagaatatgtcagtggatcaatcagtgatgagcaaagaaagaacgtgctccgcaattcatgtccaggtgcaggtgcatgtggtggtatgtacacagctaacacgatggcatcggccatcgagaccatgggcatgagccttccatacagttcttcgactcctgctgaagaccctctaaagctagaggaatgccgccttgctgggaagtatcttttagaattgctaaagatggacttgaagcctagggacattatcactgagaagtcattgcgcaatgcaatggtcattgtcatggctcttggtgggtcaactaatgctgtcctgcatttgattgcaattgctcggtctgtaggtctgcatttgactcttgatgattttcagaagatcagtgaccaagttcctttccttgcggacctcaagcccagtggcaaatatgtcatggaggatttgcataagattggtgggacacctgcagcaattcattatcttctggagcaaggtcttcttgacggggattgcatgactgtcactgggaaaactctagctgaaaatgctaaaatcttccctcctctgtctgaagggcagcaaattattcggccgctggacaatcctatcaaatcaactggccatatacaaatactttatggcaatcttgcaccggaaggctctgtagcaaaaatcactggcaaagagggactgtttttctcaggcccagctttagtttttgagggtgaagaagccatgataacagctatctcagaaaaccctgcaacctttaagggaaaagtagtagtgatctgtggagaaggaccaaaaggtgggccagggatgcctgaaatgttgaccccaacaagtgcaataatgggtgctggccttggaaaggagtgcgccctgctgacagatggtagattttctggagggtcacatggatttgttgttggccacatatgtcctgaagcacaggaaggtggcccgattggtcttgtccagaatggtgatttgataaccattgatgttggtaagagggtaattgatgtcgatctgaccgaagcacagctcgaagaaagacggaggaaatggagcccaccatcgtacaaggccacccgcggagccctttggaagtacataaagctcgtggccccagcgtcgagaggatgcgtcactgatgagtagggcgtgtgttccatggtgttagtaggttgtgcacatcatgtgttgcatggctagaagactgattgtgccacgaacaatattcctgtgagtgattcatggtggctaggcttgagtgtggtcgcctaacaataaaacgtcagtttccaggaggctggcaatgctaagtaagctgctgaataatggagtgttcttggtttgttggaggcagctagtgggtaatttagcttcagatcctttctgtacactgtctgtactaccttgtacacagacacagatacaatcatgtggattgttcttgggccagctactgcctacttgagactttttgagcatcttgtgcactgacgaaaaaaaaaaaaaaaaaa

SEQ ID NO: 6448 - protein, 593 aa, Panicum virgatum
  misc_feature: Ceres CLONE 1868182
  misc_feature (1)..(523): Pfam Name: ILVD_EDD Pfam Description: Dehydratase family
  misc_feature (33)..(593): SWISSPROT Homolog: EC 4.2.1.9 Dihydroxy-acid dehydratase
  misc_feature (38)..(585): SWISSPROT Homolog: EC 4.2.1.9 Dihydroxy-acid dehydratase
MQSLALTSPSLPAAGPVPGRRRRLQRVRATAVSNEPKLNKYSARITEPKSQGASQAVLYGVGLTDADLRKPQVGVSSVWYEGNTCNMHLLRLAEAVRDGVRDAGMVGFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEYVSGSISDEQRKNVLRNSCPGAGACGGMYTANTMASAIETMGMSLPYSSSTPAEDPLKLEECRLAGKYLLELLKMDLKPRDIITEKSLRNAMVIVMALGGSTNAVLHLIAIARSVGLHLTLDDFQKISDQVPFLADLKPSGKYVMEDLHKIGGTPAAIHYLLEQGLLDGDCMTVTGKTLAENAKIFPPLSEGQQIIRPLDNPIKSTGHIQILYGNLAPEGSVAKITGKEGLFFSGPALVFEGEEAMITAISENPATFKGKVVVICGEGPKGGPGMPEMLTPTSAIMGAGLGKECALLTDGRFSGGSHGFVVGHICPEAQEGGPIGLVQNGDLITIDVGKRVIDVDLTEAQLEERRRKWSPPSYKATRGALWKYIKLVAPASRGCVTDE

SEQ ID NO: 6449 - DNA, 2043 bp, Panicum virgatum
  misc_feature: Ceres CLONE 1868200
  misc_feature: Encodes the peptide sequence at SEQ ID NO. 6450
ttcttcctccgctcaaaccttccctcacagccaagctcccgtccaacccaaaattccccaccatcactagtgtgttcttcaattctttgcacctatagttttcccagccctccagcaagccatttgagccgttcccggtccaaatccttcaccggagctgcctcaccgccgtcgccgcctgtggtgaccttgcgtggcccagtggggccgccgttgagacctaggctccggccatcccatggcccggatggcccggccagggcctcgggcgtgtttcgggggaggtgctgggtctccccagccgctggccggcaagaggaggcactgcagcggccagtcaccgtggccgcccctttctggggaggacgacagctcgacgcggcttgcgaggaggtcggcgatggcacggggcgaggcgcaggctggagggtggggtcaggcctaggagggcggatggcgaggtgctccgcgtaggtaaagatggctaccgtttttccaaaacgcctctcattggacagagtccctcggtcgtgataggccagcttcagatctgccgttccccgccggcaagcttatcgacgtacggttcatcgaccacgagcagaccccctcctacttggtcggcgtgaccgcgccgtccttcccagatctgaccacctcgtcgcatcgcatcccgcccggtccactccgacggccgcctcgtccccccttctttaaccccgccgccccgatccagccccgcgctccaccaccgtcccgggaagttcagcgccagcgccagtcagcagacctcccgccgccatggccgcggcgctcctcctcctgctggtcccgcccgtgggcctcctcgccgcgttcgccttcctggcgcgcccccgcgccgcgcgcgtcccgctcaaaggccgccacgtcctcatcacgggcgggtccagcggcatcgggctcgccatggccacggccgcggcgcgggagggcgcgcgggtctccatcctggcccgcaacctcgaccgcctcgaggaggcgcgcgccgccatccagcgcgagtccggccgcggcgacgtcggcgtccacgcggccgacgtgcgggacgcggacgccgtggcgcgcgcgctccgggaggccgggcccgtcgacgtgctggtctgcaaccacggcgtgttcgtgccgcaggagctcgagcggcaggacatggaggagatcaagtggatggtggacatcaacctcatgggcaccttccacctcattaaggccgcgctccccgccatgaaggcgcgcacccgcgagacgcgcctccctggctccatcgcgatcatgtcctcgcaggccggccaggttggtatctatgggtacaccgcgtactcagcgagcaagtttgcgcttcggggattgggggaggcgctgcagcatgaggtgattacggacaatattcatgtctcgctaatcttccctcctgacactgacactccgggtttcgaagaggagcataagaggaggccagaattgacgaacatcattgcgggttcatctgatggaatgaaggccaatgatgttgcaaagaaggctctggacggcatcaaatccgggaagtttgttgtcccctgcaactttgagggcgcaatgttggctatagccactgctggtttatccccgcagagctccccggttattgcattcctagaggtgattggtgctggactcatgcggttcgcagcgctttgtttccagtggaattggttttctaccatagagagctactatgccaagaacaagaagcgcgagtgagaacacaatacaacgtgacacaccaaaatactgtttttgttgaattcgttggagttgaaagattaaaaaatataaatcgtattgttggtaacctgatttgaatctcatgtagcgggtatgcagagtagctgtagttctgcttctcagttttagctttacctcttttagatcatggaatagatcatgtgtacaatgtagatttcagcaaaggaatgccataaaggcacaaatttcgtggattaaaaaaaaaaaaaaaaaaaa

SEQ ID NO: 6450 - protein, 326 aa, Panicum virgatum
  misc_feature: Ceres CLONE 1868200
  misc_feature (1)..(170): Pfam Name: adh_short Pfam Description: short chain dehydrogenase
MAAALLLLLVPPVGLLAAFAFLARPRAARVPLKGRHVLITGGSSGIGLAMATAAAREGARVSILARNLDRLEEARAAIQRESGRGDVGVHAADVRDADAVARALREAGPVDVLVCNHGVFVPQELERQDMEEIKWMVDINLMGTFHLIKAALPAMKARTRETRLPGSIAIMSSQAGQVGIYGYTAYSASKFALRGLGEALQHEVITDNIHVSLIFPPDTDTPGFEEEHKRRPELTNIIAGSSDGMKANDVAKKALDGIKSGKFVVPCNFEGAMLAIATAGLSPQSSPVIAFLEVIGAGLMRFAALCFQWNWFSTIESYYAKNKKRE

SEQ ID NO: 6451 - DNA, 705 bp, Panicum virgatum
  misc_feature: Ceres CLONE 1868319
  misc_feature: Encodes the peptide sequence at SEQ ID NO. 6452
  misc_feature (674)..(674): n is a, c, t, g, unknown, or other
acgccttccagtttcgacgcgctagcttccgatcccaagtcgctgcccaaccacctccgtccggtcgcgccatggaccgcggcgccacggcgacgccgcggaagccagcagccccggctgcgacgaaggaatccagggccgagatgatggcggagctggactcgccgctgcacgccctcggcttcgagatggaggagctctccccgtcggggctcgccgggcgcctcctcgtgaccccaacctgctgccagccgttcaaggtgctgcacggcggcgtgtcggcgctggtggcggaggcgctggcgagcatgggcgcgcacatggcgtccgggtaccgccgcgtggtcgggatgcagctcagcatcaaccacttccgcagcgccgccctcgacgacaccgtcctcgcgcgggccgcccccgtccacgtcggccgctccacccaggtttgggaagtaaagctctggaagatggatccatccacgggagagaagggccctcagatcgccgaatcaagagtcacgctgctgagtaacctgcccttgccggaggagcacaagaacgccggcgatgccctcaggaaatacacatcaaaactgtagaaatgggactcttcaaacggataacattcttgcaggtttcagaatatctgatgttgtaaaaaaaacattggctanccctaagagctgcaagttttcttgtgctctc

SEQ ID NO: 6452 - protein, 175 aa, Panicum virgatum
  misc_feature: Ceres CLONE 1868319
  misc_feature (1)..(78): Pfam Name: 4HBT Pfam Description: Thioesterase superfamily
MDRGATATPRKPAAPAATKESRAEMMAELDSPLHALGFEMEELSPSGLAGRLLVTPTCCQPFKVLHGGVSALVAEALASMGAHMASGYRRVVGMQLSINHFRSAALDDTVLARAAPVHVGRSTQVWEVKLWKMDPSTGEKGPQIAESRVTLLSNLPLPEEHKNAGDALRKYTSKL

SEQ ID NO: 6453 - DNA, 2253 bp, Panicum virgatum
  misc_feature: Ceres CLONE 1868416
  misc_feature: Encodes the peptide sequence at SEQ ID NO. 6454
agcattttacaataacagatcactcatacgttgagatatcaattaagctactggttctcttatattagcttgttttccagcatagtgtaacttgaattctttgacttatagccaatcatagcgatacacttatccacctagcaatttattaaggctttatcaagcaagtaatgaaagctatatacattggtttcacagcaggatgaaaatggcaaaccatgcaaggcaaataaaggtacggggcaagccaaaaacagcaagcaactagaaacgaactgaaatgaatgaaactaacgaaggaaacactacatacgctagagcatgcaaaatacatggagccatggagattgcgtctcacctcgatgaagttggagcagagccgtccgccgactccgcgaccgatagaattctgatccagccggtgtgtcttctcgaatgtgtagaaccgactttgaaacccgcgtcctcactgaggagtgcctacgtactttcttcatagaagaaagatcagggttgctttcgtagttctttttttatcctccccccttctccatttaacgtctgttatcctcctcccttctccatttaacgtcagttagttagtagcttgacttgattcaatggatccaattcctccattgaaggatcattaagttctaaattaattaattcatttttttttagggtatcaatcctatcattgaggaatcttttataatatttactatttcgtccatgttgccgcaaactatcaagaatcatactcaacatacttggatcatattctttaccgctttgcgggtttcggattgtatttccagaggtatcatcttgccaaagtatttggccattaactgggccagttaaacgtctaagttcttccagtatgctctcttttttttcataaatctcatttgttaagtctagaaattcctccaaaacaacccccgctccctccactccgtgtctccctctctcgccgtcgcactcgcactcacgccgccaccgccgcgttgtgatcgagcctgtggagcggcgagcgaggccggaaatgcagatggactcctacttgtacgccggcttcttccacgacgaggccgcgttctacccgcagggcgccgtgccgccctccccggagctgcccttcggcctcattgcctcgccgggggagcccgcgccgcccttccagccgccggaggcgccgaggcccgccgcgttccaggactactccgtggcggagccggagctgctggcgcaggccgtgggcgccggagagccacactacgggagctcgggcccgagcgtgaacatgcgggtggtcgacgcgctgggcgggatgggcggggaccctgtgcatgatcagacaatgggggaggagtgggaggaggagccgcggcggcagcgccagcagcagcagccggcgggcgccgccgtggagagcagccgcgggttccggcacatgatgcgggagcggcagcggcgcgagaagctgagccagagctacgccgacctctacgccatggtcgccgcccggtccaagggcgacaagaactccatcgtgcagtccgcagcgatctacatccacgagctcaagggcgcgcgggagcagctgctgcggcggaacgaggagctcaaggcgcggatcctgggccacgacgcgcggcagcagtgcgtcaaggtgcagttcgaggtggacgagccggcgtcggcgatcgactccatgatcggggcgctccggcgcctcaagggcatggacgtcagggctaggggcatccggtccaccatgtccggacgcaggctgtggacggagatgaatgtcgagaccacgattgcggccggggacgtggaaaaggccgtggaggaggctctgatgcaggaagtggagaggaaccagccgcagccgcagcctgcggaggccggcagtggcggcggcggcccaggccttccgggaaccagcgccggcgccagggggtggggcccacagacgtctccgcacgtgcaaaacgtgtttcgactcatgtgatgggacccacccgcctctctcaaagcattgagcacggatcagaggccccgtttgtttgttcattctttcgcgcaaaatggagcagagtgacgaatcgccacgtgccggaatcctggctctgtttgttgctttgtcttagtacaagtcgctgttgtttaggagaacgtatagtatacaatctcagcttgcgatcgggcatttgagcacgtgaaaaaaaaaaaaaaaaaaaa

SEQ ID NO: 6454 - protein, 323 aa, Panicum virgatum
  misc_feature: Ceres CLONE 1868416
  misc_feature (1)..(47): Pfam Name: HLH Pfam Description: Helix-loop-helix DNA-binding domain
MQMDSYLYAGFFHDEAAFYPQGAVPPSPELPFGLIASPGEPAPPFQPPEAPRPAAFQDYSVAEPELLAQAVGAGEPHYGSSGPSVNMRVVDALGGMGGDPVHDQTMGEEWEEEPRRQRQQQQPAGAAVESSRGFRHMMRERQRREKLSQSYADLYAMVAARSKGDKNSIVQSAAIYIHELKGAREQLLRRNEELKARILGHDARQQCVKVQFEVDEPASAIDSMIGALRRLKGMDVRARGIRSTMSGRRLWTEMNVETTIAAGDVEKAVEEALMQEVERNQPQPQPAEAGSGGGGPGLPGTSAGARGWGPQTSPHVQNVFRLM

SEQ ID NO: 6455 - DNA, 1501 bp, Panicum virgatum
  misc_feature: Ceres CLONE 1868449
  misc_feature: Encodes the peptide sequence at SEQ ID NO. 6456
ctcaccagttcgccccggcccggttcgctccacacccgatggccaacttccccgccactccggcggccgcggcagccaccggccaccgcgtctcgccctcgtctcgctcttccccttccctgccgcggaggacgaccgtgctgccgtcgatcggggccgccgcaggccccgctgcttcgtggtcgtggaggggagcggcggcggtggccagggccgccacgggccccgacaaagccgcaggggcaaggacaatcatcaatccaaacaacatccctgttttgtctttctctgaggttgctgaaaggcttgatactttccaagcctctggtgcaaggaatcaaaattacatggccatgtactctagtatttttggtggaataacaaaagatccttcggcaatggtgataccaatcgatgatcacatggttcatagaggtcacggggtttttgatactgcagctattatggatggtcacctctacgagttagaacagcaccttgaccgcttcctgaggtctgcattgatggccaaaataccattaccttttgatcgctcaacaattagaagcatacttattcaaactgtgagtgaatcaaactgcactcaaggatcactcagatactggttatctgttggacctggagacttccagttatcttcatctggctgcgccaacccagccctctatgctgttgttattgaaagtccatccttacaagtaccagcaggctgcaaagtggtgacatcatctataccgataaagtctccacagtttgcagtgatgaaaagcgtgaactacctgccgaatgcactcacgaaggtggaaggcgaagaaaatggtgcatttactggcatttggttggataatgagggcttcattgcagagggttccaacatgaatgttggctttgtgacggctagcaaggagcttctcatgccctgtttcgacaagatactcagtgggtgcacagcaaagcgggttctgaccctggctgagcagctagttgctgatggaaggctcagcgggataatatcaaggaatgtgagtgttcaggaagggaaggcagcggacgaaatgatgcttattgggagtggcattctggtcaaacctgttgttcagtgggatgatcagataattggctccggacaagaaggcccaatagctcatgcgctttatgacctcattcttgaggacatgagatctggtctgccatcagttcgtatccccatcccttactaaagactgtttgtacttttgcatatggccatatacgattatgcatgaacgaaggttatcagagttgcaagctcagtcatataaaatgtatatatatagcaaagaaattgggttctacagagtttccttgctagcaaatatgtccgtactttgctataggggaagacctacgaaatcttgacatcaattcatgtgaaaccattttacagggttcagtaacacttgggtaatgtttggttgactaaaaaaaaaaaaaaaaaaaa

SEQ ID NO: 6456 - protein, 400 aa, Panicum virgatum
  misc_feature: Ceres CLONE 1868449
  misc_feature (1)..(274): Pfam Name: Aminotran_4 Pfam Description: Aminotransferase class IV
MANFPATPAAAAATGHRVSPSSRSSPSLPRRTTVLPSIGAAAGPAASWSWRGAAAVARAATGPDKAAGARTIINPNNIPVLSFSEVAERLDTFQASGARNQNYMAMYSSIFGGITKDPSAMVIPIDDHMVHRGHGVFDTAAIMDGHLYELEQHLDRFLRSALMAKIPLPFDRSTIRSILIQTVSESNCTQGSLRYWLSVGPGDFQLSSSGCANPALYAVVIESPSLQVPAGCKVVTSSIPIKSPQFAVMKSVNYLPNALTKVEGEENGAFTGIWLDNEGFIAEGSNMNVGFVTASKELLMPCFDKILSGCTAKRVLTLAEQLVADGRLSGIISRNVSVQEGKAADEMMLIGSGILVKPVVQWDDQIIGSGQEGPIAHALYDLILEDMRSGLPSVRIPIPY

SEQ ID NO: 6457 - DNA, 1881 bp, Panicum virgatum
  misc_feature: Ceres CLONE 1868459
  misc_feature: Encodes the peptide sequence at SEQ ID NO. 6458
accacaccagctagctcgagctcgccttgatcgatcagctccttgatctcgagctgctaagtctgctaccgcgctagccagccgacctcctaggacgccatgggcagcttggacaccaccccggccgccttctccgccttcggcgacgacgccggatcatcgttccagccgctcaaccccgaggacgtccgcgcctacctccacaaggccgtcgacttcatctccgactactacaagtccgtcgagtccctgcccgtgctccccgacgtcaagccgggctacctgcagcgcgagctgcaggccgcgccgccggcctcctccgcccccttcgacgtcgccatgaaggagctcagggccgccgtcgtcccgggcatgacccactgggccagccccaacttcttcgcattcttcccctccaccaacagcgccgccgccatcgccggcgacctcatcgcctccgccatgaacacggtcggattcacgtggcaggccaaccctgccgccaccgagatggaggtgctcgcgctcgactggctcgcgcagctcctgcgcctgccggccagcttcatgagccgcggcaccggcggcggcgtcatcctcggcaccaccagcgaggccatgctcgtcacgctcgtctcggcgcgcgacgccgccctgcgccggatcggctccgacggcgtcgctggcatcacgaggctcaccgtgtacgccgccgaccagacgcactccaccttcttcaaggcgtgccgcctcgccggcttcgacccggccaacatcaaatccatcccgacaggggcagacaccgactacgccctcgatccggcgaagctgctcgagatcatgcaggccgacgtcgccgctggcctcgtgccgacctacatctgcgccacggtcggcaccacctcttccaacgccgtcgaccctgtgggcgccatcgccgatgtcgccgccgtgttcaacgcgtgggtgcatgtggacgccgcttacgccggcagcgcgtgcatctgcccggagttccggcaccacctcgccggcgtcgagcgcgtggactccatcagcatgagcccgcacaagtggctcatgacatgcctcgactgcacctgcctgtgggtgcgcgacacgcaccggctcaccggctcgctggagaccaacccggagtacctcaagaacgacgccagcgagtccggcgccgtcaccgacctcaaggacatgcaagtcggcgtcggccgccgcttccgcgggctcaagctctggatggtcatgcgcacctacggcgccgccaagctccaggagcacatccggagcgacgttgccatggccaagatgttcgaggacaatgtcaggtccgatgacaggttcgaggtggtcgtgccgaggaacttcgcgctcgtctgtttcaggatcaagcccagtcgcggcatgacggaggaggacgccgacgaggccaaccgtgagctcatggagcgcctgaacaggaccgggaaggcgtacctggcgcacacggtggtcggcggcaagttcgtgctgcgattcgcggtggggtcgtcgctgcaggaggagaggcacgtccggagcgcgtgggagctcatcaagaagacgaccgccgagatcatgcaggagacatatgcaagtatataaaaacgaatatagtatatgttagttgattgcattgagatgttcgattctttgttgttttgctgaaataatgcttgatgccgaatgaaggcaaatatctttgttgaagagatatatgattttctaaggagggatcggagaatgtaattcttggttaataatgtttccaatgcgcatatatttaaatttgcccgcttccttgtgaaatggaatgattttctgtcagaaaaaaaaaaaaaaaaaaaa

SEQ ID NO: 6458 - protein, 512 aa, Panicum virgatum
  misc_feature: Ceres CLONE 1868459
  misc_feature (1)..(383): Pfam Name: Pyridoxal_deC Pfam Description: Pyridoxal- dependent decarboxylase conserved domain
  misc_feature (1)..(507): SWISSPROT Homolog: EC 4.1.1.28 Aromatic-L-amino-acid decarboxylase
MGSLDTTPAAFSAFGDDAGSSFQPLNPEDVRAYLHKAVDFISDYYKSVESLPVLPDVKPGYLQRELQAAPPASSAPFDVAMKELRAAVVPGMTHWASPNFFAFFPSTNSAAAIAGDLIASAMNTVGFTWQANPAATEMEVLALDWLAQLLRLPASFMSRGTGGGVILGTTSEAMLVTLVSARDAALRRIGSDGVAGITRLTVYAADQTHSTFFKACRLAGFDPANIKSIPTGADTDYALDPAKLLEIMQADVAAGLVPTYICATVGTTSSNAVDPVGAIADVAAVFNAWVHVDAAYAGSACICPEFRHHLAGVERVDSISMSPHKWLMTCLDCTCLWVRDTHRLTGSLETNPEYLKNDASESGAVTDLKDMQVGVGRRFRGLKLWMVMRTYGAAKLQEHIRSDVAMAKMFEDNVRSDDRFEVVVPRNFALVCFRIKPSRGMTEEDADEANRELMERLNRTGKAYLAHTVVGGKFVLRFAVGSSLQEERHVRSAWELIKKTTAEIMQETYASI

SEQ ID NO: 6459 - DNA, 2089 bp, Panicum virgatum
  misc_feature: Ceres CLONE 1868475
  misc_feature: Encodes the peptide sequence at SEQ ID NO. 6460
tttgagaccccagccagacgacgcgaagaccacccacgtccccaccccaccagcccccgcaattcccgcaggttgcagaagcgcccctcgccggcggcggcggcggctccggcgagcggccacgggcgcgcgcgcgtccccggaggaggcggattccgccctctgccggcgcgccgagtgggtgcggagggcccgcctcgccggcgccggcgatgggcaactcgctggggtgctcggcctccggcgagcggctcgtgtcggcggcgcgcgacggggacgccatcgaggcgcggatgctgctggagctcagcccggcgctcgcgcgctactccaccttcggcggcctcaacaccccgctccacttcgccgccgccaagggccacctcgacattgtcacgatgctgttggagaaaggtgctgacgttaacgcgcgcaactactgcggccagactgcattgatgcacgcatgtcggcatgggcactgggaggtggttcagatgcttcttctctacagatgcaatgttaccagggcagattacttgagtggccgaacggcattgcattttgccgcacatgatggatttgttcggtgtgtaaggcttttgcttgcagattttgtccctagtgtggccttggaggatattgccacttcagtagtggatggtgattgtcagacaaatggcgggagcagtcccaattcttcattggggcagaagtttaatgaacctgctcgtgtgaggtacataaacaagcctgctgatggtggtgtaacagcacttcacatggcggcattgaacggtcacttagattgcatgcagttgttgattgacttgggtgctaatgtctcagccgtcacattcccctatggcactactgcaaatttgataggagctggcagtacgccattgcattatgcagccggtggggggaagctggagtgctgtgagctattaatatcaaagggtgctagcaggttgacactcaactgtaatgggtggcttcccatggatgttgctaggatatttggacggcgctctttggagccattactttctccaaattcacactcgagtgtccctgtatttcaaccgtccagttatcttgccttgccactcatgagcatacttaacatagctagagaatttgggttgcagtatagcttaccctcagtggatgatagtgatctctgttcagtttgtctggaaaggtcttgttctgttgctgctgaaggttgcagtcatgagttctgcatcaaatgtgctctctacctttgctcaaccagcaacatccgtgttgagttcacaggcccacctggatcgatcccatgccccctctgtcggaatggaataatgtcattcaataagttgccaagcacaccaacagaagggcttaaatcaagttcatccctcacattctgtaacccatgcatactaaacacccgatctatggactcgccagccactgtctccagagctgaaatcaggcgtaaccgggtggcagctgtctcttcggagctagtctgtccaatcacttgcagccctttcccgtcgtccgccctcccaacctgcaggtgcagcgatgatgatccatgtggtgctacagaagcacaggattccgaggaccaatctccacgcccctcccacagtgcaagtatggagctggacaagaggggagaggatctcgaccggaccagctgctcaggcatgttctggagtcgaagaagctgtcacagggagcagcagtgtgatgctgagatcaacgcatgattctttatttctggttgtgaatatatttggattcgtagcagctcaatgcgggagatgagcaccagctatttttcctccccagctgtgttcttttcctatttgcagccaacattttcttgatcggtgagatcctgcagcctttgctgccgtagcgtgtgtactgtactgtaacaattttgttacaagtggtcatgtccctgtgaatctagatagcttcaaagtttctagtcagtcactgttctttgcagctgtatgtaaattacagaacttggatgaacttatttttctgattcagatgatgataaaaaaaaaaaaaaaaaaaa

SEQ ID NO: 6460 - protein, 517 aa, Panicum virgatum
  misc_feature: Ceres CLONE 1868475
  misc_feature (1)..(50): Pfam Name: zf-C3HC4 Pfam Description: Zinc finger, C3HC4 type (RING finger)
MGNSLGCSASGERLVSAARDGDAIEARMLLELSPALARYSTFGGLNTPLHFAAAKGHLDIVTMLLEKGADVNARNYCGQTALMHACRHGHWEVVQMLLLYRCNVTRADYLSGRTALHFAAHDGFVRCVRLLLADFVPSVALEDIATSVVDGDCQTNGGSSPNSSLGQKFNEPARVRYINKPADGGVTALHMAALNGHLDCMQLLIDLGANVSAVTFPYGTTANLIGAGSTPLHYAAGGGKLECCELLISKGASRLTLNCNGWLPMDVARIFGRRSLEPLLSPNSHSSVPVFQPSSYLALPLMSILNIAREFGLQYSLPSVDDSDLCSVCLERSCSVAAEGCSHEFCIKCALYLCSTSNIRVEFTGPPGSIPCPLCRNGIMSFNKLPSTPTEGLKSSSSLTFCNPCILNTRSMDSPATVSRAEIRRNRVAAVSSELVCPITCSPFPSSALPTCRCSDDDPCGATEAQDSEDQSPRPSHSASMELDKRGEDLDRTSCSGMFWSRRSCHREQQCDAEINA

SEQ ID NO: 6461 - DNA, 2043 bp, Panicum virgatum
  misc_feature: Ceres CLONE 1868581
  misc_feature: Encodes the peptide sequence at SEQ ID NO. 6462
agctggagcagagactgccgtgatggaggcagccagcaggctgaagctgggagtgggcatggacaccgtcgcctccttcgggctctcgcctctgcgccacccatcagcgtcgtcggcgagcactactactagtcgccctgcagcagccacaccgcggctgctcaagctaaagcagaggatcagcagcagagctacagccagtaactctaactcgccagcagccaggccaagatcatcgcctcgtgctaccgcgtctagtgcggcgaagacgacggcagcggagccgccgccgcagagagagaaggacctcgtcttcgtggccggcgccaccggaagagttgggtcccgagccgtaagggagctcatcaagctcggcttccgtgtccgcgctgccgtcaggaacgcgcagagggcgtcgaccctggtgcagagcgttcagcagctgaagctagacgacgacgacgacgcagctgcaatttcgcccgcggagaggcttgagattgtggagtgcgacctggagaagcagccgcaggaaggcgtcgtgaaggccataggcaatgcttcattggtggtgtgcgccattggtgccagcgagaaggagatcttggatgtgacggggccataccgcatcgactatttggccaccagcaaccttgtacaagcggcaacagctgccatggtcgagcacttcatcctggtcacgtccctgggcaccaacaagatcggcttccctgcgttcctcttgaacttgttctggggggttctgtgctggaagagacgagctgaagaagcactcatcgccagtggcatcccctacacgatcgtaaggcccggaggaatggagaggccaacggacgctttcaaggagacgcacaacctggtggtggcagccgaggacacctacgtgggtggcctcgtctccaacctgcaggtggccgagctgatcggatgcatggccaagaacaggagggcagcctactgcaaggtggtggaagtggtcgccgagacaaccgcgccgctgctgcccatggagcagctgctctccgccgtcccttccaagagggaaccccccgctgctccatgggaggaagcagaggaggtgaagcgaaagccaacagcagcgaaagcagcagaagggcgaccattctcaccttacatgacgtacgaggggctgaagccaccttcctccccatcccccacacttagcagggattctcttccaatcaacaagccccaacaagccgaagaagcagagccggcagcatcctcaaggacctcaagccggcccctctctccgtacactgcattcgtggacttgaagcctccaagctccccttcgccttcgccaccttcttcttcttcctcggtcacatatggatcaggcaccgcttcttcatcactagcattggactcgaatggcaacagcattcctgctggtagcagcaatccatcggatcaactgcaggggcagaatgaggtgaagaaacagaggccactttcaccatacacaaggtacgtggggctgaaacctccaagctcgccaacaccatctgtgcccaagacatagagataatgctacagttcacaaccaccagttttgctcccgtctctttaagtagctactgcaggagtgcaggtagcatcattcatgccatgcgttttcagttagagctacatatttttgagcgaagttaacaggagtgtgtgtgtgcgcgcgcgcacacgtgtgtgtgtacactactgtctaggaattggaaggttttgcctcatgtgggctcaagagaaagaagcatcttcatatatatgtatatatatatatatatgtatatatatatatatgtatatatatatgtggctgggcttgaggtggaaaagatggcaaaacatatcaaaatggggctggggctcaatgcccagaaatgcttcataaagatgaacaaaaattgatatgtgaaggatggaattgggggttcgaatccaaatgactcaaaggactaccttggttttaatggattgaagtgtgaacaagaagcatattttccc

SEQ ID NO: 6462 - protein, 514 aa, Panicum virgatum
  misc_feature: Ceres CLONE 1868581
  misc_feature (1)..(227): Pfam Name: Epimerase Pfam Description: NAD dependent epimerase/dehydratase family
MEAASRLKLGVGMDTVASFGLSPLRHPSASSASTTTSRPAAATPRLLKLKQRISSRATASNSNSPAARPRSSPRATASSAAKTTAAEPPPQREKDLVFVAGATGRVGSRAVRELIKLGFRVRAAVRNAQRASTLVQSVQQLKLDDDDDAAAISPAERLEIVECDLEKQPQEGVVKAIGNASLVVCAIGASEKEILDVTGPYRIDYLATSNLVQAATAAMVEHFILVTSLGTNKIGFPAFLLNLFWGVLCWKRRAEEALIASGIPYTIVRPGGMERPTDAFKETHNLVVAAEDTYVGGLVSNLQVAELIGCMAKNRRAAYCKVVEVVAETTAPLLPMEQLLSAVPSKREPPAAPWEEAEEVKRKPTAAKAAEGRPFSPYMTYEGLKPPSSPSPTLSRDSLPINKPQQAEEAEPAASSRTSSRPLSPYTAFVDLKPPSSPSPSPPSSSSSVTYGSGTASSSLALDSNGNSIPAGSSNPSDQLQGQNEVKKQRPLSPYTRYVGLKPPSSPTPSVPKT

SEQ ID NO: 6463 - DNA, 1612 bp, Panicum virgatum
  misc_feature: Ceres CLONE 1868661
  misc_feature: Encodes the peptide sequence at SEQ ID NO. 6464
cacctcgatttctccacgcgcaaaacgacagaggcgaatccgagccccacctccgctccgcctcgtatgcttcgcgcgtgcacgcgtgtcggcggcggcggcgtgggcgccggcggccggcgaggaggagccctcatggcctccctcatccacttccgcccttcctccgcctactcctcctctcatctcccgccccagccccagccccagtcgcggccagctcccactcccgctcccgccgccgccgccgcggcgcgcccgtcccggctccgcctcctgttcgcgcgcgccgccgcgcggcgcgaccccgagcctctgccgttcccgacggaggcgcctccggatcccgcggtcgaggagaggaggtcgctggcggtgaggacgggggagctcttcctcgggctggcggcgctgctgctgcgcgggaccggggccgtgcgcgggggcgggggcggcggggcggcggcggtggaggaggtggaggcgagggacggggtggtgtgggagcagcggcccgaggacgtggaggccgagcggcggcggcgggagctcaccagccccgggttcagcttctccgcggctgggttgctcttcccctaccacctaggcgtcgcgcagtgcctcatggacaaaggctacatcactgagagaactccgttagctggctcatcagctggtgccataatctgtgcagtgattgcatctggaaacacaatgcaagatgctctgcaggtgaccaaagatctagctgacaactgccggagtaaggggacggcatttcgtcttggggctgtgctcagggatgtccttgacaagtttctaccggatgatttgcacatcagatgcaatggaaggattcgtgttgctattactcagctatcctggaggcctaggggcttactagttgaccaatttgactccaaagaagatgtcattaatgctgtcattacatcctcttttattcctggatacttagctcccaggccggcaacatacttccgtaatcgcctatgcattgatgggggtcttacgttgtttatgccacccacttctgcttccgaaacagtccgaatatgtgctttcccagccaacagactgggtttgcaaggaattgggattagtccagactgcaatccggagaacagggctagcccaagacagctgtttaactgggctctggaaccggcggaagatgaaattctcgacaagttatacgagcttgggtacatggacgcagctgtatgggtcgagcagaaatctaccgagttgaatgcaaagaatgaaccccttgccgttgaatgaatcgaacccctttagtttgctcaaaactgctgggttcatgttcatggaagttctatacttgtagtgtattataaaggttagatttctttaggagaagtgcatgaaaagatgtcagaactggccatcagtcgttaggcatgacaacattgctggaggcaagttgatattggggtttacaggctgatcggcatattcaaatgtatatattagacgagatttgacctgagagctcgttttgtaatggtacatgggagtaatgtttgcaatttgcgggcaggcaactccaatagaaaaaaaaaaaaaaaaaaaa

SEQ ID NO: 6464 - protein, 411 aa, Panicum virgatum
  misc_feature: Ceres CLONE 1868661
  misc_feature (1)..(165): Pfam Name: Patatin Pfam Description: Patatin-like phospholipase
MLRACTRVGGGGVGAGGRRGGALMASLIHFRPSSAYSSSHLPPQPQPQSRPAPTPAPAAAAAARPSRLRLLFARAAARRDPEPLPFPTEAPPDPAVEERRSLAVRTGELFLGLAALLLRGTGAVRGGGGGGAAAVEEVEARDGVVWEQRPEDVEAERRRRELTSPGFSFSAAGLLFPYHLGVAQCLMDKGYITERTPLAGSSAGAIICAVIASGNTMQDALQVTKDLADNCRSKGTAFRLGAVLRDVLDKFLPDDLHIRCNGRIRVAITQLSWRPRGLLVDQFDSKEDVINAVITSSFIPGYLAPRPATYFRNRLCIDGGLTLFMPPTSASETVRICAFPANRLGLQGIGISPDCNPENRASPRQLFNWALEPAEDEILDKLYELGYMDAAVWVEQKSTELNAKNEPLAVE

SEQ ID NO: 6465 - DNA, 2261 bp, Panicum virgatum
  misc_feature: Ceres CLONE 1868672
  misc_feature: Encodes the peptide sequence at SEQ ID NO. 6466
gaaaggcgaagcgtcgaatcgaaatcgaggccagcgaggcggcggcgaagggggagtgccggcggcgaggggcccacgcgtcagggacagagcgggggagttcctcaccaccggcgggcgatggatatggcgccctcctcctcctcctccggtggcggcggcggcggcggcggcgccgacccgatggcgctcgtgcaggggtacacgagcgaggagctggccatcgcgggggagttcctcaccacatggctccccttcctgtccgcgggcctctgcccctcctgcgtcgagtcgctccgcggccgcgtcgactccttgctcccgcgagatgaggaatcgccgccgacgccgacgctccagatcgatcagattgagccgacggggtgggactcggatcccgcgccccagaagcacccgcctttcgagcccagcggatgggattcggatcctccgccaccgccgccgccgcagcagcagccggcgccggcggagaagccgaggatgtcgtgggcggatatggcgcaggaggacgagctcgctgcggcggcggaggaggacgcgccggccgcggcggctgatgacggggaggagggggacgaggttgggaggcccaaggtgcagctgacgagggaccagcgggaacagaggaggttcaagaacgtggtgcggaagaaggatttcatctgcctcgagagaattaatggccgcctcgtcaacatccttgagggcattgagcttcatgccggtgtattcagctcagctgagcagcggcgcattgtcgaatgcgtatatgacctccaggagagaggcaggcgtggggagcttggagatcgcacatacactgaacctcaaaaatggatgcgtggtaaaggccgggtaacaatccaatttggatgctgttacaattatgctacggataagaacggaaatccaccaggcattatacagaccattgtttctgatccaatgcctgatctctttaagactatggttaagagactggtacgatggcaagttctgccgccgacttgtgtaccagacagctgcattgtaaatatatatgaacctgcagattgcatcccaccacatatagatagccatgattttgttcggccattttgtaccgtttctttcctcagtgaatgcaacattctttttggatcaaacctgagagcttctgcccctggagaattcactggttcaattgcgatccctctccccgtcgggtctgtgcttgtcctgaacggcaatggtgctgatgtagcaaagcattgtgttccagcagtcccgaccaaaaggatatccattaccttcagaaaaatggacccagcaaagcgtccattcaattttaaagatgatcccgaactgcttaaccttacacctctagggacagttgtgcaagaaggtggcagatcatcaaatgaaggcaggagcaagctacctgatgtccaaataacaaatctgagcaatctatccagaggcaagaggtctaaaggaagaacatcttctgggaaagttggaggcggcattcttggagaccaacctcctggacatgatcaagctcctgcagtagaagttctgtcccggcaaagtctgcatggccagcgccctgtctctgcatcaagtgcagagagagaaaggagctctggcaggtggtcaagggaaccgagatatcaatctaatgctcttggcatgcaggctcaggtggatgatatcagagagtggccacatccgttgccacaagagagacggcatggcaatggtattaattccagtgaagatggtgtggaatctgtgggaaggagaccacgggtggagcatagacagatctcgttgataaaccggacaataaacgacgacatggatccccttccaatatcaagccgtgaatcaggtgaccagcctcatgctagcgggcgaaccttgtataacaagccaaggaggaccagagtaagcctggatgactgagccgtgctgaaatcttttgtggaaagagccctggacatctgaacggatatttaatctgtataatattgcattgggtgaatacaaaagcaccaaaagatagcgtagaacttctcatggtagacggcgcgtactgaatggactaggaacaaagtttgcttgcaggagtaatcaggttcttcctgctcatgtgtagataaggagtctgccggatgttgtatttttgactgatgcattggtgattgatgatgatgactcaataatttgatttgatagaaaaaaaaaaaaaaaaaaaa

SEQ ID NO: 6466 - protein, 615 aa, Panicum virgatum
  misc_feature: Ceres CLONE 1868672
  misc_feature (1)..(98): Pfam Name: 2OG-FeII_Oxy Pfam Description: 2OG-Fe(II) oxygenase superfamily
MDMAPSSSSSGGGGGGGGADPMALVQGYTSEELAIAGEFLTTWLPFLSAGLCPSCVESLRGRVDSLLPRDEESPPTPTLQIDQIEPTGWDSDPAPQKHPPFEPSGWDSDPPPPPPPQQQPAPAEKPRMSWADMAQEDELAAAAEEDAPAAAADDGEEGDEVGRPKVQLTRDQREQRRFKNVVRKKDFICLERINGRLVNILEGIELHAGVFSSAEQRRIVECVYDLQERGRRGELGDRTYTEPQKWMRGKGRVTIQFGCCYNYATDKNGNPPGIIQTIVSDPMPDLFKTMVKRLVRWQVLPPTCVPDSCIVNIYEPADCIPPHIDSHDFVRPFCTVSFLSECNILFGSNLRASAPGEFTGSIAIPLPVGSVLVLNGNGADVAKHCVPAVPTKRISITFRKMDPAKRPFNFKDDPELLNLTPLGTVVQEGGRSSNEGRSKLPDVQITNLSNLSRGKRSKGRTSSGKVGGGILGDQPPGHDQAPAVEVLSRQSLHGQRPVSASSAERERSSGRWSREPRYQSNALGMQAQVDDIREWPHPLPQERRHGNGINSSEDGVESVGRRPRVEHRQISLINRTINDDMDPLPISSRESGDQPHASGRTLYNKPRRTRVSLDD

SEQ ID NO: 6467 - DNA, 1716 bp, Panicum virgatum
  misc_feature: Ceres CLONE 1868692
  misc_feature: Encodes the peptide sequence at SEQ ID NO. 6468
gtggagcacggccacgatggcgggcgcgacggctgctggtgccgaggccggcggggcgctgggcgagacggtgcgggagctgcgggaggcctacgagggcggcaggacccggagcctggcgtggcggcaggcgcagctccggggcctcctccggctgctcaaggagaaggaggtggaggcgttccaggcgctccacaaggacctcggcaagcaccacgccgaggcctacagggacgaggtcggggtgctcatcaagtccgccaacggcgcgctgcagcagctcggcaaatggatggcgccggacagggtgtgggtgccgctgatcgcgtggccggcgaccgcgcaggtggtgccggagccgctcggggtcgtcctcatcttctcctgctggaacttcccattgggcctgtcgctggagccgctgatcggcgccctcgcggccgggaacgccgtggcgctgaagccgtcggagctctcgccgtgcaccgccaggttcctcgccgacaacatcggcaggtaccttgacgcctcggcggtcaaggtcgtcaacggcggccccgaggtcggggagcagctcatggagcaccgctgggacaaggtcctcttcaccgggagcccccgcatcgcgcgctccgtgatggccgcggcggccaggcacctgacgcccgtggcgctggagctggacggcaagtgcccgtgcatcttcgacgcggcggcggccggcgcgcgggacctgcaggtctcggcgaaccgcatcatcgccggcaagtggtcgtcctgcgccggccaggcctgcatcgccatcgactacgtgctcgtcgaggagcggttcgcgcccgccctcatcaaggtgctcaagtcgacgctcaagcggttcttccaggaaacggagcacatggcgcggatcgtgaacgagcgccacttcgagcggctgagcggcctcctcaaggacagggccgtggcgccgtccatcctgcacggcggctccgtggacgccaataacttgtacattgagcccacaatactgctgaacccgccgctggactccgcgatcatgaccgaggagatcttcgggcccctgctccccatcatcacggtgaagaagatcgaggacagcatcgcgttcgtgaaggccatgccgaagccgctggccatctacgccttcacccgggacgccgcgctgcggcgccgggtcgtggaggagacgtcgtccgggagcgtcaccttcaacgacgccgtggtgcagtacgcgatcgacgggctcccgttcggcggcgtggggcagagcgggttcgggcagtaccacgggaggcactcgttcgagatgttcagccacaagaaggcggtcatgaagcggggctacctcctggagctgacgcttaggtacccgccgtgggacgagagcaaggtcaccctcatgcgctacctctaccgcttcaactacttcgccttcgtgctcgccttcctcggcctcaggaaatgatcgatctccgctccgccgccccggcatcggcgcaagaaaattgcacgtggatttatttgaaaccaataaactgatagtgagttaatgaatgaactagtaaggtgacccgcgcatttgcgcggctagtattgttattcaaaatatatcttacatttttatttaattattatttataaatttaattttttctcctcacatgctacttgctttagtaattaagaatgattctctgc

SEQ ID NO: 6468 - protein, 488 aa, Panicum virgatum
  misc_feature: Ceres CLONE 1868692
  misc_feature (7)..(437): Pfam Name: Aldedh Pfam Description: Aldehyde dehydrogenase family
  misc_feature (17)..(488): SWISSPROT Homolog: EC 1.2.1.3 Aldehyde dehydrogenase 3F1
MAGATAAGAEAGGALGETVRELREAYEGGRTRSLAWRQAQLRGLLRLLKEKEVEAFQALHKDLGKHHAEAYRDEVGVLIKSANGALQQLGKWMAPDRVWVPLIAWPATAQVVPEPLGVVLIFSCWNFPLGLSLEPLIGALAAGNAVALKPSELSPCTARFLADNIGRYLDASAVKVVNGGPEVGEQLMEHRWDKVLFTGSPRIARSVMAAAARHLTPVALELDGKCPCIFDAAAAGARDLQVSANRIIAGKWSSCAGQACIAIDYVLVEERFAPALIKVLKSTLKRFFQETEHMARIVNERHFERLSGLLKDRAVAPSILHGGSVDANNLYIEPTILLNPPLDSAIMTEEIFGPLLPIITVKKIEDSIAFVKAMPKPLAIYAFTRDAALRRRVVEETSSGSVTFNDAVVQYAIDGLPFGGVGQSGFGQYHGRHSFEMFSHKKAVMKRGYLLELTLRYPPWDESKVTLMRYLYRFNYFAFVLAFLGLRK

SEQ ID NO: 6469 - DNA, 2389 bp, Panicum virgatum
  misc_feature: Ceres CLONE 1868783
  misc_feature: Encodes the peptide sequence at SEQ ID NO. 6470
gagttcgctcggcccatcgcgttgacttcgacgcgcgaatcgttgtggctcggattcgatcttcgccttccttagtttcccgctgttcagctgatctcctgcccagaaaagggggccgtttccggatgctggaggtggaggaggcgtgtgtgtatcctcgtgcgacgtgatctgagccggcggcgcggagctcgtggagtcgggagctgttcctcggatccggtcccggcgaggcgcccaataaagattcggcggccccgccgcgatggggaacacgtgcgtcggccccagcatcaccaagaacggcttcttccagtccgtctccaccgtgctgtggaaggcaccgcaggagggcgacgcgctgcccgccgcacccaatggccccggcgggggcagcccgggccggacgccgccgccggcgctgccgaagccggcgtccgacgtgcaggtcgcggtgcagagcaaggcgcctgagcccgtcaagatcgcaacctcccagtcggagccggcgcccaagcccgcgaagcaggacgccaagccggccgccgccgccgtcgcctctgctgccgccgccgctgccaccaaccccagctccaactcatccggcgaggcgcccaggccgcggcccaaggtgccgcaggtgaagcgcgtgtccagcgccgggctgctcgtcggctccgtgctcaagcgcaagacggagaacctcaaggacaagtacagcctggggcgccggctcgggcagggccagtttggcaccacgtacctctgcgtggagcggagcaccgggaaggagttcgcgtgcaagtccatcctcaagcggaagctcgtcaccgacgacgacgtcgaggacgtgcgccgggagatccagataatgtaccacctggccgggcacccgaacgcgatctccatccgcggcgcctacgaggacgccgtggccgtgcacctcgtcatggagctttgcgccggcggcgagctcttcgaccggatcgtgcagaggggtcactacaccgagcggaaggccgccgagctcgccagggtcatcgtcggcgtcgtcgaggtgtgccactccatgggcgtcatgcatcgggatctcaagccagagaacttcctcttcgttgaccagaaggaggaggccgctctcaagacaattgactttggtctctccattttctttcggcctggtcaaatatttactgatgttgtcggtagcccttactacgtcgcaccagaggtcctcaagaagaaatatggtcctgaggcagatgtttggagtgctggtgtaatcatttacatcttgctttgtggtgtgccaccattctgggcagagaacgagcagggtatatttgaagaggttttacatgggaaacttgatttcgagtcagagccgtggcctagcatctctgaaggcgccaaagaccttgtgagacgaatgcttattagggacccaaagaagagactgactgctcatgaagttctacggcatccatgggtccaggttggtggcctggctcctgataagccgttggattctgcggttctgtcccgcatgaaacagttctcagctatgaataagctgaaaaagatggctcttagggtgattgccgagaacctatccgaggacgagatcgccggcctgaaagaaatgttcaagatgattgacacagacaacagtgggaccatcaccttcgaagagctgaaggttgggttgaaaaaggttggcgccaatctccaggagtccgagatccaggcgctcatgcaagcagcggacgtggataacagcgggtcgatcgactacggcgagttcatcgcggcgacgctgcacctgaacaaggtggagcgggaggaccacctgttcgcggcgttccagtacttcgacaaggacggcagcgggtacatcaccgccgacgagctgcaactggcgtgcgaggagttcgggctgggcgacgtgaagctcgaggacatgatcggggaggtcgaccaggacaacgacgggcgcatagactacaacgagttcgtggccatgatgcagaagcccacgctggggctccccaagaaggccggcggcggcggcctgcagaacagcttcagcatcggcttcagggaggcattgaggatacaataaatataatatagcatcgaggagtggatgccatagccagagagagttctgctactgtttgtagattggaacgtcgactggggtgagtacagtagagctgctgtagagatgggtggtaacaacggtgaggcaggcgattggtttcgtggtaggacttgtaggagcgggcagccatgggcctgggccggagcccacggcccacatgtcactgctgaatccgggttcgattgtttgattacgtgtgaaagaaagtacagacggtttcgtgtc

SEQ ID NO: 6470 - protein, 618 aa, Panicum virgatum
  misc_feature: Ceres CLONE 1868783
  misc_feature (1)..(612): SWISSPROT Homolog: EC 2.7.11.1 Calcium-dependent protein kinase, isoform AK1
  misc_feature (139)..(597): SWISSPROT Homolog: EC 2.7.11.1 Calcium-dependent protein kinase SK5
MGNTCVGPSITKNGFFQSVSTVLWKAPQEGDALPAAPNGPGGGSPGRTPPPALPKPASDVQVAVQSKAPEPVKIATSQSEPAPKPAKQDAKPAAAAVASAAAAAATNPSSNSSGEAPRPRPKVPQVKRVSSAGLLVGSVLKRKTENLKDKYSLGRRLGQGQFGTTYLCVERSTGKEFACKSILKRKLVTDDDVEDVRREIQIMYHLAGHPNAISIRGAYEDAVAVHLVMELCAGGELFDRIVQRGHYTERKAAELARVIVGVVEVCHSMGVMHRDLKPENFLFVDQKEEAALKTIDFGLSIFFRPGQIFTDVVGSPYYVAPEVLKKKYGPEADVWSAGVIIYILLCGVPPFWAENEQGIFEEVLHGKLDFESEPWPSISEGAKDLVRRMLIRDPKKRLTAHEVLRHPWVQVGGLAPDKPLDSAVLSRMKQFSAMNKLKKMALRVIAENLSEDEIAGLKEMFKMIDTDNSGTITFEELKVGLKKVGANLQESEIQALMQAADVDNSGSIDYGEFIAATLHLNKVEREDHLFAAFQYFDKDGSGYITADELQLACEEFGLGDVKLEDMIGEVDQDNDGRIDYNEFVAMMQKPTLGLPKKAGGGGLQNSFSIGFREALRIQ

SEQ ID NO: 6471 - DNA, 1776 bp, Panicum virgatum
  misc_feature: Ceres CLONE 1868832
  misc_feature: Encodes the peptide sequence at SEQ ID NO. 6472
gttgaccgcattgcgccgccgctgcacgccaccgcgcgcaggcaggcgacaggcaggcgcctcccggcgatggccgagcggccgcggccgcggcgctccgcggaccaccggcaccgccttcgcctccgtcggctcctcgtcctcctcccgctcgccctcctcctcgccctcctctcgcagctccccgcgctcctccgccgcgccaactcactcggccgccggtgcctgcccggcgcccccgaccgcctcgtccgggacccccgcctcagcctcgccatcgtcaccctcgccgacgacggcgtgagcgggtcgcgcgggcggcggtccttccgcggcgtgctggcggccaccgcgcggaacaagcgcgcgtacgcggcggcgcaagggtaccacctcgtcgcgctccccgcgtccgccgtcgactccagccgcccgcccagctggagcaaggtcctcgcgctccgcgtgcacctccgccgccaccactggctcttctggaacgacgcggacaccctggttactaatccagaaatcctgctggagagaattttgttctcagtgataggacctagtgattttgatgactcacctgatcttgttctgacagaagatttcggtggtgtgaatgctggagttttcttcataaggaggtcaaaatggagtgagaggtttttggatacagtttggttccacaaaaagtggagataatgcagcactcaagcatctaattgaccacttatcagctgaagaaatgcaagcgcatgtccgaatagcaaaaatgcagtgcctcttcaattcctacccttgggtcctcacatggaagtcggcccactgcctcatcttccacctgcccactatatggaaaggttttcacattctcatccattctactagtctacattgccatatgtaatgtgagtttgcatttgaatgttataattcgtcatattaaattgaggacataacttcctaggagtcctttaggtttatctgccgactcttttgatagctttggcaaattgattttatagatcatttgctgcatgatactgcaagaacgatatttattaaattaagtcagtatagttttactcataaacaagaaaattgacacgtctcaagcattcgtgctgcttaccattgttctagtccttgtgtagcacatgtcggttggtacttaccacaaaattacacactacttgttatctgtcaccttacattgtcggctatccctgcattgagtctcaataaattgcaattatcacctgaactaagttttccactttgcttcttacggaagtttgtttactatcatttatggcctctatgatttgctcacatcatattggattttcaggggcttattcagatggagacttcatgattcattttgctggtttggatgacgagcaaggttggatacatgagattggagagagggaaactctaagatgagccacattaaactcatagtttaaggagaaactggaagattatgtaaagcccctgattgatctgatattcagtgttatagatatggacatatggtacagcacgccaggttgccatggtcagtagtcaaaattgcggcacctgcaaggtcaaacggggcggccagaagatgtatttttgtgtggagcccctgacctacatgttatttcaatgccaggatgccactgtaaaaacttgaagtcagtgccaactacattatctaccaaggctgagttgacttcctgtcgccagcgcaccgttgtccaaaaaaaaaaaaaaaaaaaa

SEQ ID NO: 6472 - protein, 212 aa, Panicum virgatum
  misc_feature: Ceres CLONE 1868832
  misc_feature (1)..(64): Pfam Name: Glyco_transf_34 Pfam Description: galactosyl transferase GMA12/MNN10 family
MAERPRPRRSADHRHRLRLRRLLVLLPLALLLALLSQLPALLRRANSLGRRCLPGAPDRLVRDPRLSLAIVTLADDGVSGSRGRRSFRGVLAATARNKRAYAAAQGYHLVALPASAVDSSRPPSWSKVLALRVHLRRHHWLFWNDADTLVTNPEILLERILFSVIGPSDFDDSPDLVLTEDFGGVNAGVFFIRRSKWSERFLDTVWFHKKWR

SEQ ID NO: 6473 - DNA, 1731 bp, Panicum virgatum
  misc_feature: Ceres CLONE 1868838
  misc_feature: Encodes the peptide sequence at SEQ ID NO. 6474
ccgcgccaccccaactcagctcgctcccgctgcccagccgctcgcccagccgctcgcccagccagccgatggcctcctccgccatggagctctccctcctgaaccccgccgcaatgcgccaccgcgccgccaggccctcttccgccggcctgccgctggcccgccgctccgcggtccgcttccgcgcgtcggcctccgccgcggccgccgccgcgccgcccaagccctcgggccccaagaagcggggcaagacggagatccaggagacgctgctcacgccgcggttctacaccaccgacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaagatggacggcccgctccgccagatattcgtcgagttcctcgagcgctcctgcaccgcggagttctccgggttcctcctctacaaggagctcgggcgcaggctcaagaaaaccaacccggtggtggctgagatcttctcgctcatgtccagggacgaggcgcgccatgctgggttcttgaacaagggtctgtctgacttcaacttggcgctggacctggggttcctgaccaaggctaggaagtacaccttcttcaagcccaagttcatcttctacgccacctacctgtctgagaagattgggtactggaggtacatcaccatcttcaggcacctcaaggcgaacccagagtaccaggtttaccccatcttcaagtacttcgagaactggtgccaggatgagaacaggcacggtgacttcttctctgccctgctaaaggctcagccacagttcctcaacgactggaaggccaagctctggtcacggttcttctgcctctcggtgtatgtaaccatgtacctaaatgactgccaacgcacttcattctatgaggggattggtctggacaccaaggaatttgacatgcatgtcatcattgagaccaaccgcacaacagcgaggatcttccctgctgttttggatgtcgagaaccctgaattcaagaggaagcttgacaggatggttgagatcaaccagaagatcattgccattggagaatctgacgatatccccttagtgaagaacctgaagaggattcctcttgttgccgcgctggtgtctgagatcatcgccgcgtacctcatgccccccatcgagtcaggatcagttgattttgctgaattcgagcctcagcttgtttactgattctgtagaaagatttatccctgaattattttccacgaaagacaagttggtgctttctccctgaggggctttgaatggtgaaacgctggatggttaagaggacctgcatcttcttgtgttcgtctgtaaaatattgacaacgtaaggcttggcaagcttttgttgtgtggcatctccatgcaagtgagacagtgaactgcgtcagaagtgagcgttccggttttccagcagaagggagcgtctgaactctgaagttgtactgatactgaagccaatagcatacagatcattgcctatgtccactgtatcacatatgatctttgtgaaattacttgcaacttctattcacacgcatgtgaatttggaactaagaatgatgaatgtaccaagcattattggctgataaaaaaaaaaaaaaaaaaaa

SEQ ID NO: 6474 - protein, 412 aa, Panicum virgatum
  misc_feature: Ceres CLONE 1868838
  misc_feature (3)..(412): SWISSPROT Homolog: EC 1.14.13.81 Magnesium-protoporphyrin IX monomethyl ester [oxidative] cyclase, chloroplast precursor
  misc_feature (5)..(412): SWISSPROT Homolog: EC 1.14.13.81 Magnesium-protoporphyrin IX monomethyl ester [oxidative] cyclase, chloroplast precursor
MASSAMELSLLNPAAMRHRAARPSSAGLPLARRSAVRFRASASAAAAAAPPKPSGPKKRGKTEIQETLLTPRFYTTDFDEMERLFNAEINKQLNQAEFDALLQEFKTDYNQTHFVRNPEFKAAADKMDGPLRQIFVEFLERSCTAEFSGFLLYKELGRRLKKTNPVVAEIFSLMSRDEARHAGFLNKGLSDFNLALDLGFLTKARKYTFFKPKFIFYATYLSEKIGYWRYITIFRHLKANPEYQVYPIFKYFENWCQDENRHGDFFSALLKAQPQFLNDWKAKLWSRFFCLSVYVTMYLNDCQRTSFYEGIGLDTKEFDMHVIIETNRTTARIFPAVLDVENPEFKRKLDRMVEINQKIIAIGESDDIPLVKNLKRIPLVAALVSEIIAAYLMPPIESGSVDFAEFEPQLVY

SEQ ID NO: 6475 - DNA, 1950 bp, Panicum virgatum
  misc_feature: Ceres CLONE 1868840
  misc_feature: Encodes the peptide sequence at SEQ ID NO. 6476
ggagagatatagagcagggaacagcagcccgggggtgagctgtgtgaggcttcaacaaagctaagtgaagcattcacacaccataggagtatatacacatacacatatatagacagagatcgagactcttgcaggctccatgcttgggagatgaaacttgggtgtggtggtggccgtcgatgatggcggtggcgggggagctcgcgcttgccgccctggcggcgatcctgctcgcctggctcctggccctggtgctgagccacttcctgcccttgctcctgaaccccaaggcccccaggggtagcttcggatggccgctcgtcggcgagacgctcaggttcctcgcgccccattcttccaacacgctgggcggcttcctggaggatcactgcgccaggtatgggcgggtgttcaagtcccacttgttctgcacccccacggtggtgtcctgcgaccaggacctcaaccacttcatcctgcagaacgaggagcggctgttccagtgcagctacccgaggccgatccatggcatcctgggcaagtcctccatgctcgtggtcctgggcgaggaccacgagcgcctcaggaacctcgccctcgccctcgtcacctccaccaagctaaagcccggctacctcggcgacatcgagaagatcgcgctgcacgtcgtcggctcatggcgccaggacggcggcggcggtagggtcgtcgccttctgcgaggaggcaaggaagttcgcgttcagtgtgatagtgaagcaggtgctggggctgtcaccagaggacccggtcactgccaggatactggaggacttcctggccttcatgaagggcctcatctccttccctctctacatcccagggaccccatatgccaaggctgtccaggctagagagaggatatccagcactgtgaagggcatcatcgaggagcggaggagtccagggtcatgcaagaagggcgatttccttgacgtgctcctgtcaagcaacgagctctccgatgacgagaaagtgagctttgtgctggactccctgctgggaggatacgagaccacctcgctcttgatctccatggtcgtatattttcttgggcagtctgcagaagatctggacctggtcaagagggagcacgacagcataagatccaacaaagggaaggaggagagcttgacttcagaagactacaagaagatggaatatacccaacatgttatcaacgaggctctgagatgcggcaacatagtcaagttcgtccacaggaaggccctcaaagatgtcagatacaaagagtatctgattccatctggctggaaggtcctacccgtcttcagtgctgttcatctgaacccctcgcttcatggaaatgcccaacattttcagccctgtagatgggagggctcaagccaagggacaagcaagaggtttacgccgttcggtggcgggcctcggctctgcccaggatcggagcttgctaaattagaggctgctttctttctccatcaccttgtgctcaattatagatggagaatcgatggcgatgacattccaatggcatacccgtacgtggagtttcagagaggtctgccaatagaaatcgagccaatctgccatgaatcttgacttggcctgaaggcccggtcacggcgagttcatctgttagctagaaggtacctgcacgggaaacatccatgtccatgaacggcgtgaagtttcatgaagtgaagaaacactgggcactagcttgtaagtagctagcatgaggcagctgagactgtgatttatgatgtacatgatgtagatatattttccccatggcaattgctcgaggtggttggttcacttcagtacttcaccctgtaacattctccactgtggctcaaccactgttctatacgagaagtttggactcctgggattcggaaggctttaaaaaaaaaaaaaaaaaaaa

SEQ ID NO: 6476 - protein, 480 aa, Panicum virgatum
  misc_feature: Ceres CLONE 1868840
  misc_feature: Great-hit functional homolog of the protein sequence given in SEQ ID NO 9371
  misc_feature: Useful for making plants with modulated oxidative stress sensitivity
MMAVAGELALAALAAILLAWLLALVLSHFLPLLLNPKAPRGSFGWPLVGETLRFLAPHSSNTLGGFLEDHCARYGRVFKSHLFCTPTVVSCDQDLNHFILQNEERLFQCSYPRPIHGILGKSSMLVVLGEDHERLRNLALALVTSTKLKPGYLGDIEKIALHVVGSWRQDGGGGRVVAFCEEARKFAFSVIVKQVLGLSPEDPVTARILEDFLAFMKGLISFPLYIPGTPYAKAVQARERISSTVKGIIEERRSPGSCKKGDFLDVLLSSNELSDDEKVSFVLDSLLGGYETTSLLISMVVYFLGQSAEDLDLVKREHDSIRSNKGKEESLTSEDYKKMEYTQHVINEALRCGNIVKFVHRKALKDVRYKEYLIPSGWKVLPVFSAVHLNPSLHGNAQHFQPCRWEGSSQGTSKRFTPFGGGPRLCPGSELAKLEAAFFLHHLVLNYRWRIDGDDIPMAYPYVEFQRGLPIEIEPICHES

SEQ ID NO: 6477 - DNA, 2409 bp, Panicum virgatum
  misc_feature: Ceres CLONE 1868982
  misc_feature: Encodes the peptide sequence at SEQ ID NO. 6478
catcgatagcccatccgaccttccaacctcctcctccatctccccctctcttcgcccctcctcttgtggggtgtgaccggtgtcctcccctcggggatcgattgaagctttcggctgggctgtgccgattgatgcgagggaggcaatggcggtgtcctcgccttcttctgctccggagaagaagaggaagtggctgctcagcaacaggaaggtgatcgacaagtacctgcgggaggcgagggcgattctcgcggcggcgccggaggccggcggcggggatgcggtggcggcgctcggcctggtggacgcggcgctggagctgtcgccgcggatggaggccgccttggagctaagggcgcgcgcgctcctcgcgctgcgccggtaccgggaggtcgccgagatgctccgtgactacatccccagctgcggtaaggcctgctccggcgacgacacctcgtcctcctcctcgtcggcggcggcgtcgctgctgtcctccggctccggcgacctcggcacgatctcccgtgcaaagctcctctcgccggaccgccaccgctccgacgacgccgagccggacgctcggcccgtccgttccttccgctgcttcgacatctccgagctcaagcgccgcgtccttgccggcctctccaagaaccccaacacggacacccaatggaggtacttggtcctgggccaagcttgcttccacctcggcctcatagaggacgccatggtgctgctccagactggccgccgcctcgcgtcagctgcgttccgccgagagagcgtgtgctggtccgacgacagcttctcgtcgtccgccgccgccgccgctgtcgccaccgttccgtctgggaaaacgtccaagtccggttcggcgttcattatcccggccatggaatcagaggccgtgtcccagttgctggcgcacgtcaagctcctgcttcgccgccgcgcagctgccatggccgcgctagacgccggactgccggccgaggcagtccgccatttctccaagatcctcgaggcacgccgtggcgtgctgccgcaccccttcgccgccgcgtgcctcgtcggccgcgctgctgcgttccagtctggtggccgccccgccgacgccatcgcggactgcaaccgcgcgctcgctctggacccggcatacatcccggccctccgtgcccgtgccgacctcctccagtccgtgggcgcgcttgctgattgcctccgggaccttgaccacctgaaactcctttacgatgccgcgctccgcgacggcaaactccctgggcctcggtggcggccgcagggcggcgtccggtaccgcgagatcgccggtgctcaccgcaaactgaccgcgcgcatccaggggctccgcacccgcgtcgccgccggcgaggcgtgcaacatcgactactacctgctgctgggcgtgcggcgcggctgcacgcgctccgagctggaacgcgcgcacctgctgctctccctgaagctgaagccggaccgcgccgtggtgttcggggaacgcctggagctcgtggacgagcaccgcgacctcgaggcggtgcgcgaccaggctcggatgtcggcgctgctgctgtaccggatgctgcagaagggttactcgttcgtcttgtccgccgtgctggacgaggaggctgccgagaagcagagggcgaaggacgccgccgcagccgctgctgccgccgccgccgccgcgctggcggccaagcaggaagccgcgaagcaggagccaccacaacccgtgccggagaaacccaagaacacggaggccggccgtccaaggagcccacagggccgcgcgccgaaggcgaaaccgaagcccaaggcggcggccgttccagcgatgtcgaaggcgccggcggccgtgatgtcgacggccccggtgtaccagggggtgttcggccgcgacatggcggtggtgggcaccctgctgtcccgcggcggcgggttcgaccgcgccctcccggtgaagtgcgaggcgatgagctgctgatggcacatgacacatgacacgtgcgacgtggcgtgcaccgagacggagacggatgggaacgtgtgatccagcgaggtggcgggaaaggggagatgggtttgaattgtttggtcgtccaactcgcttgttgtacagttggggaagtggaattggagtggaaggggaagggaaaaaaacggcgagaccaaaaaaaaaaagctgggatgcaagatgaggagagctagtagacggtaaattttggctgcatcttcatgaattcgagttgttacagtgctgttggttctgcccttgtacctcgccgttgttgtctcctgctgcaggcttcacgctgaaaccgctgtacagtctttttcccttgctgatggtttttactccaaaaaaaaaaaaaaaaaaaa

SEQ ID NO: 6478 - protein, 622 aa, Panicum virgatum
  misc_feature: Ceres CLONE 1868982
  misc_feature (1)..(61): Pfam Name: DnaJ Pfam Description: DnaJ domain
MAVSSPSSAPEKKRKWLLSNRKVIDKYLREARAILAAAPEAGGGDAVAALGLVDAALELSPRMEAALELRARALLALRRYREVAEMLRDYIPSCGKACSGDDTSSSSSSAAASLLSSGSGDLGTISRAKLLSPDRHRSDDAEPDARPVRSFRCFDISELKRRVLAGLSKNPNTDTQWRYLVLGQACFHLGLIEDAMVLLQTGRRLASAAFRRESVCWSDDSFSSSAAAAAVATVPSGKTSKSGSAFIIPAMESEAVSQLLAHVKLLLRRRAAAMAALDAGLPAEAVRHFSKILEARRGVLPHPFAAACLVGRAAAFQSGGRPADAIADCNRALALDPAYIPALRARADLLQSVGALADCLRDLDHLKLLYDAALRDGKLPGPRWRPQGGVRYREIAGAHRKLTARIQGLRTRVAAGEACNIDYYLLLGVRRGCTRSELERAHLLLSLKLKPDRAVVFGERLELVDEHRDLEAVRDQARMSALLLYRMLQKGYSFVLSAVLDEEAAEKQRAKDAAAAAAAAAAAALAAKQEAAKQEPPQPVPEKPKNTEAGRPRSPQGRAPKAKPKPKAAAVPAMSKAPAAVMSTAPVYQGVFGRDMAVVGTLLSRGGGFDRALPVKCEAMSC

SEQ ID NO: 6479 - DNA, 2018 bp, Panicum virgatum
  misc_feature: Ceres CLONE 1869042
  misc_feature: Encodes the peptide sequence at SEQ ID NO. 6480
actgcgaccagcagctagctccgcatccaagtgcgcagcaagggcagtgagggcgagggcgccatggcgcgggagcaggcgctgctgtcgacggagatcgtgaaccgcggcgtggagccgtcgggcccggacgccgggtcgccgaccttctcggtgcgcgtgcggcgccggctgccggacttcctgcagtcggtgaacctcaagtacgtgcgcctcgggtaccactacctgatcagccacggcgtgtacctggccaccatccccgtcatcgtgctggtgtgcggcgcggagctgggcagcctcagccgcgacgagctgtgggccaaggtgtggggggaggccacctacgacctcgccaccgtgctcgccttcctcgccgtcctcgctttcaccatctccgtctacatcatgtccaggcccaggcccgtctacctcatcgacttcgcctgctacaagcccgccgacgagctcaaggtgtccaaggcggagttcatcgacctggcgcgcaagtcgggcaagttcgacgaggagagcctggcgttccagtcgcgcctgctggccaagtccggcatcggcgacgagtcgtacatgccgcgctgcgtgttcgagcccaacgccaactgcgccaccatgaaggagggccgcgcggaggcctccacggccatgttcgcggcgctggacgagctcttcgacaagtgccgcgtccgccccaaggacgtgggcgtgctggtggtgaactgcagcctcttcaacccgacgccgtcgctgtcggccatgatcgtcaaccactacaagatgcgcggcaacatcctgagctacaacctcggcggcatgggctgcagcgccggcgtcatcgccgtcgacctggcccgcgacatgctgcaggccagcggcgccgggctggccgtggtggtgagcacggaggccgtctccttcacgtggtacccggggaagcggcggtcgatgctcatcccgaacgccttcttccgcgccggctgcgccgccgtgctgctgtcgaaccggcggcgcgacttccaccgcgccaagtaccagctggagcacgtggtgcgcacgcacaagggcgccgacgaccgcgccttccggtcggtgtaccaggaggaggacgagcagcggatcaagggcctgtccatcagccgcgacctgctggaggtgggcgggcacgcgctcaagaccaacatcaccacgctggggcccctggtgctgcccttctcggagcagctgctcttcttcgcgggggtgctgttccgccacctgttcccggcgtcctccaaggcggcggccgccgctccgccgccgggggagggggaggaggcctccgctgcggcgccctacatcccggacttcaagcgcgcgttcgagcacttctgcatgcacgcggcgagcggcgacgtgctggagcacctgcaggccaacctgggtctgcgcgacgccgacctggaggcctcccgcgccgcgctgcaccgcttcggcaacacctccagcagcagcatctggtacgagctggcctacctcgaggccaagggccgcgtccgccggggcgaccgcgtctggcagctcgccttcgggtccggcttcaagtgcaacagcgccgtgtggcgcgccgtccgccgcgtgcgccgcccggcgcgcagcccgtggctcgactgcatcgaccagtacccggcgcgcatggacgcctagctagacccaataaataagcgacgatgatgatggatcatctatcgtaggacgcgatcgagtctcgcaggcactaaagtgttgttgctgcttaaggaaggtacgttcgagctttggtttgtgttgcttgtttatttagcggttattaagggagaaagaaagacacagtccctaactggtaccataatgtgatgcgtgcactggaacggaagttgggctgtgtgtgaacttattatgtatgtgcaatttttaatctgtttaagagtacgttggcaatatctagatgatgttgctgttatcaaaaaaaaaaaaaaaaaaaa

SEQ ID NO: 6480 - protein, 545 aa, Panicum virgatum
  misc_feature: Ceres CLONE 1869042
  misc_feature (1)..(291): Pfam Name: FAE1_CUT1_RppA Pfam Description: FAE1/Type III polyketide synthase-like protein
  misc_feature (31)..(410): SWISSPROT Homolog: EC 2.3.1.- 3-ketoacyl-CoA synthase 1
  misc_feature (35)..(410): SWISSPROT Homolog: EC 2.3.1.- 3-ketoacyl-CoA synthase 11
MAREQALLSTEIVNRGVEPSGPDAGSPTFSVRVRRRLPDFLQSVNLKYVRLGYHYLISHGVYLATIPVIVLVCGAELGSLSRDELWAKVWGEATYDLATVLAFLAVLAFTISVYIMSRPRPVYLIDFACYKPADELKVSKAEFIDLARKSGKFDEESLAFQSRLLAKSGIGDESYMPRCVFEPNANCATMKEGRAEASTAMFAALDELFDKCRVRPKDVGVLVVNCSLFNPTPSLSAMIVNHYKMRGNILSYNLGGMGCSAGVIAVDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPASSKAAAAAPPPGEGEEASAAAPYIPDFKRAFEHFCMHAASGDVLEHLQANLGLRDADLEASRAALHRFGNTSSSSIWYELAYLEAKGRVRRGDRVWQLAFGSGFKCNSAVWRAVRRVRRPARSPWLDCIDQYPARMDA

SEQ ID NO: 6481 - DNA, 1845 bp, Panicum virgatum
  misc_feature: Ceres CLONE 1869072
  misc_feature: Encodes the peptide sequence at SEQ ID NO. 6482
atctctctctactttctctctctaccgctcctcgtgacgtcgcgtgcccacgtctcccacgccttcccgaccccccgtctctcctcctccagatccggtctcctcagccgccgccgatgtccgaggatctagcgggatcccgccgctggcggtgcgacctcggcggcgacgaccgctggctgtcgggggccgccggcgacgaccacttcgaccgcctccccgacgcgctcctcctcgtcatcttcaaccgcatcggcgacgtcaaggcgctcggccgctgctccatcgtctcccgtcgcttccacgagctcgtccccctcgtcgactccgtcctcgtccgcgtagactgcgtcatccccgacgagcccccttcctcctcgccgtccgcgccgtcctcccccacggcctccgtacgcgcccgcggggtcttctcgcagatcgcgcgcatcgtgctcggcggcatcgtgaagcccatccaggcgctcggccagatactctcaccggcccactctgcctccggcttttcagcatcctccgcttcctcgtcgtcatccttccccccatcttcgacgccgtactcgccgttgcctcctggggacgtgtcgcaccactcgccctcggaggtactccgctccttcaaggagctccgccaccttcgcattgagcttccggcgggcgagcttggcacggacgacggcgtgatgctcaagtggaaggctgactttgggtccacgctcggcagctgcgtcatcctcggcgcatcctcggcctcgccgtcccctgctggctcaaatggcgcgagcacagctccctctgttgacagtggccgcagcgagcccgaggaatgtgacgattcaggaagcatcccggaatccttctatacaaatggggggctgaggctgcgggtcgtgtggacaatcagctcgctgattgcagcagcagggaggcattacttgctgcagccaatcgttgctgaccacacaacgctggaaagattggacctgacggacgcagatgggcagggagtgctcaccatggacaagtgccaactgcaggagctgcgggtgaggccggtatcatcatctgcggcctcgcaccggaccctcatgccggagcttagcatgtggctgtggtacgcgccatgcattgagctgcctggggggttggtgctaaatggtgcgacattggtggccatcaagccgagcgaggaggcaacaagggacatggtagggaatggggctgctacggctgcctgggttttagatgcattcgaggagccataccgaacagcagcgaggatgcttctcaagcggaggacttacacccttgagatgaattcattctaatccatagaggaggtggcattttggaagcttcatatatgagaggattttatacctacaggggtcatttctggctgcctttttatgcccaatctgcacctattttggatgtgctccaattgtgttggatgcattcctttctgtgctgagcacctgccagcattccagcaagaacatggatggatatgaagagaatctgtgctttaatttatcgatgaaagagtcaagccattgttgagctgatggtgtttgctctgatggaactcccaatcactgagattagatgtggtggcatagatattttttttctgatatgtatccacatcaaggaactaaccttatgcaatttctgctttggatcgcactgcttgtttgcataatagcatccaatctgccctgtaaatcaacatgtgtcatgagtcatgagtgtattcatatatcggactggagttagcaaaagctgaaaactggtgatagtactcaaaaaaaaaaaaaaaaaaaa

SEQ ID NO: 6482 - protein, 409 aa, Panicum virgatum
  misc_feature: Ceres CLONE 1869072
  misc_feature: Great-hit functional homolog of the protein sequence given in SEQ ID NO 9404
  misc_feature: Useful for making plants with modulated low light sensitivity
MSEDLAGSRRWRCDLGGDDRWLSGAAGDDHFDRLPDALLLVIFNRIGDVKALGRCSIVSRRFHELVPLVDSVLVRVDCVIPDEPPSSSPSAPSSPTASVRARGVFSQIARIVLGGIVKPIQALGQILSPAHSASGFSASSASSSSSFPPSSTPYSPLPPGDVSHHSPSEVLRSFKELRHLRIELPAGELGTDDGVMLKWKADFGSTLGSCVILGASSASPSPAGSNGASTAPSVDSGRSEPEECDDSGSIPESFYTNGGLRLRVVWTISSLIAAAGRHYLLQPIVADHTTLERLDLTDADGQGVLTMDKCQLQELRVRPVSSSAASHRTLMPELSMWLWYAPCIELPGGLVLNGATLVAIKPSEEATRDMVGNGAATAAWVLDAFEEPYRTAARMLLKRRTYTLEMNSF

SEQ ID NO: 6483 - DNA, 2039 bp, Panicum virgatum
  misc_feature: Ceres CLONE 1869121
  misc_feature: Encodes the peptide sequence at SEQ ID NO. 6484
gcgctcacggccgcattaccgcggagatcgagagacaagagagggaagggcggcgactctgccggctgaagccttctcctctcctctcctctccgtcgccgcctccctgctccacccccggaaactaatccctcacctgaatggggacatcggcggcggagcccaatgctgcccccgcgccgccggctgcggagccggcgcagccgcggcggcggatgccggacttccagcagtcggtgcggctcaagtacgtgaagctggggtaccactacctcatctcccacggcatgtacctgctcctgtcgccgctcatggcgctcgtcgccgtgcagctctccaccgtctccccgcgcgacctcgccgacctgtgggagcagctccgcttcaacctcctctccgtggtcgcctgctccacgctgctcgtcttcctttccacggtctacttcctcacccgcccgcgccccgtttacctgctcgacttcgcctgctacaagccggagccggagcgcaagtgcacgcgcgagaccttcatgcactgctccaagctcaccggctccttcaccgacgagaacctcgagttccagcgcaagatcctcgagcgctccgggctcggcgaggacacctacctgccccccgccgtgctccgggtgccccccaacccgtgcatggacgaggcccgcaaggaggcgcgcgccgtcatgttcggcgccatcgatcagctgctcaagaagaccggggtcaggcccaaggacattggcgtcctcgtggtcaactgcagtttgttcaacccaacgccgtcgctgtcagccatggtggtgaaccattacaagctgagggggaacattgtcagctacaacctcggcgggatgggctgcagcgccgggctgctgtccatcgacctcgccaaggatctgctgcaggtgcatcccaattcgtacgccttggtgatcagcatggaaaacatcacgctgaattggtactttgggatcaaccgatccatgctcgtgtcgaattgcctgttccggatgggtggcgctgccatccttctctcgaacaagcggtccgacaggcggaggtccaagtacgagctggtgcacacggtgcgcacgcacaagggtgccgacgacaagtgcttcggctgtgtgactcaggaggaggatgagattggcaagatcggcgtgtcgctgtccaaggatctcatggcggtcgccggtgatgccctcaagaccaacatcaccacgctggggccgctggtgctcccgttgtcggagcagctcctcttcatggccacattggttgccaagaaggtgctcaagatgaagatcaagccgtacatccccgacttcaagctggccttcgagcacttctgcatccacgccggcggccgcgcggtgctggatgagctggagaagaacctggagctcaccgactggcacatggagccatcgaggatgaccctgtacaggttcggcaacacgtcgagcagctcgctctggtacgagctggcgtactccgaggccaaggggaggatcaggaagcgcgacaggatctggcagatcgctttcgggtccgggttcaagtgcaacagcgccgtctggaaggcgctccggactgtgaacccggccaaggagaagaacccctggatggatgagattgacaacttcccggtggatgttccaaggatctcaaaggttggcaacgcatgaaggacgctttgctgttcccaggtggcaagtggagttggtcatcttcaggtgccagggcagaggtttacgcttatgatcatcccatcgttcgcgccgtcagttcttgttttcagttgtggcatggcatctgtgtgggggcacttgaagtaggcaatttgattaggtagtgggtgtgatttcttcgctagggttgcctgaatgtctgatatgtcatatgtccagtttattcagattggggaaagcaattgcttttcagtaacggtgtcacattctttgccgcctgattgagatgtctcaattgcaggcccagctgaaacttgaattcccctgtcc

SEQ ID NO: 6484 - protein, 521 aa, Panicum virgatum
  misc_feature: Ceres CLONE 1869121
  misc_feature (1)..(288): Pfam Name: FAE1_CUT1_RppA Pfam Description: FAE1/Type III polyketide synthase-like protein
  misc_feature (23)..(512): SWISSPROT Homolog: EC 2.3.1.- 3-ketoacyl-CoA synthase 1
  misc_feature (24)..(518): SWISSPROT Homolog: EC 2.3.1.- 3-ketoacyl-CoA synthase 11
MGTSAAEPNAAPAPPAAEPAQPRRRMPDFQQSVRLKYVKLGYHYLISHGMYLLLSPLMALVAVQLSTVSPRDLADLWEQLRFNLLSVVACSTLLVFLSTVYFLTRPRPVYLLDFACYKPEPERKCTRETFMHCSKLTGSFTDENLEFQRKILERSGLGEDTYLPPAVLRVPPNPCMDEARKEARAVMFGAIDQLLKKTGVRPKDIGVLVVNCSLFNPTPSLSAMVVNHYKLRGNIVSYNLGGMGCSAGLLSIDLAKDLLQVHPNSYALVISMENITLNWYFGINRSMLVSNCLFRMGGAAILLSNKRSDRRRSKYELVHTVRTHKGADDKCFGCVTQEEDEIGKIGVSLSKDLMAVAGDALKTNITTLGPLVLPLSEQLLFMATLVAKKVLKMKIKPYIPDFKLAFEHFCIHAGGRAVLDELEKNLELTDWHMEPSRMTLYRFGNTSSSSLWYELAYSEAKGRIRKRDRIWQIAFGSGFKCNSAVWKALRTVNPAKEKNPWMDEIDNFPVDVPRISKVGNA

SEQ ID NO: 6485 - DNA, 1610 bp, Panicum virgatum
  misc_feature: Ceres CLONE 1869143
  misc_feature: Encodes the peptide sequence at SEQ ID NO. 6486
ctctttccccaggtccgaatcctcatccatccatggcgaccccgaccgtcgtcttgctgcccctgtggagcgccggccacctcatgtccctgctcgaggccggcaagcggctgctcgcccgcgccggcggcaagctctcgctcaccatgctcgtcatgcccccgcccacggagcagctcgcggccgaggtccaaggccacatccgccgggaggaggcctccggcctcgacgtccgcttcgtccacctccccgccgtggaacccccgacggattcccgcggcatcgaggagttcctctcccggttcgtgcagatgcactcgcccggcgtcagggcggcggtcgccgccctcccgtgccccgtggccgcgctcgtcctcgacttcttctgcaccgcgctgctcgacgtgtcccgcgacctcgccgtgccggcctacgtctacttcaccaccaacgccgcgatgctggcgctcatgctgcgcctgccggcgctccacgaagaggtgacggtcgagttcgaggagatggagggcgccgtggacgtgcccgggctgccgccggtgccgccgtcctcgctcccgaatccagtgatgaacaagaacaacccgaattacacgtggttcgtgtaccacggcaggcacttcgcggaggccgacggcatcatcatcaacacggccgccgagctcgagccgagcgcgcttgctgccatcgccgacggacggtgcacgcgcggcgtccgtgccccggcggtctatccgattggccccgtgatctcgttcacgccgccccctgagcagccgcacgagtgcgtgcggtggctcgacgcacagcccccggcctccgtggcgctcctctgcttcggcagcctaggcttcttcgccgcgccgcaggcgcacgagattgcccgcggcctggagcgcagcggccaccgcttcctctgggtgctgcgcggcccgccggcgcccggcgcgcggcacccaacggacgcgaacctcgccgagctgctccccgacgggttcctcgagaggaccaaggatagaggcctggtgtggctgacgtgggcgccgcagagggagatccttgcccacgccgcggtggggggtttcgtcacgcactgcgggtggaactccactgtcgagagcctgtggcacggcgtgccgctggccccgtggccgctgtacgccgagcagcacatgaacacgttcacgctggtggccgccatgggcgtcgccgtggcgatgaaggaggacaggaagcgggacaacttcgtggaggccgcggagctggagcgagcggtgaaggagctgatgggcggcggcgaggaggggaggaaggcgagggagaaggccatggagatgatggccgcgtgcaggaacgccgtggaggagggtggctcgtccgacgcttcgctgcataggctagcagagcagctttacaaaggcgcagtggttagcacatgtgaccatgagttgtgttgatgatcaaaattggtagctggatcagtcggcagcttatccagtgcaaaccgggcgtcctgtgcaaccatggaaacctttaatctgatccactagatgctaatcgggtggttaatgatggagattgcgtaattttgc

SEQ ID NO: 6486 - protein, 480 aa, Panicum virgatum
  misc_feature: Ceres CLONE 1869143
  misc_feature (1)..(151): Pfam Name: UDPGT Pfam Description: UDP-glucoronosyl and UDP-glucosyl transferase
MATPTVVLLPLWSAGHLMSLLEAGKRLLARAGGKLSLTMLVMPPPTEQLAAEVQGHIRREEASGLDVRFVHLPAVEPPTDSRGIEEFLSRFVQMHSPGVRAAVAALPCPVAALVLDFFCTALLDVSRDLAVPAYVYFTTNAAMLALMLRLPALHEEVTVEFEEMEGAVDVPGLPPVPPSSLPNPVMNKNNPNYTWFVYHGRHFAEADGIIINTAAELEPSALAAIADGRCTRGVRAPAVYPIGPVISFTPPPEQPHECVRWLDAQPPASVALLCFGSLGFFAAPQAHEIARGLERSGHRFLWVLRGPPAPGARHPTDANLAELLPDGFLERTKDRGLVWLTWAPQREILAHAAVGGFVTHCGWNSTVESLWHGVPLAPWPLYAEQHMNTFTLVAAMGVAVAMKEDRKRDNFVEAAELERAVKELMGGGEEGRKAREKAMEMMAACRNAVEEGGSSDASLHRLAEQLYKGAVVSTCDHELC

SEQ ID NO: 6487 - DNA, 1652 bp, Panicum virgatum
  misc_feature: Ceres CLONE 1869166
  misc_feature: Encodes the peptide sequence at SEQ ID NO. 6488
actcctccaaccgggcaggccatcctttttccgcgtgccttcgaatcaggggcaggggcagccgcgtcgcttccatgccactgccacctgggtgggctcggtgctggggcacatcacacatggcgtccgcgtaggcaggggggccgggggagaggagagggtcgtcttggagttcagtggctatccgcgaactgtacgctccgtgaccgtgaccaccacggcgtccggatcggatcgggatcggaggaggatctcaatctcactcgccgtgtttcctgctgctcgctgcatttctcacaggttcgagagctgagttgggaggaggactgcagccgcaggcagcatgaaggcgctcattctcgtcggaggcttcggcacccgcctgcggccgctgacgctcagtgtgcccaagccgctcgtcgacttcggcaacaagcccatgatcctgcatcagatcgaagctctgaaggaagtaggggtcacagaggtcgtcctggccatcaattaccagcctgaggtgatgctcaactttctcaaggacttcgagagcaagcttggcatcaagatcacctgctcccaggagacggagcccctgggcaccgcgggccctctggccctggcccgcgacaagctcgccgacggctccggcgaccctttcttcgtgctcaacagcgacgtgatcagcgagtacccgttcgcggagctcatccagttccacaaggcccacggcggcgaggcgacgatcatggtcaccaaggtggacgagccgtccaagtacggcgtggtggtcatggaggagggcaccggcaaggtggagcgcttcgtggagaagcccaaggtgttcgtgggcaacaagatcaacgccggcatctacctgctcaacccgtcggtcctcgaccgcatcgagctgaagccgacgtccatcgagaaggaggtgttcccgcgcatcgcggcggacgccgggctcttcgccatggtgctgccgggtttctggatggacatcgggcagccgcgcgactacatcaccggcctgcgcctgtacctcgactccctgcggaagaaggcgcccgcgcggctggcgtcgggcgcgcacgtcctgggcaacgtgctggtgcacgagacggcggtgatcggggaggggtgcctgatcgggcccgacgtggccgtcggccccgggtgcgtggtggaggccggggtgcggctgtcccggtgcacggtgatgcgcggcgctcgcgtgaagcagcacgcctgcgtcgccagcagcatcatcggctggcactccaccgtcggcaggtgggcgcgcgtggagaacatgaccatcctcggcgaggacgtgcacgtctgcgacgagatctacagcaacggcggcgtcgtgctcccgcacaaggagatcaagtccagcatcctcaagcctgagatcgttatgtgacggttgtcccgtgcatccgatcgcgtgcgcttcatatgtttgttgtttcatttgttgctcggttgtctatctgcaagtgtaacgagttgtccccctgtctgcctctcccaactagtgtctaccgagctatatatggttaatttctctacgtggttgtagataggtatcagattgaatggaaagaagaacaaaagttttctttgtgtcataagttagcatcctc

SEQ ID NO: 6488 - protein, 361 aa, Panicum virgatum
  misc_feature: Ceres CLONE 1869166
  misc_feature (1)..(235): Pfam Name: NTP_transferase Pfam Description: Nucleotidyl transferase
  misc_feature (1)..(361): SWISSPROT Homolog: EC 2.7.7.13 Mannose-1-phosphate guanyltransferase
MKALILVGGFGTRLRPLTLSVPKPLVDFGNKPMILHQIEALKEVGVTEVVLAINYQPEVMLNFLKDFESKLGIKITCSQETEPLGTAGPLALARDKLADGSGDPFFVLNSDVISEYPFAELIQFHKAHGGEATIMVTKVDEPSKYGVVVMEEGTGKVERFVEKPKVFVGNKINAGIYLLNPSVLDRIELKPTSIEKEVFPRIAADAGLFAMVLPGFWMDIGQPRDYITGLRLYLDSLRKKAPARLASGAHVLGNVLVHETAVIGEGCLIGPDVAVGPGCVVEAGVRLSRCTVMRGARVKQHACVASSIIGWHSTVGRWARVENMTILGEDVHVCDEIYSNGGVVLPHKEIKSSILKPEIVM

SEQ ID NO: 6489 - DNA, 1942 bp, Panicum virgatum
  misc_feature: Ceres CLONE 1869170
  misc_feature: Encodes the peptide sequence at SEQ ID NO. 6490
aaaaaaaaccacgcgaaccgactagcctagccctctgcttcctctgtttcccctccccctcctcccctcctcccccgattgctctcgatcttccagcgcgcgacaccatggccgacaaggcgtctccggagaagaagtcgtgggccgacgtcgaggaggaggaggaggccaaggccaaggcggcggcggaggcggcggcggcggcggcctcgtcctcctccacctccgagtcggcggtggaggcgcaggtcaagcagatcgaatcgctctccctcgccccgccggaggacgacgccgccggcgaggaggccccgcctctcctcgatgactccgacgacgcgcaaatccaagctgtgacttcgggcggcacggtgtacgagtcggccaccacgtttgaggatctgaagctgtcgccggagctgctcaaggggctgcacgacgagatgggcttcagccgcccgagcaagatccaggcgatcaccctccccatgatcctcacgccgccctacaaggacctcgtcgcgcaggcgcacaacggctccggcaagaccacctgctttgtcctcggcatgctcagccgagtcgatcccaatcgcaggatcccccaggccatctgcatttgccccactagggagctcgcgcagcagaataaggcagttctgatgaggatgggcaagtttattggcattacatgtgcctgtgcgatcccaccagctcaaaaggattatgtgccggtctctaaaatgccgccaattaatgaccagattgtgatcggcacatctggcacactcatcaagtggattaccaataagaaggtggccacaagggagatcaagatacttgtgtttgatgaggcggatcatatgcttgctgaggatggctttaggagtgattctgagaggatgatgagggatatacaaagaagcgctggtggttgtcaggtgcttctcttttctgcaaccttcaatgagagggtgaaagattttgtaacaaaggtaattaaggatgggaatcaaatattcgttaagaaggaagatcttactttggaaaaagtaaagcaatacaaagttcaaattcctgacgaggctgccaaaatagaggtcataagggacaagatctttgagtttggacaaaaagttggccaggttatcatctttgttagaacaaagcaaagtactaagaatgttcacaatgctttgacgagagaggactacgtctgctcctcaattcaaggatcccttgatcaagcagagagggaaaagattatacaagaattcaaggatgggtacaccaaggttcttatatcaactgatgttcttgctcgtggttttgaccaagcacaggttaacctggtcatcaactatgacatgccaatcaaatttggtacaagagatgaacctgattatgaggtgtacctgcacagaattggcagagctggacgctttggccgaaaaggtgctgtgttcaacttgctgtgtggtgaaacagataatgttgtgatgaaaaagattgagaactacttccagcaccaagtacctgaggtgcgaaattggaaaaatgaggaaggttttgagactgctctcaaggatgcaggtttactatgagtaacctcagaaacatggctagctgttgcgctctcccaatcaggacaattcgctggtgattgtttgccgagccggctgcctgctcctcatcatcatggttttagctttgtttaggcggccaaaagttgtgtatggactatggagttttgtggattatgttaaaagacttgcttatacacagcagagtttttctttgccgatctactgtttggtggagtagcgccagctatcggttttaccatttgaaactgtaaatctagttaaacagtaaactgtttttgtcgttgatgatatgcgccaattctcaggttgttgaacaaaaaaaaaaaaaaaaaaaa

SEQ ID NO: 6490 - protein, 498 aa, Panicum virgatum
  misc_feature: Ceres CLONE 1869170
  misc_feature: Great-hit functional homolog of the protein sequence given in SEQ ID NO 9567
  misc_feature (1)..(85): Pfam Name: Helicase_C Pfam Description: Helicase conserved C-terminal domain
  misc_feature (1)..(143): Pfam Name: DEAD Pfam Description: DEAD/DEAH box helicase
  misc_feature: Useful for making plants with modulated cold sensitivity
  misc_feature: Useful for making plants with modulated heat sensitivity
MADKASPEKKSWADVEEEEEAKAKAAAEAAAAAASSSSTSESAVEAQVKQIESLSLAPPEDDAAGEEAPPLLDDSDDAQIQAVTSGGTVYESATTFEDLKLSPELLKGLHDEMGFSRPSKIQAITLPMILTPPYKDLVAQAHNGSGKTTCFVLGMLSRVDPNRRIPQAICICPTRELAQQNKAVLMRMGKFIGITCACAIPPAQKDYVPVSKMPPINDQIVIGTSGTLIKWITNKKVATREIKILVFDEADHMLAEDGFRSDSERMMRDIQRSAGGCQVLLFSATFNERVKDFVTKVIKDGNQIFVKKEDLTLEKVKQYKVQIPDEAAKIEVIRDKIFEFGQKVGQVIIFVRTKQSTKNVHNALTREDYVCSSIQGSLDQAEREKIIQEFKDGYTKVLISTDVLARGFDQAQVNLVINYDMPIKFGTRDEPDYEVYLHRIGRAGRFGRKGAVFNLLCGETDNVVMKKIENYFQHQVPEVRNWKNEEGFETALKDAGLL

SEQ ID NO: 6491 - DNA, 2585 bp, Panicum virgatum
  misc_feature: Ceres CLONE 1869330
  misc_feature: Encodes the peptide sequence at SEQ ID NO. 6492
acgcctctgatctcgtgcttcagagattacgagcttcctccactcttccagctcccggctcttcagtcaacccgagaaccgaagccaaatcgccagcatactcaagcaaggcatgagctcctgagctgagagctgaggttgactccagctacgacctctgtgactcgccggcgacgcggtagcagaaacggccacctcgcagagcttacattccaccaccatgccgagcaccacgccggcctctcggacggcgatcccgctcccctccgcctccccggcctcccgctgcggcagccggacgctccgcctgctcgcgctccccgccccgcccgcgccgcggcgaaggatcggcctgcctcctggccgcgcgaggcgcccggtggcggccgtggccagcgcggcaatgccagcgccggggcccaaggcgcgcgtcctggtggccggcggcggcatcggcgggctggtgttcgcgctcgccgccaggcggaaggggttcgaggtgctggtgctggagcgggacatgagcgccatccgcggggaagggaggtaccgcggcccgatccagctgcagagcaacgcgctcgcggtgctcgaggccgtcgacgccgccgcggccgaccaggtcatggacgccggctgcatcacgggggaccgagtcaacggcatcgtcgacggcgtctccggctcctggtactgcaagtttgatacatttacccctgcagctgagcgggggctcccagtcacgagggtcattagccgcatgacgctgcaacagatccttgctcgcgcagttggcgatgacgctatattgaacgatagccatgtagtcgattttatagatgatggcagtaaggttactgccatattggaggatggtcgaagatttgaaggtgatcttttggtcggtgctgacggaatatggtcaaaggtgaggaagacactatttgggcactcagaagccacttattcaggatacacatgctacactggaattgcagactttgtgcctcctgatattgacacagttgggtaccgagtatttcttggtcacaaacaatacttcgtctcttcagatgttggtgctggtaaaatgcaatggtatgcttttcataaagaagaggctggtggcactgaccctgaaaatggtaaaaagaaacgattgctcgagatattcagtggttggtgtgacaatgtcatagatctgattaatgcaactgaagaggaagcgattcttcgccgtgacatatatgaccgcccacctactgtgaattggggaaaaggtcgtgtgaccttgcttggtgattctgtccatgctatgcagccaaatctgggtcaaggtggctgcatggctattgaggatggataccagctggctgtggagcttgagaatgcctggcaggagagtctcaagtccggaactcctatggacatagtttcctccttgaagcgttatgagaaggagagaaggctgcgtgttgctgttatacatggattggcaagaatggcagcaatcatggcaaccacttatagaccatatctgggtgttggtcttggacctttgtcgtttttgaccaagctgcggataccacatccgggaagagttggtggaagattcttcatcaagattggaatgccagcgatgctgagctgggtgcttggtggcaacagttcaaagctaaaaggaagacctctaagctgccggctttcagacaaggccaacgaccaactttatcgatggtttgaggatgacgacgcattggaagaagctatgggcggagaatggtacctcttccccacaaatgaaggaaacagcaatagtttgcagcctgtccgtttaatcagggatgaacagaggacaatctctgttggaagtcggtcagatcccagtgactctgcatcttccttggcattgcccatgtcgcagatatcagaaatgcatgctaccatcacatgcaagaacaaggctttctatctgactgatcttggaagtgaacaaggcacatggattactgacaatgaaggtagacgttaccgtgtcccaccaaacttcccggttcgtttccgcccctctgatatcattgagtttggttccgataagaaggccatgttccgggtgaaggtgctgaacacggtcccatatgaatccacaagaagagggaagcatccgcagcagcagcaagtccttcaggcagcatgaatggagacacgagccaccactcctatcatcagccacactgtactgtacagcattcagtaaacgcaacactgcatcaggggaaggatatagaagatacgtcaaaaataaagaagtgattcttgtatccatccagatgccaaataggattttgagtactagcacctaacggattgaaattgcagttctacgagaagaattgagttgtacaatgcaatagggataggcaatttatctgttgccggactgtgtacatagttgtaccatcaaataaaatattgtacacgaagagggcatattgtaatgacggcacgaacacagttacactgtgatcatgtatactgatacagtgatactatagttaaaaaaataaaaaaaaaaaaaaaaaaaa

SEQ ID NO: 6492 - protein, 658 aa, Panicum virgatum
  misc_feature: Ceres CLONE 1869330
  misc_feature: Great-hit functional homolog of the protein sequence given in SEQ ID NO 9610
  misc_feature (1)..(31): Pfam Name: Pyr_redox_2 Pfam Description: Pyridine nucleotide-disulphide oxidoreductase
  misc_feature (1)..(31): Pfam Name: DAO Pfam Description: FAD dependent oxidoreductase
  misc_feature (50)..(639): SWISSPROT Homolog: EC 1.14.13.90 Zeaxanthin epoxidase, chloroplast precursor
  misc_feature (58)..(658): SWISSPROT Homolog: EC 1.14.13.90 Zeaxanthin epoxidase, chloroplast precursor
  misc_feature: Useful for making plants with altered alkaloid content
MPSTTPASRTAIPLPSASPASRCGSRTLRLLALPAPPAPRRRIGLPPGRARRPVAAVASAAMPAPGPKARVLVAGGGIGGLVFALAARRKGFEVLVLERDMSAIRGEGRYRGPIQLQSNALAVLEAVDAAAADQVMDAGCITGDRVNGIVDGVSGSWYCKFDTFTPAAERGLPVTRVISRMTLQQILARAVGDDAILNDSHVVDFIDDGSKVTAILEDGRRFEGDLLVGADGIWSKVRKTLFGHSEATYSGYTCYTGIADFVPPDIDTVGYRVFLGHKQYFVSSDVGAGKMQWYAFHKEEAGGTDPENGKKKRLLEIFSGWCDNVIDLINATEEEAILRRDIYDRPPTVNWGKGRVTLLGDSVHAMQPNLGQGGCMAIEDGYQLAVELENAWQESLKSGTPMDIVSSLKRYEKERRLRVAVIHGLARMAAIMATTYRPYLGVGLGPLSFLTKLRIPHPGRVGGRFFIKIGMPAMLSWVLGGNSSKLKGRPLSCRLSDKANDQLYRWFEDDDALEEAMGGEWYLFPTNEGNSNSLQPVRLIRDEQRTISVGSRSDPSDSASSLALPMSQISEMHATITCKNKAFYLTDLGSEQGTWITDNEGRRYRVPPNFPVRFRPSDIIEFGSDKKAMFRVKVLNTVPYESTRRGKHPQQQQVLQAA

SEQ ID NO: 6493 - DNA, 1448 bp, Panicum virgatum
  misc_feature: Ceres CLONE 1869486
  misc_feature: Encodes the peptide sequence at SEQ ID NO. 6494
cagcactggcgcacgccacttgactgttgcctctcgatcggtctcggcagctcaacgccggcaagaagccccccctagctcgccgccggcagctccaccactcgagcaggctgcagccagccatgggctccaccgccaccgacgtggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtgacgcccactaaccccgacgcggcgaccatggtcgaccgcatcctgcgcctgctcgcctcctacgacgtcgtccggtgccagatggaggagggcaaggacggcaagtactcgcgccgctacgccgccgcgcccgtctgcaagtggctcacccccaacgaggacggcgtctccatggccgccctcgcgctcatgaaccaggacaaggtcctcatggagagctggtactacctcaaggacgccgtgctggagggcggcatcccgttcaacaaggcgtacggcatgacggcgttcgagtaccacggcacggacccgcgcttcaaccgcgtgttcaacgagggcatgaagaaccactcggtgatcatcaccaagaagctgctcgagttctacaccggcttcgagggcgtcggcaccctggtcgacgtcggcggcggcatcggcgccaccctgcacgccatcacctcccactacccgcggataacgggggtcaacttcgacctgccccacgtgatctccgaggcgccgccgttccccggcgtgcagcacgtcggcggcgacatgttcaaggccgtgcccgccggcgacgccatcctcatgaagtggatcctccacgactggagcggcgcccactgcgcggtgatcctcaagaactgctacgacgcgctccccgccggcggcaaggtgatcatcgtcgagtgcatcctgccggtgaacccggaggcgacgcccaaggcgcagggcgtgttccacgccgacctcatcatgctcgcgcacaaccccggcggcaaggagcgctacgagagggagttcgaggagctcgccaagggcgccggcttcaccgggttcaaggccacctacatctacgccaacgcatgggccatcgagttcaccaagtagatctctgaagctgcttcctcgtgctgttgtcgcgcatgtgctttcgcttaatttgctttcttcttcttcatcatcatcatcctactggcctgcctgcctccatgtccatggccaccatcgatcttgttctggattccaaacgaactctaatggttgtatgtgttgagatgtctctaccatgtaccattaataacagccaaggtactcttatatatatacatacatacttaatatgatgac

SEQ ID NO: 6494 - protein, 361 aa, Panicum virgatum
  misc_feature: Ceres CLONE 1869486
  misc_feature: Great-hit functional homolog of the protein sequence encoded by LOCUS At5g54160
  misc_feature (2)..(246): Pfam Name: Methyltransf_2 Pfam Description: O-methyltransferase
  misc_feature (1)..(361): SWISSPROT Homolog: EC 2.1.1.68 Caffeic acid 3-O-methyltransferase
  misc_feature: Useful for making plants with altered cell wall content and/or composition
MGSTATDVAAAADEEACMYALQLASSSILPMTLKNAIELGLLEVLQKDPAAALAPEEVVARLPVTPTNPDAATMVDRILRLLASYDVVRCQMEEGKDGKYSRRYAAAPVCKWLTPNEDGVSMAALALMNQDKVLMESWYYLKDAVLEGGIPFNKAYGMTAFEYHGTDPRFNRVFNEGMKNHSVIITKKLLEFYTGFEGVGTLVDVGGGIGATLHAITSHYPRITGVNFDLPHVISEAPPFPGVQHVGGDMFKAVPAGDAILMKWILHDWSGAHCAVILKNCYDALPAGGKVIIVECILPVNPEATPKAQGVFHADLIMLAHNPGGKERYEREFEELAKGAGFTGFKATYIYANAWAIEFTK

SEQ ID NO: 6495 - DNA, 663 bp, Panicum virgatum
  misc_feature: Ceres CLONE 1870086
  misc_feature: Encodes the peptide sequence at SEQ ID NO. 6496
agcacacacagcagctaatccagactcacactactgcagcatttgctttgcttagcacgaccgccgatcgataattaataataatacaacgataatggcggttctgatgatgaagaacaagaagcagatgcaggcggtggtggccttggccgttgtggtggcggcggcggcgccgtgcatcccgtacgcgacggggaaggcgagcgcgctgccgtcgtcgtgctgcggcggcgtgcgcagcctcaacagcgcggcgcgcacgagctcggaccggcaggcggcgtgccggtgcctcaagagcctggccagcaccgtcaagtcggtgaacatgggcaccgtcgccaccatccccggcaaatgcggcgtctccgtgccattccctatcagcatgtccactgactgcaacaagatcaactaaattaatcttacatcagatatgctgctacctgatggtgagaagcttggtccttcagaagatagcaacgagctatttattaggacaataaaataaagttgttaaggcatcatcatcagcatcatctatactattttgtagtaataattaattaattaattaaatgttgtactcgatctgtgtgtacgtgcgcgtatacatacatgcatgcttatccgatcgatgtatatatatgtgctgcttctctc

SEQ ID NO: 6496 - protein, 107 aa, Panicum virgatum
  misc_feature: Ceres CLONE 1870086
  misc_feature (4)..(86): Pfam Name: Tryp_alpha_amyl Pfam Description: Protease inhibitor/seed storage/LTP family
MAVLMMKNKKQMQAVVALAVVVAAAAPCIPYATGKASALPSSCCGGVRSLNSAARTSSDRQAACRCLKSLASTVKSVNMGTVATIPGKCGVSVPFPISMSTDCNKIN

SEQ ID NO: 6497 - DNA, 588 bp, Panicum virgatum
  misc_feature: Ceres CLONE 1870419
  misc_feature: Encodes the peptide sequence at SEQ ID NO. 6498
attcccccacagcacacacagcagctaatccagactcacactactgcagcatttgctttgcttagcacgaccgccgatcgataattaataataatacaacgataatggcggttctgatgatgaagaacaagaagcagatgcaggcggtggtggccttggccgttgtggtggcggcggcgcgcacgagctcggaccggcaggcggcgtgccggtgcctcaagagcctggccagcaccgtcaagtcggtgaacatgggcaccgtcgccaccatccccggcaagtgcggcgtctccgtgccattccctatcagcatgtccactgactgcaacaagatcaactaaattaatcttacatcagatatgctgctacctgatggtgagaagcttggtccttcagaagatagcaacgagctatttattaggacaataaaataaagttgttaaggcatcatcatcagcatcatctatactattttgtagtaataattaattaattaattaaatgttgtactcgatctgtgtgtacgtgcgcgtatacatacatgcatgcttatccgatcgatgtatatatatgtgctgcttctctcac

SEQ ID NO: 6498 - protein, 78 aa, Panicum virgatum
  misc_feature: Ceres CLONE 1870419
  misc_feature (36)..(86): Pfam Name: Tryp_alpha_amyl Pfam Description: Protease inhibitor/seed storage/LTP family
MAVLMMKNKKQMQAVVALAVVVAAARTSSDRQAACRCLKSLASTVKSVNMGTVATIPGKCGVSVPFPISMSTDCNKIN

SEQ ID NO: 6499 - DNA, 785 bp, Panicum virgatum
  misc_feature: Ceres CLONE 1870591
  misc_feature: Encodes the peptide sequence at SEQ ID NO. 6500
atccagcacacagagttgagttgatcgataaggcgccatggcttcttccacgaccaccctgtcctttgtcttcgtcctggcgttgctgctctcatacggcggcggatgcaacgcggcgcggcggatgcaggagctcccgaagcccgacgtggcgccgctgcccaagcctgaggacccgatgcctgagccgctgccggtgcccccacagcccctgcccaagcccgaggagccgaagccggagccgctgccggtaccaccacagcccctgcccaagcctgagccacttcccgtgccaccacagcccctgcccaagcctgagcccctgcccgtgccaccacaacccctgccgaagcctgagccgcttcctgtgccgccacagcccttgcccaaacctgagccgttgccggtgccaccacagcccctgcccgtgccaccacagccgaagcctgagccgttgcccgtgccaccgcagcccctgccccaaccggagctgccggtgccgccgaagccatgatcgatgagccatggcaactttacaggcgcatattattgacacggcgctccagtgattattttctattgtattttgctcattcgtgtgaccatgcgtgatgctttcaccgatttgtatagcaagtgtatcagatttgcagtgtggaatggtgtgcattgccatgccatctcatctgatccggccgtgatctatgtattctggctgagatccatgtgtataaataaataaatggattcgtttgtacatgtgccaaaaaaaaaaaaaaaaaaaa

SEQ ID NO: 6500 - protein, 158 aa, Panicum virgatum
  misc_feature: Ceres CLONE 1870591
  misc_feature (60)..(133): Pfam Name: Trypan_PARP Pfam Description: Procyclic acidic repetitive protein (PARP)
  misc_feature (89)..(212): Pfam Name: Peptidase_M10_C Pfam Description: Peptidase M10 serralysin C terminal
MASSTTTLSFVFVLALLLSYGGGCNAARRMQELPKPDVAPLPKPEDPMPEPLPVPPQPLPKPEEPKPEPLPVPPQPLPKPEPLPVPPQPLPKPEPLPVPPQPLPKPEPLPVPPQPLPKPEPLPVPPQPLPVPPQPKPEPLPVPPQPLPQPELPVPPKP

SEQ ID NO: 6501 - DNA, 1191 bp, Panicum virgatum
  misc_feature: Ceres CLONE 1870602
  misc_feature: Encodes the peptide sequence at SEQ ID NO. 6502
atccagcgtgccgctgcctgcaggcggccgccgtccagcgcccctcgcggccccgccggctcgcccttcgctgccctcgcccagcacggctgcgcctgcgcggccggccggcagcaccctcgcggcctcactccctgcccagcgcggcagccgcgcagccacacaaaacctgctgcgccgccgccggatttcccctcctcccctaccccggtcccttcctccaacccatcgctgcccgatccaacaccgtcagagcaccctcgactgcaacgcttacggcgagaggggggaaacctaggagatgaagctggtggggttgacgggcgggatcgcgtccgggaagagcaccgtatccaacctcttcaaggacgccggagtccctgtcgtcgacgccgacgtcgttgctcttaatgtagtgcagaaaggtactggaggttggaagaagattgtaaaagcctttggggatgaaattttgttggacaacagagaaattgacagagctcacttgggacaaattgtgttttctgacccaccaaagcggcaacttcttaaccgtcttctggcgccacatatttcttctggcatattctgggagattgcaaaactgtggatgaagggatgcaaggttattgtcctggacatcccgctgctgttcgaaacaaagatggatagatggacaaatccagtcattattgtctgggttaatccagaaacccagatcgagaggctcatgtcaagagatgggtgctctgaagaacaagctcagaacaggatcaacgcacagcttgctctggactggaagaagtcggaagcggacatagtgatcgacaattttgggtcactggatgacaccaaacaacagtttcaggaggtgttgaggaaagtctccgagcccttgacatggaaggagtgcttgcgatcccgagacggtctgatctctgttgtcatgtgtacagcagtgggggtattacttgcccagaagaacctgctatgatcccgataagtttgaggaggttaaaaccagtgatgatgtgtttctggagaccggcacaaataatctcatctggtctcttaagagtggaaattggatggctgcatttgaaccataatgataaaataaaatttcatatgatttagtgttttacggtggaaactactcgattgtggtggcaaaaaaaaaaaaaaaaaaaa

SEQ ID NO: 6502 - protein, 230 aa, Panicum virgatum
  misc_feature: Ceres CLONE 1870602
  misc_feature (1)..(182): Pfam Name: CoaE Pfam Description: Dephospho-CoA kinase
MKLVGLTGGIASGKSTVSNLFKDAGVPVVDADVVALNVVQKGTGGWKKIVKAFGDEILLDNREIDRAHLGQIVFSDPPKRQLLNRLLAPHISSGIFWEIAKLWMKGCKVIVLDIPLLFETKMDRWTNPVIIVWVNPETQIERLMSRDGCSEEQAQNRINAQLALDWKKSEADIVIDNFGSLDDTKQQFQEVLRKVSEPLTWKECLRSRDGLISVVMCTAVGVLLAQKNLL

SEQ ID NO: 6503 - DNA, 813 bp, Panicum virgatum
  misc_feature: Ceres CLONE 1871159
  misc_feature: Encodes the peptide sequence at SEQ ID NO. 6504
acctggcgcagctcatcgtagacgtagaccgaccatagctagctcctcacaagtgtccagtgcaacccatctcgtttcgcaacatggcggaggccaagacgactgagcctgctccggcggcgccagaggggggttcgggggagcagcagcacaagacggtggtggtggtcggggtggacgacagcgaccacagctaccacgcgctcgagtggacggtgcgccacgtggccgccggcatggcgggcgccaccgacctcgtcatcgtccacgccaagccctcgccgtcctccgtcgtcagcttcggcgggcccggagccggcgaggccatgaggtacgtggaggccgacctgcgcaagatggccgaggccgtcgtcgacagggcgcgccgcgtctgcatcgcaaactcggtgcacgctctgatcgaggtggtcgaaggggagcccaggtacgtgctctgcaacgcggccgagaagcaccacgccgacctgctcgtcgtcggcagccatggctatggcgccatcaagagggcctttctggggagcgtgagcgactactgcgcgcaccacacgcactgctccgtcatgatagtgaagcaccccaagcccaagtgctgagcagagctccggtgctctgctagctcatcaggtccatactgccctgctccggtgatgacggtggtggactagtagtgaagcgacctataggtccaaatgctgggcatgtatgtacctgcaacagccgcctcagctgtgcttctgccaacaaaggtttatctaagtggatgcaagtgaaacaaaaaaaaaaaaaaaaaaa

SEQ ID NO: 6504 - protein, 176 aa, Panicum virgatum
  misc_feature: Ceres CLONE 1871159
  misc_feature (1)..(150): Pfam Name: Usp Pfam Description: Universal stress protein family
MAEAKTTEPAPAAPEGGSGEQQHKTVVVVGVDDSDHSYHALEWTVRHVAAGMAGATDLVIVHAKPSPSSVVSFGGPGAGEAMRYVEADLRKMAEAVVDRARRVCIANSVHALIEVVEGEPRYVLCNAAEKHHADLLVVGSHGYGAIKRAFLGSVSDYCAHHTHCSVMIVKHPKPKC

SEQ ID NO: 6505 - DNA, 953 bp, Panicum virgatum
  misc_feature: Ceres CLONE 1871345
  misc_feature: Encodes the peptide sequence at SEQ ID NO. 6506
acttctcacgctgcctgcccagagcctccgcatcggccaacgccagcagacctcagctcgcgactcgcgccgtctccgctagtgcaaagctgccatggcgaggctactcgtcgaagcgccgccggccggctcgggcgcgccggagccggcggactccctcaactcggacatgatcctcatcctcgccgggctgctctgcgcgctcgtctgcgtcctcggcctcggcctcgtcgcccggtgcgcgtgctcgcggcgctgggccgcggcggcccgggcgccgccgggcgcggccgccgcgaacaagggcgtcaagaaggaggtgctgcgctcgctgccgacggtcacgtacgtccccgacggcggcaaggcggcgggggaaggggcggacgagtgcgccatctgcctcgccgagttcgaggacggccaggccatgcgcgtgctgccgcagtgcggccacgcgttccacgccgcctgcgtcgacacgtggctgcgcgggcactcctcctgcccgtcctgccggcgcgtgctcgccgccgagctgccggccggcgagcggtgccgccgctgcggcgcgcgccccggcctcggcatcagcgcgctctggaaggcgccctgcagcgccgaggggacgacgttcttggcctagtgccgtgcgcactcagcacaggaattggacccagggcgcaagctcattggtgaatggtgaacttccttttttagcctcgtaggttccattcctttgtaggagtgagtagtgattagctgggccctggcaatggggaggacaaagcatcaagatgtgtgtgcctacctgattgatggataaacattgtccttgtaaattatctgtacatatgtgcaatgatataaggcttgaatctagtagtttctgttggcagtgtctgaattaaaagatcataagttggactgaacaaaaaaaaaaaaaaaaaaaa

SEQ ID NO: 6506 - protein, 183 aa, Panicum virgatum
  misc_feature: Ceres CLONE 1871345
  misc_feature: Great-hit functional homolog of the protein sequence given in SEQ ID NO 9435
  misc_feature (1)..(42): Pfam Name: zf-C3HC4 Pfam Description: Zinc finger, C3HC4 type (RING finger)
  misc_feature: The sequence is a functional homolog of  SEQ ID NO 670 in the  10/666,642 US patent application
  misc_feature: Useful for making plants with modulated biomass
  misc_feature: The plant is abnormally small.
  misc_feature: Useful for making plants with modulated growth and phenotype characteristics
MARLLVEAPPAGSGAPEPADSLNSDMILILAGLLCALVCVLGLGLVARCACSRRWAAAARAPPGAAAANKGVKKEVLRSLPTVTYVPDGGKAAGEGADECAICLAEFEDGQAMRVLPQCGHAFHAACVDTWLRGHSSCPSCRRVLAAELPAGERCRRCGARPGLGISALWKAPCSAEGTTFLA

SEQ ID NO: 6507 - DNA, 579 bp, Panicum virgatum
  misc_feature: Ceres CLONE 1871519
  misc_feature: Encodes the peptide sequence at SEQ ID NO. 6508
acctcgattcgtctccgctctttatcccccgctgcgcccgtgcctttcctctccatctccgccgccgccgccgcctcccacccgcagccgcaccactctccccggcggatcaggacgtctgctcggcgcggtccatccatggcggaggaatcaggtcgccccttgcctaagtttggtgaatgggatgtgaacgacccagcttccgctgatggattcacggtgatattcaacaaagccagagatgagaagaagggtgggaatggacaggatacagagtctccttccaaggacaccaggaccgagagggtggaatcttatgctgccaagccgaactcgaagaaatggttttgctgcgtgacagccagccccacacaatcctgaagacgatcacccgctcgtgggaatactgcccctttaatttttctatacatactatccataagacaatgtagaggtacccagcgctctccgggctccaggatgggtacctcgtatgtatgtgtgtgtgagggttgtcggcacacatttgcaaagtggacttctgagttctgattgtaattgtagtcccccgtctgtctt

SEQ ID NO: 6508 - protein, 80 aa, Panicum virgatum
  misc_feature: Ceres CLONE 1871519
  misc_feature (1)..(73): Pfam Name: NOI Pfam Description: Nitrate-induced NOI protein
MAEESGRPLPKFGEWDVNDPASADGFTVIFNKARDEKKGGNGQDTESPSKDTRTERVESYAAKPNSKKWFCCVTASPTQS

SEQ ID NO: 6509 - DNA, 574 bp, Panicum virgatum
  misc_feature: Ceres CLONE 1871568
  misc_feature: Encodes the peptide sequence at SEQ ID NO. 6510
atcatcaaattaaatctgcgggggcgcacaacctacctacgaccatgggcgccacgctacccggcttgctctctgcgcttctgctgctgctcctcccggcttccctccgagtccgagaccacctccccgcgtccaaccggcgagaggcggaggacggcgtcgtcggccgcggcctgcacccgatcgtgctgatccccggcttgtcctgccccgacctggaagcgcggctcgccgacgcctaccggccctcgacgccgcggtgcagccgggtgcaaggggaggaggggtggttcgggctgtggacgaaccgcacctgggagctggacgccgagcgcgccgagtgcttcgtcgaccagatgcgcctcgtctacgacgccgtcctcggggacttccggaacctgcccggcgtcgagtcgcgcgtccccggcttcggatccgcccgcggctccggctccaaggttccaacacacccgtaagcccaaccatacttcttctactccaggagggtgtaactcgccgagcatgcatggatcaacaagtcagcttcattccacgagtgcatgctgcttacatg

SEQ ID NO: 6510 - protein, 143 aa, Panicum virgatum
  misc_feature: Ceres CLONE 1871568
  misc_feature (1)..(62): Pfam Name: LACT Pfam Description: Lecithin:cholesterol acyltransferase
MGATLPGLLSALLLLLLPASLRVRDHLPASNRREAEDGVVGRGLHPIVLIPGLSCPDLEARLADAYRPSTPRCSRVQGEEGWFGLWTNRTWELDAERAECFVDQMRLVYDAVLGDFRNLPGVESRVPGFGSARGSGSKVPTHP

SEQ ID NO: 6511 - DNA, 871 bp, Panicum virgatum
  misc_feature: Ceres CLONE 1871675
  misc_feature: Encodes the peptide sequence at SEQ ID NO. 6512
ctcgaccgtcgccaatattcggacggttcaccgggacgaggtaacccctctggccctctccaattccaagggccgccgcgtcctctccgctccgccccacctcgtcgtgcctgcccaccgccctcccctccccgccggccggcctcgccccgatccagatccaggattcaaactaataagtacactgccaccatggttctggattcattatcatcccctcaccggaggtcccagaacacattctttgtgtcatccacaaagaagcctcagccatctcgggatgacagttggtctgcactgcttgagcggcaccggttcctcttgacaacgcttgttgtgcttgccttcctgtgcaccatctatctgtacttcgcagtaaccttgggggcatcaaatgcttgcgctggattggcaggggcggagaggattgagtgccaggcaaaatccgttctgcaacatggaaagttgaaattcctctgacgctgagttgttttgagactcattggtgaagaccaaaatattgagttttatatgcgctctggtcacaggtcttattcttcataacttgaatatgtatattttgggtggtgggtggtgtgtattcatgctcatgtacttggactgcgagatttactgtactgtacccccgtagaggcaacaaatctaatagtgatagtgctgagttatggaaacgttatgatgaagtaggtcaccatattattcttttaccatgatgtactgaaaacatcgtggcgccattattcatcaaggagatcttgatattgtctcccttacatgtaactcgaaattaatttgaaactgtgctgcctgagtatatacttattgatcagaaaaaaaaaaaaaaaaaaaa

SEQ ID NO: 6512 - protein, 95 aa, Panicum virgatum
  misc_feature: Ceres CLONE 1871675
  misc_feature: Great-hit functional homolog of the protein sequence given in SEQ ID NO 9340
  misc_feature: Useful for making ornamental plants with delayed petal abscission
  misc_feature: Useful for making plants with modulated nitrogen use efficiency
MVLDSLSSPHRRSQNTFFVSSTKKPQPSRDDSWSALLERHRFLLTTLVVLAFLCTIYLYFAVTLGASNACAGLAGAERIECQAKSVLQHGKLKFL

SEQ ID NO: 6513 - DNA, 709 bp, Panicum virgatum
  misc_feature: Ceres CLONE 1871852
  misc_feature: Encodes the peptide sequence at SEQ ID NO. 6514
acacagtttgccagagatagcgagagagagaggaggggagggactagggaggaggcggcggcggcggcggcggcggcgcgccatcactctgccctgccctgttgatccggagggacgaaagcgaggaaagtcacaaacttcatcaatggcgactcccaccacctactcggtccgcgtctcctcggagacccacaaggtcgaggaatggctgacgtctgacgaagctctggcctggcagctgcaggaggaggagaacacgcgcgatgccgctgccgacaccagagaatccgccggtaacgtgtccttggagccatcgtcgccggctgttcagtacaggcctgcgcagaatgcagctcaggtggcacgggaagacaatgttgaccctgataatatgtcttacgagcaactacaagcattaggcgaagcagttggaactcagtccagaggattatctgatgacctgatagcttacttggagccatttaggcgcaagtgcacctttttctcgagaaaaaagaacagtgaagaatgcgtgatctgcaaaacgacctataaaagccggcagaagatgataaggctaccctgcagccattgttatcatgcaaactgcataagtcggtggcttaagatcaacaaagcatgcccagtctgcaacgaggaagtatttggatgaactaagaggctccctcggttcaaaaaaaaaaaaaaa

SEQ ID NO: 6514 - protein, 175 aa, Panicum virgatum
  misc_feature: Ceres CLONE 1871852
  misc_feature (1)..(41): Pfam Name: zf-C3HC4 Pfam Description: Zinc finger, C3HC4 type (RING finger)
MATPTTYSVRVSSETHKVEEWLTSDEALAWQLQEEENTRDAAADTRESAGNVSLEPSSPAVQYRPAQNAAQVAREDNVDPDNMSYEQLQALGEAVGTQSRGLSDDLIAYLEPFRRKCTFFSRKKNSEECVICKTTYKSRQKMIRLPCSHCYHANCISRWLKINKACPVCNEEVFG

SEQ ID NO: 6515 - DNA, 971 bp, Panicum virgatum
  misc_feature: Ceres CLONE 1872106
  misc_feature: Encodes the peptide sequence at SEQ ID NO. 6516
aaaccacatcccccgcgcttcccaaccaacccaagcagatagcattccgtcgaacacctcgcctcgcctcccctccaatggccaccgccaccgccaccgccaccaccgcatccctctcccccgcggccggcaagcggttcgtcctctcctgcccgtccctctcattctcctcccaccgcctcgccgcccccgccgggcccgtgccccgcctccgcggcgccgccgccgcagccgcctcgagggcggcggcaagcaggagtcggcgggcgtcccgcgtcgcggcgaccatcgcggtgggcgacaggctccccgacgcgacgctgtcctacttcgacccggccgacggggagctgcggaccgtgacggtggcggagctgacggcggggaagaaggccgtcctcttcgcggtgccgggcgcgttcacgcccacgtgctcgcagaagcacctcccggggttcgtggagaaggcggcggagctgcgggcgaagggggtggagaccctggtgtgcgtgtcggcgaacgacgcgttcgtgatgaaggcgtggagggaggcgctgggggtggcccccgacgccgtgctgatgctgtcggacggcaacctggagctgacgcgcgcgctgggcgtggagatggacctctccgataagcccgtcgggctgggcgtgcggtcgcggaggtacgcgctgctggcggaggacggcgtggtcaaggtgctcaacctcgaggacggcggcgccttcaccagcagcagcgccgaggacatgctccaggcgctcgggtgagcaatgcaagcccgtcggcgtcttcttgtcgtcggcttgcaaatagtaagaatcgacgggccgtgtctgtctccttcgacccgactatccgagagcatcttgtcgtcgtcgccgctgttgagagctctcttttttttttttgttcagcatctcggccattcccagtcccaaaaaaaaaaaaaaaaaaaa

SEQ ID NO: 6516 - protein, 234 aa, Panicum virgatum
  misc_feature: Ceres CLONE 1872106
  misc_feature (1)..(162): Pfam Name: Redoxin Pfam Description: Redoxin
  misc_feature (2)..(233): SWISSPROT Homolog: EC 1.11.1.15 Peroxiredoxin-2E-1, chloroplast precursor
  misc_feature (3)..(233): SWISSPROT Homolog: EC 1.11.1.15 Peroxiredoxin-2E-2, chloroplast precursor
MATATATATTASLSPAAGKRFVLSCPSLSFSSHRLAAPAGPVPRLRGAAAAAASRAAASRSRRASRVAATIAVGDRLPDATLSYFDPADGELRTVTVAELTAGKKAVLFAVPGAFTPTCSQKHLPGFVEKAAELRAKGVETLVCVSANDAFVMKAWREALGVAPDAVLMLSDGNLELTRALGVEMDLSDKPVGLGVRSRRYALLAEDGVVKVLNLEDGGAFTSSSAEDMLQALG

SEQ ID NO: 6517 - DNA, 551 bp, Panicum virgatum
  misc_feature: Ceres CLONE 1872146
  misc_feature: Encodes the peptide sequence at SEQ ID NO. 6518
gcgaatcttccggggggcgccgcgtgctttcccaattccgaattccgccacccctcttctccatctccggcaaggcatttggcatctgacctcaacagcaagcaaatggcaggtggcagggttgcacatgccaccctcaagggcccgagcgtggtgaaggagatcttcattggagtcaccctcgggctgattgccggtggcatgtggaagattcaccactggaacgagcagaggaagactagatccttctacgacatgctggacaagggccagatcagcgttgttgtcgaggagtagctttcacgcgccaagtctgaagttattttctcacagttgtttctgaaactctggagagcatgatgaagtgaatgctgtggagattcgtcttgaaaaataagcataaccatttgaggacaccagattttgttgaatttccttccgtttcatgaatattagaacatgtccaggtcataccgatcaactgaatatctgatctagttttacataagttaatgtgattgtgaaatttgcaaaaaaaaaaaaaaaaaaaa

SEQ ID NO: 6518 - protein, 63 aa, Panicum virgatum
  misc_feature: Ceres CLONE 1872146
  misc_feature (1)..(62): Pfam Name: COX5C Pfam Description: Cytochrome c oxidase subunit Vc (COX5C)
  misc_feature (1)..(63): SWISSPROT Homolog: EC 1.9.3.1 Cytochrome c oxidase polypeptide Vc
MAGGRVAHATLKGPSVVKEIFIGVTLGLIAGGMWKIHHWNEQRKTRSFYDMLDKGQISVVVEE

SEQ ID NO: 6519 - DNA, 1131 bp, Panicum virgatum
  misc_feature: Ceres CLONE 1872336
  misc_feature: Encodes the peptide sequence at SEQ ID NO. 6520
agaaggttgtcccgtgctcagctcgtaatctcgtgccagctgcggcggcggcgatgcggctgctcaccggcgcctcggcgtcccgcatcccctccccgcttctctcacttccccgcgcaaggccgagatgcgtgcccgcctcctcctccgcctgccgggccgcctcctcatcggccgcgggcgcaggcgacggcggcgcgcggaagccgtggctcttcgtcgggttggggaaccccgggaaggtgtaccagggcactcgccacaacgttggattcgagatgatcgatgttatagctgaagctgagggtatacctctcagcagtatgcaattcaaggcaatggttggaaaaggtcgtattggtgatgcacctatcatgcttgccaagccgcaaacttttatgaatgcaagcggtgagtctgtggggcagctggtttcatatttcaagattccacttaatcaagtcattgtgatgtatgatgatctagatttaccctttgcaaaattgcgcttgctgccaaagggtgggcatggagggcataatgggatgagaagtatcatcaaccatttgaaacaaagtcgtgattttccacgcctaagaattggcattgggcgaccacctgggaagatggatcctgcaaattttgttctccggccttttaccaagaaagagcaagaagagcttgatttcgcgttccataggggcttggaggcagtgcgaataatggtgcttgaaggattcaacaagagcgcaacttacgtgaacactgcccagtcatctgaaatgttaaatagatgatagaatcatagactactgaattcagttttattcctatgccaaggagatttaattggggtatgaattgcagtaaggcacactgcagtcagattcacctggtgcatcattttgcatggttcaaaaaaattctgacagccgaagtgttcattgcagcatactgtatgatatgagcaatatatgtattgtgaatctatgattccgtagcattccactatattgtaccggcttgttaatttcatatctagtgtgcaaccttgaaattttgaagaactctgtaccctactctttgaaaatccatatatgtttactgccttaaaaaaaaaaaaaaaaaaaa

SEQ ID NO: 6520 - protein, 247 aa, Panicum virgatum
  misc_feature: Ceres CLONE 1872336
  misc_feature (1)..(247): SWISSPROT Homolog: EC 3.1.1.29 Peptidyl-tRNA hydrolase, mitochondrial precursor
  misc_feature (52)..(246): SWISSPROT Homolog: EC 3.1.1.29 Peptidyl-tRNA hydrolase, chloroplast precursor
MRLLTGASASRIPSPLLSLPRARPRCVPASSSACRAASSSAAGAGDGGARKPWLFVGLGNPGKVYQGTRHNVGFEMIDVIAEAEGIPLSSMQFKAMVGKGRIGDAPIMLAKPQTFMNASGESVGQLVSYFKIPLNQVIVMYDDLDLPFAKLRLLPKGGHGGHNGMRSIINHLKQSRDFPRLRIGIGRPPGKMDPANFVLRPFTKKEQEELDFAFHRGLEAVRIMVLEGFNKSATYVNTAQSSEMLNR

SEQ ID NO: 6521 - DNA, 635 bp, Panicum virgatum
  misc_feature: Ceres CLONE 1872858
  misc_feature: Encodes the peptide sequence at SEQ ID NO. 6522
attaattactcccccatcccctccttccctggctccgttcctccgagcgagaggtttcaaacagagggggagggcgatccatccacccatcgagtctccggcgcctgatcggttcgtcgtcgatggcggactggggccccgtggtgatggcgacggtgctgttcgtgctgctgacgccggggctgctgttccagctccccgcgcacggccgcatcgtgggcttcggcaccatgcacaccagcggcatcgccatcctcgtccacgccgtcctctacttcgcgctcatcaccatcttcctcatcgccatcggagtccacatctacgccggctagctcaagctgcggagcccggtcgtctcttccgcccgcccgcggcccgcccttcgccaagtcttctctctcctctcgtctcctctcgtcgcttccctttccgatctactcctcctagtagtagaatatgtgacgcctgcctgcctgcctgcttgctcgtgctagcagggttagcagtgccgttgctggtggtgttatcttgttaatttaactgcagcgaaagcaatccggtggatgctgcagtgtgtgtactgtaatgaagggattatcgtgagattctctgttcaaaaaaaaaaaaaaaaaaaa

SEQ ID NO: 6522 - protein, 69 aa, Panicum virgatum
  misc_feature: Ceres CLONE 1872858
  misc_feature: Great-hit functional homolog of the protein sequence encoded by LOCUS At5g63500
  misc_feature: Useful for making plants with altered cell wall content and/or composition
MADWGPVVMATVLFVLLTPGLLFQLPAHGRIVGFGTMHTSGIAILVHAVLYFALITIFLIAIGVHIYAG

SEQ ID NO: 6523 - DNA, 782 bp, Panicum virgatum
  misc_feature: Ceres CLONE 1872912
  misc_feature: Encodes the peptide sequence at SEQ ID NO. 6524
aacacaaccagaagctttttttggttgccgcgacctcacctgacccatccatcacccacacgcacaccacctgcagatcaacagcaacaagccagaagagatgaagcatccgagggagcagcagccgcaggaggaggtgtcgttggcgctgtcgctgagcacggcggactcgtgcacgacgacctccgactcgtccgccggggcgcccccggcggccaagtgcgcgcggcggcggaggggtccggtggtggccacatccggggagggggagttcgtctgcaagacctgcggccgcgccttcacctccttccaggcgctgggagggcaccggaccagccacctgcggggccgccacgggctcgagctcggcgtcggcgccaaggcgctcaggcagcacaaggcggccgccgccgccggcggcgacaagcaggagaagcagcagcaccagacccacgagtgccacatctgcgggctcggcttcgagttggggcaggcgctcggcggccacatgaggaggcaccgcgaggagatgggcgccgccgaggccgccgacgcatgggtctggcgcagcgtcgcgcgactaccggaggagctcgaggtccagagcgccgccgccgccggcccgcccgtcttgctcgagctcttcgcctagatcatcctccgtcgcccatcggattaattagacgcgcgtaggacatgtaaatgatattgtttggtctttcattaattagatctctttaggaattgagatcgttctctcttaaaaaaaaaaaaaaaaaaaa

SEQ ID NO: 6524 - protein, 183 aa, Panicum virgatum
  misc_feature: Ceres CLONE 1872912
  misc_feature (1)..(23): Pfam Name: zf-C2H2 Pfam Description: Zinc finger, C2H2 type
  misc_feature: The sequence is a functional homolog of  SEQ ID NO 1288 in the  10/666,642 US patent application
  misc_feature: The sequence is a functional homolog of  SEQ ID NO 1290 in the  10/666,642 US patent application
  misc_feature: The sequence is a functional homolog of  SEQ ID NO 622 in the  10/374,780 US patent application
  misc_feature: The sequence is a functional homolog of  SEQ ID NO 624 in the  10/374,780 US patent application
  misc_feature: Useful for making plants with modulated growth and phenotype characteristics
MKHPREQQPQEEVSLALSLSTADSCTTTSDSSAGAPPAAKCARRRRGPVVATSGEGEFVCKTCGRAFTSFQALGGHRTSHLRGRHGLELGVGAKALRQHKAAAAAGGDKQEKQQHQTHECHICGLGFELGQALGGHMRRHREEMGAAEAADAWVWRSVARLPEELEVQSAAAAGPPVLLELFA

SEQ ID NO: 6525 - DNA, 693 bp, Panicum virgatum
  misc_feature: Ceres CLONE 1873510
  misc_feature: Encodes the peptide sequence at SEQ ID NO. 6526
gtcagttcatttctgctgcacaatcacagacacgcagtcgcgagctataagttttaatttgccaacatgaagagcagactgagcagtagactgccgtggcagcaagaggaggagctggacctcgagctcagcctcctccccggcgactcggacacggagccgcccggcttcttccgctgcacctactgcgaccgcaagttctacacctcgcaggcgctcggcggccaccagaacgcgcacaagtacgagcgcaccctcgccaagcgccgccgcgagatcgccgccgccttcaatgccggcggcgcggggcgcgccatcagcgtcgccgcgggagctgagaccgtcggagcgaggccgcggctggaagacgctctggcgccggagagatcgtctcgcctgctgctgcgggacaagaagggctcgtcggagcacggcggcgtcgagcgcgccgacgagctggacctgtccctcaggctatgatcgatggacctcgccctcggcgcctctcaagtttccgtaatcggtttgcctgctggttaatttttcctacctgtatgctttgcctcttagattattcaccgtcatcttgcacataaaagctgagtttctatccttggatacatatatgcttgcagatgagtttgtgtaataataggatttcttggcaacacgcgaagggcatataattcgtcc

SEQ ID NO: 6526 - protein, 137 aa, Panicum virgatum
  misc_feature: Ceres CLONE 1873510
  misc_feature (1)..(23): Pfam Name: zf-C2H2 Pfam Description: Zinc finger, C2H2 type
  misc_feature: The sequence is a functional homolog of  SEQ ID NO 2308 in the  10/374,780 US patent application
  misc_feature: The sequence is a functional homolog of  SEQ ID NO 501 in the  11/479,226 US patent application
  misc_feature: The sequence is a functional homolog of  SEQ ID NO 516 in the  10/225,066 US patent application
  misc_feature: Useful for making plants with modulated growth and phenotype characteristics
MKSRLSSRLPWQQEEELDLELSLLPGDSDTEPPGFFRCTYCDRKFYTSQALGGHQNAHKYERTLAKRRREIAAAFNAGGAGRAISVAAGAETVGARPRLEDALAPERSSRLLLRDKKGSSEHGGVERADELDLSLRL

SEQ ID NO: 6527 - DNA, 1022 bp, Panicum virgatum
  misc_feature: Ceres CLONE 1873927
  misc_feature: Encodes the peptide sequence at SEQ ID NO. 6528
atcgcatcatcacaactgcaagtacaagcagcagccacgtactcatcgatcactcctagcaagcacattaatcgcgttccgttgagacccgtacgagcaaggcagctgcgaggaatcgatcgatcgagatggcgggtctgatgaggctgctcgccgtgggcgtggccgtggcggcgctgctggcctcgccggcgccggtggcggtgtctgggcagccggtggccgggccgctgtcgtgcacggcgtcgctggtctccagcttcgcgccgtgcctcaacttcatcatcaacagcacggcctccccgacggccgactgctgccgctccctgggggcgctgatgaaggcgagcaccggctgcgcctgcctcatcctcaccggcagcgtgccgctcggcgtgcccgtcaaccggaccatggccgtcacgctgcccagggcctgcaacaacgcctccgtccccctgcagtgccaagacgcgacgacgtcggctcagaccccggctccgggtcccgtggcggacgcgcctgctccctcctcattggccccgctgccgcccatgacgacggcgccggtggcaacgccagtgcctgaagcgccggcgccggcgacggcgacggcgacgcctgcgttggagccgacgaacacgccgccgatcagccaggggcagacgaggccgacggttgtgcccagcagctctgcctggaggaggccgagcggcgcccacgggtccgttgcgctgctgcttgcagttgctggagccgccctggtgtgagatgtgtgatcccctagcagtggttagttgaataagcgttggaatttatttggtggagtgttttggacttttggtgattttttttagcagcagcactgcagcagtttggtacacggattgtattaatatgttcatttagcgatttggagttctgaacgcaccacctgcttgtaattagtttgttctttcaggttacgttgattgagaattgatggcatgattagtatggtgcaaaaaaaaaaaaaaaaaaaa

SEQ ID NO: 6528 - protein, 213 aa, Panicum virgatum
  misc_feature: Ceres CLONE 1873927
  misc_feature (1)..(89): Pfam Name: Tryp_alpha_amyl Pfam Description: Protease inhibitor/seed storage/LTP family
MAGLMRLLAVGVAVAALLASPAPVAVSGQPVAGPLSCTASLVSSFAPCLNFIINSTASPTADCCRSLGALMKASTGCACLILTGSVPLGVPVNRTMAVTLPRACNNASVPLQCQDATTSAQTPAPGPVADAPAPSSLAPLPPMTTAPVATPVPEAPAPATATATPALEPTNTPPISQGQTRPTVVPSSSAWRRPSGAHGSVALLLAVAGAALV

SEQ ID NO: 6529 - DNA, 623 bp, Panicum virgatum
  misc_feature: Ceres CLONE 1874066
  misc_feature: Encodes the peptide sequence at SEQ ID NO. 6530
gacaacaaacagccatgaagatagagagacatctccgcatggccaccggcgacggcgagaacagctacgcggccaattccagtgggcagaagaaggccatactgcaggctaggcccgtgcttcagaaggcaatagaagagctctacgcatcgctcccccgcgagagcacgatggtcatcgccgaccttggctgctcgtcaggccccaactcgctggtccttatgtccgaggtggtgaacatggtccaaaccatggtccgggaaacgggtgactgccgcgccgtggagatgcagttcttcctcaatgatctgcccggtaatgacttcaacctcgtgttccggtcactggaggagctccagagcttcagcatggacggggtggtgccaccaccgtactatgtggccgggctaccgggttcattctacacgaggcttctaccctgcaacagcgtccatctcttccactcgtcttattgcctcatgtggcgctctaaggtatgctgccctcgggcaaccttcaaagtatccaccgttcgtgtggtgtgagatatagcatgtgaaaaacatacaacagctagctttgctttacaacctcatatttctcaaaaaaaaaaaaaaaaaaaa

SEQ ID NO: 6530 - protein, 176 aa, Panicum virgatum
  misc_feature: Ceres CLONE 1874066
  misc_feature (1)..(127): Pfam Name: Methyltransf_7 Pfam Description: SAM dependent carboxyl methyltransferase
MKIERHLRMATGDGENSYAANSSGQKKAILQARPVLQKAIEELYASLPRESTMVIADLGCSSGPNSLVLMSEVVNMVQTMVRETGDCRAVEMQFFLNDLPGNDFNLVFRSLEELQSFSMDGVVPPPYYVAGLPGSFYTRLLPCNSVHLFHSSYCLMWRSKVCCPRATFKVSTVRVV

SEQ ID NO: 6531 - DNA, 756 bp, Panicum virgatum
  misc_feature: Ceres CLONE 1874278
  misc_feature: Encodes the peptide sequence at SEQ ID NO. 6532
acagagatcgtcagtttatttctgcttcaaaaaaaaaaaagtctcacaaagtcacagacacgcagtcgcgagctataagctttgccaacatgaagagcagcaggcagctggggcagcagcaggaggaggagctggacctcgagctcagcctcctccccggcgactcggacacggagccgcccggcttcttccgctgcgcctactgcaaccgcaagttctacacctcgcaggcgctcggcggccaccagaacgcgcacaagtacgagcgcaccctcgccaagcgtcgccgggagatcgccgccgcaatgcgcgcgcacggggccgcgcccgtggtgggcgcctgggtcgacgccgccttcaggaccggcggcgacgcggggcgcgacatcggcgtcgccgcgggaactgagcccgacggagcgaggccgcggctggaagacgctctggcgccggaaagatcgtctcgcctgctgctgcgggacaagaagggctcgtcggagtacggcggtgtcgagcacgccggcgagctggacttatccctcaggctatgatcgatggacctctgatctctcccgcggcgcccctcaagtctccgtgatcgatttgcttggttaatctatccagtctgcatgcttgccagagttttttttcttgttcttttggatgggtgcaatacaagtactaagctctttcttagattcacagtgatcttgcatataaaagttgagtttctctcaaaaaaaaaaaaaaaaaaaa

SEQ ID NO: 6532 - protein, 153 aa, Panicum virgatum
  misc_feature: Ceres CLONE 1874278
  misc_feature (1)..(23): Pfam Name: zf-C2H2 Pfam Description: Zinc finger, C2H2 type
MKSSRQLGQQQEEELDLELSLLPGDSDTEPPGFFRCAYCNRKFYTSQALGGHQNAHKYERTLAKRRREIAAAMRAHGAAPVVGAWVDAAFRTGGDAGRDIGVAAGTEPDGARPRLEDALAPERSSRLLLRDKKGSSEYGGVEHAGELDLSLRL

SEQ ID NO: 6533 - DNA, 731 bp, Panicum virgatum
  misc_feature: Ceres CLONE 1874339
  misc_feature: Encodes the peptide sequence at SEQ ID NO. 6534
gccatgtcctccaagccatcagccagcttagttattaggcatcacagaagcaagcaagtacgggttccgtgatcatcagtgtgtgtgtcaggtgacgaggatgaggggtctccttgtgctcgccctcctgctcgccgccgcggcgtgcctcgccgagggcgcgggcgagtgcggggcgacgccgccggacaggatggcgctgaggctggcgccgtgcgcgtcagcggcgcagaacccgagcgccgcgccgtccggcacctgctgcggcgctgtgcgcaccatcgggaagcagagcccccagtgcctgtgcgccgtgatgctgtccaacaccgccaagagctccggcatcaagcccgaggtcgccatcaccatccccaagcgatgcaacctcaccgaccgccccgtcggctacaagtgcggagcttacacttcgccatgagcagtaaggactgaacgcggctggtgcgtggcatgttcatggatcacctaagtacaagcacgaagtcgtgtccgtgtgtgtgtgtgtgtgtgtctctgtgtgtaaccaataataaacgacagttgcgagtaccatccatgtggaactctagtatgttgagtgattgagtctatccttagagatgtatacttgctactcatgtggtcacgttcagggtccagagatgtagtcctgcattgtcgaaataaaactaatctctccttttcttttacaaaaaaaaaaaaaaaaaaaa

SEQ ID NO: 6534 - protein, 112 aa, Panicum virgatum
  misc_feature: Ceres CLONE 1874339
  misc_feature (1)..(83): Pfam Name: Tryp_alpha_amyl Pfam Description: Protease inhibitor/seed storage/LTP family
MRGLLVLALLLAAAACLAEGAGECGATPPDRMALRLAPCASAAQNPSAAPSGTCCGAVRTIGKQSPQCLCAVMLSNTAKSSGIKPEVAITIPKRCNLTDRPVGYKCGAYTSP

SEQ ID NO: 6535 - DNA, 872 bp, Panicum virgatum
  misc_feature: Ceres CLONE 1874443
  misc_feature: Encodes the peptide sequence at SEQ ID NO. 6536
aaaaactgcaaggttgctacccaacccgactccgacacgtcagtcatggaagcctcaacggcacaggcgccggcgaagaccgttctgagggtggcggcgatctccggctcgctccgcagggcgtcggccaacaccggcctcatccgcgccgccgcggagatctgcaaggactgcatcccggggttgcagctcgaccacgtcgacatctccgagctgccgctgctcaacaccgacctcgaggtcgacggtggcttccctccggccgtcgaggcgttccgcgccaaggtccgcgcggccgactgcttcctcttcgcctcgcccgagtacaactactccatttcaggccctctgaagaacgcgctagattggggatcacggccgccgaactgctttgcagacagagccgcggcgatcctgagcgcgtcgggcggctccggcggcagccggtcgcagtaccacatccggcaggtcggggtgtttcttgacatccatttcatcaacaagccagagatcttcaccaaagcacacatgccccccaaaaagttcgatgatgatggcaacctgatcgatccagagaccaaggagcagctcaggaagatgctcctgtcgctacaagctttcgcgctcaggctccaggggaagactgcaagctctgaacaggggagttgatggctccatttgtttcttgtattggggtgaatagtactttactagttttcattggattgtccgagcagatcattgcactccaaatgccggagtgatctgtgctagcgtacactcgaattgatgtcttgaataattctgtgcgactgaacatttcggtggcaataatgcaaaaccacatttatcaaaaaaaaaaaaaaaaaaaa

SEQ ID NO: 6536 - protein, 207 aa, Panicum virgatum
  misc_feature: Ceres CLONE 1874443
  misc_feature (1)..(167): Pfam Name: FMN_red Pfam Description: NADPH-dependent FMN reductase
  misc_feature (1)..(199): SWISSPROT Homolog: EC 1.6.5.2 NADPH:quinone oxidoreductase
  misc_feature (10)..(199): SWISSPROT Homolog: EC 1.6.5.2 NAD(P)H:quinone oxidoreductase
MEASTAQAPAKTVLRVAAISGSLRRASANTGLIRAAAEICKDCIPGLQLDHVDISELPLLNTDLEVDGGFPPAVEAFRAKVRAADCFLFASPEYNYSISGPLKNALDWGSRPPNCFADRAAAILSASGGSGGSRSQYHIRQVGVFLDIHFINKPEIFTKAHMPPKKFDDDGNLIDPETKEQLRKMLLSLQAFALRLQGKTASSEQGS

SEQ ID NO: 6537 - DNA, 638 bp, Panicum virgatum
  misc_feature: Ceres CLONE 1874461
  misc_feature: Encodes the peptide sequence at SEQ ID NO. 6538
aagatcatcagagttcatctcagtgcagtgtagtgaaggcagcagagtgttgtcaagtgcgctaccaggcagaggcatgatcaaagcaatggagctccaggcgacgaggtgcatctgcgtcatcgcgatgctcctggtggccggcctggcggggatggagacggcgcacggcgcgggagagtgcggccgcacgcccgtggaccaggtggcactcaagctggccccgtgcgcggcggcgacacagaacccgcgggccgcggtgccgccgtcctgctgcgcgcaggtgcgcgccatcgggcgcaaccccaagtgcctctgcgccgtcatgctgtccggcacggcgcggaaggccggcgtcaagcccgccgtggccatgaccatccccaagcgctgcgccatcgccaaccgccccgttggctacaaatgcggcccatataccctgccatgagaggtgatgatgatgatgaggaacaaagtgatggcgccggcacctggggctccaaactctgaatgtccaatatgctgcgatctctgtcttgtgggactttcaaaatatccctgaataatgtggctgtaacaatgcctcaactttgctttggaataaactacttttttccgaaaaaaaaaaaaaaaaaaaa

SEQ ID NO: 6538 - protein, 123 aa, Panicum virgatum
  misc_feature: Ceres CLONE 1874461
  misc_feature (1)..(82): Pfam Name: Tryp_alpha_amyl Pfam Description: Protease inhibitor/seed storage/LTP family
MIKAMELQATRCICVIAMLLVAGLAGMETAHGAGECGRTPVDQVALKLAPCAAATQNPRAAVPPSCCAQVRAIGRNPKCLCAVMLSGTARKAGVKPAVAMTIPKRCAIANRPVGYKCGPYTLP

SEQ ID NO: 6539 - DNA, 715 bp, Panicum virgatum
  misc_feature: Ceres CLONE 1874480
  misc_feature: Encodes the peptide sequence at SEQ ID NO. 6540
ctactatcacttggcatttctgactcatctctatcttttccggccaccgtataatcaatcctctaatcccaccagcaaggcagtaatggcggatggggagatggactggatcgcggcgcggttcctgctgtccaccatactcggggtgcacccgctggtggtcctggacgacggcggccgcgacgacgagcacttcgccgtggacgaccgcggccagcgcgtgacggtgccggtgccggcggcggtggaggcgcccgacggggtggccggcgtgtcggtgtgcgcggtgtgcacggaggaggtcgcggcggggcaggccgtggtgcggctgccgtgcgcgcactggtaccacgccggctgcatcgccccctggctgcggatccggaacaactgcccgacgtgccgggcggagctgcctcgggagggcggggcggagaggccgcggccgcctgccggtgccggctggttgcggcgggaggcgtcctacacgatgcttgccggcacgttgccctgctaataattaaactagctactagccggcggacgtgcgtgacagcctgacaggcaacgcgtcgtgacagtagtattaatgtacagcgatatttgaagaatttttttagtgttagcaatgtacagcgctaaggcgataatctaatcgaagcgaccaaaactaagagtttggagatttcactcggaaaaaaaaaaaaaaaaaaaa

SEQ ID NO: 6540 - protein, 143 aa, Panicum virgatum
  misc_feature: Ceres CLONE 1874480
  misc_feature (1)..(41): Pfam Name: zf-C3HC4 Pfam Description: Zinc finger, C3HC4 type (RING finger)
MADGEMDWIAARFLLSTILGVHPLVVLDDGGRDDEHFAVDDRGQRVTVPVPAAVEAPDGVAGVSVCAVCTEEVAAGQAVVRLPCAHWYHAGCIAPWLRIRNNCPTCRAELPREGGAERPRPPAGAGWLRREASYTMLAGTLPC

SEQ ID NO: 6541 - DNA, 595 bp, Panicum virgatum
  misc_feature: Ceres CLONE 1874738
  misc_feature: Encodes the peptide sequence at SEQ ID NO. 6542
atatctagctacctacatacaaccaacacacacaattgccagcacacaattcgatcacaaccgtatccctaaccagccagctagtagcaatacaataactaataatacgatgggccaccaccaccacgtcaagaacaaggaggccgaggccgccgccggcgacgaccggcggcgcaaggaggagatgaagcaccacaagcacatggagcagctcgcccagctcggtgccgccgccgcgggggcctacgccatgcacgagaaacacaaggccaacaaggaccccgaccacgcgcgctcgcaccggatgaagcaggagatcgccgccgccagcgcgggcttcgccatccacgagcaccacaagaagaaagaggccaagaagcacgggcggcaccaccattaattagctagatacatccgtctatatatgtgtttgtttgtccttcatacattcattatttctctttctcagattgtacgtataaacagtattgcgttgtattcgagttttgtaaattaatattagccctgtattgtgctactaactttgttttcatacatttgttgaagccgttatgaaaaaaaaaaaaaaaaaaaa

SEQ ID NO: 6542 - protein, 96 aa, Panicum virgatum
  misc_feature: Ceres CLONE 1874738
  misc_feature (2)..(54): Pfam Name: ABA_WDS Pfam Description: ABA/WDS induced protein
MGHHHHVKNKEAEAAAGDDRRRKEEMKHHKHMEQLAQLGAAAAGAYAMHEKHKANKDPDHARSHRMKQEIAAASAGFAIHEHHKKKEAKKHGRHHH

SEQ ID NO: 6543 - DNA, 983 bp, Panicum virgatum
  misc_feature: Ceres CLONE 1874997
  misc_feature: Encodes the peptide sequence at SEQ ID NO. 6544
gtgtccatccccattccttccgttgccccccacaccccctcgcgtcgacagcctcgaaagaatcggaaattacagcccggtccccggatcggatccccccaaatcagcctcggcctcgagcgcgccgctccgccgcgatggggatctcgagcatgccggagccgcgggacagcctgctggggttcctggtctacaacgcggtgatctcgctggcggcgctggcggggctggtgcgggcggcgctggtgttcctcgacctcggggactgggaggccgacggcgccggcagcggggaccgcctcgtgtccgccgcggggccggggccggcggagaggatgcagagggccctcctccgcccggcgcggctcggcccgatcccgggggtcacgacgacgtgcggcgcggcggcggccggggacgactgcagcgtgtgcctggcggagttcggggccgcggccgtggtgaaccggctcccctgcgggcacctcttccaccgcggctgcctcgagacctggctccggtacgagcgcgccacctgcccgctctgccgcgcccacgtccccgtccccgcccccgcccccgccgacgacacgccggggcttcgctacccggagtgcgagtgatcccgtccggcgcccggcggacttccccacccccacgacccgccgtcgtcgcgcgcccggctgtgtgctgcaggctccgtgtggcctttccgtgtgcgcgtagcaaagcttaggagtagtagagttgctgttgctttccttttttttctcatttttttcttattttttttgcccccatcttgttgtttctgttgctgtcgctgtagcgtgtaaatactccagttcgcagcagagtgtgtggagtgctcccgcggctgtggtgtagcgctttttacgagctctgctcgtgtacatgcttcttccccccaaccagcaaaatatcgaggaaaaattcgccaccaaaaaaaaaaaaaaaaaaaa

SEQ ID NO: 6544 - protein, 161 aa, Panicum virgatum
  misc_feature: Ceres CLONE 1874997
  misc_feature (1)..(42): Pfam Name: zf-C3HC4 Pfam Description: Zinc finger, C3HC4 type (RING finger)
MGISSMPEPRDSLLGFLVYNAVISLAALAGLVRAALVFLDLGDWEADGAGSGDRLVSAAGPGPAERMQRALLRPARLGPIPGVTTTCGAAAAGDDCSVCLAEFGAAAVVNRLPCGHLFHRGCLETWLRYERATCPLCRAHVPVPAPAPADDTPGLRYPECE

SEQ ID NO: 6545 - DNA, 1887 bp, Panicum virgatum
  misc_feature: Ceres CLONE 1875150
  misc_feature: Encodes the peptide sequence at SEQ ID NO. 6546
gaccgcagggctcgatcgggtctgcgtctgctcaccgaaacagccgcagccatggcgacctgctcgagaatccccttcgcctgcttcctcgtggcgccgccgctgctgctgctgcttctgtcgtcgtcgacagcccgcgcggaggaggcggcggcggcggtgctgacgctggacgccggcaacttctcggaggtggtggcagcgcaccagttcatcgtcgtcgagttctacgccccctggtgtggccactgcaagcaactagctccagagtacgagaaggccgcgtccatcctgagcagacatgacccaccggtcgttcttgccaaggttgatgccagcgacaagacgaataaggatctcagcggcaagtacgatgtgcaggggttccccaccatcaagatcttgaggaaccagggggagaatgtgcaggagtacaatggccccagggacgcagatggcatagtggagtacctgaagaagcaggtcggtccagcctctgttgagatcaagtcggcggagtatgccacaaatctgatcggcgacgagggtgtggtcattgttggagttttccctgcatttggtggtagagagtttgagggtttcatggccgtggctgagaggatgagaaatgactatgacttcctccacacactggatgccagtattctaccgcgaggggacaaggctgtcaaaggacctgctgttcggctctttaagcccttcgatgagctctttgttgattccctggattttgacaaagatgcactacaaaagtttatcgaaatttctggtttcccaactgtagttacctttgacaccaatccaacaaatcacaaattcctcctcaaatactttgacaatgatggtaccaaagcaatgcttttcctgagcttcgatgatgacaggattgaggcctttaagagtcagttttatgaagctgcaaagcaatatggtgagaagaacataagttttctgatcggtgatgttactgaagcacagggtgctttccagtattttgggctcaaagaaagtgaagtgcccctcctcttcatacaagcgtcgactgcaaaatatatcaaaccaactgtggaacctgatcaaatcttaccctggttgaaagagtacacagatggcaccttattaccacatgtcaagtcagatccaattccggtggtcaacgaccaacctgttaaagttgtcgtcgctgatgatatcaatgatgtggttttcaactctggcaaaaatgtgcttcttgagttttatgcaccgtggtgtggccattgtcagaagctggccccaaccttggacgaagttgcagtttcgttgcagaatgatggagatgtgatcattgcaaagatggatgctaccaccaacgacataccaccagattttgcagtcgagggatatccaaccatgtatttctactcatccgcgggaaacctcctaccatacgaaggtggaagaaccgctgaggagatcatcgatttcatcaagaagaacaagggctccaaacctggtgaagctgctgtagatgatgtggcagatgagaatgatgtcatggaggagcaagaacctgaaccagagtctgttaaagatgaactgtgatcattgagactggcgagcttttcaccgtgaagaacgctcagcattgttcctgttcaaagtttgagtaggcgtcttaagtagcaagccacaccgcacagtttcattacgttcaaaaagaaaaacaccagacagtttcaggacacagttcagtaattctgttttcaggcaaaagtcaagaaaattctacaggtgtgctcgtttgtagagagaatactgaatcagtgagcaatccatttcgctggacctctaatggggtcgttggggtcccagctaatgtgcctc

SEQ ID NO: 6546 - protein, 517 aa, Panicum virgatum
  misc_feature: Ceres CLONE 1875150
  misc_feature (20)..(517): SWISSPROT Homolog: EC 5.3.4.1 Protein disulfide-isomerase precursor
  misc_feature (5)..(504): SWISSPROT Homolog: EC 5.3.4.1 Protein disulfide-isomerase precursor
MATCSRIPFACFLVAPPLLLLLLSSSTARAEEAAAAVLTLDAGNFSEVVAAHQFIVVEFYAPWCGHCKQLAPEYEKAASILSRHDPPVVLAKVDASDKTNKDLSGKYDVQGFPTIKILRNQGENVQEYNGPRDADGIVEYLKKQVGPASVEIKSAEYATNLIGDEGVVIVGVFPAFGGREFEGFMAVAERMRNDYDFLHTLDASILPRGDKAVKGPAVRLFKPFDELFVDSLDFDKDALQKFIEISGFPTVVTFDTNPTNHKFLLKYFDNDGTKAMLFLSFDDDRIEAFKSQFYEAAKQYGEKNISFLIGDVTEAQGAFQYFGLKESEVPLLFIQASTAKYIKPTVEPDQILPWLKEYTDGTLLPHVKSDPIPVVNDQPVKVVVADDINDVVFNSGKNVLLEFYAPWCGHCQKLAPTLDEVAVSLQNDGDVIIAKMDATTNDIPPDFAVEGYPTMYFYSSAGNLLPYEGGRTAEEIIDFIKKNKGSKPGEAAVDDVADENDVMEEQEPEPESVKDEL

SEQ ID NO: 6547 - DNA, 1036 bp, Panicum virgatum
  misc_feature: Ceres CLONE 1875272
  misc_feature: Encodes the peptide sequence at SEQ ID NO. 6548
ctgatttctgatctctcaaacgcgccaacagaaccggcagcaggcgccggcggcactcccaacccccaatcgcaatcgattcgctcgctggcaccagagaccaatccggtggcaccggatggcggcggcgcccccgaggccgggcggcttcgtgctgtttctgcacggctccggcgggtcgggcgacgagagccgcgccgaggtcgcgccctacttcgccgcgccggagctcgccgcctccgtccgcctctccttccccaccgcgcccacggcctccatcgcctgctacggtgatgcggtgatcactgcttggttcggcatcacggaggttcccataaccgtgaaaactgtcagagacgagaaagaagtccttaaagctgttgattatgtgcatgtattgttagacgaagaaatagcttccggaacaagtccgtcagacatatttgtttgtgggttgagccaaggaggtgctctagccatagcaagtgttcttctctacccaaaaactttaggtggttgtgttgttttcagtggttcagttccgctgagtaaatcatttgctgacaaggtgtggcctgaagctaggaagacaccggtattatggtttcatggaatggctgatgggctggtcttatttgaagcggggcatgttgggtgtgcatttttagaagagcttggcatgatctgtgaattcaaggcttatcctacccttggacattcaatgattgatgaagagctccagtattttcagaaatggatcctgaatcgtctagggatctgtggagcaactgaaactgcaagaccgtcatcgtcatctcagcacaaggatctccagtagctgctgttgcttgtgaacgaatagtttatattaaaattcatggctgcatttttagacggcataacatttctaaactggaaaatatttcacatacaaatgctcaatgtacaatccatgtacacgactctgtaaagaccacatgattcgagcagtttggtccataaatgagccaccacttaaaaaaaaaaaaaaaaaaaa

SEQ ID NO: 6548 - protein, 239 aa, Panicum virgatum
  misc_feature: Ceres CLONE 1875272
  misc_feature (1)..(216): Pfam Name: Abhydrolase_2 Pfam Description: Phospholipase/Carboxylesterase
MAAAPPRPGGFVLFLHGSGGSGDESRAEVAPYFAAPELAASVRLSFPTAPTASIACYGDAVITAWFGITEVPITVKTVRDEKEVLKAVDYVHVLLDEEIASGTSPSDIFVCGLSQGGALAIASVLLYPKTLGGCVVFSGSVPLSKSFADKVWPEARKTPVLWFHGMADGLVLFEAGHVGCAFLEELGMICEFKAYPTLGHSMIDEELQYFQKWILNRLGICGATETARPSSSSQHKDLQ

SEQ ID NO: 6549 - DNA, 828 bp, Panicum virgatum
  misc_feature: Ceres CLONE 1875393
  misc_feature: Encodes the peptide sequence at SEQ ID NO. 6550
aagcaacggcagatagatatccccgacgacgacgtcgagcgcagcaatctagcagcatccgcctcagcctcgtccccgttcccgatccctccccgattcgatacgaggcgagtgtcgcgtcggctccgaaccggatcggagcccgggggagtttggatttggtggaaggggggtagagaggggaggagggggacatggaccaggtgctcaacaaggtggggagctactggttcagcaagagggccagcaaggagatcgactccatcggcgacgacatcagttctatctcaagcagcattggagagtcagccaaatggatggtgaacaagattagagggaagatgcagaaagcactaccagacctcctcaaggaatatgacatgccagctggcctcttcccacgggacgcgactaactatgagttcaatgaggagacaaagaagctgatggtgtacatcccttcagcgtgcgacgttgggtacaaggactcgtcagtcctgcggttcttcacctgtgtgactggctaccttgagaaaggtaagttttccgacattgagggcatgaagaccaaagtgctggtctggaccaaggtgaccaccatcaagaccgagggctcgaaggtccatttcactgcaggtgtgaagaagacccggagccgtgatgcctatgaggttgttagggatggtatcaccatagacaaattctagaccatggttcgctttgtaattaaattatccagaccatgattctccgcctcttggtacaccaaaagtctaaaatatggtgtggtactgcccatttggtcattaaaaaaaaaaaaaaaaaaaa

SEQ ID NO: 6550 - protein, 170 aa, Panicum virgatum
  misc_feature: Ceres CLONE 1875393
  misc_feature: Great-hit functional homolog of the protein sequence given in SEQ ID NO 9372
  misc_feature: Useful for making plants with modulated nitrogen use efficiency
MDQVLNKVGSYWFSKRASKEIDSIGDDISSISSSIGESAKWMVNKIRGKMQKALPDLLKEYDMPAGLFPRDATNYEFNEETKKLMVYIPSACDVGYKDSSVLRFFTCVTGYLEKGKFSDIEGMKTKVLVWTKVTTIKTEGSKVHFTAGVKKTRSRDAYEVVRDGITIDKF

SEQ ID NO: 6551 - DNA, 1550 bp, Panicum virgatum
  misc_feature: Ceres CLONE 1875396
  misc_feature: Encodes the peptide sequence at SEQ ID NO. 6552
gttctgttccctgacgccccttcccttctacctcacggccgccgctgctctggactgaagctcgcctcctcgccttcccccgcatcgggtcctagcccagaggcttggtggcaagccgccttttaagtcggctcatcagcggccaacggcggcggcgttctcccccgaccccgctaccggccggtatcgggttggcgtgaagtggagatccatccggaaaattgccgaattgggatcgatctcttctgttggttcatcttctcctccagcgcgcgagttcgatccacctggcgcaaggtgctggtgccgatggagcacgctaagtccggccccggcagttggccggagatggccgacgtggtaccagtgccgcaggacgatgggcccagccccgtggtccccatcgcctaccgcgacgacttccgcgaggtcatggactacttccgcgccctctacttcgcgggagagcgcagtccccgtgccctccgcctcaccgccgaggccatcgagctcaaccccggcaactataccgtctggcatttcaggcgccttatcctggagacactagattatgatttactgcaagagatgaattttgtcgaaaaaattgctgaatgtaatccaaaaaattaccaaatctggcatcataagagatggcttgctgagaaattaggacctgatgttgcgaataaagagcatgaattcacaatgaagatacttgctcttgatgccaaaaattaccatgcttggtctcataggcagtgggttcttcaagcactgggtgggtgggagagtgaattgcagtactgcaacaaactacttgaggaagatatcttcaataattcagcttggaatcagagatatcttgtaataacaagatcaccacttcatggtggccttatggcgatgcgtgattcagaagtagattatacaattgaagctattctagcaaatcctcagaatgaaagcccttggaggtacctcaagggtctatacaaaggcgagaataacttgctagtagccgacgagcgcatatctgatgtttgcctcaaggtcttgaagaatgattggagttgtgtgtttgctttgagcttgttgcttgatcttcttcgctcaggtttgcagccttcggatgaacttaaagccacccttgaaccaataaggcactccaacccagaaatggcagatgctgatcttgcgacagcagtttgctgtacccttcagaaatgtgatcccctccgggtaaattattggtcttggtacaaaaccaccctttcttctcagatctcataacattacatgggctcacagcttgttaccctcgttgtactggactctgaggtagacatgatttaggtgccttgggttaaagatggtttcactggatctacatgatgcaaagccaaccagggcggactgtgtactggattaagcttggcagaatttatcaatgttattgttccaaaatacacttgcggcaacaaatgttacctcatacaagtaagcttgaatacattgcaattgtcatgcaaaaaaaaaaaaaaaaaaaa

SEQ ID NO: 6552 - protein, 327 aa, Panicum virgatum
  misc_feature: Ceres CLONE 1875396
  misc_feature (1)..(31): Pfam Name: PPTA Pfam Description: Protein prenyltransferase alpha subunit repeat
  misc_feature (13)..(323): SWISSPROT Homolog: EC 2.5.1.58 Protein farnesyltransferase/ geranylgeranyltransferase type I alpha subunit
MEHAKSGPGSWPEMADVVPVPQDDGPSPVVPIAYRDDFREVMDYFRALYFAGERSPRALRLTAEAIELNPGNYTVWHFRRLILETLDYDLLQEMNFVEKIAECNPKNYQIWHHKRWLAEKLGPDVANKEHEFTMKILALDAKNYHAWSHRQWVLQALGGWESELQYCNKLLEEDIFNNSAWNQRYLVITRSPLHGGLMAMRDSEVDYTIEAILANPQNESPWRYLKGLYKGENNLLVADERISDVCLKVLKNDWSCVFALSLLLDLLRSGLQPSDELKATLEPIRHSNPEMADADLATAVCCTLQKCDPLRVNYWSWYKTTLSSQIS

SEQ ID NO: 6553 - DNA, 1756 bp, Panicum virgatum
  misc_feature: Ceres CLONE 1875465
  misc_feature: Encodes the peptide sequence at SEQ ID NO. 6554
gcctcctaggataggaaaatggtcgctgctgctatcctggtgctgcgttcgtcaggtcggaacaaaagagtagagacagcatcgtacctaccaagtgaacccatcttcgccgccggccttacatatttcatcgcctggttgttgtggccggaccgaagctttgaagcgagtcgccgcctgggcctgttcgccgcagtaggagcagagagtcagagaacaaagccactaacccacctcgatggagtcgcctgtcgccgtcgccgtcgtcccgttcccggcgcagggccacctgaaccagctgctccacctggcgctgcacctcgccttgcgcggcctgcccgtacacttcgcggcgcccgcggagcacgtccgccaggccaaggcgcgcctgcacggctggggcgccggcgccctccgcggcatcgagttccacgagctcgccatctccgagtacgactccccgcctcccgaccctgccgcggactcgccctacccctcccacctcctgcccctgttcgaggcgttcgtcgccgacgcgcccaccgcggtcgcggccctcctccgcaggatctccgcctcccaccgccgtgtcgtcgtcctgtacgacatcatcaacgccttcgccgcggaggaggccacgcggctgcccaacagcgaggggttcgcgttccactgcaccgccgcgtctatcctcgccagggggttggatttggatggagggctccagctgcggatgagcgatgtgcacggcttcgccgacatcccaccccaaggcttcgtgcccgacaagcacctggagttcatcggcaagcaggccagaagccaccagacggtcccgtccagcgccggcgtcatcatgaacacgtcccgcgcgttagagggtgagttcatcgacttcgtgaccgagcggctcggcgccgccggcaagaaggtcttctcgatcgggccgctgaacccggtgctggatgcgaacgcgcccgagcaggtagcagagcggcactggtgcctcgactggctcgacaagcagccggccgcgtccgtgctctacgtgtcgttcggctcggtatcctcgctgcgcggcgagcagatcgaggagctcgcggcggcgctgcgcgacagcaagcagcggttcatctgggttctgcgcgacgccgaccgcggcaacgtgttcgcggcctccggcgagagccggcacgccaagttcctgtccgagctcaccaagcaaacagagggaacagggctgctgatcaccgactgggcgccgcagctggagatcctagcccaccccgccacggcagcgttcctgagccactgcgggtggaactccacgatggagagcatgagctacgggaagcccatcctggcgtggcccatgcactccgaccagccgtgggacgcggagctggtgtgcaagtaccttaagaccggcttcctggtgaggccatgtgagaagcacgccgaggtgattccagcggcagccatacgggaggtgatcgagaagatgatggtctctgaggaagggctcgcggtgcggcagcgtgcagtggcgctcggtgaggccgtccgtgcgtccgcggctgcgggtgggtcatcccaaaaggaccttgaggacttcattgctcacatcacaaggtaagagatccaagaatgcaggaacaattggtgtatcaatttgtatttcagttctattttcttcctgaaaataagttggagagtgttttgtacaagtggtaagtaaaaaaaaaaaaaaaaaaaa

SEQ ID NO: 6554 - protein, 465 aa, Panicum virgatum
  misc_feature: Ceres CLONE 1875465
  misc_feature (2)..(138): Pfam Name: UDPGT Pfam Description: UDP-glucoronosyl and UDP-glucosyl transferase
  misc_feature (1)..(465): SWISSPROT Homolog: EC 2.4.1.215 Cis-zeatin O-glucosyltransferase 1
  misc_feature (1)..(465): SWISSPROT Homolog: EC 2.4.1.215 Cis-zeatin O-glucosyltransferase 2
MESPVAVAVVPFPAQGHLNQLLHLALHLALRGLPVHFAAPAEHVRQAKARLHGWGAGALRGIEFHELAISEYDSPPPDPAADSPYPSHLLPLFEAFVADAPTAVAALLRRISASHRRVVVLYDIINAFAAEEATRLPNSEGFAFHCTAASILARGLDLDGGLQLRMSDVHGFADIPPQGFVPDKHLEFIGKQARSHQTVPSSAGVIMNTSRALEGEFIDFVTERLGAAGKKVFSIGPLNPVLDANAPEQVAERHWCLDWLDKQPAASVLYVSFGSVSSLRGEQIEELAAALRDSKQRFIWVLRDADRGNVFAASGESRHAKFLSELTKQTEGTGLLITDWAPQLEILAHPATAAFLSHCGWNSTMESMSYGKPILAWPMHSDQPWDAELVCKYLKTGFLVRPCEKHAEVIPAAAIREVIEKMMVSEEGLAVRQRAVALGEAVRASAAAGGSSQKDLEDFIAHITR

SEQ ID NO: 6555 - DNA, 662 bp, Panicum virgatum
  misc_feature: Ceres CLONE 1875576
  misc_feature: Encodes the peptide sequence at SEQ ID NO. 6556
atcctcacaccacgccgtgccacgaatcgcgtcgatcctcctgcgcgccatggccaccgcgtctctgtccgccgtcgcgtcgccgctgtccgtcgccgggctcaggaagccgctcggcgccgcggcgtcgtcgttccagcccctgcagccgagggcgaggccggccgccaggatggccgtgcgggcgtcggcggcgtccatgaaggagaaggcggcggccgggctgaccgcggcggccgtggcggcggctctcgtgctgcctgacgtcgctgaggccgcgcagtccgggctgacaccgtcgctcaagaacttcctgctcagcatcgtgtccggcggggtcgtcctcgtggccatcgtcggcgccgtcgtcgccgtctccaactttgacccggtcaagcgggcctgagggatcattcgttcgttaggaggcacgtctccccctgtatcatgtatccagcggtaaaccattctgtgttattttggaggctgttcgaacttatttatgatacggagttcgagttaaaccatcgttgctttttgttcaatttatgcgattttgatgcttcgatgcgtgcatgctgtataaagtttaaaaggtgtttgtactgatgttttactttggaagttcttattattatattgaaaaaaaaaaaaaaaaaaaa

SEQ ID NO: 6556 - protein, 118 aa, Panicum virgatum
  misc_feature: Ceres CLONE 1875576
  misc_feature: Great-hit functional homolog of the protein sequence given in SEQ ID NO 9275
  misc_feature: Useful for making plants with modulated nitrogen use efficiency
MATASLSAVASPLSVAGLRKPLGAAASSFQPLQPRARPAARMAVRASAASMKEKAAAGLTAAAVAAALVLPDVAEAAQSGLTPSLKNFLLSIVSGGVVLVAIVGAVVAVSNFDPVKRA

SEQ ID NO: 6557 - DNA, 1871 bp, Panicum virgatum
  misc_feature: Ceres CLONE 1875667
  misc_feature: Encodes the peptide sequence at SEQ ID NO. 6558
accactgcacagtacacacaccactgctccctgcctcagctcgctcccccctctctctccgtcctccaatgcgagaggctcccggggcgcgcgagctctgaagcccatggcagccgcggccgggagcccttggcgcagcgccggacccgtcgcggccctcgccctcctcgctccaccggaacctcaccaacacgctccgcgccctctcgctcgcggccgactcggacccctccgcctccgaccccgccgccgctgccgccgctgacgccaacgcctcgtccccccgccagctcgacctccaggccaaggacctgatccgcgccgcgcgcgccgccatcgccgaatccaagccgctcttcgacccgcagctcaagatccagcgcctcaaggacgccatcttcgcgcagaacgagctgctcgcgcgcgccaagaagcgcggcgccttcgcctccctcatcgctgccaagtccatccccaagccgctccactgcctcgccgtccgcctcaccgccgagcggatcgcgaggcccgagcagtacgcggacccggtgccgccgcagcgggcgctcgaggaccccgcgctcttccactacgccatcttctctgacaacgtgctcgcggcctcatgcgtcgtgcgctccgccgtcgccaactccaacgacccctccaagcacgtcttccatgttgtcaccgatcggatgaacctcggtgccatgcaggtgataatacgccgaatggacttaaaaggtgcacactatgaggttaaagcatttgaggattacaaatttctgaactcctcatatgtccctgtgctccggcaactggagtctgcaaaccttcaaaaattctattttgagaacaagcttgagaatgccaccaaagatgctagcaatatgaaattcagaaatcccaagtatctatctatgctcaatcacttgcgattctatttgccggagatgtacccgaagctgcaccgtattcttttcttggacgatgatgttgtggtacagagggatcttacaggactgtggaagattgacatggatgggaaagtgaatggagcagtagaaacgtgctttgggtcttttcatcggtattggcagtacatgaacttctcacatccccttatcaaagcaaagtttagtcctaatgcctgtggatgggcatatggcatgaacttctttgatcttgattcttggaggagggagaagtgtactgagcagtaccattactggcagaatcagaatgcgaaccggacattatggaagctaggaacgctgcccccaggcttaatcacattctactccaccacgaagcctctggacaaatcctggcatgttcttgggcttgggtacaatccaagcatcagcatggaggagatcaggaatgctgctgttgtgcatttcaatggtaatatgaagccgtggctggacatcggtatgaaccagttcaggcacctttggacaaagtatgtggactacgatgacgaatatattcgtcaatgcaattttgcaccaccatagaaggcttaattatctatgtatccattcttcaatgaaaaacaaagaagtttggcaattagaactagtgactgccactgaagggttactgccactgaagggttacatgttctgtaagcacattttgtgtagagattcaaggagtttgtcaagtacaactgaagggtccacaattctttctcgcttataatgtacgtcaccgattaagttataatgaaagtaatgttcgccacatgaacattattttcgttatgtttgtaataatgttttttagtgcgtttgtaataatgttatgtctgcgatagcgtgtgtatgccgaagtcagatatataatgttcatgtggatcctag

SEQ ID NO: 6558 - protein, 274 aa, Panicum virgatum
  misc_feature: Ceres CLONE 1875667
  misc_feature: Great-hit functional homolog of the protein sequence encoded by LOCUS At3g25140
  misc_feature (71)..(317): Pfam Name: Glyco_transf_8 Pfam Description: Glycosyl transferase family 8
  misc_feature: Useful for making plants with altered cell wall content and/or composition
MNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYWQYMNFSHPLIKAKFSPNACGWAYGMNFFDLDSWRREKCTEQYHYWQNQNANRTLWKLGTLPPGLITFYSTTKPLDKSWHVLGLGYNPSISMEEIRNAAVVHFNGNMKPWLDIGMNQFRHLWTKYVDYDDEYIRQCNFAPP

SEQ ID NO: 6559 - DNA, 2818 bp, Panicum virgatum
  misc_feature: Ceres CLONE 1875671
  misc_feature: Encodes the peptide sequence at SEQ ID NO. 6560
acgcttgtgcagtagcatcggcacgctccccgcggggcgatggggccgtcgacggcggcagccgcgcgcgcgcgcgccgccttcctcctcctcgtcgtcctcctcgccgtcccgtggcccggtgcggccgcgcaggccgggtaccgcgtggtgtcggtggccggggcggggggccagctgtccgcgcggctggagctcgccggcgatggcgagaaggccgagctcgggcccgacgtccagaggctcagcctaaccgccaggcttgagacgagcagccggctacacgtccgcatcaccgacgccgaccacccgcggtgggaggtcccccaggacgtgatcccccgcgaggcgccccggcaagtccaactcgacgcgagcacgggcgcgtcgccgcgcagccgcgtcctctcggcggcgacctccgacctcaccttcaccctccacgcctccccgttccgcttcaccgtgtcccgccgctccacgggggacgtcctcttcgacgcctccccgggcctcgccttcaaggaccggtacctggagctgaccacggcgctccccgccggccgggcgtcgctctacgggctgggcgagcacaccaagcgcacgttccggctgcagcgcaacgacacgttcacgctctggaacgccgacatcgccgcctccaacgtcgacctcaacctctacggctcgcacccgttctacctcgacgtgcgctcggcgtcgtcccccggcggcgccggcgccggggccggcgcggcgcacggggtgctcctgctcaacagcaacggcatggacatcgagtacggcgggtcctacctcacctacaaggtcatcggcggcgtgctcgacttctacttcttcgccggccccgccccgctcgacgtcgtcgaccagtacacccagctcatcggccgcccggcccccatgccgtactggtccttcgggttccaccagtgcaggtacgggtacaagaaccttgccgacctggaaggcgtggtcgccggctacgccaaggccaggatcccgctggaggtgatgtggacggacatcgactacatggacgccttcaaggacttcaccctggacccggtgaacttcccggccggcccgatgcggcagttcgtcgaccgccttcaccggaacggccagaaatacgttgtcatcctcgacccagggatcaacgtgaacgagacgtacgggacgttcatccgcgggatgcagcaggacgtgttcctgaagcggaacggcaccaactacctcggcaaggtgtggccgggaaatgtctacttcccggacttcctcaacccgcgcgccgccaggttctgggcgcgggagatcaccctgttccggcggacgctccccgtcgacgggctctggatcgacatgaacgagatctccaacttcgtcgacccgcccccgctgaacgcgcttgacgacccgccgtaccgcatcaacaactccggcgtgcgccgccccatcaacaacaagaccgtgccggcgtccgcggcgcactacggcggcgtgcgcgagtacgacgcgcacaacctctacggcttcctcgaggcgcgcgccacgcacggcgcgctgctcgccgacaccggccgccgccccttcgtgctcagccggtccaccttcgtgggctccggccggtacaccgcgcactggaccggcgacaacgcggcgacgtgggccgacctccggtactccatcaacaccatgctcagcttcgggctcttcggcatccccatggtcggcgccgacatctgcggcttcggcggcaacaccaccgaggagctctgcagccgctggattcagcttggcgccttctacccgttctcgagggaccactcggcgatcggcaccgtccggcgagagctctacctgtgggagtcggtggcgcggtcggcgaggaaggcgctcggcctgcgctaccggctgctgccgtacatctacacgctgatgcacgaggcgcacacgacgggggcgcccatcgcgcggccgctcttcttctcctaccccaaggacgtcgacacctacggggtggaccggcagttcctgctcggccgcggcgtgctcgtgtcgccggtgctcgagccgggcgccaccaccgtcgacgcctacttccccgccggccggtggttcagcctcttcgactactcgctcgccgtcgcctcggcggccggcaggcgcgtgacgctcccggcccccgcggacacggtgaacgtgcacgtcgccggcggcaacatcctgccgctgcagcggccggcgctgaccacggcgcgcgcgcgccagaccgtgttccacctcctggtcgcgctcggcgaggacggatccgcggccggggagctgttcctggacgacggcgagtcgccggagatggccgggccgcggggccagtggaccctggtacggttcagctgcgagacggggcgcggcggcgccacggtgaggtcgcacgtggtgcacgactcgtacggcccgagccggaagctggtcatcggcaaggtggtgttcctgggcctgcgttcgccggcgccgccgagggggttcgccgtgtacgtcaacagcgtcaaggcggccaactcgaccggccgcgcccaggggtaccggccggggagcggggagctaggcgccgctcacgtggaggggttgtcgctggccgtcggcaaggagttcgagctcaaggtcgtcatgtcgtaacatgggattggagctctgaaagtgaaatggtgcgaatgctctgaataaaaactgatcatcagaagattaaacttgaaataaatggcatctcaatcaacaaaaaaaaaaaaaaaaaaaa

SEQ ID NO: 6560 - protein, 886 aa, Panicum virgatum
  misc_feature: Ceres CLONE 1875671
  misc_feature (220)..(494): Pfam Name: Glyco_hydro_31 Pfam Description: Glycosyl hydrolases family 31
  misc_feature (34)..(881): SWISSPROT Homolog: EC 3.2.1.20 Alpha-glucosidase precursor
  misc_feature (54)..(886): SWISSPROT Homolog: EC 3.2.1.20 Alpha-glucosidase precursor
MGPSTAAAARARAAFLLLVVLLAVPWPGAAAQAGYRVVSVAGAGGQLSARLELAGDGEKAELGPDVQRLSLTARLETSSRLHVRITDADHPRWEVPQDVIPREAPRQVQLDASTGASPRSRVLSAATSDLTFTLHASPFRFTVSRRSTGDVLFDASPGLAFKDRYLELTTALPAGRASLYGLGEHTKRTFRLQRNDTFTLWNADIAASNVDLNLYGSHPFYLDVRSASSPGGAGAGAGAAHGVLLLNSNGMDIEYGGSYLTYKVIGGVLDFYFFAGPAPLDVVDQYTQLIGRPAPMPYWSFGFHQCRYGYKNLADLEGVVAGYAKARIPLEVMWTDIDYMDAFKDFTLDPVNFPAGPMRQFVDRLHRNGQKYVVILDPGINVNETYGTFIRGMQQDVFLKRNGTNYLGKVWPGNVYFPDFLNPRAARFWAREITLFRRTLPVDGLWIDMNEISNFVDPPPLNALDDPPYRINNSGVRRPINNKTVPASAAHYGGVREYDAHNLYGFLEARATHGALLADTGRRPFVLSRSTFVGSGRYTAHWTGDNAATWADLRYSINTMLSFGLFGIPMVGADICGFGGNTTEELCSRWIQLGAFYPFSRDHSAIGTVRRELYLWESVARSARKALGLRYRLLPYIYTLMHEAHTTGAPIARPLFFSYPKDVDTYGVDRQFLLGRGVLVSPVLEPGATTVDAYFPAGRWFSLFDYSLAVASAAGRRVTLPAPADTVNVHVAGGNILPLQRPALTTARARQTVFHLLVALGEDGSAAGELFLDDGESPEMAGPRGQWTLVRFSCETGRGGATVRSHVVHDSYGPSRKLVIGKVVFLGLRSPAPPRGFAVYVNSVKAANSTGRAQGYRPGSGELGAAHVEGLSLAVGKEFELKVVMS

SEQ ID NO: 6561 - DNA, 2033 bp, Panicum virgatum
  misc_feature: Ceres CLONE 1875702
  misc_feature: Encodes the peptide sequence at SEQ ID NO. 6562
actactcatcagcctgctcagctcagctcaagctctcagcttgctttcccctctccctgcagcttgcccaacccaacaagccaagcgagcactcactgtatcgctggctagctaattaagcgatacaaacaatccgagctagagacggagcagatcatcggtttgtcgacggcatgggggatcacgccgagatgttgcatgccgctccggccgtcgtgtacagcggcgccggcgccggcggcgctgtccctcatggcggcggctggtggaacgcggcggtgcccgcgccgacctgctcgacggacctggccgggttcggcacgtggtcggccgccctggctgccagctacgatatagcagtcgaggggggcaaggccaagagcaccaccacggcctcgtcggaatcgccggggaacaacagctccgtgaccttccaagaaccgaccggcgtcgccgatccggtcgtcggcatcggcgccgccgtgcaccagcagcctcttgctgctggttacaccgattggacacatccctacatgagcggtggagctactctgcatgggttccagcaagatggccaccaggacatgagctcaagaactgagcagcagagccccatggccgcatcaagcttgatgagcccttcatcgaataacctagccctgcaaggtcaccaccaagagcaggaccaccaccaccagcagctgctctccagcttcggatccgagctgctcctgtcgccgacctcaccgtacggcttccagtcgtcgtctctgctaagaagtctcatggagccgacggcaccggcggcagcgaagccggctttgccggggttcgtccagcagtatgatcagtacggccagcagatgggccagcaggcgtcaccagcagctgcgaggttcgcgcctggagctatccgggagccactccagttcaccaacgatgcccccttctggaactcttctgctgggttcggcgtgccggcggcggcggtgcctgacgaagctagcgttcgttctgtcaaaccatcgccggcgccgcgtgcagcgaccgttgcattaaagactgcgttcgaaggagtaggggagtctagcccaatcatcaagaagaagaaggcgaacggcgagccggcgttcaagaagcctaggctccagacgccgtcgccattgccaaccttcaaggttaggaaggagaagctaggggacaggatcactgcactccaacaactagtctctccttttggaaagacggacactgcatcggtgctccatgagaccatcgagtacatcaagttcctccacgaccaagttggtgcccttagtgctccatacttgaagaacggccctcaagtgcacgtgccccagttgaagagctcaagtcccgagaagtccaaggacgacagtcatggcgagatatcactcaagggccggggcctgtgcctggtcccgatatccagcacgttcgcggtggcaagcgaggtgcccgtcgacttctggactccgtttggcgccaactttaggtagaagaaggctgctggaataacagctctgatcagaagcgtcgttgaacgaattagctacgcaacaaagtggaccgacctgatgatcgatgtcttaatctcgtctactagtatatgatcataattcatagctatagtactaagcagcagcagctctggaagtgacaaggatagcacactgagctagctagaagctagctaagatgaacctttggaatgagtgcttgaagacttggattcattctccaggttcatccgtcagagaataataatggatcagctaatatattatttgcgaggcacaagtctctactgatcgtcagcagcttctaattatgattggttgttaggtttcatcattgggtagttgccaaaggatttgttaaagatgtgtaatggttttagtttaaactattagtgacgacgatggatcaaagtgtgtagcaggtttctattgattgtactaccaaataaaagtggcatctcttggattgatcaaaaaaaaaaaaaaaaaaaa

SEQ ID NO: 6562 - protein, 448 aa, Panicum virgatum
  misc_feature: Ceres CLONE 1875702
  misc_feature (3)..(50): Pfam Name: HLH Pfam Description: Helix-loop-helix DNA-binding domain
  misc_feature: The sequence is a functional homolog of  SEQ ID NO 560 in the  10/666,642 US patent application
  misc_feature: Useful for making plants with modulated growth and phenotype characteristics
MGDHAEMLHAAPAVVYSGAGAGGAVPHGGGWWNAAVPAPTCSTDLAGFGTWSAALAASYDIAVEGGKAKSTTTASSESPGNNSSVTFQEPTGVADPVVGIGAAVHQQPLAAGYTDWTHPYMSGGATLHGFQQDGHQDMSSRTEQQSPMAASSLMSPSSNNLALQGHHQEQDHHHQQLLSSFGSELLLSPTSPYGFQSSSLLRSLMEPTAPAAAKPALPGFVQQYDQYGQQMGQQASPAAARFAPGAIREPLQFTNDAPFWNSSAGFGVPAAAVPDEASVRSVKPSPAPRAATVALKTAFEGVGESSPIIKKKKANGEPAFKKPRLQTPSPLPTFKVRKEKLGDRITALQQLVSPFGKTDTASVLHETIEYIKFLHDQVGALSAPYLKNGPQVHVPQLKSSSPEKSKDDSHGEISLKGRGLCLVPISSTFAVASEVPVDFWTPFGANFR

SEQ ID NO: 6563 - DNA, 1671 bp, Panicum virgatum
  misc_feature: Ceres CLONE 1875736
  misc_feature: Encodes the peptide sequence at SEQ ID NO. 6564
atcctctctcctctctcctctctcctctccatttgtcctaccaaaatctctcctttgcatagctcctcaattcctcttcctcctctttgtcgagttccccaaatccaatcccctcgtgaagctctcctcccttcgcccctagaggtcgagaccggcgcaggcgtcccctccgggatgggatcaggagcggggtggctccccgtggccctcctgctgctggccgcctccgtcctctcgccgcgggtcgccgcagccgccgccgccggcggcggcgaggccgagcatgccgttcagcagcacagcgagcgcatctcagggagtgctggtgatgtgttagaagataatcctgtggggaggttgaaggttttcatttatgacttgccgaggaagtacaacaagaagatggtcaccaaggatccacggtgcctcaatcacatgtttgctgcagaaattttcatgcatcgtttcttgctctcaagtgctgtgcggactctaaatcccaaggaggcggactggttctatacgccagtttatactacttgtgatttaactaatgctggactgcccttgccatttaagtcaccacgggtgatgaggagtgcaatccaatatatttcaaacaaatggcccttctggaacagaactgatggagcagatcacttctttgttgttccgcatgattttgcagcatgcttccattaccaggaagaaaaggctattgagcgtggaattcttccattgctgcgacgtgctactttggttcaaacttttggacaggaaaatcatgtctgtctgaaggagggttctatcattatcccaccctatgctcctccacagaaaatgcaagctcatctgatttcccctgacactccacgctcaatctttgtttacttccggggacttttctatgatacagggaatgaccctgagggcgggtactatgccagaggtgcacgagcttccctgtgggagaatttcaagagcaaccctctatttgatatttccacagatcaccctgccacttactatgaagacatgcagcgtgctgtcttctgcctgtgcccattgggctgggcaccatggagccctagattggttgaggctgtggtctttggctgcattccagttatcatagctgatgatattgtgctaccatttgcggatgcaattccatgggaggaaattggtgtctttgtcgaggagaaggatgtcccgaagttagacacaatcctcacatcaatgccaatcgatgacattttaagaaagcaaaggttacttgcaaatccatcaatgaagcaggccatgttgttcccgcatccagcccaaccgagggatgcattccaccaaatcttgaacggtcttgctcgcaagctgccacaccctgagggaacatacttacaacctggcgataggcatctcaactggactgctggacctgtgggagatctgaagccctggtagcgaagagcaatcttcttctcggataagcttttccatggaaaccccataggagtagtatatacttcatgaagtgtgatgtaatcgaaatgttgtgctttaggtgcaaaatacaccctggccttgtctagtccttatgaacaccatgtaacttattatctttcgatagaaatgaaatggtgtttatcttgccaaaaaaaaaaaaaaaaaaaa

SEQ ID NO: 6564 - protein, 428 aa, Panicum virgatum
  misc_feature: Ceres CLONE 1875736
  misc_feature: Great-hit functional homolog of the protein sequence encoded by LOCUS At1g27440
  misc_feature: Great-hit functional homolog of the protein sequence encoded by LOCUS At5g61840
  misc_feature: Useful for making plants with altered cell wall content and/or composition
MGSGAGWLPVALLLLAASVLSPRVAAAAAAGGGEAEHAVQQHSERISGSAGDVLEDNPVGRLKVFIYDLPRKYNKKMVTKDPRCLNHMFAAEIFMHRFLLSSAVRTLNPKEADWFYTPVYTTCDLTNAGLPLPFKSPRVMRSAIQYISNKWPFWNRTDGADHFFVVPHDFAACFHYQEEKAIERGILPLLRRATLVQTFGQENHVCLKEGSIIIPPYAPPQKMQAHLISPDTPRSIFVYFRGLFYDTGNDPEGGYYARGARASLWENFKSNPLFDISTDHPATYYEDMQRAVFCLCPLGWAPWSPRLVEAVVFGCIPVIIADDIVLPFADAIPWEEIGVFVEEKDVPKLDTILTSMPIDDILRKQRLLANPSMKQAMLFPHPAQPRDAFHQILNGLARKLPHPEGTYLQPGDRHLNWTAGPVGDLKPW

SEQ ID NO: 6565 - DNA, 1620 bp, Panicum virgatum
  misc_feature: Ceres CLONE 1875758
  misc_feature: Encodes the peptide sequence at SEQ ID NO. 6566
cagctcgcgttgactacgtccctgccctttgtacacacacgtctattctattccaaaacaacatttgccccctgtcggtataccaccatgtcgtcaaccaccgcgccggcgtccgctgtcccagccaccgaactggtgccggcgcacgtcgtggaggacttgcagggcatcgtccagctcctcagcgacggcaccgtcaagcgcttccagctgccgcaggtcctcccgccaccaccggtccgatggaaggacgtcgtctacgacgagacccacaacctcagcctccgagtgttcgtgccgccgctcgccggcgccgagaagctccccgtgatcgtctacttccacggcggcggcttcgtcatcaacagcttcgcctccaccgagttccacgccgcctgcctccgtctcgccggcgagctgcccgctgtcgtgctctccgtcgactaccgcctcgccccggagcaccgcctccccgcggcgcatgacgacgccgatgccttcttctcctggctgcgcgcccaggccgcggcgaccaccgacctgtggctcgccgagtcggcggacttcggccgcgtgttcgtgtccggcgactcggccggcggcaacatcgcgcaccacgcgatcgtgcgcatcgggtcgggtgccctcgccaccggcgcggcgcgcgtcgccgggtgcatcctgctgtacccgttcttcggcggcgagcagaggacggcgtcggaggcggccggctcgaacgacatttacctgacgctgcccgtgtccgaccagatgtggcgcctcgcgctgccggcgggggcgagcagggaccacccgctggcgaacccgttcgggccggacagccccgcgctggactccgtcgccctcccgccactgctcgtcgtggccggcacccgcgacttgctggtcgaccggatcaaggacttcgtggcgcggctgaacgccacggggaaaaagcgcgccgagttcgtcgagttcccggggaagggacacgcgttcttctccgtggagcacgatggcgaggtcaccggcgaaatgatccgtgacgtgctgcggccgttcgtacacggcggcgcggcggcgcccgccagctgactgagctcagggccgctgccgggaccaggctctgcttgtgtggacgcatcgcgtaaggcatgcaggccggccgtgacgctggcacgctgctcgtcagttcacgtaaggttctggtcgctttcaagcgttgcattactatattgtcgtggaattgaacagtaaataaagatacggtgagctcattaaacaccggtcgcatagtacactgtaaggtttgtcggcttgcttaaatttgtgtttgtcattgttcaatgtcggtttgtatatttggtttggatgaactgtttgccatcctggcttgatttggagatgtgcagctctaggtttgtagtgctgcgtaaaaatacatttgtagaggtggatgaggtaccctccatgttttttatgcttttaaaaatgttgtttgcaggggcacccggtcccctagtacactgtaaggttcgtcggtatgtttaaatgtgtgtttgtaattgttcaatatcagtttgtatgtttggtttgtaaaaaaaaaaaaaaaaaaaa

SEQ ID NO: 6566 - protein, 336 aa, Panicum virgatum
  misc_feature: Ceres CLONE 1875758
  misc_feature (1)..(228): Pfam Name: Abhydrolase_3 Pfam Description: alpha/beta hydrolase fold
MSSTTAPASAVPATELVPAHVVEDLQGIVQLLSDGTVKRFQLPQVLPPPPVRWKDVVYDETHNLSLRVFVPPLAGAEKLPVIVYFHGGGFVINSFASTEFHAACLRLAGELPAVVLSVDYRLAPEHRLPAAHDDADAFFSWLRAQAAATTDLWLAESADFGRVFVSGDSAGGNIAHHAIVRIGSGALATGAARVAGCILLYPFFGGEQRTASEAAGSNDIYLTLPVSDQMWRLALPAGASRDHPLANPFGPDSPALDSVALPPLLVVAGTRDLLVDRIKDFVARLNATGKKRAEFVEFPGKGHAFFSVEHDGEVTGEMIRDVLRPFVHGGAAAPAS

SEQ ID NO: 6567 - DNA, 1577 bp, Panicum virgatum
  misc_feature: Ceres CLONE 1875772
  misc_feature: Encodes the peptide sequence at SEQ ID NO. 6568
aaactggacacctcaccggccgctgcgccccctaccaaaccaaactaatcccttcttcccgcgagcgtctccccggcgtaccccctccggagatccaccccgactcgacccgacctgccacggcaatggccggcgccgctcccaccgtcaccaagtccccgccgtccctggtgccgccggcggggcccaccccgggcggctccctcccgctctcctccatcgacaagaccgccgccgtccgcgtctccgtcgacttcatccaggtcttcccggcgcccgggggcggggaccaggcctccgcgatcgcgaccatgcgcgagggcttcgccaaggcgctcgtgccgtactaccccgtcgccggccgcatcgcggagcccgtcccgggggagcccgagatcgagtgcaccggggaaggggtgtggttcgtggaggccgaggccagctgctccctcgaggaggcgcgcaacctcgagcgcccgctgtgcatccccaaggaggagctgctcccgcgcccgccggccggggtgcgcgtcgaggacaccgtgctgctcgcgcaggttacaaagttcacatgcggtggattctctgtgggcatttgcttcagtcacttagtatttgatgggcagggcgctgcccaatttctgaaagcagttggtgagatggctaggggcatccctgagccatcgatcaagcctatctgggcacgggacgccatccccaacccacctaagccaccccttggcccgccaccctcattcaccgcattcaactttgagaaatcagtggttgagatctctctggacagcatcaaacgtgttaaagaccaggttgcaagtgaaaccaaccagaagtgctccacctttgatgtggtcactgccataatcttcaaatgccgcgccttggcagtcgacttttcacctgatgccgaagttcgcctaggctttgctgccagcacacgccacctgctgagcaatgtgctgccttcagtcgaaggctactatggcaactgtgtgtaccctggtggtctcaccaagaccagccaggaggtgaaggaagcttcactcgtggagatcgtgactgcaatcagggaagccaaggaagctctatcgtcgaggttcctcgactggttgagcggcggtgccaaggagaaccactacaacgtgtcactagactatggcacgcttgtcgtcactgactggagccacgtcgggttcaatgaggtggactatgggtttggcgagccgagttacgtgttcaccctgaacgacgacgtgaacatcgtcccctccgttgtgtacctgaagccgcccataccgaagcagggcatcaggctggtcctgcagtgcgtggaggggcagcactccgctgtgttcagcgaggagttgcagaagcatgcatagagtgagtgtgtcctactccatagttgggaattgttgtattttgttgtgacattgctgcttccagacttgcttgcaataagacagggttgatcgtgtttataaattgtactattgtcggaaagttacattatacatgtattcacattgatgaaagaataatagtgttccatttgaagc

SEQ ID NO: 6568 - protein, 424 aa, Panicum virgatum
  misc_feature: Ceres CLONE 1875772
  misc_feature (3)..(373): Pfam Name: Transferase Pfam Description: Transferase family
MAGAAPTVTKSPPSLVPPAGPTPGGSLPLSSIDKTAAVRVSVDFIQVFPAPGGGDQASAIATMREGFAKALVPYYPVAGRIAEPVPGEPEIECTGEGVWFVEAEASCSLEEARNLERPLCIPKEELLPRPPAGVRVEDTVLLAQVTKFTCGGFSVGICFSHLVFDGQGAAQFLKAVGEMARGIPEPSIKPIWARDAIPNPPKPPLGPPPSFTAFNFEKSVVEISLDSIKRVKDQVASETNQKCSTFDVVTAIIFKCRALAVDFSPDAEVRLGFAASTRHLLSNVLPSVEGYYGNCVYPGGLTKTSQEVKEASLVEIVTAIREAKEALSSRFLDWLSGGAKENHYNVSLDYGTLVVTDWSHVGFNEVDYGFGEPSYVFTLNDDVNIVPSVVYLKPPIPKQGIRLVLQCVEGQHSAVFSEELQKHA

SEQ ID NO: 6569 - DNA, 2416 bp, Panicum virgatum
  misc_feature: Ceres CLONE 1875775
  misc_feature: Encodes the peptide sequence at SEQ ID NO. 6570
gaaaccacttttcggctcctcctcccgatggcaaacgaggcctcctgccccccgacctttccctcccctgttctctagatcgcgacggaaccgagctccccctcctgccgaagcgaagcggagtaagcgatacggcaacgtcgcgcgatctgatcggcccctcggctccggcgatcggggcaatgctgcgtggatcgagctgctgctgctgatcacggttttcatactggacttcttttgattgctatgacctttggatgaagtttgcacttatctatggaagtgggtgactcacacggtgctgtagttaataaaagtgaagagaatgactttgaaaagaagggcagttctaatcccgtggtctatcagctagttcgggttgaaggtgatggaacacttgttcctgctacagaggatgatgttttgcaattcgaccattttcttcatgacgagaaggttgatcttccttctattgaagatgtagatcatgtggaagagtttttcagcaatgattgcatcttactgaagaaatctgacttggaagatggcacttccaaattgaagactacagaactgcacacacaaaaatcgggagatgacttagaggaaaacaggctacagtcaatggatgactcccttagtcctccctcaaagtgttcaattgttcacggccagcagccagataaatttcttacagaacaaggagacaacaacatcgctcaacaggacaatgcttcaactgagactacaaaatcaacagtgttaaatgagacttgcaatgctgaaaaagacaaggctgatgcctgctcaagacctgtagatgacacatttacagaaccatctgttcctggagttaatagttccgtgcctgatttttccatattaagaggagaagtccgtttggatgatcttactattagggaacttcaggaggcatttagagccacatttgggcggcagactactgtcaaggacaagatatggctcaaaagacggattacgatgggcttgaccaattcctgtgatgttccaagttcaggctgtgtagttaaagactacaaaattgttggcaaggatgcaaaacaagatatgccaaacacaggtgaaatacccaagattgggcttcaatctacttctctggttagggatcaaattatatatccaggaaatgaaggggactcaccatctagctactactatcatagtgaggaccaacaaggatcttccaagaggttcaaaagagtaccaatacataatgatgaaccacaagttatccttgccgaacaaagcactaacaagagaactagaaagccaacgaaaagatacatagaggagcttacggacattgaaactcatgactccactggaaaactttcttcacctgcaaaaaggactgcacgtgatgaagtgttgctgaaaccacgagtagcacatttccatgaggctgagtctctgggcactacctatcctactagaaaggatactcttggaggatttagtatacatgttccttatgtttcaaggacaagaagggggcgcccaaggaaggacttcatttcatttgtggataaagaaccatttttggaacataatggggttcatacagcagttgggatgatgttggcaaaagagcgtgaagaggggaaccacgtgaggaaagcatccgaagttccactaatggtaaattctgggagaggacatatagaagcagttgataggaagaggattcagaacctacaaccaaatgtttataatgctgcttccaagcccaaaataaagcgaggtttgacacggaagcatcatcgagcatggacactgtgtgaagtcatgaagctggttgatggtgtggcccagtttggagctggcaagtggtctgagattaggaagctgtccttttcctcgtattcttaccgtacttcggtggatctcaaggacaaatggcggaatctaatcagagcgacccagacacagcttccttcacaaaaagatggcgtctgtccaaggaagattaacccttctatcatacctataccaccatccattttgttgcgagtgaaggagctaaatgagctgcagtcgcaagggggcggcttcacagcgccagtcaagttccccggtcagaacagcaaggttgtacaggaaaaagggtctggttttttgtgatccgtgccatgcagatataggggaaaaggaggatactagttgctagttagatagctcgcttttggacgatggaggatgagtacataatattacatacaacttgtaggtgtagccgcgttatccatcttcaaaatgttctcaacacgctcaatgcacgttttctcctgtgaaatcttctggaacatgtgtaatcttattggtgtaaaaaggggcaggcagcgccgttgccgaacaaaaaaaaaaaaaaaaaaaa

SEQ ID NO: 6570 - protein, 628 aa, Panicum virgatum
  misc_feature: Ceres CLONE 1875775
  misc_feature (1)..(51): Pfam Name: Myb_DNA-binding Pfam Description: Myb-like DNA-binding domain
MEVGDSHGAVVNKSEENDFEKKGSSNPVVYQLVRVEGDGTLVPATEDDVLQFDHFLHDEKVDLPSIEDVDHVEEFFSNDCILLKKSDLEDGTSKLKTTELHTQKSGDDLEENRLQSMDDSLSPPSKCSIVHGQQPDKFLTEQGDNNIAQQDNASTETTKSTVLNETCNAEKDKADACSRPVDDTFTEPSVPGVNSSVPDFSILRGEVRLDDLTIRELQEAFRATFGRQTTVKDKIWLKRRITMGLTNSCDVPSSGCVVKDYKIVGKDAKQDMPNTGEIPKIGLQSTSLVRDQIIYPGNEGDSPSSYYYHSEDQQGSSKRFKRVPIHNDEPQVILAEQSTNKRTRKPTKRYIEELTDIETHDSTGKLSSPAKRTARDEVLLKPRVAHFHEAESLGTTYPTRKDTLGGFSIHVPYVSRTRRGRPRKDFISFVDKEPFLEHNGVHTAVGMMLAKEREEGNHVRKASEVPLMVNSGRGHIEAVDRKRIQNLQPNVYNAASKPKIKRGLTRKHHRAWTLCEVMKLVDGVAQFGAGKWSEIRKLSFSSYSYRTSVDLKDKWRNLIRATQTQLPSQKDGVCPRKINPSIIPIPPSILLRVKELNELQSQGGGFTAPVKFPGQNSKVVQEKGSGFL

SEQ ID NO: 6571 - DNA, 1876 bp, Panicum virgatum
  misc_feature: Ceres CLONE 1875805
  misc_feature: Encodes the peptide sequence at SEQ ID NO. 6572
tataatcatacaagtaatgacagggtgtgggggttacttggaatgtggaaatatgcctcgccaagagtttattgatcttgtacatggaaactgggaggaaaggcttcaggtcacaaattcatcgcatacatcacacgaaattaagacatgcatcgaaatagcgttaagatgtgtggattccgacccagtgaaaaggcctactatagcagagattgttgatgaactgaataagattgataatgcaaaaagatcactaccagaccaggacaacttacaaaccacgcacaccaagcaacaaaggaatttcggtgctgctgatgcagagggtgccatgattgtacaatgtacaagtacagggacaaaagatcaagaacacaggactctagaacagaatgtcctagagaaagacccatccgacactaaatatcctcgcccgcaaactagtgggacactcgagaggttgcgcgctatgtgggctgtggtcaagcccaccttcaaagccaaatttggtggctatgaagatggccacttatggtggcatgatactgcacgctgccaagacggggacctctccatctctgtcgtgcaggctaacaatttgcttgaggaccagttctttgtcgagtcagccctgtctcttggcactgttattggggtcttcgacggtcatggtggccctgaggcctcctacttcatacacgaccacctcctcaccaacctccgagaggccgcatctggcccgcaaggcatgacacctgatgccatcaggaaggcatttctggccacagagcaaggattcatctcactcgtttcagaccaatgggaaaccaggccaagcctcgctaccatgggatcatgctgccttgttggcatcgttcagcacaggactctcttcattgccaaccttggggactcccgagctgttcttgggaaagtcagccccaatggggatcttgtcgcggagcaactgtgcagggagcacaatgtcagtgatgagggtattaggcaggagctcattgctgaacatcctgatgatccgcacattgttttacttaagcataatgtctggagagtgagaggcatcatgcaggtgtcgagatcaataggtgacgcgtacttgaaatacgcgcaatataacaaggaaccactccatgcaaagtttaggcttcgtacaccattcagcaaacctttattgagtgccaacccagatattgtatctcattgtattcaaccaagtgaccatttcgtcatatttgcatcagatggtttgtgggaattcttgagtaaccaggaagctgttgcgatcgttcaaaaacatcaacgtgctgaaggagttgcaaggagactcgttaaagcagctctccacggagcagcgcgaaaacgtgatatgccttactcggacctcaggaatatcgacaggggggttcgcaggcatttccatgacgatattactgtcatcgtcttgtttttcaatcatgcagtacaaaccctttccataaggtgccccataccaaggagggacgtggccttcgggagctcttggagcggcacgtgagcctgctgcttatatgtataaaaaatcagtgtttagttaacatgttcaattagcattcacatgggcgcggaatacccaactttcacgggaaaatgtcaactatatgaagtatacatgtatatttatagtagtactatgttgggttagtcatctattttctgagctacaaccagcccagctcgtccgttaataaatgaaacaattgtttagctgagcagctgagtatattgtaactaggctatactgatgtacagcttcgaaaaatgaacacgtatagattttcaaaaaaaaaagaacacgtaaaaaaaaaaaaaaaaaaaa

SEQ ID NO: 6572 - protein, 512 aa, Panicum virgatum
  misc_feature: Ceres CLONE 1875805
  misc_feature (1)..(284): Pfam Name: PP2C Pfam Description: Protein phosphatase 2C
MTGCGGYLECGNMPRQEFIDLVHGNWEERLQVTNSSHTSHEIKTCIEIALRCVDSDPVKRPTIAEIVDELNKIDNAKRSLPDQDNLQTTHTKQQRNFGAADAEGAMIVQCTSTGTKDQEHRTLEQNVLEKDPSDTKYPRPQTSGTLERLRAMWAVVKPTFKAKFGGYEDGHLWWHDTARCQDGDLSISVVQANNLLEDQFFVESALSLGTVIGVFDGHGGPEASYFIHDHLLTNLREAASGPQGMTPDAIRKAFLATEQGFISLVSDQWETRPSLATMGSCCLVGIVQHRTLFIANLGDSRAVLGKVSPNGDLVAEQLCREHNVSDEGIRQELIAEHPDDPHIVLLKHNVWRVRGIMQVSRSIGDAYLKYAQYNKEPLHAKFRLRTPFSKPLLSANPDIVSHCIQPSDHFVIFASDGLWEFLSNQEAVAIVQKHQRAEGVARRLVKAALHGAARKRDMPYSDLRNIDRGVRRHFHDDITVIVLFFNHAVQTLSIRCPIPRRDVAFGSSWSGT

SEQ ID NO: 6573 - DNA, 3680 bp, Panicum virgatum
  misc_feature: Ceres CLONE 1875953
  misc_feature: Encodes the peptide sequence at SEQ ID NO. 6574
gcaatttcccaacctcccgccgcgccgccgctacagcccgagcgaccgcgcctccaaatcgatagggtttttgctctcccccgttagcccgctgccgccgatcgcagcaaaagtgaggctccaggcggcgggaagcagcaggagcagcagcacgcgggagaaatggcgcagtcgctggagctgctgctgatccagttcctgatgccggacaacgacgcgcgtcggcaggcgaaggagcagatccggcggctggcgcgcgacccgcaggtggtcccggcgctcgtccaccacctccgcacggccaagacgcccaacgtccgccagctcgccgccgtgctactccgcaagaagatcacctcccactggcccaagcttcccctggactccaaggcgtccctcaagcaagccctcatcgactcaatcacgctcgaccacagtcatcctgtaaggcgagctagtgcaaatgttgtgagcattatagctaagtatgctatccctgcaggagagtggccagagctgttacctttccttttccaatgcagccaaagtcctcaggaagatcatagagaagtggctttgattcttttcagctcccttactgaaactatcggggctacgtttcagtctcatctgaacaatttgcaacctattttgctgaaatgtctgcaagacgggactagttctcgagtcagaattgcggccctaaaggctgttggatctttcatagaatatgtcaatgatggaggtgacattgtcaaaatgtttcgggactttgttcccagtatcttgaatgtatcaaggcaatgtcttgctaatggcgaggaagatgttgcttcaattgcatttgaaatttttgacgaactaattgaatctccagtgccacttcttggtgactctgtaaggataattgtgcaattctcgctggaagtttctgcaaaccaggatctggaaataaatataaggcagcaggctatccagataatttcatggcttgcaaagtttaaagcatctttcttgaaaaagcacaaactggttgtacctatcctgcaagttatgtgccctttgcttacggaaacagctaatgaagatgaagactctgatctagcagcagatcgctctgctgctgaagtcattgatacgatggctatcaacttaccaagacacgttcttgcaccagttcttgagttcgcttctgtgagctttcatcacattaatcctaagtatcgtgaggctgctgtgacatcactgggtgttattgcagagggttgttgcgaacatttgaaagataagttggaagattgtctgaaaattgttttggaagcattaaaggatcaagagcaaatggttagaggcgctgcgtcttttgctcttggtcagtttgctgaacacctgcaaccagaaattttgtctcattatgcgaatgtacttccatgcatcctaaatgctcttgaagacccatcagatgaagttaaggagaaatcatattatgcccttgcagcattctgtgaggacatgggtgaagatatcctgccatatatagaccccttgatatgcaaattggttatgtctttgcagagcagtccgcggaacttgcaagagacatgcatgtctgcaattggctccgtggccgctgctgcagagcaggcttttaccccatacgcagaaaaggtccttgtaatgatgaaaggtttcatggtgctcactagtgacgaagatttgtgtgcaagagctagggctaccgaggttgttgggatagtagccatggcagttggcagagcaagggttgaagcgatactgcccccctttatcgaggctgctattgccggttttggattggattacagtgaacttagagaatatactcatggtttttttagcaatgttgctgagatcttgggtgatagttttacacagtatcttcctcatgttgtacctctcgtattttcttcctgcaacttggatgatggttctgctgtggatattgacgatgctaatgatgaaaatggatttggtggtgtttcctctgatgatgatgatgttaatgatgaaccaagagttagaaatatctgtgtgcggactggggtattagacgagaaagctgctgcgacacaggctattggtttttttgcactacacacgaagagtgcctatgctccgtatctggaggagtcgctgaagattttaatcaggcacagtgggtattttcacgaagatctgaggctccaggcagtcatttctttaaagcatatcctaactgcagttagggcaatacctgctacacatgctgatgtacaagagaaacagaaggatgtccttgattcggttctgaacatctgtattaagaccatgacaaaggatgatgacaaagaggtagttgcacaagcttgcatgagtgtagcagacattgtgaaggactgtggttttgctgcaattgaaccttacatactaaggcttgctgaggcgacactggttcttttgcgtcaagaatcaagttgtcagcaagtagagtcagatggtgaggatgatggcgacattgatcatgatgaaatcctcatggatgctgtttcagatctattgccagcttttgcaaaagtgatgggttcttattttgatcctatctttgcaaaattgtttgatccattgatgaaatttgctaaatctccccatcctccccaagataagactatggttgttgcaaccttagctgaggtcgctcaggaaatgggtgctccaatttctgcttatgttgataagataatgcctttggtgttgaaagagcttgcatcatctgatgctactaataggagaaatgctgctttctgtgttggtgagatttgcaagaatgggggtgctgcgacactaaagtactatggggatatacttcgttctctgcataatctgtttagtaactccgaatcagatgatgcagtgagagataatgctgctggtgctattgctaggatgataatggtgcagcctcagtcaattcctctcaaccaggttcttccggtatttattaaagcattgccactaaaagaagatcatgaagaatcaatgcctgtctatagttgcatctgcagtttattactatcatcgcatccccagatccttcctcttgtgcctgatgtgatacatgtatttgcccaagtggtggtatccccagacgagagcgatgaagtcaaaacaaatattggcaaggctgtatctcacttgatatctgtctatggccagcaaatgcagcctatactgagtgcactgccaccagctcatgcaaacgcattggcagcatttgccagtagaagatgatcactgagaagcagcatttcttcaattccttgttctgttggattgttttggttgtcaaatgattgccattttctgaaggccatcattcgtggattctggttagatggatcaaaccagatgggatgtctgcatcggacatgggtgcgagtagaattcttgtttccctttttggagtcagtggtgctcattggacctgtgtgtgcggtcgatggtgcaatccttggccaacagcgcatttgcccagtctgcctgtattcaggttccggttttggttgtttcttatgcttggtttcataattcttttacctggctgtgcgattcattgattactgttgtatatagaacagagtatttttgaaagagaatatggctgg

SEQ ID NO: 6574 - protein, 1047 aa, Panicum virgatum
  misc_feature: Ceres CLONE 1875953
  misc_feature (1)..(67): Pfam Name: IBN_N Pfam Description: Importin-beta N-terminal domain
MAQSLELLLIQFLMPDNDARRQAKEQIRRLARDPQVVPALVHHLRTAKTPNVRQLAAVLLRKKITSHWPKLPLDSKASLKQALIDSITLDHSHPVRRASANVVSIIAKYAIPAGEWPELLPFLFQCSQSPQEDHREVALILFSSLTETIGATFQSHLNNLQPILLKCLQDGTSSRVRIAALKAVGSFIEYVNDGGDIVKMFRDFVPSILNVSRQCLANGEEDVASIAFEIFDELIESPVPLLGDSVRIIVQFSLEVSANQDLEINIRQQAIQIISWLAKFKASFLKKHKLVVPILQVMCPLLTETANEDEDSDLAADRSAAEVIDTMAINLPRHVLAPVLEFASVSFHHINPKYREAAVTSLGVIAEGCCEHLKDKLEDCLKIVLEALKDQEQMVRGAASFALGQFAEHLQPEILSHYANVLPCILNALEDPSDEVKEKSYYALAAFCEDMGEDILPYIDPLICKLVMSLQSSPRNLQETCMSAIGSVAAAAEQAFTPYAEKVLVMMKGFMVLTSDEDLCARARATEVVGIVAMAVGRARVEAILPPFIEAAIAGFGLDYSELREYTHGFFSNVAEILGDSFTQYLPHVVPLVFSSCNLDDGSAVDIDDANDENGFGGVSSDDDDVNDEPRVRNICVRTGVLDEKAAATQAIGFFALHTKSAYAPYLEESLKILIRHSGYFHEDLRLQAVISLKHILTAVRAIPATHADVQEKQKDVLDSVLNICIKTMTKDDDKEVVAQACMSVADIVKDCGFAAIEPYILRLAEATLVLLRQESSCQQVESDGEDDGDIDHDEILMDAVSDLLPAFAKVMGSYFDPIFAKLFDPLMKFAKSPHPPQDKTMVVATLAEVAQEMGAPISAYVDKIMPLVLKELASSDATNRRNAAFCVGEICKNGGAATLKYYGDILRSLHNLFSNSESDDAVRDNAAGAIARMIMVQPQSIPLNQVLPVFIKALPLKEDHEESMPVYSCICSLLLSSHPQILPLVPDVIHVFAQVVVSPDESDEVKTNIGKAVSHLISVYGQQMQPILSALPPAHANALAAFASRR

SEQ ID NO: 6575 - DNA, 1758 bp, Panicum virgatum
  misc_feature: Ceres CLONE 1875960
  misc_feature: Encodes the peptide sequence at SEQ ID NO. 6576
aagctcacaacagccgcttctcaacactgttgtcactttccgtgcccaaacgaagcatccgctgcacgggcggcgccgcagcatggctcgcttacacccggcgctatccgccgccgtgctccttctcgccgtcaccaccggctgccgcggcttccagatcgaggaggccaccctcgacgccatccgccagggcttcagcaacggcagcctgacatccgcggcgctcgtcgggcactacctggaccgcatcgcccgcctcaaccctctcctccgcgccgtcatcgaggtcaaccccgacgcgctccggctcgccgcacgcgcggacgccgagcggtcgtcgtcttgccggcgccgcggcggcggcgcgctgcacggcgtgcccgtcctgctcaaggacaacatcggcacccgcgaccggctgaacacgacggccgggtcgctggcgctgctggggtccgcggtggcgcgcgatgccggcgtggtggcgaggctgcggcgcgccggcgccgtggtgctcggcaaggccaacatggacgagtgggccaacttccgcagcgtggagggctccggcggctggagcgcgcgcggcggccagggacggaatccgtacgtgctgtcggcggatccatgcgggtcgagcaccggatcggcgattgccgcggcggcgaacatggcggcggtgacgctcgggtcagaaaccgacggctccatactctgcccggcgtcctacaactcggtggtcgggatcaagccaacagtcggattgaccagccgggctggagttatccccatttccccgaggcaagacacgattgggccaatatgccgcactgttgctgatgctgtagaagtgctggatgctattgttggttatgatgctcgtgattcaaaagcgacaagagcagcgtccaagcacattcctcctggtggatatatgcagttcctgaaaatagatgggttaaatggtaagagaattggcattcccaatggattttcaaatgggatggatcagcagattatttttcagcaacacttagacacaatgaggaagcatggcgcaatcttgatagagaacatagaaatacccaatttgagtgtcatattggatatgtttatcaatggcgaattgattgcactaccagcagagttcaagctaagcctaaatgtttatttgtcagacttatccaagtctccagttcgttccctcacagagataatagaattcaacaatgaacatcccattgaggaaaagctaaaagaagttgggcagctcatcttccttgtagctgagaatactaccggcattggtgcccctgaaagagcagcaatccaacagctaaacatgctgtcatctgacggattggagaggctgatgaaggagcaacagttggacgctatcgtggcgcctaatgtcagtgtagctgatgttctcgccatcagtggcttgccagggatcactgtgcctgctgggtacagcaagacaggagtcccatttggtatttgctttggtggcttgaagggctatgagccaaggctaatacagatagcctatgcgtttgaacaagctaccagagtacggaagattcccacgttcatgccatagtagtactaaaaaggacagttacttcgttatcgttgtattgtagatcatgacatgatatttaaataatcatcaggatgccatcaagctgaaaatcatgcaaatattcatccacaaatggcgagcatgccaggaaacaaaaaaaaaaaaaaaaaaaa

SEQ ID NO: 6576 - protein, 506 aa, Panicum virgatum
  misc_feature: Ceres CLONE 1875960
  misc_feature (1)..(440): Pfam Name: Amidase Pfam Description: Amidase
MARLHPALSAAVLLLAVTTGCRGFQIEEATLDAIRQGFSNGSLTSAALVGHYLDRIARLNPLLRAVIEVNPDALRLAARADAERSSSCRRRGGGALHGVPVLLKDNIGTRDRLNTTAGSLALLGSAVARDAGVVARLRRAGAVVLGKANMDEWANFRSVEGSGGWSARGGQGRNPYVLSADPCGSSTGSAIAAAANMAAVTLGSETDGSILCPASYNSVVGIKPTVGLTSRAGVIPISPRQDTIGPICRTVADAVEVLDAIVGYDARDSKATRAASKHIPPGGYMQFLKIDGLNGKRIGIPNGFSNGMDQQIIFQQHLDTMRKHGAILIENIEIPNLSVILDMFINGELIALPAEFKLSLNVYLSDLSKSPVRSLTEIIEFNNEHPIEEKLKEVGQLIFLVAENTTGIGAPERAAIQQLNMLSSDGLERLMKEQQLDAIVAPNVSVADVLAISGLPGITVPAGYSKTGVPFGICFGGLKGYEPRLIQIAYAFEQATRVRKIPTFMP

SEQ ID NO: 6577 - DNA, 1736 bp, Panicum virgatum
  misc_feature: Ceres CLONE 1876038
  misc_feature: Encodes the peptide sequence at SEQ ID NO. 6578
ctcgctcttcccactcgcccactcgctccaagccacctgatccaagagctcgagctcctccctgcctctgcgaccacaatgccctcacgcgcaatggcggcgctcatccctctcctgccagccctgctcctcctgctcccgtccaccccggaggccacgtcctcggcgctgctgggcatcagctacggccgcgttggcaacaacctcccgccggccacctccgtgccgcggatcctcgcctccctcggtgtcggccgcgtccgcctctacgacgccgaccccgccaccatccgcgccttcgccaacacgggcgtcgagctcgccgttggcgtcccggacgagtgcctcgcggcggtctccacccccaccggcgccgcctcctgggtccgctccaacattgcccccgcgctcccggccaccaagatcgccttcctcaccgtcggcaacgaggtgctcaccggcgccaacagctcctcgctgtccaggtacctcctcccggcgatgcagtgcctccacgacgcgctcgcgcaggccggcctcgacaagaagatcgccgtcaccaccgcgcacaacctcggcgtgctggcgacgtcgtacccaccctcgtcggcctacttccgcaaggacctcctcccggtgctctgccccatcctcgacttccacgcgcgcgccggctcgccgttcctcgtcaatgcgtacccctacttcgcctacgccgaggagcccaccggcgtggagctcgagtacgcgctgctggagcccggccacgccggcgtcgccgacccggggtccgggctgcactacaccaacatgctcgccgcgcaggtggacgccgtgtaccacgccatcggggcggccaacagcgcggcggcgcgggccgtggaggtgcgcgtgtccgagaccgggtggccgtcggcgggcgacgccaacgagaccggcgccacgccgcagaacgccgcgagatacaacggcaacgtgatgcggctcgtggcccaggggaagggcacgccgctgcgcccgtcgatgccgctgcgcgtctacatgttcgcgctcttcaacgagaacatgaagcccgggccggcctccgagcgcaactacgggctcttcaagcccgacggcacgccggcgtacgagctctcctaccgcctgccgcaggacaacaacacctcctccggcagcagcagcggcattgccggcggtggcgtgtacaatggccacggctacggatcggagaacggcggatactacagcatctcggccgccggcaaggcaacaatgggttggtggacatgggcacaggcagctgcggcagcatgtgtagttgtcctggtgatgcaattgtggctgtgagcagatcacgcgatgtggttggatggatggaagcctctggtttctaatggagtccgaggctggtagggccacagtggggaagaaccgctgctgctgtcgacaaaggcattgatcatggtgatgaacaaaggttgttgtaattgaggtgcccttgtagttggcggtaagctaatgcgtttagccggtgccattaaactaattatctttttaatgtttgttgttttgagatttagatctttttttgaggtgagggtactaatacgagtggaatgaagtattccacttggaattgtgtaaaagtgtcttggtaatgactcataaaaaatggatcacatggagaacatgtatcacctggtcttttatttcaaaaaaaaaaaaaaaaaaaa

SEQ ID NO: 6578 - protein, 423 aa, Panicum virgatum
  misc_feature: Ceres CLONE 1876038
  misc_feature: Great-hit functional homolog of the protein sequence given in SEQ ID NO 9235
  misc_feature (1)..(324): Pfam Name: Glyco_hydro_17 Pfam Description: Glycosyl hydrolases family 17
  misc_feature: Useful for making plants with altered Lignin content
  misc_feature: Useful for making plants with altered cell wall content and/or composition
MPSRAMAALIPLLPALLLLLPSTPEATSSALLGISYGRVGNNLPPATSVPRILASLGVGRVRLYDADPATIRAFANTGVELAVGVPDECLAAVSTPTGAASWVRSNIAPALPATKIAFLTVGNEVLTGANSSSLSRYLLPAMQCLHDALAQAGLDKKIAVTTAHNLGVLATSYPPSSAYFRKDLLPVLCPILDFHARAGSPFLVNAYPYFAYAEEPTGVELEYALLEPGHAGVADPGSGLHYTNMLAAQVDAVYHAIGAANSAAARAVEVRVSETGWPSAGDANETGATPQNAARYNGNVMRLVAQGKGTPLRPSMPLRVYMFALFNENMKPGPASERNYGLFKPDGTPAYELSYRLPQDNNTSSGSSSGIAGGGVYNGHGYGSENGGYYSISAAGKATMGWWTWAQAAAAACVVVLVMQLWL

SEQ ID NO: 6579 - DNA, 1814 bp, Panicum virgatum
  misc_feature: Ceres CLONE 1876077
  misc_feature: Encodes the peptide sequence at SEQ ID NO. 6580
gtagttcccttttcaaaacaaaacattggctctgtatgaattcagtgtgaactctcaagagtacaattttcagagctgattcgttgcattgctaggttactgtgggcacacatgcggccataggtgatgacgagcttgcctgagaggggagaagcaccgccatccgattctttgtgcgaggaagacaccgcagctgcagttgcctcttcttctagctcccagcacaaggaagatagcagctccaagcagtcaaagtcctccatcctatctggggtcttcactcccccatttaccatctttgagggccagcaggactcgttgccggcgtgcgagaagaagtcaccaaagtcctcctcaggatcctatggttggtccaggattttgaggagatttgtgggcagcagctcgatgtggcgtcttctgggatgcaccaaggttctgacctccagtgatgtgtggttccttggcaaatgctacaaggtgtcacctgaggagtcgtccagcgactcggattccgaaagtgggcatgctgcgtttctagaagatttctcttccaggatatggatcacttaccgaaaaggctttgacgcaatatctgattccaagctaactagtgatgtgaactggggctgcatggttagaagcagtcagatgctggttgctcaggcgctgatttttcaccatcttggaaggtcttggagaaagcccccagagaagccatacaacccagaatatataggggtcttacacctatttggtgattctgaagcttgtgctttctctattcacaatttacttcaagctggaaagagttatggtctggctgctggatcatgggtggggccatatgctatgtgccgggcatggcagacccttatccgcacaaatagagagcaggctgatgctgttgatgggaaggaaaatttccctatggctctttatgtggtttcgggtgatgaagatggtgaaagaggtggagctccagtcgtgtgcattgatgttgctgctcagctttgctctgatttcaacaaaggacaatcaacatggtcacctatacttttgctagttcctctggttcttggccttgacaaaattaatccaaggtacatcccattactaaaggagacatttacatttcctcaaagcttgggcattttaggtggaagaccaggaacatcaacttacattgctggggtacaggatgagagggcactctacctagatccccatgaagttcagatggcagttaacatttcactggataatttggaggcagacacttcctcataccactgcagtgttgtccgagatttggctctagaccaaatagatccatccctggctattggtttttactgccgtgacaaagatgactttgatgacttctgttctcgggcctctgagttggtagagaaggccaatggagcgccactctttactgttgtgcagtcaatcgagccatcgaaacagatttataaccaagatggtgggctgggttgttcaggcagtagcatggccaacgacgatgaccttgatggctctggtgaaggagaagaagagtggcagatcctctgaacgggaggaaaaccattgacatattgagtgaaaaaaaaacttacaccgaacacgttgttggaatgcccttgtttgtgtgtgaatacaggagattatttgtgatctcagggtgtcgtgggacgccagtgtcccataggaaatgttcaaaacgcgggcggatgcaaaatccctttgtatcgtacatacactgggtttatcatgactaaatgtttctattccaaaaaaaaaaaaaaaaaaaa

SEQ ID NO: 6580 - protein, 482 aa, Panicum virgatum
  misc_feature: Ceres CLONE 1876077
  misc_feature (1)..(286): Pfam Name: Peptidase_C54 Pfam Description: Peptidase family C54
MTSLPERGEAPPSDSLCEEDTAAAVASSSSSQHKEDSSSKQSKSSILSGVFTPPFTIFEGQQDSLPACEKKSPKSSSGSYGWSRILRRFVGSSSMWRLLGCTKVLTSSDVWFLGKCYKVSPEESSSDSDSESGHAAFLEDFSSRIWITYRKGFDAISDSKLTSDVNWGCMVRSSQMLVAQALIFHHLGRSWRKPPEKPYNPEYIGVLHLFGDSEACAFSIHNLLQAGKSYGLAAGSWVGPYAMCRAWQTLIRTNREQADAVDGKENFPMALYVVSGDEDGERGGAPVVCIDVAAQLCSDFNKGQSTWSPILLLVPLVLGLDKINPRYIPLLKETFTFPQSLGILGGRPGTSTYIAGVQDERALYLDPHEVQMAVNISLDNLEADTSSYHCSVVRDLALDQIDPSLAIGFYCRDKDDFDDFCSRASELVEKANGAPLFTVVQSIEPSKQIYNQDGGLGCSGSSMANDDDLDGSGEGEEEWQIL

SEQ ID NO: 6581 - DNA, 682 bp, Panicum virgatum
  misc_feature: Ceres CLONE 1876198
  misc_feature: Encodes the peptide sequence at SEQ ID NO. 6582
cagatccgccgccctgcgcccgtctccgccgtccgccggccgcgccgccgcctctccccggccctcgctcgctcctgcccgtcgcccgcgcgcctccccgcgctcgtacgggacacggcgccgcccgtctctccggcacgcgccgctcctccgcgctcccgctcgcgctcgcgccgcccgtctccccggctgagaaatggaactaggtgataaggcggttggttttctgctgacgctaacgagcttatccatcttcacctactatacattctgggtcattatcttgccgttcgttgacagcgaccactttgtgcacaagtacttcctgcctcaagagtatgctattttgataccagtgattgccggcgtggttctcctttctttcttgagcatctttgtgggtctcgtgatgctcaagtcaaagaaaaagaagaagaccacttgattgggtttggcttgtatattgtagtactcttcgcttactatgatgattaaatccatgagttcagagtctatataattgctggaagctcggtaaacagttccatcgtatcgttggcgctcactttgtaactcagatctctgttttcatttgtgattctcagatcaatcaagttaattgaaagacgaccactcaggttgtccgtttttctttattgtagaaaaaaaaaaaaaaaaaaaa

SEQ ID NO: 6582 - protein, 82 aa, Panicum virgatum
  misc_feature: Ceres CLONE 1876198
  misc_feature (1)..(80): Pfam Name: DPM2 Pfam Description: Dolichol phosphate- mannose biosynthesis regulatory protein (DPM2)
MELGDKAVGFLLTLTSLSIFTYYTFWVIILPFVDSDHFVHKYFLPQEYAILIPVIAGVVLLSFLSIFVGLVMLKSKKKKKTT

SEQ ID NO: 6583 - DNA, 565 bp, Panicum virgatum
  misc_feature: Ceres CLONE 1876230
  misc_feature: Encodes the peptide sequence at SEQ ID NO. 6584
acgttgcagtttcacctcagcagccagtggtggttggttctgtgtcttgagccgtgctgaagatctcgacgaacaaaggtggagaagatgaaggggatccctgtggctctcctgctcctcgccctggtcgccgccgcctcgctccatgatctcgccgtggctgcagacgacagctctggcgccggtccggacggtgcgtgcgacggcaagtgccagagccggtgctcgctgaagaaggccgggcggtgcatgggactctgcatgatgtgctgcggcaagtgcggcggctgcgtgccgtcggggccctacgctagcaaggacgagtgcccctgctacagggacatgaagtcgcccaagagccagcgccccaagtgcccctaggacctcatcccctcacgagcgcgatcgatccgcgcttccgacgtcgatctgtgcttctgttcgtgtgccgttcgtgtatccagagaagtagtgtgctgcaataaacaatgctagatctgtagtgttgtttgttctgtgagatcccagagaccccaagcacgatccatctcttctgttcccccgc

SEQ ID NO: 6584 - protein, 97 aa, Panicum virgatum
  misc_feature: Ceres CLONE 1876230
  misc_feature (1)..(89): Pfam Name: GASA Pfam Description: Gibberellin regulated protein
MKGIPVALLLLALVAAASLHDLAVAADDSSGAGPDGACDGKCQSRCSLKKAGRCMGLCMMCCGKCGGCVPSGPYASKDECPCYRDMKSPKSQRPKCP

SEQ ID NO: 6585 - DNA, 2588 bp, Panicum virgatum
  misc_feature: Ceres CLONE 1876480
  misc_feature: Encodes the peptide sequence at SEQ ID NO. 6586
ctgttcccctcccggcccgattcgtctcggacccctccccgcttctcccccgtccggcgcatggcggctccccccaaaccctaacccatagatccctccccgcgacccaacccccagcctctgctccggtcgccgcccgcgtcccgccggcgcggcgccaccggcccaccccgccgccccaccgccgggagaaaggccccgcctcggcgacctccgcccgccgcgcgaggtgcaagtccaagagaactgatcgcggaatatatgaagtagcggccgttggatgaccttctctatggatttgaacgcatccccattgcccgaagatgacgagcagcagccgtacgaagaggctgttgaggttgactatgctcaggaggggcatgtcgagtccgctgtggcgacaatgcgcagggagcgtgaagaaagacgtaggaaactaaagagagagaagcaggatgatggatcgaggctacattcccagcagattaggaatgattatgttcctcaaccaaaaagacctagtcgcataaaagaggcacctcagggctggttggactgtcctgcatttggagagccaatagataaaatcataccatccaaggttcctctcgacgaaacgttcaatgagtcggtgcctcctgggaaacgatactcctcaaagcaactagttaacaaacaaagaaaagctggtcgtgatataggccttgtgattgatttgacaaataccactcggtattattcaccagcagaatggacaaagcaaggtaccaagcatgtcaagattccatgcaagggaagagatgctgtacctgataatgaatctgttaacgtgtttgtctatgaggcgatgatgttccttgatcgacagaagcaatcaaagaatcctaaatatatcttggttcactgtacccatggtcataatcgtacaggtttcatgattattcattaccttatgcgcacacatgtctcttgtgttgctgaggcaataagtatatttgctcaaaggcgaccacctggcatatacaagagggactacattgaagctctgtataagttttaccatgaggtccctgagaatatgatgatagcatgccctccaacaccagaatggaagagacctgatgatcttgatttaaatggtgaagctaagcaggacgacgatgatgataatggtgatcttgaaccaccaaataatgaatccaaggttaaagtcataactaatgacgatgtgttaggggatgctgtgccatatgaccaacaagaagctttgcgtgtcctgtgttatcggttgcttgaaatgccccttgtaagagggcacacacaattccctggatcacatccagtctctcttaacagtgagaatctacaactacttaggcagcgatactactatgctacatggaaagctgacggaacacgctatatgatgcttataatgagagatggctgtttcttgattgatcggaatttctgctttagaagggtccagatgcgctttccccataagagcctcgaaggtctgcatgatatgaccttgattgatggagaaatgattatagacacggtaccagagtcaggattgaagagaaggtacttggcatatgatctgatggcccttgatgctgtgtccaaaaccaagctgccgttttctgaaaggtggagaatgctagaagatgaaataatacggccacgttatcatgagaaaaagcagtttgagagtggtgctaagagcaatcctttgtacaaatatgacatggaactattttcggttaggaggaaggatttttggctgctctccacagttattaggttgcttaaggaatttattccaaaactttgtcatgatgctgatggcctaatatttcagggctgggatgatccatatgtaactcgtactcatgaaggtcttctaaagtggaaatacccttcgatgaattcagttgattttttgtttgagcttacgaatgataatcgtcagctggttttcctttatgagagaggaaaaaagaaacttatggatggtgctcggatcacgtttcctgatgaaatagatccaccctctgttgctgggaggattgttgagtgttcttggaataaggaagaacagtgttgggcctgcatgcgtattcgatcagataaatcgactccaaacgatatcaacacataccgaaaggtgatgaggagcatcacagataacatcactgaggagaagcttcttgaagagattgatgagatcaggcgcctcccgatgtatcacgataggatagcgcaggctcatgcgaagatggcacatcggaggagatgaagaacgccagattagagtgatagtctctttgcgatagtgctggagtgctctcctatcatctctggccagcggctggttcctgtagctgtgtaattagtagaggtttcagtagggcccctatgatgatggctggctgggtctggccagccaactaattctttgcaccatcgcatttgtgcttcctcccgacccacctgtataggcatcgccgcagagtagctgcatgtaaatcgtgtattctatgttctcctatattctctccgaaaaaaaaaaaaaaaaaaaa

SEQ ID NO: 6586 - protein, 674 aa, Panicum virgatum
  misc_feature: Ceres CLONE 1876480
  misc_feature (1)..(124): Pfam Name: DSPc Pfam Description: Dual specificity phosphatase, catalytic domain
MTFSMDLNASPLPEDDEQQPYEEAVEVDYAQEGHVESAVATMRREREERRRKLKREKQDDGSRLHSQQIRNDYVPQPKRPSRIKEAPQGWLDCPAFGEPIDKIIPSKVPLDETFNESVPPGKRYSSKQLVNKQRKAGRDIGLVIDLTNTTRYYSPAEWTKQGTKHVKIPCKGRDAVPDNESVNVFVYEAMMFLDRQKQSKNPKYILVHCTHGHNRTGFMIIHYLMRTHVSCVAEAISIFAQRRPPGIYKRDYIEALYKFYHEVPENMMIACPPTPEWKRPDDLDLNGEAKQDDDDDNGDLEPPNNESKVKVITNDDVLGDAVPYDQQEALRVLCYRLLEMPLVRGHTQFPGSHPVSLNSENLQLLRQRYYYATWKADGTRYMMLIMRDGCFLIDRNFCFRRVQMRFPHKSLEGLHDMTLIDGEMIIDTVPESGLKRRYLAYDLMALDAVSKTKLPFSERWRMLEDEIIRPRYHEKKQFESGAKSNPLYKYDMELFSVRRKDFWLLSTVIRLLKEFIPKLCHDADGLIFQGWDDPYVTRTHEGLLKWKYPSMNSVDFLFELTNDNRQLVFLYERGKKKLMDGARITFPDEIDPPSVAGRIVECSWNKEEQCWACMRIRSDKSTPNDINTYRKVMRSITDNITEEKLLEEIDEIRRLPMYHDRIAQAHAKMAHRRR

SEQ ID NO: 6587 - DNA, 1037 bp, Panicum virgatum
  misc_feature: Ceres CLONE 1876696
  misc_feature: Encodes the peptide sequence at SEQ ID NO. 6588
aacacaagaaatgaaccagttcctcccctcccagcaatcggcgctcaccatggactccgcgggcagcacggccgccaccgccgcgcccgcgcccaacggcgccgcagaccgcgccgcggccatcgacgacgacgacggcgtccccgaggtagccgcctgcatttcgtcgatgatcgaccgcgggggcagcgtcgagagccaccgcctcttcctggcgcgccgcaccacgctggagatgctccgcgaccgcgggtacagcgtcccggaggaggagctcgcgcgcaccctcccggagttccgcgcctggtgggccgacaagcccgagctcgaacgcctcgccttctccactactctcgcctccgacccgtccaacaaggtgaaagttgtgttctgtcgaccggaacctgtcaaaattgcagttatccgggagatttatagtggagtcaaagaagacaacttgtctagactgattctgatattgcagagcaaaataatgtctagagccaaagaatctattaaggagatcttcccatttaaagtcgatacattccagatcacggaattactggtgaacattactaagcatgtcctgaagcccaagcatgaggtgttgactgcagaagagaaggccaagctcctgaaggaatataatgtggtggattcacagttgcctcgcatgctggagactgatgctgttgctcgctaccacggccttggcaagggagctgttgttaaagttacatatgacagcgagcttactgggaaccatgtgacgtacaggtgtattttctgagggggcatgggtttccgcggatgatgtttctcgtaagcggttagtaaaataacttcgcggcagatgatactgcccttctgtaaaaataacttctcggcagatgatactgcccttctaggccagtgtaagcactctattatgtaggatgaggttatctgtaactgtaaggtgttggtaaaaattgcctcgcagcaaagttactaccctaccaggcgattatatcgaaaaaaaaaaaaaaaaaaaa

SEQ ID NO: 6588 - protein, 260 aa, Panicum virgatum
  misc_feature: Ceres CLONE 1876696
  misc_feature (1)..(91): Pfam Name: RNA_pol_Rpb5_N Pfam Description: RNA polymerase Rpb5, N-terminal domain
  misc_feature (1)..(74): Pfam Name: RNA_pol_Rpb5_C Pfam Description: RNA polymerase Rpb5, C-terminal domain
MNQFLPSQQSALTMDSAGSTAATAAPAPNGAADRAAAIDDDDGVPEVAACISSMIDRGGSVESHRLFLARRTTLEMLRDRGYSVPEEELARTLPEFRAWWADKPELERLAFSTTLASDPSNKVKVVFCRPEPVKIAVIREIYSGVKEDNLSRLILILQSKIMSRAKESIKEIFPFKVDTFQITELLVNITKHVLKPKHEVLTAEEKAKLLKEYNVVDSQLPRMLETDAVARYHGLGKGAVVKVTYDSELTGNHVTYRCIF

SEQ ID NO: 6589 - DNA, 731 bp, Panicum virgatum
  misc_feature: Ceres CLONE 1876717
  misc_feature: Encodes the peptide sequence at SEQ ID NO. 6590
acccctgatagccaaatcgaaagcaaaaggagaaatcatggcggagcggaggatcggcgtggcgatggacttctcgccgagcagcaagaaggcgctgcggtgggcggccgacaacctggtgcgcaagggcgacaccctcgtgctcctccacgtccggcaccacggccgcgtggagagcaagaacgtcctctggtcccacaccggatcgccgctgatcccgctggaggagctcttggagccgcaggtgaggcagcgctacgacatgccggaggacgccgaggtgtacgacatgctcaccaccctggcccggcagaaggagctgtgcgtggtggtgaagatgtactggggcgacccgagggagaaggtgtgcgacgcggtgggggagctcaacctcgagttgctcgtcatgggcagccgtggcctcggccagatccagaggattctgctgggcagtgtgacgaactacgtgctctccaatgcatcatgccctgtgaccgttgtcaagtcaaagtagtgggtgtcctctacaggaatacgaatatgcaattagaacatcctttaaactcttgtgtttgtgtgcgctttgttctagtaataaagcgggtagaagtaaaaatamacttgatgtatcgcatcttacttcagctgttattactacatmtcgcgttgtaccgtctgttcatttgttgcctctggacatgattaaatcaaggatgaatttgtttgtggcc

SEQ ID NO: 6590 - protein, 158 aa, Panicum virgatum
  misc_feature: Ceres CLONE 1876717
  misc_feature (2)..(155): Pfam Name: Usp Pfam Description: Universal stress protein family
MAERRIGVAMDFSPSSKKALRWAADNLVRKGDTLVLLHVRHHGRVESKNVLWSHTGSPLIPLEELLEPQVRQRYDMPEDAEVYDMLTTLARQKELCVVVKMYWGDPREKVCDAVGELNLELLVMGSRGLGQIQRILLGSVTNYVLSNASCPVTVVKSK

SEQ ID NO: 6591 - DNA, 888 bp, Panicum virgatum
  misc_feature: Ceres CLONE 1876747
  misc_feature: Encodes the peptide sequence at SEQ ID NO. 6592
aggcccaaacccaccaaccagcccaccaccaatccagaaccgcgcaccaacgaccaccggcggcgaccatggcgaccaaggaccccgcggccaccagcggcgatcccgccatcggcatcccgtaccaccccgcggcggcggcgcaggggcaatactactatgcaccgccgccgaatccctacgcggcggggatgccgccgcccaacgcgatctacgccggcgcgcccaagggggtcccgctgcagcagaccatgttccgcgacacgcccgcgcccttccactgccaggcctgcggcgaagccgccgtctctaccgtccggtcaaagccgagcctggcatctgttgtggcttgcatgatgcccttcatgatgggggtctgcttcctgtgcccttcgatggactgcctctggcacaagtaccattactgccccagctgcggcgaaaaggtgggcgagttcaggaagtctgacccgtgcctcgtggtcgatgtgccccggtggaccgagccaagcttcgccgtgcctgcgtagtgcatacaccacttgctataataataccattacggcattaccctgaaaatgatagaatgcactgctgctgttcttgtgtagtctgtacataaaaggatgttactttcttgttgcatgctgtatatcctgtatgcctcaactgccgttgccctctagtctctctactacgttagaactgaatgtatcgtttgttttggatcagaataaacatgttactctagttacaagtgcatgactgaagctacactgcctacacatgtaatatgggattttgcaggactacactgtagtcgcttggctgaccgtgaagtaacagtttgaccgtaagaggtttcctgaaaaaaaaaaaaaaaaaaaa

SEQ ID NO: 6592 - protein, 153 aa, Panicum virgatum
  misc_feature: Ceres CLONE 1876747
  misc_feature: Great-hit functional homolog of the protein sequence given in SEQ ID NO 9638
  misc_feature: Useful for biocontainment applications
  misc_feature: The plant produces a reduced number of seeds.
MATKDPAATSGDPAIGIPYHPAAAAQGQYYYAPPPNPYAAGMPPPNAIYAGAPKGVPLQQTMFRDTPAPFHCQACGEAAVSTVRSKPSLASVVACMMPFMMGVCFLCPSMDCLWHKYHYCPSCGEKVGEFRKSDPCLVVDVPRWTEPSFAVPA

SEQ ID NO: 6593 - DNA, 616 bp, Panicum virgatum
  misc_feature: Ceres CLONE 1877129
  misc_feature: Encodes the peptide sequence at SEQ ID NO. 6594
gcggcggccgcatcgatttctagggtagaaacccgctcaaatccctcggcgatttgaggcgctcgggcggaggtaggaggagccagcctcgcgaagggttcggccacgtgctagagtcgagatggcggggcgcaaggagactgcactcgacctggcgaagttcgtcgacaagggcgtccaggtgaagctcaccggcggccggcaagtgacaggaactttaaagggatacgaccagctactcaacttagtgctagatgaagcagtggagtccgaaagagagcaagatgacccattgaagctatctgggaaaaccagacagcttggtctcattgtgtgcaggggcacggcagtcatgctggtctcaccaactgttggaactgatgagatcgcgaaccctttccttgccgatggggcataagcttgcactggttgattatttagaaccgtgctctcaaagcaccctcagaaccatctgttccagtgaaaaagaactccagtctcatgtattatttacccgttgctgatgaagttgtaatttccattgtacaacttaaaatgttgaccctttgctgctaatgtattgttgctatgtacttaaaaaaaaaaaaaaaaaaaa

SEQ ID NO: 6594 - protein, 98 aa, Panicum virgatum
  misc_feature: Ceres CLONE 1877129
  misc_feature: Great-hit functional homolog of the protein sequence given in SEQ ID NO 9281
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MAGRKETALDLAKFVDKGVQVKLTGGRQVTGTLKGYDQLLNLVLDEAVESEREQDDPLKLSGKTRQLGLIVCRGTAVMLVSPTVGTDEIANPFLADGA

SEQ ID NO: 6595 - DNA, 2055 bp, Panicum virgatum
  misc_feature: Ceres CLONE 1877193
  misc_feature: Encodes the peptide sequence at SEQ ID NO. 6596
ctctcccatctccccgccccccgcctgcgtcggcctctcaagtctcgacacaccgcgccacagagccccccctcgctcgctcgctcgcgccgctacagtcccccgcgcacgcctctcctcctcgtactgccgacgcgcgaggccggaggctggtggcggcggcggaggggggattccgattgggagccgaggcgcggcgggggcgctcgctcccccgagggagggagatcggcgcacgggcgggtgcccgcggctctcgccgggctcgattccgcgggatggctccggcgcggcgcggcctccgcggcccatgccgtgagtgaaggcgctggctttgccgtccgggggagtgatcttgccgcagcagcagcagcagcagcagcagccggaggccggtgctccggtggtcgaggcccagcggcgcccgctcaccgccatggctggcagcgacgaggtcaaccgcaacgagtgcaagacggcggtgccgatccacacatgggtgctcatctccaacttcaagctggcgtacaacatgctccggcgggcggacggcaccttcgaccgcgacctcgccgagtacctcgaccgccgggtgccgcccgacgcgcgggcccaggagggcgtctcgtccttcgaccacgtcatcgacccctccgtcggcctcgaggtccgcatctaccgcgccgccgccaacaacgccgcgggcgccggcgccggcgcggcagcggtcacgctgcccatcctcgacttcctcaccggcgcgccgtcgccggacccgttcccggtcatcctcttcttccacggcggcagcttcgcgcactcctcgtccagcacggccatctacgacaacctgtgccgtcggttcgtgaagctgagcaagggcgtggtgctgtccgtcaactaccggcgcgcccccgagcaccggtacccgtgcgcctacgacgacggctgggccgcgctcaagtgggccatgtcgcagccgttcctccgcagcggcgagggcgcccagccccgcgtgttcctctccggcgactcctccggcggcaacatcgcccaccacgtggccgtgcgggccgccgacgccgggatcaggatctgcggcaacatcctgctcaacgccatgttcggcggcaccgagcgcaccgactcggagcggcggctggacggcaagtacttcgtcacgctccaggacagggactggtactggaaggcgtacctgcccgaggacgccgaccgggaccacccggcgtgcaacccgttcgggccgaacgggcggcggctcaggggcctccccttcaccaagagcctcatcatcgtgtcgggcctggacctcacctgcgaccggcagctggcctacgccgagggcctccgggaggacggccaccatgtcaagctcgtgtaccgcgagaaggccaccatcggcttctacctgctgcccaacacagaccactaccacgaggtcatggaggagatctccgacttcctcggggctaacctcctctagtacatacgtacaccacagctgctgatcctgatctgatcgtcgccttcgcacactccacttgttatagcaagatggtaagcttgacttatactagttctgtcgtctcgtctcgccgtatactgctgctgctgctgccgctgccgcttggggatcatcgtctgaattccggccatggcaagtggcgcttctgataaaaagctctaggaaagaaaccaaccatggcgacttttgttccccccctgcctgctgatcgcgaagccctgcctgcgtccctggttgatggagagaagcctattatttcgccttcaatcaccctccggctggtccccgggggcaaattcatctaacattctgtgtacagtgatggactgatgatggatcaacaaggaggcgtgtggcctttttgttgcttgtgtttgatgtagtagttcttcctctctttcttatggattggatggtgcctgcgcgtacggcgtacccctcaacctatatctgtcttcccatgttttgtgaaacatatgtgatgtttccaaaaaaaaaaaaaaaaaaaa

SEQ ID NO: 6596 - protein, 355 aa, Panicum virgatum
  misc_feature: Ceres CLONE 1877193
  misc_feature (1)..(215): Pfam Name: Abhydrolase_3 Pfam Description: alpha/beta hydrolase fold
MAGSDEVNRNECKTAVPIHTWVLISNFKLAYNMLRRADGTFDRDLAEYLDRRVPPDARAQEGVSSFDHVIDPSVGLEVRIYRAAANNAAGAGAGAAAVTLPILDFLTGAPSPDPFPVILFFHGGSFAHSSSSTAIYDNLCRRFVKLSKGVVLSVNYRRAPEHRYPCAYDDGWAALKWAMSQPFLRSGEGAQPRVFLSGDSSGGNIAHHVAVRAADAGIRICGNILLNAMFGGTERTDSERRLDGKYFVTLQDRDWYWKAYLPEDADRDHPACNPFGPNGRRLRGLPFTKSLIIVSGLDLTCDRQLAYAEGLREDGHHVKLVYREKATIGFYLLPNTDHYHEVMEEISDFLGANLL

SEQ ID NO: 6597 - DNA, 2060 bp, Panicum virgatum
  misc_feature: Ceres CLONE 1877245
  misc_feature: Encodes the peptide sequence at SEQ ID NO. 6598
tttgttaattgcgaaaacgaaggagcccgtgtgaactagagaggtcaagaaaagaggaaaaaaggagagataaattggaggccattagctgaaatctccctaatctgttcatctccctgtgtggtgctagtcagctagtgtgaccctgcgatgtcttctcctacctcatgagcttccagtctggaactgtggtagcttcttgtttttcctaatcccttttcagctcaggtatttttcttcgtttggaactgccgggtccgaaattccggtgatttgttgggttttttgcctgcgaaatccgggcaaaaatggggatctgcagcttctgtgctttgttggctaaatcctgacccaaatttggctcttaaacctaccttttcttggaccttttaccatttccttcgcctatttttatctcccatttttccagtaatttatttttctttttcatttctacctattttcatcttccttttcttcgagaaatttgcttctgtggtaaaactgcgtgttcgtcgcgagaaagatcttgtacttgagcactgaaagggttttatggttttttttacagattcacaatccgtagtcctgacctcagttgagcactcgtgagctcgtaccgctgattaaagctggcagctttcagttatagtccaagaaacgagtgctcctccgccatggaggtgaggtctgagcaagggctgatggcaggcagggatctgtttggcatgcccaagagcccgccggcgccgccggcgtccgcggccatgcagagcgtgcgcatggcgcacaccgcagacggcacccctgtcttcgccccggtaacctcggcagcgccgccgtcttaccagccgcaggtcgcggtccacgggcctagcatgtccactgcggcggccactggaggcaatggcgccatggcgtcgccgggcataagtgagccagtggccaagaagaagcgtgggcggccaaggaagtacggacccgacgggtccatgtcgctggcattggtgcctgcatcgtcggctacagggtcaccggcgatggggcagggttcttccgggcctttctcactggcggggccaaatccggcgaactctgtgctgggggtgtcgccggatggagtgaagaagcggggccggcccaagggttctaccaacaagccgcgcatgggtgcccttgggtcatcaggagttggatttactcctcatgttattacagttcaagctggggaggacgtttcatcgaagattatgtcattttctctgcatggaacacgtgcggtttgcgttctttcagcaaatggtgccatatcaaatgtaacgcttcgccagactgctacttcaggtggcactgtaacatacgagggtcgatttgagatactatcactgtcagggtcattcctcctgatagagaatggaggccagcgtagtcgaacaggaggactcagtgtgtcactggcgggtcctgatggtcgtctcttgggtggtggagttgcagggcttctcatagcagcttcaccaattcagatagtattgggaagcttcagttctgaaagcaaaaaggagccaaaacagcatgctccttcagaccctgcatcagcaccattgaaggtcgccccgaccacctctatgggacccaacagccccccttcaagaggcacattgagtgaatcatctggtggggctggaagcccaccaccactgcatcaaggcatggctgctagcaacagtaatcaaccaccaatcatgtccagcatgccctggaaatgatctctgcatccttgaccaaatccaggcaggctcagatctagattggcgaactgccttccaggaggaagtagcaatttgcgcttcaatagtgctcgttctctgactagcttatatgtagtgtaattcggagcttgagtagtgagagtactgtagccagaagtttgtagctctattgtaggtttcaccctgaattcatgtgctaggagctgtctgtcatctagagatgatgtactgagctttgtccatgtgatccttggcagtgttatcaaatgtttatttagttctatgttc

SEQ ID NO: 6598 - protein, 363 aa, Panicum virgatum
  misc_feature: Ceres CLONE 1877245
  misc_feature: The sequence is a functional homolog of  SEQ ID NO 1012 in the  10/225,066 US patent application
  misc_feature: The sequence is a functional homolog of  SEQ ID NO 124 in the  10/374,780 US patent application
  misc_feature: Useful for making plants with modulated growth and phenotype characteristics
MEVRSEQGLMAGRDLFGMPKSPPAPPASAAMQSVRMAHTADGTPVFAPVTSAAPPSYQPQVAVHGPSMSTAAATGGNGAMASPGISEPVAKKKRGRPRKYGPDGSMSLALVPASSATGSPAMGQGSSGPFSLAGPNPANSVLGVSPDGVKKRGRPKGSTNKPRMGALGSSGVGFTPHVITVQAGEDVSSKIMSFSLHGTRAVCVLSANGAISNVTLRQTATSGGTVTYEGRFEILSLSGSFLLIENGGQRSRTGGLSVSLAGPDGRLLGGGVAGLLIAASPIQIVLGSFSSESKKEPKQHAPSDPASAPLKVAPTTSMGPNSPPSRGTLSESSGGAGSPPPLHQGMAASNSNQPPIMSSMPWK

SEQ ID NO: 6599 - DNA, 1738 bp, Panicum virgatum
  misc_feature: Ceres CLONE 1877382
  misc_feature: Encodes the peptide sequence at SEQ ID NO. 6600
gtcgcctcgttctgctcgttttccacactgggcggatttcttcgtcacgaggacgaggagaggaggagggcggaaaggtgctccgtttcttgctctagtccgtttcagagatccaatcgattcaagagaaacggcagttttgtgcttccgttgggttgctcgccgagagattccccccaaagtttgttgcttggagccgatttgggccaagaaagggccaaaaggcgccgcaaatccgttaccgtcccggaaaatcccaaaacgcctcgtcgtatttgatcgttggcgacctggctcgatccatctgagtggagaggagaaggggaagaggaggacaagggaggagaggagagggcgtcctcctcggagcagccgcattgccgcctgtcgatgaatgagcgctgcctccgatgctgtcggggtgctcggtgtccagtctcgcggcgcggttcgccttcttcccgccggagccggcaacgtacgccatcaggaaggacgaggccaccggctgcctcgtcgcctccggcgtgccgcgggacaacgccctcgacgtgctgctcgtcgacaccaggagggggaacaaggtggtggccttctacttccggaacccctgcgcgcgcctcactctgctctactcgcacggcaacgccgccgacctcagccagctctacgacctctttgtgcagctcaaggtcaatctcaagatcaatctgatgggatatgactactctggctatgacgcatctactggcaagccaagtgaagaaaatacatatgcagacattgaagcagtttaccaatgcttagaaaccgagtatgggatcagccaggaagatattatcttgtatggacaatctgtgggcagtggaccaacattacatttagcctcccatttgcctagattgcgcggggtggttctccacagcgctatactttcaggcctccgtgttgtttgccatgtgaactttactccctgctttgacatttacaaaaatgtcaagaaaataaaaaaggtcaaatgcccagtgctcgttattcatgggacagacgatgacgttgtgaactggtcacatggtaaggatctgtggaaactggcaagggagccttatgatccactctggatcaaaggcggaggtcactgcaacctggagctgtaccctgacttcatccgccacctctcccgtttcatccgtgaaatggagactatcacaacaaaaatccggctcaagaagattaggcagtccctccagcccagaaagaaggcccaccgcgtgaacaccgccacaacaacaaccttcagcactaactgctgctgccgcattcgagttcgcaaaccgacctgccccagctgcaacttcagctgcggctgctgcgggttgaggaactgcttcgcattccgtttcttcaggtgctgccctacctgtttctcctgcggcacctgctgctcctgccggagctgcttcaagtgctgctgttgtggagacgagcgttaatgccgccgatctttgtgagcgcgtgtatattaaagagggatggtcctgagatatatctactaaccctttagatgccgtaggactaaaaagtagatttgagttaactgaacattgtgcaacagatagagactcccgtacttgtgcatcgtatctggtttctacctgtcccattttagttacatgtcagattcattctaattattatttcctcgtgatatcttttttaaaaaaaaaaaaaaaaaaaa

SEQ ID NO: 6600 - protein, 360 aa, Panicum virgatum
  misc_feature: Ceres CLONE 1877382
  misc_feature (1)..(83): Pfam Name: Abhydrolase_1 Pfam Description: alpha/beta hydrolase fold
  misc_feature (1)..(204): Pfam Name: Abhydrolase_2 Pfam Description: Phospholipase/Carboxylesterase
MLSGCSVSSLAARFAFFPPEPATYAIRKDEATGCLVASGVPRDNALDVLLVDTRRGNKVVAFYFRNPCARLTLLYSHGNAADLSQLYDLFVQLKVNLKINLMGYDYSGYDASTGKPSEENTYADIEAVYQCLETEYGISQEDIILYGQSVGSGPTLHLASHLPRLRGVVLHSAILSGLRVVCHVNFTPCFDIYKNVKKIKKVKCPVLVIHGTDDDVVNWSHGKDLWKLAREPYDPLWIKGGGHCNLELYPDFIRHLSRFIREMETITTKIRLKKIRQSLQPRKKAHRVNTATTTTFSTNCCCRIRVRKPTCPSCNFSCGCCGLRNCFAFRFFRCCPTCFSCGTCCSCRSCFKCCCCGDER

SEQ ID NO: 6601 - DNA, 559 bp, Panicum virgatum
  misc_feature: Ceres CLONE 1877479
  misc_feature: Encodes the peptide sequence at SEQ ID NO. 6602
gagcctggctgcatctctcgctagctctccattgtttcgttcagccgggccttctccccgccgaaacccttcccctcttcatccgggttccggcggcggcggcggcgaagatgatcatcccggtgcgctgcttcacctgcggcaaggtgattgggaacaagtgggacctctacctggacctcctccaggccgactatacggagggagatgctctggatgctttggaattggtccgctactgctgcaggcgaatgctcatgacccatgttgatctcattgaaaagttgctcaactacaacacattggagaagactgatacaaactaaagagaacacgccatgctccacaatcacctactgtttcttagtatgatagtgtgtggtatgctgtttcttctgtaccgggagaagctggttgtgagataatgttaatttagcttgctcatgaacaaaggacgtttgatgtgccgtgcatgttgcatctatgctatgaacttgtgatgctgtcagatatttgaagcgatgtttgaactgttgaccaaaaaaaaaaaaaaaaaaaa

SEQ ID NO: 6602 - protein, 71 aa, Panicum virgatum
  misc_feature: Ceres CLONE 1877479
  misc_feature (1)..(60): Pfam Name: RNA_pol_N Pfam Description: RNA polymerases N / 8 kDa subunit
  misc_feature (1)..(71): SWISSPROT Homolog: EC 2.7.7.6 DNA-directed RNA polymerase II 8.2 kDa polypeptide
MIIPVRCFTCGKVIGNKWDLYLDLLQADYTEGDALDALELVRYCCRRMLMTHVDLIEKLLNYNTLEKTDTN

SEQ ID NO: 6603 - DNA, 1779 bp, Panicum virgatum
  misc_feature: Ceres CLONE 1877510
  misc_feature: Encodes the peptide sequence at SEQ ID NO. 6604
atcctgtcgtcctgtttcccggaatcattcccggatgcgatacccccgcaaagccaagccccccaaaaccggcgacgcgacgagggcgaggaaggcgccaccggttcaagcaagccctagcccttggcgacgcggcggtgaaggatttgatcggcggagaagccctaggttcttcccctgttactctcctcggcgggctgcgccgcgaggacccgtgttgatctgatccattcggcccggctcggccccgccatgtcgaccaatagggttctttgcaagttcttcatgcatggagcttgcttgaaaggagagtattgtgagttctcccatgactggaaagatcaagcgaataatgtttgcacattctaccagaaaggtgcatgctcatatggtagccgttgcagatatgaccatgtcaaagtttctcgtaaccctacagtgcctctgccatcaccatcgtcaagtactgcaagaccctcatctacttatcttcaactttcaagttctggtcatcctcctcgcacgggacaccaaacagattcaaagaatcaaagaaatcagatatctgtagatgtgccggcacattctgccagtaagcctgcatggagaaatgattttcaacacgttgtttccgaggatggaattgactggtcctctaaccaaactttgcaaaaccagacatcattgaaacctgctgatctgcctatttgttcttttgctgctgctggcaattgtccttatggggaagggtgccctcaaatgcatggagatatttgcagtacctgtggaaaaatgtgcttgcatccttatcgtcctgatgagagggaggagcatatcaagttatgtgagaaaaaccacaaacgccttgaatctctgaaacgcagccaagagatagaatgcagtgtctgtttggattgtgtgctatcaaagcctactgctgctgaaagaaagtttggactattatctgaatgtgatcatcctttctgtatcgcatgcattagaaattggcgtagcaattctcctgcatctggtatggatgtgaattcagcactaagggcatgtccaatatgtcgcaaactttcgtactatgtcattccaagtgttctttggtacttctcgaaggaagagaaggaggagatcattgaaagctacaaatccaagctcaagtctatagattgcaagtacttcgattttgggactggctcatgccccttcggtacaagttgtttctacaggcatgcctatagggatggacgcttggaagaggtcgtactgcggcatcttgatgctgatgatggaagtacagtaattgcaaaaaatatcaggctgtcggatttcctcagtcggatgcatctttagggattaccagctgtatatatatcaaataaattttgaagttctccgctgtctggctagatgcctggatgacctcttgaaagaagcacagtcgacgcaaggatgacgggaaaatagtcccagaagaattgtgctggaatttcaaagcagaagtaaaacaattaatagatttcactatatgcgttttgagtgctggtcttctgggctaccagtgattcagtagaacatttcctggccgtcactaaaatggcaggtgtgtaaaatactaaccttctaccttggtggtcgtattgtgttgagaaaagggttaagcaccgttggccgttcaccaattagtcaactgaggtcatttggttgtattactttgttatacggaaggtggacaaaacagcaaatgaaacgcaaaaaaaaaaaaaaaaaaaa

SEQ ID NO: 6604 - protein, 368 aa, Panicum virgatum
  misc_feature: Ceres CLONE 1877510
  misc_feature (1)..(28): Pfam Name: zf-CCCH Pfam Description: Zinc finger C-x8-C-x5-C-x3-H type (and similar)
  misc_feature (1)..(58): Pfam Name: zf-C3HC4 Pfam Description: Zinc finger, C3HC4 type (RING finger)
MSTNRVLCKFFMHGACLKGEYCEFSHDWKDQANNVCTFYQKGACSYGSRCRYDHVKVSRNPTVPLPSPSSSTARPSSTYLQLSSSGHPPRTGHQTDSKNQRNQISVDVPAHSASKPAWRNDFQHVVSEDGIDWSSNQTLQNQTSLKPADLPICSFAAAGNCPYGEGCPQMHGDICSTCGKMCLHPYRPDEREEHIKLCEKNHKRLESLKRSQEIECSVCLDCVLSKPTAAERKFGLLSECDHPFCIACIRNWRSNSPASGMDVNSALRACPICRKLSYYVIPSVLWYFSKEEKEEIIESYKSKLKSIDCKYFDFGTGSCPFGTSCFYRHAYRDGRLEEVVLRHLDADDGSTVIAKNIRLSDFLSRMHL

SEQ ID NO: 6605 - DNA, 1852 bp, Panicum virgatum
  misc_feature: Ceres CLONE 1877530
  misc_feature: Encodes the peptide sequence at SEQ ID NO. 6606
gtggtgccagtgccagcgcagcctggcctggctgcctgtgctcgagctcggccaccaccacctaggcccaccagctccggcaacgaacaaaaccacccgaccgccgcgccacatcgcccgccggatccgcctccgccgtaccccctctctctctcgctcgcctgatccctctcggagtctcggttaatcgcggggaaaatcattcatcgcctgcccgtcgccccgtccatccccccgagcgcaaaagccggcgcccggcggcggggcccgtggccactcggtgccgcgtacgtgtccgcctcgctcacctcacctcacccccgacccgctataaaacgcggctcggcacacgccacccttcgacctcacatcaacccgccggagagccggtctcactcccgtgcccgtacgccgtgcgcgtcaccttattcgccagccaccacacgccggcacagccgcacgagcgggccagcaaggccgtttcgcgtccctcagtgcgcgcgggatcggagcgtccgtttgccagcggccatggcgctggaggccgtggtgttctccccggcggcggcgggccatttcggctacagccgcggggactcgccgtacgcgctgccctggtgcgacatgggcggcctcggcgacctctgcgcggggggttactgggaccaggagctggacgacgcgtgggcggcggcgccggccgtgtgggacgtcgacttggcggaggcggcgtccagggacgaccactcctcggacgcctcctcggaccggcagcagggcaaggaggcggcgcccgagccggcgccggcggtgcggaggaagcggaggcgcaccaaggtcgtcaagaacaaggaggagatcgagacccagcggatgacccacattgccgtcgagcgcaaccgccgccgccagatgaacgagtacctcgccgtgctccgctcccacatgccgccgtcctacgcccacaggggtgaccaggcatcgatcgtcggtggcgccatcaactacgtgagggagctggagcaactgctccagtcgctcgaggtccaaaagagcatcaggaataaccggcggggcggctccacggacgccgccggcagcagctcctccccgttcgccgccttcttcagcttcccgcagtactccacctcgccggctcacggcagcagcagctccacgagcctcggcggctcgagcaacacgagcaataatgccgccagcagcgacgtgtcctccggcgggtcggccgagagcggccggccggcggcggtcgcggacatcgaggtgacgatggtggaaggccacgcgagcctcaaggtgctcgcgcggcggcgtcccaagcagctcctgaagctcgtcgccggcctgcaccagctgcgcatcccgccgctgcacctcaacatgaccaccgtcgacgccatggtcctctacaccttcagcctcaaggtggaggatgactccaagatggggtctgttgaggacatcgccaccgctgtgcatgagattctcggcagcatccagcagcagcagcaggaggagaccgccgccatgtgaagccctgcacagcacctgcatctatctgcatgccctccgcaggctgcactggcagcggcagtgccgtcctgccagtggaatcccgtagcctgtacgtgtgaccgtgatcgcacccggggcacctgagccaccacgcagcattgtcagtccccatggtcacaaggatacatgtcaagaatttaggctgtaatctaagcacctattcaccttcacctagctccgttaacttggagtggactacttgtagattcaattattcacagatacaaatttgcctgaaaaaaaaaaaaaaaaaaaa

SEQ ID NO: 6606 - protein, 340 aa, Panicum virgatum
  misc_feature: Ceres CLONE 1877530
  misc_feature (1)..(52): Pfam Name: HLH Pfam Description: Helix-loop-helix DNA-binding domain
  misc_feature: The sequence is a functional homolog of  SEQ ID NO 486 in the  10/666,642 US patent application
  misc_feature: Useful for making plants with modulated growth and phenotype characteristics
MALEAVVFSPAAAGHFGYSRGDSPYALPWCDMGGLGDLCAGGYWDQELDDAWAAAPAVWDVDLAEAASRDDHSSDASSDRQQGKEAAPEPAPAVRRKRRRTKVVKNKEEIETQRMTHIAVERNRRRQMNEYLAVLRSHMPPSYAHRGDQASIVGGAINYVRELEQLLQSLEVQKSIRNNRRGGSTDAAGSSSSPFAAFFSFPQYSTSPAHGSSSSTSLGGSSNTSNNAASSDVSSGGSAESGRPAAVADIEVTMVEGHASLKVLARRRPKQLLKLVAGLHQLRIPPLHLNMTTVDAMVLYTFSLKVEDDSKMGSVEDIATAVHEILGSIQQQQQEETAAM

SEQ ID NO: 6607 - DNA, 2452 bp, Panicum virgatum
  misc_feature: Ceres CLONE 1877601
  misc_feature: Encodes the peptide sequence at SEQ ID NO. 6608
attttccctttctctttcctctatctctccttccgcttctctcaagcccaacgaaatccccacaccgccgctgacgggcccccaagcttttcgtgcggccgcagctcgccaccaccggggagccaccgagatcctcgcgcacgcagcaaaactgtcctgcatcaccacagcgaggctcctctgatccggatctcagattcagaagggaggccactaaagatgatgggggcatgacccctgtgcctcggcgaggcaatccctacctcgagcgtggcggcggttgtggaatggatcgacgcccccgagtgcggcggcacatgtggtagggttgctggccttgatttgtagcagccgggaagcgcccccggtaaatcgccgcttcttgctcccctttccccttctgaccgaccgataatagaacttgtgcggatgagattcaaggccgaccgatgatagagctcgtgctcaagagatgtttgaaattgcagatctgcatgagctttgatgatgtagcagatgcaagcacagttccttagaaatccgtcgtgttgatcgtttgtggtatggaattttttttaatgtttgggttttagtgctctacagaagcattttaactgcttgcatctcgcattctacaccaagcatcgacccatactgtgctactctctcaacgtcttattgcttaggttatcctcctaatgttttacatttttcattccaaggagtgtaccttcaaaatttttcattccattttcttcgttttgtggtaattactgaactacttcccggatactctgtatgatagattgttgtttgttctcttgcatgtttagcttggtttcagctttccagtgtgacagatttccctatgtgcatcatgttgatagttcagcattcattttctttagtctttgcttcctttttctccaggaaggtcaaagaataatcttatgatttaactgatatgctttactatgtcttctgaaggttttttctgtgaataaccgccaaaaaatatcccaccccaccgggccaggccagtcaccaccatggctcgccgcggcctccgccccctcgccggcgccgcgctcctcctcctcgccctcttctccgccgccgcgctctgctcggcggagcccgaggaggccgcctccgccgcggaggacccgctcatcgagcaggtggtcggggccggcgcggacggcgacgagctggagctgaacgcggaggcgcacttcgccagcttcgtccgccggttcggcaagtcgtaccgcgacgaggacgagcgcgcgcaccgcatgtccgtgttcaaggccaacctccgccgcgcgcggcgccaccagcgactcgaccccacggcggtgcacggggtcaccaagttctccgacctcaccccggccgagttccgccgccagttcctcggcctccgccgctcctccgcccgggacctgctcaaggggtcgtccgcgcacaaggcgcccatcctccccaccgacggccttccgaccgacttcgactggcgtgaacacggcgccgtcggacccgtcaagaaccagggctcgtgcgggtcgtgctggtccttcagcacgtcgggggcgctggagggggcgcactacctcgccaccggcaagctcgaggtgctcagcgagcagcagatggtcgactgcgaccacgagtgcgatgcatccgacccacgctcatgcgatgcaggatgcaatggtggcttgatgactacagctttcagctatctcgagaaagttggtggcctagagagtgagaaagattacccttacactgggagtgacggcacctgcaagtttgacaagtccaaaattgtagctcaagtgaaaaacttcagcgttgtatctgtggatgaagaccaaattgctgctaatttggttaaacatggcccactcgcaatcggtatcaatgcagtattcatgcagacatacatcgggggtgtctcgtgcccatacatttgtggaaggcatcttgaccatggtgttctcctagttggctatggatctgctggatacgcgccaatccgcttcaaggaaaagccctactggatcatcaagaactcctggggtgagaactggggtgagaatggttattacaagatttgcaggggtccgcatgtgaaaaacacatgcggtgttgattcgatggtttctacggtcactgccatccacacctccaagaaggaataggttctgatttgtcctcgtctgtatatagcattgcatatgatgtgatcttgtgctagatcatttgccagagagggctatcctatggcattatctgaaaatgttttcgatggatgtattgtacatttgtattaagttattgtggatgtttgtcacaccagcacattaaccattggtaatgtttgtaatggtaaatatatgaacatgttaccaaacatgtgctataaaaaaaaaaaaaaaaaaaa

SEQ ID NO: 6608 - protein, 386 aa, Panicum virgatum
  misc_feature: Ceres CLONE 1877601
  misc_feature (1)..(228): Pfam Name: Peptidase_C1 Pfam Description: Papain family cysteine protease
MARRGLRPLAGAALLLLALFSAAALCSAEPEEAASAAEDPLIEQVVGAGADGDELELNAEAHFASFVRRFGKSYRDEDERAHRMSVFKANLRRARRHQRLDPTAVHGVTKFSDLTPAEFRRQFLGLRRSSARDLLKGSSAHKAPILPTDGLPTDFDWREHGAVGPVKNQGSCGSCWSFSTSGALEGAHYLATGKLEVLSEQQMVDCDHECDASDPRSCDAGCNGGLMTTAFSYLEKVGGLESEKDYPYTGSDGTCKFDKSKIVAQVKNFSVVSVDEDQIAANLVKHGPLAIGINAVFMQTYIGGVSCPYICGRHLDHGVLLVGYGSAGYAPIRFKEKPYWIIKNSWGENWGENGYYKICRGPHVKNTCGVDSMVSTVTAIHTSKKE

SEQ ID NO: 6609 - DNA, 1961 bp, Panicum virgatum
  misc_feature: Ceres CLONE 1877606
  misc_feature: Encodes the peptide sequence at SEQ ID NO. 6610
cccccaccaccttcccccacccaaaccccacctcctccccgtgtcaaaacctccgagccccgaagcgatcgccagctcagcgcgccggcggcggcggcggccgccggagggaagacggaggacgtgatggactccgcggtggggccccacttcagcgggctccgcctcgactcgcgccgcctctcatcctcctcgctcccgtcccccacctcctttccctccgccaacggcacggccgacgccgccagaggggtcgcgccccccaaggcggacgggaccaggcagcccttcgtgataggtgtgtcgggagggacggcgtcggggaagacgacggtgtgcgacatgatcatccagcagctccacgaccaccgcgtcgtgctggtcaaccaggattcattctacctcggtttaactgaggaacagtctgagcacgtgcaagactacaactttgatcaccctgatgcatttgatacagatcaacttctggagtgcatgggaaagctaaaaagtgggcaatctgtgaatattcctatatatgattttaagaatcaccggcgatgctctgaaagttttagaaaggtcaatgcatcagatgtcatcattttggaggggatcttagtttttcatgaccaaagggttcgtgatttgatggacatgaaaatttttgttgacacagatgctgatattaggcttgctcgacgcataaggcgtgatacagttgaaagaggtagagatgttatctcggtgctggaacagtatgggaggtttgtgaaacctgccttcgatgattttgtcctgccttccaagaaatatgctgatgtgatcataccaaaagggggagataaccatgttgcaattgatttaattgtgcaacacatccgtacaaaacttggtcagcatgacttgtgcaaaatctacccaaatgtctttgtagttcacacaactttccagatacgaggaatgcatactctgattcgtgacaggaacattacaacacctgactttgttttctactcagatcggctgatccgtctggtagttgagcatggtcttgggcatttgccatttacagagaagcaggtcgttacaccaacaggatctgtttacatgggagttgacttctgcaagaagctctgtggagtgtctattgttcgaagtggtgaaagcatggaaaatgctctgcgtgcttgttgtaaggggataaaaattggtaaaattctaatacatcgggttggagacaatggacaacaactcatataccataagcttccaatggacattgctgaacgccatgttttgcttttggatcctgtgcttggtacaggtaactcagctaatcaagctattgagcttcttataaggaaaggagttcctgaggaccggatcatttttcttaatctcatctcggcccctgaaggcgtccattgtgtctgcaagcgcttccctcatttaaagattgtaacctcagagattgatggtggcttgaacgatgaatatcgggtcatccctggacttggagagtatggggaccgctacttcggcacagactaatccaggattggaactgctgtagttggcattgtgaaaagatactcaagctagagctaacatcaccgtgacggatatactggtgtttggttggttatggtatactggaagcaaacgtggaaaggtttccccggagttgctgaaaccgtgtggtcttgtccattatcacatgactcggtaatactgttgattctcttggtgtgtccgtgtgtgacaaacagaatctggtttgcattttgaagctcctggctgaatggacctgttcctcagttacaggcccgcaaaatgtatgactaaaccctgtttcccggcttccaacagatgccgtgcgatctcagctgtgattgaactgagtttcccaatgaaattcgatagtagtgtgaatggtaattgcagagtattcgttgtgttgg

SEQ ID NO: 6610 - protein, 474 aa, Panicum virgatum
  misc_feature: Ceres CLONE 1877606
  misc_feature (1)..(188): Pfam Name: PRK Pfam Description: Phosphoribulokinase / Uridine kinase family
  misc_feature (279)..(474): SWISSPROT Homolog: EC 2.4.2.9 Uracil phosphoribosyltransferase
MDSAVGPHFSGLRLDSRRLSSSSLPSPTSFPSANGTADAARGVAPPKADGTRQPFVIGVSGGTASGKTTVCDMIIQQLHDHRVVLVNQDSFYLGLTEEQSEHVQDYNFDHPDAFDTDQLLECMGKLKSGQSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPKGGDNHVAIDLIVQHIRTKLGQHDLCKIYPNVFVVHTTFQIRGMHTLIRDRNITTPDFVFYSDRLIRLVVEHGLGHLPFTEKQVVTPTGSVYMGVDFCKKLCGVSIVRSGESMENALRACCKGIKIGKILIHRVGDNGQQLIYHKLPMDIAERHVLLLDPVLGTGNSANQAIELLIRKGVPEDRIIFLNLISAPEGVHCVCKRFPHLKIVTSEIDGGLNDEYRVIPGLGEYGDRYFGTD

SEQ ID NO: 6611 - DNA, 1758 bp, Panicum virgatum
  misc_feature: Ceres CLONE 1877708
  misc_feature: Encodes the peptide sequence at SEQ ID NO. 6612
cttgcaacaatccacaagtgcacaaagttctcccagccttgacaaggtgacaggaatactggaaatggcagccagcctgtgccggaagcctcacttcgtggtcatcccatggccagccaccagccacattatccccatcgtcgacatcgcctgcctcctcgccgggcacggcgcggcggtcaccgtcatcaccacgcccgccagcgcgcagcttgtccagggccgcgtggagcgcgccgggccaggctcatcggccgtcacggtcaccgcgataccgttcccggcggctgaggccggcctgccggatggctgcgagaggctcgaccacaccccctcggtcgacctcgtgcccaacttcttcgacgccaccacgcgatttggcgacgccgtggcgcggcactgccgccgcctcatggcgacgcgccggccggactgcgtcatcgccgggatgtgcaacacgtgggcgcacggtctggcgcgcgaactcggcgcgccctgcttcatcttccacggcttcggcgcgttcgcgctgctgtgctgcgagtatctgaacacgcaccagccccacgaggcggtcgcgtcgctggacgagctcttcgacgtcccggtcctgccgcctttcgagttcaagttcgccaggaggcagctgccgctgcagttcctgccttcgtgctccattccggaggtccgcctccgagagctccgggaattcgagatggccgtggacggcatcctcgtgaacagcttcgaagagctggaacacggctcggccgcgggccttgcggcggccacgggcaaggccgtgttcgccgtcggcgcggtctcgctttgcggcgcgcctggcctcctcgactcgcgggccgactcggatgacgccaggcggtgcatggcgtggctggacgccaagaaagccaggtccgtgctttacgtcagcttcggcagcgccgggcgcatgccaccagcgcaggtgatccagctcgggatggcgctcgtgtcgtgcccctggcctgtcctctgggtcatcaagggtgcagactcgttgccggacgacgtcaacgagtggttacaggacaacaccgacgccaatggcgtcccggggagccagtgccttgcagttcgagggtgggcgccgcaggtggccatcctggagcacccggccgtcggtggcttcctgacacactgcgggtgggggtcgaccctggagagcgtcgccgcgggtgtgcccatggccacctggccgttcaccgccgagcagttcttgaacgagaagctgatcgtcgacgtgcttcgggtcggtgtgtccgtcggcgtgaccaagcccacggagggcgtgctgaccggtgtcaaaagcggcggcggcaaggcgaaggcagatgtgggaacgaaacaggtgaagaaagtattggatatgctgatggatggaggagtggacggggaggctaggaggacgaaggctgaggagctgaaggccaaagcaaaagctgctttgcagcatggggggtcgtcgtttatgaatctgcagaagttgatacagtttgctggttagtttcaggctttcagctcgtgaatcagttgatttcagcgtaatagtttacattgtttggatctcaaatgtactggtgattaatttgcttgaactatgcttatgtgccggtccggctgggaaggaagaattataaaatacctgaaacaagcagatgttgcaatttccaacctgttataaagttcagtgacacgcaaaaaaaaaaaaaaaaaaaa

SEQ ID NO: 6612 - protein, 493 aa, Panicum virgatum
  misc_feature: Ceres CLONE 1877708
  misc_feature (1)..(118): Pfam Name: UDPGT Pfam Description: UDP-glucoronosyl and UDP-glucosyl transferase
MAASLCRKPHFVVIPWPATSHIIPIVDIACLLAGHGAAVTVITTPASAQLVQGRVERAGPGSSAVTVTAIPFPAAEAGLPDGCERLDHTPSVDLVPNFFDATTRFGDAVARHCRRLMATRRPDCVIAGMCNTWAHGLARELGAPCFIFHGFGAFALLCCEYLNTHQPHEAVASLDELFDVPVLPPFEFKFARRQLPLQFLPSCSIPEVRLRELREFEMAVDGILVNSFEELEHGSAAGLAAATGKAVFAVGAVSLCGAPGLLDSRADSDDARRCMAWLDAKKARSVLYVSFGSAGRMPPAQVIQLGMALVSCPWPVLWVIKGADSLPDDVNEWLQDNTDANGVPGSQCLAVRGWAPQVAILEHPAVGGFLTHCGWGSTLESVAAGVPMATWPFTAEQFLNEKLIVDVLRVGVSVGVTKPTEGVLTGVKSGGGKAKADVGTKQVKKVLDMLMDGGVDGEARRTKAEELKAKAKAALQHGGSSFMNLQKLIQFAG

SEQ ID NO: 6613 - DNA, 1844 bp, Panicum virgatum
  misc_feature: Ceres CLONE 1877752
  misc_feature: Encodes the peptide sequence at SEQ ID NO. 6614
atccacccacctcaagctctcacaactcacaggtcagaagcaaagcccgcacgctcccccaagtcctgaggcaagctagctagctgtgctcctcccgtccgagtgcctggggttgggggaaggaaggtgaggcctcgccgtcttcgcggcgcacgagcctgcacctgggccgttggtgaggcgaagcacatgacgaaccaggacgtggtcgtgtcggagatgggcattgcggccggggcggcgctgccgggaccgagcccggcgctcttggcttgccggggcgcggccgccggcgccatgtcccttcggtacctcgacctggccgcggccgccgcgcgctcggccagctgcacctgggccgacgccatgcgcgcctcgtcccccacccgctcccgcgccgccgccgatgtcgacgagttcacggcctggatgaggaagcacccgtcggcgctcggcaagttcgaccagattgccagcgcgtccaaggggaagaagatcgtcatgttcctggactacgacggcacgctctcccccatcgtcgccgaccccgacgaggcctacatgagcgacgcgatgagggcggcggtgcgcgacgtcgcgaagcacttcccgacggcgatcgtgagcgggcgctgccgcgacaaggtgcgcaacttcgtcggcctctcggagctctactacgccggcagccatggcatggacatcaagggaccaagatccaatccggagtcggtcctgtgccaacctgcaagcgagttcctcccagtgatcgacgaggtgtacaaggcgctggtggaaaagacgaagtccacacctggagccaaggtggagaacaacaagttctgcctgtccgtgcacttcagatgtgtagatgaaaagagatggaatgctttggcggagcaagtcaaggccgtcatcaaggactaccccaagctgaagctcactcaagggaggaaggttctggagatccgcccgagcatcatgtgggacaagggcaaggccttggagtttctgctcgaatcgctcggattcgccagctgcagcgacgtcctcccggtgtacatcggtgacgaccgcaccgacgaggatgctttcaaggtgctgaggaagaggggtcagggcatcggcatcctcgtctccaagtgccccaaggagaccaacgcctcctactccctgcaggacccgagcgaggtcatggacttcttgctccggctggtggagtggaagcgcaagtcgccgccgccgccgatgatccggccgcgagtgtagctggctggctcggcgcggcagccggtcggcggccggtcgactagtgaatcgacggactgatcgaatcggtgtccaatcatgcgaacataccccaccaccaatgttccccctctctgacgattcttagcttgtgtggtggcctccgaaacggactcgtggtggttgctgcgttgcacgcatgttcttcgattccctggcggggccacacacacacaacacaactcctccgcgtcactgaaaatgttggagcatgttggtgctgctgtctaatacagtaaccgtgtgtctgcttccccggcaatgtaccactagtagtacccctcccttctcgtgttatttttgtccctcgtctcatccccatgggcttggaaggcatctgcaaagctccctgccgtcctagaagagaagaacctttgcaagaaagagaaggttcccttcaccccatgtaactagcacctactatattctaggcactactgttctttgtacccttctctgctgtgtaaaatgtagtctgtaaaagtaattaagatccaagtaatggaattattttgtaaaaaaaaaaaaaaaaaaaa

SEQ ID NO: 6614 - protein, 359 aa, Panicum virgatum
  misc_feature: Ceres CLONE 1877752
  misc_feature (1)..(227): Pfam Name: Trehalose_PPase Pfam Description: Trehalose-phosphatase
MTNQDVVVSEMGIAAGAALPGPSPALLACRGAAAGAMSLRYLDLAAAAARSASCTWADAMRASSPTRSRAAADVDEFTAWMRKHPSALGKFDQIASASKGKKIVMFLDYDGTLSPIVADPDEAYMSDAMRAAVRDVAKHFPTAIVSGRCRDKVRNFVGLSELYYAGSHGMDIKGPRSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFASCSDVLPVYIGDDRTDEDAFKVLRKRGQGIGILVSKCPKETNASYSLQDPSEVMDFLLRLVEWKRKSPPPPMIRPRV

SEQ ID NO: 6615 - DNA, 3273 bp, Panicum virgatum
  misc_feature: Ceres CLONE 1877798
  misc_feature: Encodes the peptide sequence at SEQ ID NO. 6616
agaagcagccaagtgatccgtttcgttcatccatccgttcctctcgcgccactagaattccccgcccaatctgacgccgccatatcctcgtcggccgtcgcgccattaatctatcattgcgtccacgcctgctccacttcctcgcccgcccatccccccattacttccacgcaaaggatttcctttttacaatactctagtctgattgattgatccggccaagactgtcggaagcttgtgcttatttactacctcttcccctttttttccccctcatttttggggtttatttattccctcccccacgcttgcatcttttttatgcgtgctgagtcgcggctgggatcggaggctcttgcgattttttgatctagcatcctgccctgctcaattccgattttttagttcgcatttgagtagctgcacttgattgggttctcctgtttcttctgctagcttgtgtaactatatccactactggtgcgaattggggattcttaccatttagatgttcttgatttggaatcgaaggagctccaattttctgggggctccgaagagctcaggtcgatattaaaccagttcggggttctggttcctgcccatggacgagtccggcgaagcaagcgtcggcgccttcaggatcgggccgtctacgctgctcggccgcggggtcgcgctccgcgtgctcctcttcagctcgctgtggcgcctgcgggcgcgtgcgtacgccgccatctcgcgcgtgcgcagcgcgacggtgccggtggtggcttcctggctgcacctcaggaacactcacggcgtcctcctgatggtcgtcctctttgccctcttcttaaggaagctctccggcgctcggtcgcgggcggcgctggcgcgccggcgtaggctgtgcgagaaggtcatgcgtcatgccgcgacgtacgaggagtgggcgcgcgccgccaaggtgctcgacaagatgtccgagcaggtccacgaggcggatttctacgacgaggagctgatcaggagtaggcttgaggagctccggagacggagggaggatgggtcgctccgggatgtggtgttctgtatgcgcggcgatctcttgaggaacttggggaacatgtgcaaccctgagcttcacaagggcaggcttgaggttcctaagcttataaaggactatattgatgaggtttctactcaattgaaaatggtgtgtgaatctgacactgacgagttgctattggaagaaaagcttgcctttgttcaagagaccaggcatgcctttgggaggactgcactactcttaagtgggggcgcctcactggggtctttccatgtaggtgtagtgaaaacattggttgagcataagcttctgcctcgtattatagcaggatcaagcgttggttccattatatgttcaatagttgctacccgaacatggcctgagattgagagcttcttcacagactcattacagaccttgcaattctttgataggataggtggaattttcgcggtgatgaggcgtgtcaccacctatggtgcactacatgacattagccagatgcaaaggcttctgagggatctcacaagtaacttaacatttcaagaggcttacgacatgactggccgtgtccttgggatcactgtttgctctcctagaaaaaatgagccaccccgctgcctcaactatctgacctcacctcacgttgttatttggagtgctgtaactgcctcttgtgcatttcctgggctctttgaagctcaggaactgatggcaaaggatagattaggcaacatagttcccttccatgcacccttttcgacagaccctgaactaggtcctggagcatcaaagcgccggtggagagatgggagcttggagatggatttgcccatgatgagactcaaggaactgtttaatgtaaatcatttcattgtgagccaaactaatcctcacatttctccactcctccgaatgaaagagcatgttagagcttatggaggccgctttgctggaaagctagctcgtcttgctgagatggaagttaagtatcgatgtaaccaaattctagagatgggtcttccaatgggaggacttgcaaagttgtttgctcaggactgggagggtgatgtcaccatggttatgccagcaacagtagctcagtatctgaagattatacagaatccaacatatgcagaactccagttggctgccaaccaaggccgcaggtgcacttgggagaagctctctgcaatcagagcaaactgtgccattgaacttgcattggatgaatctatagcagttttaaaccacaaacggcgactaaaaagaagcattgaaaggaccgcggtagcttcccagggacattctaactatgttcgattcaaaacaccaaggagggtaccatcatggagctgcatcagtcgagagaattcttcagaatctctctccgaagaaatttctgcagttgctacttcatccacgcagcaaggtgctgttcttgctgttggcacaccacatatttctcaccacgaccgacacacttcttatgatggaagtgagagcgaatcagaaaccattgaccttaattcctggaccaggagtggtgggcctctaatgaggacagcatctgctgacaagttcatcagtttcatccacaatcttgagattgacactgaattcagtaggccctgtactgtagaaggtgatactacaggcattttgtcggaatctacctttccagacgatccatgcccaaacaatagctgtagagttgctacgccagatagatgcacagaagtttctgagaccgagtcatgccacactgtcaacaccagagctagtcaagcttctactcccacaaacatcgcagtttctgaaggagagttgctacagcctgataatactacaaatagtattctacttaaaattgtgaagggagatgctctgcatgctcatcataacaatgcaaccgaattggccgagagctccttgactgaagcatatgtggaaccttgtgacaccatctcaggggccgaatctgctgaagataacaaggatgcagcggactcaagtaatccctcacttgataatgctgatcttataacttaacatcaatcttcagttgatgaatagattcttgattttgaaaggtcgtgatatagttcactacagcaacgctgtacaagaaaattgttgtggctctatttaaagagcacggatagcatatatgttatgttaatgttagtatttgcatctaaaaaaaaaaaaaaaaaaaa

SEQ ID NO: 6616 - protein, 833 aa, Panicum virgatum
  misc_feature: Ceres CLONE 1877798
  misc_feature (1)..(205): Pfam Name: Patatin Pfam Description: Patatin-like phospholipase
MDESGEASVGAFRIGPSTLLGRGVALRVLLFSSLWRLRARAYAAISRVRSATVPVVASWLHLRNTHGVLLMVVLFALFLRKLSGARSRAALARRRRLCEKVMRHAATYEEWARAAKVLDKMSEQVHEADFYDEELIRSRLEELRRRREDGSLRDVVFCMRGDLLRNLGNMCNPELHKGRLEVPKLIKDYIDEVSTQLKMVCESDTDELLLEEKLAFVQETRHAFGRTALLLSGGASLGSFHVGVVKTLVEHKLLPRIIAGSSVGSIICSIVATRTWPEIESFFTDSLQTLQFFDRIGGIFAVMRRVTTYGALHDISQMQRLLRDLTSNLTFQEAYDMTGRVLGITVCSPRKNEPPRCLNYLTSPHVVIWSAVTASCAFPGLFEAQELMAKDRLGNIVPFHAPFSTDPELGPGASKRRWRDGSLEMDLPMMRLKELFNVNHFIVSQTNPHISPLLRMKEHVRAYGGRFAGKLARLAEMEVKYRCNQILEMGLPMGGLAKLFAQDWEGDVTMVMPATVAQYLKIIQNPTYAELQLAANQGRRCTWEKLSAIRANCAIELALDESIAVLNHKRRLKRSIERTAVASQGHSNYVRFKTPRRVPSWSCISRENSSESLSEEISAVATSSTQQGAVLAVGTPHISHHDRHTSYDGSESESETIDLNSWTRSGGPLMRTASADKFISFIHNLEIDTEFSRPCTVEGDTTGILSESTFPDDPCPNNSCRVATPDRCTEVSETESCHTVNTRASQASTPTNIAVSEGELLQPDNTTNSILLKIVKGDALHAHHNNATELAESSLTEAYVEPCDTISGAESAEDNKDAADSSNPSLDNADLIT

SEQ ID NO: 6617 - DNA, 2454 bp, Panicum virgatum
  misc_feature: Ceres CLONE 1877855
  misc_feature: Encodes the peptide sequence at SEQ ID NO. 6618
ataaggaggtgctcatcataaccaaccaccactcgctactactgctagctccttcctccctctccttctacctccttctcttttgcttccgtgtgtgttccaagagggagagagaaagagaggggcgcatgctccggttgctagcttcagttcgatccgtgtagctctgctagctccttctcgatcgatcacccgactttcgggattcattatcatccagttggtgcttatatactattgatatcgatcggtcgtcggtggtgcagaagaagccggagagtcaggtaggctactgtccaagctaaggagagactatactagcagtcacgctgccgcacagttgcgtgacttggactggccagtcgcagtgtgaccggccggtagctcgctctgctagcagcagtggtggactggtggtggtggtgaccaatccaccaatcaactcgtgagctagctagctgagatcgatcgatacacatggcggccgcccacctgttcggactcggcgacgcgcagatgcagccgccgctgccgcagcaggcggcgcctcctcctccggcagccgcgccggcgcccaagaagaagaggaaccagcccggtaacccaaatccggacgctgaggtgatcgcgctgtcccccaagtcgctgctggcgacgaaccggttcgtgtgcgaggtgtgcaacaaggggttccagcgggagcagaacctgcagctgcaccggcgcgggcacaacctgccgtggaagctcaagcagaagaaccccaaggagacgcggcggcgggtgtacctgtgcccggagccgacgtgcgtccaccacgacccgtcgcgggcgctcggcgacctcaccggcatcaagaagcactactgccgcaagcacggcgagaagaagtggaagtgcgacaagtgcaacaagcgctacgccgtgcagtccgactggaaggcgcactccaagacctgcggcacccgcgagtaccgatgcgactgcggcaccctcttctccaggagagacagcttcatcacccaccgtgcgttctgcgacgcgatggcgcaggagagtgcacgggcgccgccgatcggcgcgggcatgtacggctccggcggcatggccctcggcctctccgggctggccgcctctcagctgcattcctttcaagaccaagcccactcgtcggccgccaccgccatcggcggcaatccggcggcgcagttcgaacacctcatgccgtcctcggccggctccccagcgttccgcggcgcgcagccagcgtcgtcatcctcctcgccgttctacctcggcggcgccgaggatggacaccagagccaaccgggacacacctctctgctccacggcaagccggccttccacggtctgatgcagctgccggagcagcacggccagccggggagcaacggtctcctaaacctggggttcttctcgggcgcgagcagcggccaggacgcgcgcctcgtcttcccgaaccagttcaacggtgccacaggagggaacggccgcggcgatggcagcgagcatggcaacagcggcgccaacaccgggtccgcagccatcttctccgggaacctaatgggcaaccaaatggcaggcggcggcggcggcttctcttcatccttgtacaactcaaccgagaccgtcgcgccgccgcagatgtcggcgacggcactgttacagaaggccgcgcagatgggcgcgacgacgagcggcggcggaggcggcagcgtgaactctctgctcagggggctcggtagcggcggcgccttgaacgggaggccatccggtgctgctgggttcatggccggggagagctcgtcgtcgaggagcacttctcaggccgagaacgagagccagttccgggacctgatgaactcgctggcggcttccgggagcggtggcttccccggcatggacgacgggaagctgagcacgagagacttccttggcgtcagcggcggcgtcgtgcggagcatgggcggcgcggcggggcttccgctgcggcacggcgccgcgggcattggcatgggctcattggacccagaaatgaagtaggagatcatcgaatggaaagcaaccaaggcaaggcaagacatgcattgatcattggagccatgcatgggcattggcatgggctcattggacccagaaatgaagcaggacagcatagggttcatggagttgcattggttggtgaatggtgatgaagatgctgatgaggccatcaaccatcatcatcagtgttatgatgctgcatggtgaatataaaggtgatttgcattatccatgcatctgtgttgttcaatggtgatgaattggtgatgggatgtattgtagggcagtacgtgtagtagcttctggagaacatgaaattcgaccagcaaataatagcagaaaaggccgggccgtttaattacatttcgtcaaaaaaaaaaaaaaaaaaaa

SEQ ID NO: 6618 - protein, 528 aa, Panicum virgatum
  misc_feature: Ceres CLONE 1877855
  misc_feature (1)..(23): Pfam Name: zf-C2H2 Pfam Description: Zinc finger, C2H2 type
  misc_feature: The sequence is a functional homolog of  SEQ ID NO 1524 in the  10/666,642 US patent application
  misc_feature: Useful for making plants with modulated growth and phenotype characteristics
MAAAHLFGLGDAQMQPPLPQQAAPPPPAAAPAPKKKRNQPGNPNPDAEVIALSPKSLLATNRFVCEVCNKGFQREQNLQLHRRGHNLPWKLKQKNPKETRRRVYLCPEPTCVHHDPSRALGDLTGIKKHYCRKHGEKKWKCDKCNKRYAVQSDWKAHSKTCGTREYRCDCGTLFSRRDSFITHRAFCDAMAQESARAPPIGAGMYGSGGMALGLSGLAASQLHSFQDQAHSSAATAIGGNPAAQFEHLMPSSAGSPAFRGAQPASSSSSPFYLGGAEDGHQSQPGHTSLLHGKPAFHGLMQLPEQHGQPGSNGLLNLGFFSGASSGQDARLVFPNQFNGATGGNGRGDGSEHGNSGANTGSAAIFSGNLMGNQMAGGGGGFSSSLYNSTETVAPPQMSATALLQKAAQMGATTSGGGGGSVNSLLRGLGSGGALNGRPSGAAGFMAGESSSSRSTSQAENESQFRDLMNSLAASGSGGFPGMDDGKLSTRDFLGVSGGVVRSMGGAAGLPLRHGAAGIGMGSLDPEMK

SEQ ID NO: 6619 - DNA, 1812 bp, Panicum virgatum
  misc_feature: Ceres CLONE 1877903
  misc_feature: Encodes the peptide sequence at SEQ ID NO. 6620
ggttacagcgtttgcccccgccgtgctctcgctctcccagaaatggcctcgcctgaggtagcccgccgtacaagcataccgcgctgcgccccagaggcagaagagcatagcacgatggggacccgagctgccagagtccgctcgagccctccccttcccgctcccatggccgcgccgccgctcctcctgctgctcctgctcgctgtattcttctcctccgccgccgcggccgggcctcgcgtggtgggggaggactacgtccggccgccgccggcgcgggcccaccgcaaggcgctcctgagcatcttcccctggagcaagaagaaggcctccgcatccgacctgcagcaggtgcacatatcgctagcgggagaaaagcacatgagaataacatggattaccgatgataactctgccccctctgtggtggactatggaaccaaagaaggaaaatacacaatgacatctcaaggagaaaacacatcctacagctacttattgtatagctcaggaaaaattcatcatgtagttatcggacctcttgaggacaacacaatttattactaccgatgtggagggcaaggtctggaattccaatttaagacccctccatcccaatttccgttgtcattggctgttgttggtgatcttgggcagactagttggacaaaatcaacactggatcacattaagcagtgcgagcatgatatgcttttactccctggtgatctctcttacgctgattttatgcaacatctgtgggattcctttggtacattggttgagccacttgctagaacacggccttggatggtgacagaaggaaaccatgagaaggagcacattctgtttcttgagtcagggtttcagtcatataatgcacgatggaaaatgccttatgaagaaagtggatctacatcaaatttgtactactcttttgaggttgcaggggcacacattataatgctaggttcgtacacagattatgatgagagctcagatcagtacgcttggctcaagtctgatcttgccaaggccgataggaagaagacaccatggctcatcgtattgttgcatgccccgtggtataatagcaattgggctcatcagggtgaaggtgacagtatgatggccgcgatggagcctttgctctatgctgctcatgtggatatggtaatagcgggtcatgtgcatgcttacgaacgcgcggagcgcgtctacaatggcagacttgatccttgtggtgctgttcacataactattggggatggtggaaaccgtgaaggcttggcccacaggtatcgtaatccgaagccagcttggtcagtcttcagggaagcgagctttggtcacggcgagctaaagatcatgaactccacccatgcccactggacctggcacaggaacgacgatgaagagccagtgagaacggatgacgtgtggataaactcgctggctggttccgggtgcatccaggaaggcagccatgagttgaggaagattctaatgtctccttgagaacaactgctgcacctggcgatccgctacagctcagtgtaaaagatcctgccatgtattgtatatatctccacgactagataaactaacaccgaaaagagaaactaaagcgttgtgctgtatattgaagactgttgatcaagggtgattgtcgcggagtacttttgttgtgtaatatgatgtttgtagcaagtaacacttctgtatactgtgatgttgtaatggactgaaattgatatttctgtaagggcgtgcgacatacttaccggagcggaaaaaaaaaaaaaaaaaaaa

SEQ ID NO: 6620 - protein, 491 aa, Panicum virgatum
  misc_feature: Ceres CLONE 1877903
  misc_feature (1)..(192): Pfam Name: Metallophos Pfam Description: Calcineurin-like phosphoesterase
MASPEVARRTSIPRCAPEAEEHSTMGTRAARVRSSPPLPAPMAAPPLLLLLLLAVFFSSAAAAGPRVVGEDYVRPPPARAHRKALLSIFPWSKKKASASDLQQVHISLAGEKHMRITWITDDNSAPSVVDYGTKEGKYTMTSQGENTSYSYLLYSSGKIHHVVIGPLEDNTIYYYRCGGQGLEFQFKTPPSQFPLSLAVVGDLGQTSWTKSTLDHIKQCEHDMLLLPGDLSYADFMQHLWDSFGTLVEPLARTRPWMVTEGNHEKEHILFLESGFQSYNARWKMPYEESGSTSNLYYSFEVAGAHIIMLGSYTDYDESSDQYAWLKSDLAKADRKKTPWLIVLLHAPWYNSNWAHQGEGDSMMAAMEPLLYAAHVDMVIAGHVHAYERAERVYNGRLDPCGAVHITIGDGGNREGLAHRYRNPKPAWSVFREASFGHGELKIMNSTHAHWTWHRNDDEEPVRTDDVWINSLAGSGCIQEGSHELRKILMSP

SEQ ID NO: 6621 - DNA, 2425 bp, Panicum virgatum
  misc_feature: Ceres CLONE 1877917
  misc_feature: Encodes the peptide sequence at SEQ ID NO. 6622
aattcgcatcactcctccccgcacggcagtccactccccagtcccagactccccactcgccactgcccccaaagctcctctctctttctctctccgccatggcctctccctccaccgcctcctcctagctccctccccgacccctcccagatcccgcacgcagcgcgccaacccccggcgcaggcacaacatgggagggtgccacgcgaagccgctcacccacgacgccgacgcctcgccgccgcgcgccgcgccggcgaccccgcccccgggctgcgccaccccagccaccccggggaagaagcattgggcggtctcccccttcttctcgttctccaccccgagcccgagccccgcgcaccacctcttcggcggctccgcggcgtccccgcgcaagtcctcccccgcgcacccgggcgcggcggccggctccgcgcccaccaccccggccaggcgcctgctgcggcttcccttcccgccgccgtcgcctgccaagcacatcagggcggcgctcgccaggcggcacggcccgcctcggccctccatccccgaggaagtctgcggcgagggggagggctgcggtggcggcagggggctggacaaggggtttgggttcaacaaggggttcgctgccaagtacgatatgggggatgaagtcgggaggggacacttcggctacacctgcgtcgccacggttaagaaaggcgcgcgcaagggggaggccgtcgccgtcaaggttatccccaaggcaaagatgactacatccattgctatagaggatgtccgaagggaggttaaaatcttgaaagctttggcaggaaacaagaacttggttcaattttatgatgcctatgaggacaatgagaatgtatatatagtaatggagttgtgcgagggcggagagctacttgatagaatactttccagaggtgggaagtactccgaggatgatgcaaaagctgtcctggtgcaaatattaaatgctgttgctttttgtcacattcaaggagtggttcatcgggatctcaagccggagaattttcttttcacttcaaaagatgagaatgcccatcttaaggcaattgacttcggcttatcagattttgtaaaaccagatgagaggctaaatgacattgttggaagtgcttattatgttgctccagaagttctgcatagatgctatagcacagaagctgatgtatggagtataggtgtaattgcatatattcttctttgcggcagtcgtcctttttgggcgcgcactgaatctggcatattccgttctgttctcaaagctgaccctagctataatgaggcaccgtggccttctctaactccagaagcaatggattttgttaagcgattgctgtgcaaggatccacgtagaaggatgactgcagctcaagctttaagtcatccatggatcagaaattataatgacattaaactgccattggacattcttatattccgacttatcaaagcttatattcgttcctcatcgttacggaaagctgctctgagggctctatcaaagactttaactgttgatgagcttttctatctgaagacgcagttttctttattggaacctgacagaaatggatgcatcactcttgacaatatcagaatggccttaacaagagaagctacagatgcaatgaaggaatcacgagttcaggagattcttgtttcgttgagtgcccttcagtacagaagaatggactttcaagagttctgtgctgcagcagttagtgtgcaccagctcgaagcattggatagatgggagcaacatgcacgatctgcttatgaacattttgagaaggatggcaatcgtgctattgtaatcgatgaactagcatctgaattgggcctcagcccttcagtaccactgcatgtcgttctgcaagattggatcaggcatacggatgggaaattgagctttctcggatttgtcaagctattgcatggcatgtccagcaggtctctgtcaaagatgagatagctgttgataatctctgacgacagcacaagtttacaccaccctagcccctgccttcacaggcaaattaacagggcttaaagaacagccatctggagcttgcagaccgtgggcgtctgagttctagcactgcctgatctgccactaattttagtatagagacatagagttatgtcgtcgactgtcgtagcctgcctactgatcatttagtcgataggaaaaaggaaaatctcacccatgtctgcaacatgtgatgtttctaacagtcttagaataggtgccatgttctgttgtaattttgggaacaaactttaatgctgttcctggaactggagcaagtttgctgcggtcaccagggtggcgtctgaagcagtgaagcgtggacatattcactttactgccaaaaaaaaaaaaaaaaaaaaa

SEQ ID NO: 6622 - protein, 604 aa, Panicum virgatum
  misc_feature: Ceres CLONE 1877917
  misc_feature (14)..(602): SWISSPROT Homolog: EC 2.7.11.1 CDPK-related protein kinase
MGGCHAKPLTHDADASPPRAAPATPPPGCATPATPGKKHWAVSPFFSFSTPSPSPAHHLFGGSAASPRKSSPAHPGAAAGSAPTTPARRLLRLPFPPPSPAKHIRAALARRHGPPRPSIPEEVCGEGEGCGGGRGLDKGFGFNKGFAAKYDMGDEVGRGHFGYTCVATVKKGARKGEAVAVKVIPKAKMTTSIAIEDVRREVKILKALAGNKNLVQFYDAYEDNENVYIVMELCEGGELLDRILSRGGKYSEDDAKAVLVQILNAVAFCHIQGVVHRDLKPENFLFTSKDENAHLKAIDFGLSDFVKPDERLNDIVGSAYYVAPEVLHRCYSTEADVWSIGVIAYILLCGSRPFWARTESGIFRSVLKADPSYNEAPWPSLTPEAMDFVKRLLCKDPRRRMTAAQALSHPWIRNYNDIKLPLDILIFRLIKAYIRSSSLRKAALRALSKTLTVDELFYLKTQFSLLEPDRNGCITLDNIRMALTREATDAMKESRVQEILVSLSALQYRRMDFQEFCAAAVSVHQLEALDRWEQHARSAYEHFEKDGNRAIVIDELASELGLSPSVPLHVVLQDWIRHTDGKLSFLGFVKLLHGMSSRSLSKMR

SEQ ID NO: 6623 - DNA, 1936 bp, Panicum virgatum
  misc_feature: Ceres CLONE 1877936
  misc_feature: Encodes the peptide sequence at SEQ ID NO. 6624
aacttctccttccctttctcgccgccgaataatccggccctcgtctacgagaagctagcccccgttgcgtgcgcctcgagcatctggcggttcgagaatcggcggcggcgggcggcggcataattcgatacagccgtgcgctcctttttttgggcggcggtggaggagaatcgcgctggttgggggtgagggtggtgggggaatccatttttagggcggtgcgggcgcgatcggtccgggatcgggagttttttgttgttgggggcgagagaggccacgagagcggcgacgcccggggacccgacccgacccagcccagcaccgcgccgaggagggagaagaagggataggagacggcgacggtggtcgcgaggatggccggcagcatgcaggcggcggaggccgcggggcggctcagcgcgctgctctcgctgctcgcgctgcgccgcctcctcgccgtgctccagccgctggccctgctcctgctcctgcccttccgctggcgcgcgcgcccgggggccgcggccgcggaagccgcgtccgacgccgcgccgtccgcgtcgagcgccaccgtgaagaaggggaaggcgtcggcgtcggtggtgctgcgggtgccggccggctcgcccatggtcgccgcgcgcaggcaggcgttggcgcggagggagatagccatccgccgggcgcgggaggacggacgggagtatgagctcatccccaccgcccgcggagagacgctcttcacgcagtgctggtggccgtacccgcccccctccaccattaaaccaagggcgctagttgttgtcatgcacgggctaaacgagcacagtgggagatatgatcatttagcgaggcgtttgaatgagatcggcatcaaggtgtacgggatggactggactggccatgggggaagtgatggtcttcatggatatgtgcagtctcttgatcatgctgtcagtgacttgaaaatgtacctcaagaaagtcttagctgagaaccctggtcttccatgcttctgctttggccattcaactggcggtggcatcattttgaaggctgcacttgatccagaggtagatattcttattaacggtattatcctgacatcaccagctgttcgtgtacagcctgcccacccaatcgtaaaggtcatggcgccacttttcgccctcatcgcgccgaggtaccagttcacggcgtcccaccggaacggcccgccggtgtcgcgcgacccggaagccctgcgcgccaagtacacggacccgctcgtgttcacgggcgccatccgcgtcaggacgggctacgagatcctccgcctgacgtcctacctgcagcagcacctgcaccgcatcaccgtccccgccctggtgatgcacggcgccgacgacatggtgaccgaccccgagggctcgcgggcgctctacgagcggtcctcgtccgcggacaagtccctcaggctctacggcggcctgctgcacgacctcctgatcgagcccgagaaggaggcggtgatggacgacatcgtggcgtggctgcgccccagggtctgacgcccgccgccgccgccgccaccggcaagcgccggccgtaggacgcagctcgatcgccagccgcggagcgcggaggaccagcaggcgggccgccgcctcgcctccggacggtgatgacgcggtgacgacgcgagagcagaggacaggagtgcccgagtacctacggtgatggcgctttactcacacgcctcccggtgtgcctgtatcccgagatttttggtcagggatacgtatgggtttgtaaaattgttgttcgtttcgccctgtgtggccgcacgagtggtgcccgatacttatataatttagacgcccattcccctcgggttgatgcattaaagattgcaattccaagtcagagttgcgacgaaaaaaaaaaaaaaaaaaaa

SEQ ID NO: 6624 - protein, 391 aa, Panicum virgatum
  misc_feature: Ceres CLONE 1877936
  misc_feature (1)..(218): Pfam Name: Abhydrolase_1 Pfam Description: alpha/beta hydrolase fold
MAGSMQAAEAAGRLSALLSLLALRRLLAVLQPLALLLLLPFRWRARPGAAAAEAASDAAPSASSATVKKGKASASVVLRVPAGSPMVAARRQALARREIAIRRAREDGREYELIPTARGETLFTQCWWPYPPPSTIKPRALVVVMHGLNEHSGRYDHLARRLNEIGIKVYGMDWTGHGGSDGLHGYVQSLDHAVSDLKMYLKKVLAENPGLPCFCFGHSTGGGIILKAALDPEVDILINGIILTSPAVRVQPAHPIVKVMAPLFALIAPRYQFTASHRNGPPVSRDPEALRAKYTDPLVFTGAIRVRTGYEILRLTSYLQQHLHRITVPALVMHGADDMVTDPEGSRALYERSSSADKSLRLYGGLLHDLLIEPEKEAVMDDIVAWLRPRV

SEQ ID NO: 6625 - DNA, 2537 bp, Panicum virgatum
  misc_feature: Ceres CLONE 1877996
  misc_feature: Encodes the peptide sequence at SEQ ID NO. 6626
aaatcaaacccgacgctgcgcagcatccacacctaaacccctcggccggcggcgcctcgatccccccgcgcgatgtcgccgtcgtcgccaccgcgccggccgcagcgccgcgcggcgtcgttgcgcccggcctcgtacgacgagtccctcggtgacgccgcgctggaggcctacctgggcgacgccccctcgcggcgggtgcggcgcctgcgccgcctctcggcggaggagcggcagcgggagacggagacggaggcgctcatcgcgctctcgctgggcttccccatcgacgagctgctccccgaggagcggcccctcctgcccgcccacatcgccgacgcgcccaacgactacatcgtcgtccgcaaccacatcctcgcctcctggcgcgccgacccgggcgcgccgctgccccgcgcgcgcgtcctcgagaccgtcgccgcctcctacgaccacctcgtcgccgccgcgcacgggttcctcgcccgcgagggccacatcaacttcggcgtctccgccgccttcccggccgcgccgcccctggacgccgccctccagggcccgcccgcccccgccgcctcggtcatcgtcgtcggcgcgggcctcgcggggctcgccgccgcgcgacagctgctccgcttcggcctccgggtgctcgtcctcgagggccgcgcgcgccccggcggccgcgtctacacatcccgcctaggcggggataaggccgccgtcgagctcggcggcagcgttatcaccggaatccacgctaatccgctcggcgtgctcgcgcggcagcttggcattccgctgcacaaggtgcgggaccgctgcccgctctactacccggacggccgcaccgtggagaccaggctggacaggagcatagatctggtgttcaacacgcttctcgaccatgccaccaggctccgggagtttctgaatgaggtcgcggagaggatctcgctgggggaaggcatcgagaagatcagaaggctgtaccatgcggccacgacggatgacgagcggatggttttggattggcatttggcgaatctggaattctccaatgctggttgcctgtcagagctctcactcgcacattgggaccaagacgatccttatgagatggggggagatcattgcttcctagccggagggaattcccggctcatacatgccttgtgtgatggtgtgcccgtgttgtatgagaagacggtgatgcgaattgagcatggatccgatggggttagcgtcacagtggaaggagggcaggttttccaggctgacatggttttgtgcactgtaccccttggggtgctcaagagtggtagcatcgtgttcgacccagagttgcctgagcataagcttggggcaatacagaggttggggtttgggttgctgaacaaggtggccatggtgtttcctcacatgttctgggatgaggatatcgatacatttgggtgtttgaacaaggagagtagcaagcgtggggagtactttctgttctatagctaccacactgtctctggcggagcagtgcttattgcacttgtggctggagaggctgctttggagtttgaaaaggtcgatcctgttgttgcacttcaccgagtacttgccattcttagaggtatctatggtccaaagggtgttactgttcctgatcccattcagtcggtttgcacaagatggggtagtgatccgttttgcctaggttcatactcccacatcagagttgggtcttctggtgccgactatgatattcttgctgagagtgtgaatgatcggctcttctttgctggagaagccacgattcgtgcgtacccagcaacaatgcatggtgccttgttgagcggattaagagaagcttccaaaattcatcgtgcggcagagagtataatgaattctgaccagaagaagtataccgtgcctaatagcctgagaccacccaatggtgcccttgaagatattttctccgagccagatcttgcattcgggagattctcgttcgtgttctcctcagtgacacttgatgatcctgaggctccaggactagcccggatttcactcgacaatttgctgctgcagcccaagaataatgaaccaaaagaagatgaaaaggttcaagaccctgcagctgagaaaatcgtccttcagaccttccatttgtatgccaccatctcccgagagcaggctgatcgactgcaaaattcaagcaacgacgacaaaggtaggttaggattgttatgcaaggatctcggtgtaaagctgatgggctatgatagtacgtgtgatgtatgtagtgatatgatcttgagcatcttgagcgcacggaaagccaggaaacggctgcagcaccccaagtacttcaagatctcgcattgatttgtattctgtaccatctccttcgccatcttgtagaacagaagcattcttttgttagatccgaagaactggctgttggagcttggattttttttctctctatgcgcattgaactctcatttgtaatttgtatagtaaaaaaaaaaaaaaaaaaa

SEQ ID NO: 6626 - protein, 769 aa, Panicum virgatum
  misc_feature: Ceres CLONE 1877996
  misc_feature (1)..(425): Pfam Name: Amino_oxidase Pfam Description: Flavin containing amine oxidoreductase
MSPSSPPRRPQRRAASLRPASYDESLGDAALEAYLGDAPSRRVRRLRRLSAEERQRETETEALIALSLGFPIDELLPEERPLLPAHIADAPNDYIVVRNHILASWRADPGAPLPRARVLETVAASYDHLVAAAHGFLAREGHINFGVSAAFPAAPPLDAALQGPPAPAASVIVVGAGLAGLAAARQLLRFGLRVLVLEGRARPGGRVYTSRLGGDKAAVELGGSVITGIHANPLGVLARQLGIPLHKVRDRCPLYYPDGRTVETRLDRSIDLVFNTLLDHATRLREFLNEVAERISLGEGIEKIRRLYHAATTDDERMVLDWHLANLEFSNAGCLSELSLAHWDQDDPYEMGGDHCFLAGGNSRLIHALCDGVPVLYEKTVMRIEHGSDGVSVTVEGGQVFQADMVLCTVPLGVLKSGSIVFDPELPEHKLGAIQRLGFGLLNKVAMVFPHMFWDEDIDTFGCLNKESSKRGEYFLFYSYHTVSGGAVLIALVAGEAALEFEKVDPVVALHRVLAILRGIYGPKGVTVPDPIQSVCTRWGSDPFCLGSYSHIRVGSSGADYDILAESVNDRLFFAGEATIRAYPATMHGALLSGLREASKIHRAAESIMNSDQKKYTVPNSLRPPNGALEDIFSEPDLAFGRFSFVFSSVTLDDPEAPGLARISLDNLLLQPKNNEPKEDEKVQDPAAEKIVLQTFHLYATISREQADRLQNSSNDDKGRLGLLCKDLGVKLMGYDSTCDVCSDMILSILSARKARKRLQHPKYFKISH

SEQ ID NO: 6627 - DNA, 3330 bp, Panicum virgatum
  misc_feature: Ceres CLONE 1878097
  misc_feature: Encodes the peptide sequence at SEQ ID NO. 6628
gctgctgctcccctcctcccgtccatccgccgcggggagctcagctccagctcgtcacgctgctccgctcggccggccgggcgcgggtgccaacgggaagccgcggccttaaaaaaagggaagggtacccagcttgcccaagcttatcacatctccctccggctgctctcgctcgctactcttgtgctacttaaacaaacagctcttgcgatccgcaagggccagcggccagcacccccgcacgcgaccccaagccaggaatcgcttcccacccagcgcggccaccagcagcagcaagcaccgcaccgctctgctctctccctgtcggcaacggcaaatccggcctccctccctcccgctcgctcgctcgcagtccccctccctgtcggcaacggcaaatctggttcgtgatccggcgcgcggggatggtgtcgagatcctactccaacctcctggagctcgcctccgggggcggcgggggcggggagccgctgccgtcgctggggcgccgccgggtgccgcgcgtcgtcacggcgcccggcattgtgccgggcctcgacgcctccgacgacgacgacgacgcctccgaccgctcctcccacgcgccgcgggagcgcgtcatcatcgtcgccaaccagctccccgtgcgcgccgcgcaccgcgcgggcggcgccggttgggacttcgcgtgggacgaggacagcctcctgctgcaggtcaaggacagcctccgcgcgcaccacggccgcggggacgtcgagttcgtctacgtcggcggcctccgcgacgacgtgccccccgccgagcacgaccaggtcgcgcacgagctcctcgaggggttccgctgcgtgcccaccttcctgcccgccgacctccgctccaggttctaccacggcttctgcaagcagcagctctggccactgttccattacatgctgccactgtcgccggagctcggcggacgcttcgaccgcctgctctggcaggcctacgtctccgtcaacaagatcttcgcggacaagatccttgaggtgatcagccccgacgaggactttgtgtgggtgcacgattaccacctcatggtgctgcccacattcctgcgcaagcgcttcaaccgggtcaagctcggcttcttcctgcacagcccgttcccctcctcggagatctacaagaccctgcctgtgcgtgaggagctgctccggtcgctgctcaatgccgatctgattgggttccacacctttgactatgccagacacttcctgtcgtgctgcagcaggatgctcgggctcaagtacgagtcgcagaggggctacattgcactggagtactatggacgaacagtcacaatcaagatcttgccagtgggggttcacttggagcagttacagtcagtccttaatcttccagagactggagtcaaggtggctgagcttctgaagcagttcaatcatcggagccggctgctgttgcttggtgttgatgatatggatatcttcaaaggaattagcttgaagcttttggcgtttgagcagctgctgatgcagcatccaaagtggcggggaagggtggtgctggttcagattgccaatccggcaagggggaagggaaaggatgtgaaagaggtacaggaagagagcgatgcaatggtaaagcgcatcaatgatgcattcgggcagccagattaccagcctgttatactgattgataagccactgcggttctatgagaggatggcatattatgttgttgccgagtgctgcttggttactgcagtgagagatggcatgaatcttatcccgtatgagtacattattgctcgacaagggaatgagatgatcgacaggatcctaggtcttggcccatcttcaaggaagaagagcatgcttgttgtctcagagttcatcggatgctcgccctccctaagcggcgcgatccgggtgaacccttggaacattgattcagtggctgatgcgatggactctgcattggagatgccagaaggggagaaggtcttgagacacgagaagcatcatagatatgtgagcacacacgatgttagctattgggcgaacagcttcctgcaagatcttgagaggacttgtctcgaccacaacaggaggcgttgctggggcataggattcgggctaaagttcagggttgtagcccttgacccaaacttcaagaagcttgcagttgagcacttggtctcggcctaccggaggacaacaaagcgcatcattctcttggactatgatgggaccctgatgccgcagacttcgtttggtaagagtcctacctcaaggacgatagacatgttgaacagcctttgccgtgacaagaacaacatggtcttccttgtgagcacaaagagtcggacgactttaagcgagtggttctcaccatgcgagaacttgggactagcagctgaacatggctactttctcaggctgagaagagatgcagaatgggaggagtgtgtcacggtgatagactgcagctggaagcaaattgcagagcctgtgatgaagacctacacagagacgacagacgggtcaacaattgaggacaaggagactgcaattgtttggagctatgaggatgctgatccagattttggctcctgccaggccaaagagctccacgaccatctggagagtgtcctctcaaacgagccggtgtcggtgaaagctggcttgaaccatgttgaggtgaagccacagggcgtgagcaagggcctggtggcgaagcggatcttgtcgacgatgcaggagcgtggtgacctgccggacttcatcctgtgcgtgggcgacgaccggtccgacgaggacatgttcgaggtgatcaccacggcggcggcgcggggcccctcctccctgcacccggaggcggaggtgttcgcgtgcacggtggggcgcaagcccagcaaggccaagtactacctggacgaccccgcggacatcgtgcgcctcatccagggcctcgccaacgtctccaacgaccaggcgtcgcacggcggcagcggcgcgaccctgcccgacgatgccgcagcggccgccgccaccgtcctgaggtgacaccgcacctgcccgcccgcgcgcagttaagctcaagtaggcggtatgagagaccgacctctcggaagggggagggagcatcgctcggtcgttggtcccagatgtgtacattgttctaggaacgaactcgcgcaagtgcgtgctgtgcttgcgagtgcgctgcttcgtcgaactgtcagccgatgtgtacataaactcctccagatcatctccatcgacagcgtcgagttctcgtcaaaaaaaaaaaaaaaaaaaa

SEQ ID NO: 6628 - protein, 882 aa, Panicum virgatum
  misc_feature: Ceres CLONE 1878097
  misc_feature (1)..(488): Pfam Name: Glyco_transf_20 Pfam Description: Glycosyltransferase family 20
  misc_feature (1)..(236): Pfam Name: Trehalose_PPase Pfam Description: Trehalose-phosphatase
MVSRSYSNLLELASGGGGGGEPLPSLGRRRVPRVVTAPGIVPGLDASDDDDDASDRSSHAPRERVIIVANQLPVRAAHRAGGAGWDFAWDEDSLLLQVKDSLRAHHGRGDVEFVYVGGLRDDVPPAEHDQVAHELLEGFRCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSEIYKTLPVREELLRSLLNADLIGFHTFDYARHFLSCCSRMLGLKYESQRGYIALEYYGRTVTIKILPVGVHLEQLQSVLNLPETGVKVAELLKQFNHRSRLLLLGVDDMDIFKGISLKLLAFEQLLMQHPKWRGRVVLVQIANPARGKGKDVKEVQEESDAMVKRINDAFGQPDYQPVILIDKPLRFYERMAYYVVAECCLVTAVRDGMNLIPYEYIIARQGNEMIDRILGLGPSSRKKSMLVVSEFIGCSPSLSGAIRVNPWNIDSVADAMDSALEMPEGEKVLRHEKHHRYVSTHDVSYWANSFLQDLERTCLDHNRRRCWGIGFGLKFRVVALDPNFKKLAVEHLVSAYRRTTKRIILLDYDGTLMPQTSFGKSPTSRTIDMLNSLCRDKNNMVFLVSTKSRTTLSEWFSPCENLGLAAEHGYFLRLRRDAEWEECVTVIDCSWKQIAEPVMKTYTETTDGSTIEDKETAIVWSYEDADPDFGSCQAKELHDHLESVLSNEPVSVKAGLNHVEVKPQGVSKGLVAKRILSTMQERGDLPDFILCVGDDRSDEDMFEVITTAAARGPSSLHPEAEVFACTVGRKPSKAKYYLDDPADIVRLIQGLANVSNDQASHGGSGATLPDDAAAAAATVLR

SEQ ID NO: 6629 - DNA, 830 bp, Panicum virgatum
  misc_feature: Ceres CLONE 1878170
  misc_feature: Encodes the peptide sequence at SEQ ID NO. 6630
gaaccacggcgagaagccttgtcgatcagttgttcatagcagccacgacgacgaacaccggccttacttggcggcgcacactgcaccatgggcatcctgaaccacctctcccacctctgcagcttcacggagacgaaggaggccctcaagctccggaagaagcggccgctcaacacggtgaacatcaaggtgaagatggactgcgaggggtgcgagcggcgggtgaagagcgccgtcaagtcgatgcgcggcgtgaccagcgtggcggtgaacccgaagcaggggaggtgcacggtgacggggtacgtggagccggccaacgtgctggcgcgggtcaagggcaccggcaagaacgcccagatgtggccctacacgccctacaagctcacctcccacccctacgtcggcggcgtctacgacaagaaggcccccgccggcttcgtccgcagcgcgccgcaggccatggccgaccccgccgcgcccgaggtcaggatgatgaccatgttcagcgacgacaacgccaacgcctgcgccgtcatgtgacccagcaccgatcagccgccgcccggagacgccgcgccgcgccaccgcgcctgcgcgcggcgaatcacgcgtcttgctgcgggagcaaaacacatgaatcagtgggccttttagaaataaatgttgttaattatgtaatatatttttgtactaaagctatttggagacataaatgttattaatttttttatgtaaatttagtcaaatttaaaattatttgacttctcacgaagtgttagttatattaataaggattaatttacatataaaaaaaaaaaaaaaaaaaa

SEQ ID NO: 6630 - protein, 151 aa, Panicum virgatum
  misc_feature: Ceres CLONE 1878170
  misc_feature: Great-hit functional homolog of the protein sequence given in SEQ ID NO 9550
  misc_feature: Useful for biocontainment applications
  misc_feature: The plant produces a reduced number of seeds.
MGILNHLSHLCSFTETKEALKLRKKRPLNTVNIKVKMDCEGCERRVKSAVKSMRGVTSVAVNPKQGRCTVTGYVEPANVLARVKGTGKNAQMWPYTPYKLTSHPYVGGVYDKKAPAGFVRSAPQAMADPAAPEVRMMTMFSDDNANACAVM

SEQ ID NO: 6631 - DNA, 710 bp, Panicum virgatum
  misc_feature: Ceres CLONE 1878331
  misc_feature: Encodes the peptide sequence at SEQ ID NO. 6632
gagaagctagatcgatcgagcactctggttgccggacgatggccgcgcgggcgccgcagctggggcaggggcagagggtgatggtggcggtggacgagagcgagtgcagccgccacgcgctggagtgggcgctgcggaacctggcgcccacgctggcgccgccgctgctgctgctcaccgtgcagccgctcgtcccccttggatacgtctccgccgcctccttcggcgcccctctgggcaccgttccccctgtagctccggagctcatcaagtcgatgcaggatcagcagagggagctcacgcgggcgctcctcgacaaggccaaggccatctgcgcggagcatggggttccagtagagacaattgttgaggtaggagatccgaaggagatgatatgtgaagcagctgagaaaaaaaatgtcaatctgctagtccttggaagccacagtcgtgggcctatacaaaggttgtttcttgggagcgttagcaactactgcgttcatcattgcaagtgtccagttcttgttgtgaagaaccaaggctgaggattcatgcatagatcaacttccaatgttgtcgtaattctgtttgggtatttatcaacatatattatacacaataatgggcaagataatgtaagtattactttagccaaacacatttggcaaataaagcatcttgcttcaggacaaaaaaaaaaaaaaaaaaaa

SEQ ID NO: 6632 - protein, 168 aa, Panicum virgatum
  misc_feature: Ceres CLONE 1878331
  misc_feature: Great-hit functional homolog of the protein sequence given in SEQ ID NO 9665
  misc_feature (3)..(155): Pfam Name: Usp Pfam Description: Universal stress protein family
  misc_feature: Useful for making plants with modulated biomass
  misc_feature: The plant is abnormally small.
MAARAPQLGQGQRVMVAVDESECSRHALEWALRNLAPTLAPPLLLLTVQPLVPLGYVSAASFGAPLGTVPPVAPELIKSMQDQQRELTRALLDKAKAICAEHGVPVETIVEVGDPKEMICEAAEKKNVNLLVLGSHSRGPIQRLFLGSVSNYCVHHCKCPVLVVKNQG

SEQ ID NO: 6633 - DNA, 1848 bp, Panicum virgatum
  misc_feature: Ceres CLONE 1878362
  misc_feature: Encodes the peptide sequence at SEQ ID NO. 6634
aaccacacaccttctcagcgtcagctagcattgcttgggtagtttttgcatccacggagttggccggagatgacgacgatgtcagccaagttccgttccatggccggcaagatcgtcctcgtcctcgtcctgggcgtcctcctccaccccttctcctctgcaggtgcaggggaagaagcaatggcagctctccagccggagctgccgcagtgcaaccccttggtggggccgccggacatctcgccggactgcgacacctggtgctggtacggcggccacccgggaggctacgtcaaaggcgacgtctgctgctgcaaccccggcgccggcctagctgatgatgctgatagctaaacgaaaggcagcgacgacgccgagcccggcccggcggctaagccagcagcgagctgatcgatatataccccacacccccagccccagcagccaagcgccacgctccaccgtaccaaccgcaaccagccgcgcgccgtgatcatctgtgcggtggtgctgtagttagttgctttccgctccgctgctcggcttcgctttcctgccgttgtgcggaccggcatcgatctaccagggcgaggaggatgaaggtgtcggtggccgcggcggcggcggcggcgcttctgctgctgctgctctcggcggcggacgcgagcgagctcaagctggggtactacgccaagacctgccgggggtgggagaacgtggtcaaggaccacgtcgccaaggccatccgggccaaccgcgccagcggcgccgccctcgtccgcctcatcttccacgactgcttcgtcaggggttgcgacgcgtcggtgctgctcgacccgacgccggcgaacccgcacacggagaagacggcgccgatcaacatcgggctggcggcgttcgaggtgatcgacgacatcaaggaggcgctggaggagcggtgccccggcacggtgtcgtgctcggacatcgtggtcttggcggcccgggacgcgtccagcatcctgagcaacgggcacgtgcacttcgacccgccggcggggcggctggacggcaaggtctcccgcgccgccgacgcgcagcgggacctcccggactcgaccttcacgatcgccgagctgatccgcaacttccggcgcaagaacttcacggtggaggagctggtgatcctgtcgggcgcgcacgccgtcggcgtgggccactgctcctccttccgcgcgcggctgacctcgccgccgagccagatcgtgccggcgtaccggaacctgctgaccgggcggtgcgcggaggggccggaccccgtggtgccgaacaacgtgcgggacgaggacccgcgcgcggtggcggcggcgttcccgtcgttcctgaagaagctgcggcggagcggggacttcctggacaacagctactaccacaacaacctggcccggatcgtgaccttcaactcggactggcagctgctgacggagaaggaggcgctggggcacgtcaaggagtacgccgagaacgggacgctgtgggacgaggacttctccgaggcgctggtgaagctcagcaagctgcccatgccgccgcgcagcaagggggagatcaggagccactgccgcgtcgtcaacggccaccaccaccaccactgatcgaaccgacgcagctgatcgaaactgtgattactacagtctctcgccttcatcatttgattgttcattttgttgttgatgctgtacgttgccttctcctattcctatgtgatttttttgttgttgtctttctggtgttgggggatgtaatgtgattgatatgttatatgatctttggatgcacaaagttactgaaaaaaaaaaaaaaaaaaaa

SEQ ID NO: 6634 - protein, 345 aa, Panicum virgatum
  misc_feature: Ceres CLONE 1878362
  misc_feature (1)..(261): Pfam Name: peroxidase Pfam Description: Peroxidase
MKVSVAAAAAAALLLLLLSAADASELKLGYYAKTCRGWENVVKDHVAKAIRANRASGAALVRLIFHDCFVRGCDASVLLDPTPANPHTEKTAPINIGLAAFEVIDDIKEALEERCPGTVSCSDIVVLAARDASSILSNGHVHFDPPAGRLDGKVSRAADAQRDLPDSTFTIAELIRNFRRKNFTVEELVILSGAHAVGVGHCSSFRARLTSPPSQIVPAYRNLLTGRCAEGPDPVVPNNVRDEDPRAVAAAFPSFLKKLRRSGDFLDNSYYHNNLARIVTFNSDWQLLTEKEALGHVKEYAENGTLWDEDFSEALVKLSKLPMPPRSKGEIRSHCRVVNGHHHHH

SEQ ID NO: 6635 - DNA, 2062 bp, Panicum virgatum
  misc_feature: Ceres CLONE 1878652
  misc_feature: Encodes the peptide sequence at SEQ ID NO. 6636
aaaaaagaaagtaaaaaatcgaacgagcaaaaaaaagaaaaggaaaggaaattccaaaccctcttcccccaaaatcgcagcggcggcttatccaccttgatcgagtcgaagcctctctccgacaaggcgtcgccgtcggacctctcgtagagccgccgaccttctccgcgcctcgcgccggtgaggtgatccgggcgatctgatccagtggtggtgcggtgcgattctgttgcggaaatttttgttgagggggaattttctgcgggcggcgccggcgccggcgccggaggcgaagcgaagatgatccgtcttcagacgtacgcggcgttcagcctgctggcgaccgcgtcggcggtgtactacgccttcagcagccgggatcagttttacccggcgatggtctacctctccacctccaagatctgcttcgtgctgctcctcaacacgggcctcgtcgccatgtgcgtcgcctggcagctcgtcaagcgcctcttcctgggctccctccgggaggccgaggtcgagcgcctcaatgagcagtcctggcgggaggtcgtcgagatcctcttcgcggtcaccatatttcgtcaggacttctccgtctccttcctggccatggtcgctgcgctgctcctcgtcaaggcgctgcactggctggcacagaagagggtcgagtacatcgagaccacgccctcggtgcccatgctctcgcatataaggatcgtctccttcatggtgttcctactcatcatcgactgcctcttcctgtcgaactcgctcaggtcgctcatagacaagcgggaggcgtcagttgccatcttcttctcatttgaatatatgatactggcaacatccacagtatcaacatttgtgaagtatgtattctatatcagtgacatgctaatggaaggtcaatgggagaaaaaggcagtgtacacattttacttggagctcatcagtgaccttgtacacttatcactatacatgctctttttcatagctatcttcctgaactacggtgtcccgctgcacttgattcgcgagctatatgagaccttccgcaacttcaaaattcgtgttgcagattatgtacgctacagaaaaatcacttccaacatgaatgaacgctttccagatgctacagcagaggagctcaacgcgagtgatgctacatgtattatttgccgtgaggagatgactacagcaaagaagttgctttgtgggcacctgttccatgtgcattgtctaaggtcatggctagagcgccagcacacttgccccacgtgcagagctccaatcattccgccagataatggacgtgctgcatcagcccgacaacatggagctcagcctggagttcagcctggtactggtactccagcctcagaaggagcagcaggtgacaacatgagcaggcgccaagcaaagcttgaagctgctgcagcagctgcttctttatatggaagatcttttgcttatcctccagcaaacatcctaaataggtcaggtcctccacagtctgcatcaagtacaccacaatttgaagcaagtagctccaatcaatcacagaaagaccaagaactgcagttacataacaccagcgatggtttcgcacctctgccttttaatgcacatggtgccattggttcaggaacaatcaccagggatcttgaaaattcactgcagagggcacaagaaaactttataaagagccagatagagatgttacaaatccagctgcaaatggttcagcgtggtgctgctgtgccggccactaacaatgagaatgccgagcacacaaagaatgattgaaactgtaaatacttaataggcagagatgaggacgagataaagaaaacaaagatttggctgtacctgaggggaaactgttgcatgatgccttgccttgattttggtaggtttgttcatttatacttcccttgttaatgccctcttagcaacaccagatgtttcttctttttatgtgttggctgcgcagtttggatctctgtcaagcccgtataataccattgatatagtccaaaaaaaaaaaaaaaaaaaa

SEQ ID NO: 6636 - protein, 503 aa, Panicum virgatum
  misc_feature: Ceres CLONE 1878652
  misc_feature (1)..(38): Pfam Name: zf-C3HC4 Pfam Description: Zinc finger, C3HC4 type (RING finger)
MIRLQTYAAFSLLATASAVYYAFSSRDQFYPAMVYLSTSKICFVLLLNTGLVAMCVAWQLVKRLFLGSLREAEVERLNEQSWREVVEILFAVTIFRQDFSVSFLAMVAALLLVKALHWLAQKRVEYIETTPSVPMLSHIRIVSFMVFLLIIDCLFLSNSLRSLIDKREASVAIFFSFEYMILATSTVSTFVKYVFYISDMLMEGQWEKKAVYTFYLELISDLVHLSLYMLFFIAIFLNYGVPLHLIRELYETFRNFKIRVADYVRYRKITSNMNERFPDATAEELNASDATCIICREEMTTAKKLLCGHLFHVHCLRSWLERQHTCPTCRAPIIPPDNGRAASARQHGAQPGVQPGTGTPASEGAAGDNMSRRQAKLEAAAAAASLYGRSFAYPPANILNRSGPPQSASSTPQFEASSSNQSQKDQELQLHNTSDGFAPLPFNAHGAIGSGTITRDLENSLQRAQENFIKSQIEMLQIQLQMVQRGAAVPATNNENAEHTKND

SEQ ID NO: 6637 - DNA, 870 bp, Panicum virgatum
  misc_feature: Ceres CLONE 1879148
  misc_feature: Encodes the peptide sequence at SEQ ID NO. 6638
acacagatacattcgtcgatccaccactgtccagtgctcggctcggttacgcacgcacgcacacaaattgtagtacctgtgttttacaccaccaaagatactagcaagccgagtcgacaaacaaagcagcaggaagaggcatggcgctcgctgacgggaacggcgcggccatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagcgcagctacggaaggccgggaaggtcaccgtcagggagacgacgctcaagcggctgggcgcaacgcacttcaagtacggcgtcgccgacggccacttcgaggtgacaaggttcgcgctgctggagacgataaaggaggcgcttcccgccgacatgtggagcctggagatgaagaacgcctggagcgaggcttacaaccagctcgtggcggccatcaagcaggagatgaagcctgctgcatgatgctgcatgctgctacatactcggcctccgagttccccctacgatgcaccaccatctccaagttcttcatcgctattttttccgttttgactttgtcaatcgtcttgtgcattttccaattctctcgatggagaaaagtgtgatgtactaatttgcatggcgagagcatgtatattgcgacgagcacggaataaagatgcaacttgcttgtagccaaaaaaaaaaaaaaaaaaaa

SEQ ID NO: 6638 - protein, 164 aa, Panicum virgatum
  misc_feature: Ceres CLONE 1879148
  misc_feature: Great-hit functional homolog of the protein sequence given in SEQ ID NO 9685
  misc_feature: Useful for making plants with modulated cold sensitivity
  misc_feature: Useful for making plants with modulated salt sensitivity
MALADGNGAAIFGEEQEALVLKSWALMKKDSADLGLRFFLKIFEIAPSAKQMFSFLRDSDVPLEKNPKLKTHAMSVFVMTCEAAAQLRKAGKVTVRETTLKRLGATHFKYGVADGHFEVTRFALLETIKEALPADMWSLEMKNAWSEAYNQLVAAIKQEMKPAA

SEQ ID NO: 6639 - DNA, 630 bp, Panicum virgatum
  misc_feature: Ceres CLONE 1879302
  misc_feature: Encodes the peptide sequence at SEQ ID NO. 6640
agcccgatccccttttcctttcccccacaggcacagcaccgagcggcacgatggcgacggagctgacggcggcgcagctgcgggcgtacgacggcaccgacccctccaagccgatctacgtctccgtccgcggcaaggtctacgacgtcacctccggccgcagcttctacggccccggcggcgcctacgccatcttcgccggccgcgaggccagccgcgccctcggcaagatgtccaaggaagaggccgacgtctccggcgacctctccggcctcaccgacaaggagctcggcgtcctcgctgactgggagaccaagttccaggccaagtaccccgtcgtcgcccgcctcgtcgacgcctgaactcgaaatctcaagtcaaaaaccccccaatcagcggcgaccaccaccacctcggcaagtatcagtgtatttctgtatcctacctcttgcagccttgtgcttgcttgcttgctacattagctacaaaataatctcaagggaagaatgtatgttcctgctacataactccctgcatacactgtggtatctgtcaggatgtatgtgtttgtttgctgtgtaattgcatgaccaataatctgaatgaaagattggggttggttcaagtatt

SEQ ID NO: 6640 - protein, 103 aa, Panicum virgatum
  misc_feature: Ceres CLONE 1879302
  misc_feature: Great-hit functional homolog of the protein sequence encoded by LOCUS At2g24945
  misc_feature: Useful for making plants with modulated nitrogen use efficiency
MATELTAAQLRAYDGTDPSKPIYVSVRGKVYDVTSGRSFYGPGGAYAIFAGREASRALGKMSKEEADVSGDLSGLTDKELGVLADWETKFQAKYPVVARLVDA

SEQ ID NO: 6641 - DNA, 620 bp, Panicum virgatum
  misc_feature: Ceres CLONE 1879383
  misc_feature: Encodes the peptide sequence at SEQ ID NO. 6642
accaccccccagcgtccatctcatccccgtttgccgttgagaattcctttcacctcactcttgagcacgcggcggcggctcctcactctcgcgagcgagcacgggcgaaatggcgcgccacgcagggaagcccctcctcgcgctcctcgtgctgtccagcctcctcctcttcctcccgctcgtcgcctccgtccccttgccaagaagcctgcgcctggggaacccgcagcagcacccgccggctgtgaagcttgctgcttcttctcaggaggcggcgatggcggcgtggaacctcggcagcaggccggcggcgaggctggccgtggaggtgaacgactaccaaccgtccggccccaacaaccgccatgacccgcccaagggtcccggcagagcgtgaacagtggacccaataaccctccatcttcttcgccagtagtacaaaagtgcttgcttgcttgctagttcgatcctgtattctaaaatggtagcagaaacaaaatcacctactagtagttacagaaggggtctgggggtcgatcggtatctgtctatatgccgcgccgatcggctggctgttcttgagtttgttcatcagaactgccaaaaaaaaaaaaaaaaaa

SEQ ID NO: 6642 - protein, 95 aa, Panicum virgatum
  misc_feature: Ceres CLONE 1879383
  misc_feature: Great-hit functional homolog of the protein sequence given in SEQ ID NO 9364
  misc_feature: Useful for making plants with modulated flowering time
  misc_feature: The plant flowers significantly late compared to wild-type.
MARHAGKPLLALLVLSSLLLFLPLVASVPLPRSLRLGNPQQHPPAVKLAASSQEAAMAAWNLGSRPAARLAVEVNDYQPSGPNNRHDPPKGPGRA

SEQ ID NO: 6643 - DNA, 919 bp, Panicum virgatum
  misc_feature: Ceres CLONE 1879409
  misc_feature: Encodes the peptide sequence at SEQ ID NO. 6644
actctcccaccggccgcatccgtcgaaatccgcaagggcagcgaggcgaggccacgagagaggtgtagagaaaaaaaaaatgctgcgccacgccgcccgccgtctcgcctcccgcgccgccgtggcgcccaccgcccgccgggcgctcgccacggcggaggtgcccgcggaggccgccgaggactccacgttcgtggaggcgtggaagaaggtcgcccccaacctcgagccccccaagacgcccatctccctgatgaagccgcgcccgcccacgccggccaccatccccaccaaactcaccgtcaacttcgtcctcccctacaagtccgagatcgccaacaaggaggttgacatggtgatcgtaccagctacaactggtcagatgggtgttttgccaggccatgttgccacaattgctgagctcaagcctggtgttctctcggtacatgaggggaacgatgtgacaaagtactttgtgagcagtggatttgcgttcgtccatgcaaactccatagctgacattgtggctgttgaggcggtccctgtggatcagatcgacccagccttggtccagaagggtcttgctgatttcactgccaagcttgggtcggcctcaactgacttggagaaggctgaggctcagattggagtcgatgtccacagtgcgctcaatgctgcattgaccagttaattgatgacacttaagtttgcgtctgtcttttgcatctacatttttagaatgtgagttggaagtttgcaaactcatggacatgggatggagggaatgatcctaaataaattatactccatctaaaacatggactatagtttcttcgttttacttgaatcctgcatggatttctttttgtactggtgaatatttttcctttgagctcaagatctggtgctgctttcagtc

SEQ ID NO: 6644 - protein, 203 aa, Panicum virgatum
  misc_feature: Ceres CLONE 1879409
  misc_feature (1)..(71): Pfam Name: ATP-synt_DE_N Pfam Description: ATP synthase, Delta/Epsilon chain, beta-sandwich domain
  misc_feature (1)..(202): SWISSPROT Homolog: EC 3.6.3.14 ATP synthase delta' chain, mitochondrial precursor
MLRHAARRLASRAAVAPTARRALATAEVPAEAAEDSTFVEAWKKVAPNLEPPKTPISLMKPRPPTPATIPTKLTVNFVLPYKSEIANKEVDMVIVPATTGQMGVLPGHVATIAELKPGVLSVHEGNDVTKYFVSSGFAFVHANSIADIVAVEAVPVDQIDPALVQKGLADFTAKLGSASTDLEKAEAQIGVDVHSALNAALTS

SEQ ID NO: 6645 - DNA, 922 bp, Panicum virgatum
  misc_feature: Ceres CLONE 1879465
  misc_feature: Encodes the peptide sequence at SEQ ID NO. 6646
gcgtttacctgttcccagcgtgcaagcatcagatgtcccccttgccacaaaacctgaccgaataccgatggcagcggcccggtgctacacagctgctaccgcggtctcctctcccatagcaggagtggccggcctgtccttttccctccacacagccgccgccgccgccgcggcggcgcttccctcgtcgcgtccaagatcgagaggagcgtggacgtgcggaggagggcacggccacaggcgaaccgccgtccgcgccatgggctccgcaccgtcgtcgtcgtcgtcgtcgtccccgtcgccgcaaacgccgccaggacaagcccaagagaaagctaactataagtccctgagtgaagatgagtggaagaagcggctgactgaagagcagtattacgtgactcggcagaagggcacggagagagcattcactggtgaatactggaacactaaaacctccggcatttatcactgcatctgctgtgacacccctctatttgaatcatcgaccaagttcgacagtggtactggatggccctcctactataaaccgattggcgacaatgtcaagagcaagctcgatatgtcaatcatattcatgccccggactgaggtgctttgtgctgcctgtgatgcccatctggggcatgtctttgatgacgggccaccaccgacagggaagagatactgcatcaatagcgcgtctctcaaattgaagccactctcaaattgaagccacaataatcgctggatgctttaagatgaagtcaactgtaacttctacctgttcataacgggatgcttcgatgtatttaactttgttacatgtgcatgtaaagtactaagagtgattcaccaataagataaatgttaatatgttccattgtaaccttaattcattatatttgtgatctttctgatc

SEQ ID NO: 6646 - protein, 221 aa, Panicum virgatum
  misc_feature: Ceres CLONE 1879465
  misc_feature (96)..(220): SWISSPROT Homolog: EC 1.8.4.12 Peptide methionine sulfoxide reductase msrB
MAAARCYTAATAVSSPIAGVAGLSFSLHTAAAAAAAALPSSRPRSRGAWTCGGGHGHRRTAVRAMGSAPSSSSSSSPSPQTPPGQAQEKANYKSLSEDEWKKRLTEEQYYVTRQKGTERAFTGEYWNTKTSGIYHCICCDTPLFESSTKFDSGTGWPSYYKPIGDNVKSKLDMSIIFMPRTEVLCAACDAHLGHVFDDGPPPTGKRYCINSASLKLKPLSN

SEQ ID NO: 6647 - DNA, 846 bp, Panicum virgatum
  misc_feature: Ceres CLONE 1879543
  misc_feature: Encodes the peptide sequence at SEQ ID NO. 6648
atcccatttccagctcctcgcgtgttccttccgcccgcctgcttcccctccgggcccggcagcggcgggaggagccgagccgaggaggccgggcaggggatcgccctacatcgccgcccggcggatgtcggatcgggagctctgcccgctgcgctcgatcagaatcacaggggacggccgatgcctgtttaggtccgttgcttacggcgcatgcttgaggagaggaaagcagtcacccagcgacagcgcccagaaggaactggctgacgagcttcgagcgaaagtggctgatgagtttgtcaagagaagaggagacactgaatggttccttgaaggagatttcgagagctacgtgcgaaagatgagaaaaccgcatgcttgggggggagaacctgaactgctcatgtgctcccatgttctcaggatgcccatcacggtttacatgtatacaagtagctctgatagccccaggatcatagcagaatatggccaggaatatggcaaggacaatccagtccgtgttctctatgacggttatgggcactatgacgcacttcagccatctcttgtaagaacacaatcaagactgagaggtctgtagataaccggagattgcattacctgagcttcttctataggacagctgcataagtggcagcagctcaagattcaccgacgtggttttgcccagattgacaaacatatgcagtagcacacatatgaaattcagcctcaattggctgctctggcctttccttttcttcaaggattgatgtataaataaactcaagacgcagtaagaaaactaatggaatggccttataccaaaaaaaaaaaaaaaaaaaa

SEQ ID NO: 6648 - protein, 158 aa, Panicum virgatum
  misc_feature: Ceres CLONE 1879543
  misc_feature (2)..(127): Pfam Name: OTU Pfam Description: OTU-like cysteine protease
MSDRELCPLRSIRITGDGRCLFRSVAYGACLRRGKQSPSDSAQKELADELRAKVADEFVKRRGDTEWFLEGDFESYVRKMRKPHAWGGEPELLMCSHVLRMPITVYMYTSSSDSPRIIAEYGQEYGKDNPVRVLYDGYGHYDALQPSLVRTQSRLRGL

SEQ ID NO: 6649 - DNA, 883 bp, Panicum virgatum
  misc_feature: Ceres CLONE 1879623
  misc_feature: Encodes the peptide sequence at SEQ ID NO. 6650
gcaagcaccaccagcgcggacgtcgtggcgcgcatgtgggcggcctgtacatcccgcgtcccgtctccaccgccttcgtcgccgtcgccgtcggcctagatccagcacgcccccgagcttccattgccatagaggccgccacctttcccgcggacaaagcgtcggctgccgcgagttcctgcttgcggtggggaccacgatggctgcggaccgcgggctcctgctgctgctcctctcggccgccgcccttgccgcggtggcctccgccgctggccctttcttgtccgatggcgtgttccaggctagcgccggatctacgggcaggagcttgctgcaggccaagaagaattgcgccatgaactttgagtttcaaaactacacaatcatcacaagcaagtgcaaagggccaaaatttcctgctgaccaatgctgtggggccttcaaggaattcgcatgcccgttccgtgattacatcaacgacgacagtagcgactgttcatcagcaatgttcagctacatcaacctctatggcaagtaccccccaggactgtttgccaacatgtgccgtgagggcaaggaggggcttgcctgcacagatgcccagagcgccgtcgctgccaatggtagccaacgagcccaaagccgctcgcttgttttggttaccctcgtgtgtggattggtagcattgttgttccactgaatgatgatgccttcaatttcgccagagatggtgtttttgtaactgatgaggctcaagttcattctctgcgccttatggtgctaaaatagtaaaattgtgggtgggtctcagagtttcttccttttgtgtaaagtctttcttcatgtaatttatgacagattgcatattctatgggcttccacc

SEQ ID NO: 6650 - protein, 166 aa, Panicum virgatum
  misc_feature: Ceres CLONE 1879623
  misc_feature: Great-hit functional homolog of the protein sequence encoded by LOCUS At5g56170
  misc_feature: Useful for making plants with altered cell wall content and/or composition
MAADRGLLLLLLSAAALAAVASAAGPFLSDGVFQASAGSTGRSLLQAKKNCAMNFEFQNYTIITSKCKGPKFPADQCCGAFKEFACPFRDYINDDSSDCSSAMFSYINLYGKYPPGLFANMCREGKEGLACTDAQSAVAANGSQRAQSRSLVLVTLVCGLVALLFH

SEQ ID NO: 6651 - DNA, 955 bp, Panicum virgatum
  misc_feature: Ceres CLONE 1879901
  misc_feature: Encodes the peptide sequence at SEQ ID NO. 6652
gtttacgcattcggccatcgccggcgcgctcgctaatcagcgaaacagcgccgccgccccgcgctcctcgtcggccgcctgcgtcgatgtcggcggcggccggctcgtgcggcgccccctcgccgtctcccgcctccggcaccggcggcgggggcggggaaatcacgtacgtgagctacggcggggagcagcacctgccgctggtgatgtcgctggtggacgcggagctcagcgagccctactccatcttcacctaccgctatttcgtctacctctggccgcagctcaccttcctcgcgttcgatgccaaggagggagagtgcgtgggcacggtggtgtgcaagatgggggagcaccggggcgccttcaggggctacatcgccatgctcgtcgtcctcaagccctacagaggaaggggaatagcaactgaattggttactagatctattcaggtaatgatggaatctggctgtgaggaggtgacacttgaagccgaagttacaaataagggtgcccttgctctatatggacgcctggggtttatccgagcaaagaggctgtatagatactatctcaatggcgtcgatgcttttcgcctgaaactattgtttgcacgctctgatcctggcttgcctccgatggtgatcggcaacgaaggggatgaccagcagattgattccccatacttgtgacagtactcttttgagtaggtagaatgtcttgccctttttgcacttctgtttcgaagctttcacaactcaaatataactgtaaggatgttgtttgtgcttacaactctcacatatttctgcctctttgttaagaatgttgcaaagtttgtatttttaccatcatcgttgagcactgcagatctgcaattcgtttgctcagtgaatgtatgttgcagtgtcccaaaccactattgaatttaaatgtgaatattgatagtcttctc

SEQ ID NO: 6652 - protein, 201 aa, Panicum virgatum
  misc_feature: Ceres CLONE 1879901
  misc_feature (1)..(83): Pfam Name: Acetyltransf_1 Pfam Description: Acetyltransferase (GNAT) family
MSAAAGSCGAPSPSPASGTGGGGGEITYVSYGGEQHLPLVMSLVDAELSEPYSIFTYRYFVYLWPQLTFLAFDAKEGECVGTVVCKMGEHRGAFRGYIAMLVVLKPYRGRGIATELVTRSIQVMMESGCEEVTLEAEVTNKGALALYGRLGFIRAKRLYRYYLNGVDAFRLKLLFARSDPGLPPMVIGNEGDDQQIDSPYL

SEQ ID NO: 6653 - DNA, 687 bp, Panicum virgatum
  misc_feature: Ceres CLONE 1879904
  misc_feature: Encodes the peptide sequence at SEQ ID NO. 6654
  misc_feature (614)..(614): n is a, c, t, g, unknown, or other
  misc_feature (615)..(615): n is a, c, t, g, unknown, or other
acaactccaaatcaaccaaatctagagcctaagcctaacaaccacccaaagctatacaacttccttgagcacataattaaccatggcaaaggcacaggcaatgggtgcgctcctgaccatcttggtggtcctagccacatcggccgagatggcacacggcatctgcaacctctcaagcaatggcatccgggcctgccagccggcggccgccatccgcaacccgaccgatcagccctcggcggcgtgctgcgccgccctggccggggccgacctgccgtgcctgtgccggtacaagaacgccgccggcgtgtgggtgaggttctacagcatcgacatcaaccgcgccatggggctgcccggcaagtgcggcctcgccatgccggccaactgctgatcatgactggcgatcagatgtgcgtagcgtgctgtctacatcggagcatgcacgcacattgctagtagtaattccgtattatatagctacgagattgaataaatgaagcacttaaaagactgataatgtctgtgcttctctctccaggtgatgcactgcaacatttcaaatttgagctgcgaatgagctcatattaatcagtgcagaagaaagtgtcagnnctgtcttatgtaatatgtgtcttttgtaactgcaaattaaagttgggcttattaatatgaatacatattggc

SEQ ID NO: 6654 - protein, 103 aa, Panicum virgatum
  misc_feature: Ceres CLONE 1879904
  misc_feature (1)..(78): Pfam Name: Tryp_alpha_amyl Pfam Description: Protease inhibitor/seed storage/LTP family
MAKAQAMGALLTILVVLATSAEMAHGICNLSSNGIRACQPAAAIRNPTDQPSAACCAALAGADLPCLCRYKNAAGVWVRFYSIDINRAMGLPGKCGLAMPANC

SEQ ID NO: 6655 - DNA, 846 bp, Panicum virgatum
  misc_feature: Ceres CLONE 1880003
  misc_feature: Encodes the peptide sequence at SEQ ID NO. 6656
acacgaaacgatcgagcagcagctgcttcaggtaatcaagttttctccagcggcttcctccgttcatccgccgccggccggccatcagcaccagcgcgcagacatgaagatcgggtgcgacgcgtgcgggcgggcggaggcggcggtgctgtgctgcgccgacgaggccgcgctctgccgccgctgcgactccgccgtccactccgccaacaggctcgccggcaggcacagccgcgtcgcgctgctcccgtccaccgccatcgtcgacggcagcggcagccacccaacctgtgacatctgccaggagaagacgggctacttcttctgcctggaggaccgcgccctgctgtgtcggccctgcgacgtcgccgtccacgccgccggcgcccacgtcgcgtcccaccggcgcttcctcatcaccggcgtccgcgtcggcggcggcgtcgtcgccgtgagcccaagcaccagcagcggcaacgggagcagcagcgctcccagcagctccggcaacccgacgaccatgcccgacaaggcgcggccatcgacgtcggccagcgcggcggcggcgacagagggccttggcgatcagcagtggccgtggagtgatttcttggcggacgacgttggcgtcgggatggaccatctccatccggacctgtgctgccctgccgagatctccgaacctggctcctccagcctgacgggatgacatgtatgctcactgttcagagatcactaagctgataataatccatggcatcaactgacccaacaaataaattgttagctttagcgtcctgtggaccaggtacttgaaacaacagattaacagagcatcgggcaatc

SEQ ID NO: 6656 - protein, 201 aa, Panicum virgatum
  misc_feature: Ceres CLONE 1880003
  misc_feature (3)..(48): Pfam Name: zf-B_box Pfam Description: B-box zinc finger
MKIGCDACGRAEAAVLCCADEAALCRRCDSAVHSANRLAGRHSRVALLPSTAIVDGSGSHPTCDICQEKTGYFFCLEDRALLCRPCDVAVHAAGAHVASHRRFLITGVRVGGGVVAVSPSTSSGNGSSSAPSSSGNPTTMPDKARPSTSASAAAATEGLGDQQWPWSDFLADDVGVGMDHLHPDLCCPAEISEPGSSSLTG

SEQ ID NO: 6657 - DNA, 591 bp, Panicum virgatum
  misc_feature: Ceres CLONE 1880266
  misc_feature: Encodes the peptide sequence at SEQ ID NO. 6658
cccttccccgccgccacgcttgagagaggaagagcgcgcgcggagagcggaagcccgggacaaggcggcggccggcggcaagatggtgcagcggctcacctaccggaagcggcacagctacgccaccaagtccaaccagacccgcgtcgtcaagacccctggtgggaggcttgtgtaccagtacaccaagaagcgcgcgagtgggccgaagtgccccgtcaccgggaagaagatccaaggaattcctcacctcagacctgctgagtacaagaggtccaggttgtcaaggaacaggaggactgtgaatcgtccatatggtggtgttctgtctggtaccgcagttagggagaggatcattcgggcatttttggtcgaggagcaaaagatcgtaaagaaggtgttgaagatccaaaagaccaaggacaaggcctccaagagctagatataattgcaataggcattttgccaccatgtttaattctctcgaatttgtttcagtatgaaattttctggtgggtctgagaatcttgctagatcgatgtgagtgattgaattttcggcgctgttgcgcaaaaaaaaaaaaaaaaaaaa

SEQ ID NO: 6658 - protein, 119 aa, Panicum virgatum
  misc_feature: Ceres CLONE 1880266
  misc_feature: Great-hit functional homolog of the protein sequence given in SEQ ID NO 9667
  misc_feature: Useful for making plants with modulated nitrogen use efficiency
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKASKS

SEQ ID NO: 6659 - DNA, 585 bp, Panicum virgatum
  misc_feature: Ceres CLONE 1880353
  misc_feature: Encodes the peptide sequence at SEQ ID NO. 6660
atccagaaatcactaacgccgaggcccgactggatctgccgccgttcagggtgctccccgtcgtcggaggcaatggcgagtcccaacaccgacatccccatcagggctgaacaagattctgatggctcggcccaaagcactgcagatatgactgcttttgtgcaaaatcttctgatgcagatgcaaaccaggttccaagctatgtcggagaacatcattacaaagatagatgagatgggtatgagaatagatgaattggagcagagcatcaatgacctcaaggctgagattggcagcgacgggatgacaacaccgtgtaagacaaaacatgaaggttcaaaacatgcagacagttctgcatgaacgcaggacagcagaagcagctgatagcatcatgattcgtatcatacaccagtgctgtattggtatcttaggcattcgtgactaacaaatacctgttatgaggtctcatatgagagaacgttgttactgatgtgatacttctgatgctttgtcggtttgctatgatttttctgtaaactgtatccatcttcgttctgtgtggaaaaaaaaaaaaaaaaaaaa

SEQ ID NO: 6660 - protein, 96 aa, Panicum virgatum
  misc_feature: Ceres CLONE 1880353
  misc_feature (1)..(54): Pfam Name: HSBP1 Pfam Description: Heat shock factor binding protein 1
MASPNTDIPIRAEQDSDGSAQSTADMTAFVQNLLMQMQTRFQAMSENIITKIDEMGMRIDELEQSINDLKAEIGSDGMTTPCKTKHEGSKHADSSA

SEQ ID NO: 6661 - DNA, 889 bp, Panicum virgatum
  misc_feature: Ceres CLONE 1880494
  misc_feature: Encodes the peptide sequence at SEQ ID NO. 6662
atccatccccagcagcagcaaccatctcatcagcttctctctcgagctctagctactagcctgcagctagctagtagctgttgttgatcgtggacgcaagtagccgtccagcagctaggccaggtagcccactagctgatcaaggagggaactagatagtagaaggagaggaagatgtctggcgtgtgggtattcaagaacggggtggtgcggctggtggagaacggcgcggcgggcggcggcgaggcggcgcggaagcggaaggcgctggtgcacacgccgagcgggcaggtggtgaggtcgtacgcggagctggaggcggagctgcgggcgctggggtgggagcgctactacgaggacccggcgctgtaccagttccacaagcggggagccctcgacctcatctccctccccgccgacttcgccaggttctcctccgtccacatgtacgacatcgtcgtcaagaaccgcgactccttcagggtcgtcgacatctgaatcctcatctctagttcgtccgccattgatgctgctgccgagcgatcgagcttcgcatatattgttgttcgttctctgatcgatcgacgatccatatgcacgtgcatggccatctgatcgatctaggtatccatgcagctgcttgttaattattagttgtgactttgtgacttgtgaggagggccgccgcagccttcatcagctagtgtgacagccgttctcgatcgtcgttttgcttaatttctcgatgcagtgtgtgtgagtgtccgtcagagtgtgtgagactgatgaatcagtagcgtccatggttgctggtgtttcctgatgtaatctgctttctcatgtgactgtaaatttatcgtttgtgccagaaaaaaaaaaaaaaaaaaaa

SEQ ID NO: 6662 - protein, 107 aa, Panicum virgatum
  misc_feature: Ceres CLONE 1880494
  misc_feature: Great-hit functional homolog of the protein sequence given in SEQ ID NO 9508
  misc_feature: Useful for making plants with modulated flowering time
MSGVWVFKNGVVRLVENGAAGGGEAARKRKALVHTPSGQVVRSYAELEAELRALGWERYYEDPALYQFHKRGALDLISLPADFARFSSVHMYDIVVKNRDSFRVVDI

SEQ ID NO: 6663 - DNA, 875 bp, Panicum virgatum
  misc_feature: Ceres CLONE 1880516
  misc_feature: Encodes the peptide sequence at SEQ ID NO. 6664
ggccggccacactcactcccctccaattcgatcctcccatccatccacccccacgcccagctcacctcctacgatcaattgctgatgggtttccccgttgggtactcggagatgcccaggctggtgcttcacctcctcttcctgctcggccacctgcgccgcctctcctcctgcctgctccgcctcaccggctacgtcgacgacgccgacgccgacgccgacgccgaccactaccactaccaccctgcagctgcagatgtcttccgcctcgacgagcactcccccgcggtgcgcttcgactctctcccgccggcggccggcgcgggcagtgacggcggctgctgcgtctgcctcgccgacttccacgccgccgcctccgtgcgccgcgcgcggggctgccgccacgtcttccaccgcgcctgcctcgaccgttgggcccaccacggccaccgaacctgcccgctctgccggacgccgctcctgccgccgccgcctctgctcctcccgctgcctctgcctccgtcgtagcaaacggagagcctccttcttcttgttggggtcttctctgcaagaataacatcccttttcgacctgcctagtttttgcgtgattttgagcaggctcagggactcagggggatcaaagacgacaaacagcggccctcctgcaagccaaggccaaaagaaaaaaagagagagagagagaggaatacttactgtacttagatgctgatagcagagtgacagacagatagatttatttaggacgtacgttagggcaatctgtatgtatttgtattggattgtgggaggactgagcaatttaatttgctgacaggttttgtttgctctcctcaaaaaaaaaaaaaaaaaaaa

SEQ ID NO: 6664 - protein, 147 aa, Panicum virgatum
  misc_feature: Ceres CLONE 1880516
  misc_feature (1)..(43): Pfam Name: zf-C3HC4 Pfam Description: Zinc finger, C3HC4 type (RING finger)
MGFPVGYSEMPRLVLHLLFLLGHLRRLSSCLLRLTGYVDDADADADADHYHYHPAAADVFRLDEHSPAVRFDSLPPAAGAGSDGGCCVCLADFHAAASVRRARGCRHVFHRACLDRWAHHGHRTCPLCRTPLLPPPPLLLPLPLPPS

SEQ ID NO: 6665 - DNA, 866 bp, Panicum virgatum
  misc_feature: Ceres CLONE 1880575
  misc_feature: Encodes the peptide sequence at SEQ ID NO. 6666
tggtatgctctgtttccttgcagttacctgaatagatatgatattgttcaaatgaagtctggtgatggttaccccaccctatagggtgctattgctatgtaccagtttgttttttgcacattgcatagtctttttccaccgtttttgtatgatgtaatatggcctatgtcacaagaatttctggtctgtctctttttacctcacatgtttgcaggactaaagattggtgttttgacctttaatcagtcgtgctatgcctcatataaaaacttttactcgctacgatggtcaaaatattgcatggtttctgcttacctcatcaaatttaagcaaagctgcttggggtgcactgcagaagaacaacacacagctaatgatacgctcgtatgagttaggtgtgttgttcttgccccaaaccctcaagtccataccacaattttcgtgcacggagaagaaccgcccaagccaggatggcctcacccttggcaagacgatcaagaccaagctggtcacgctttgctggaaaggcgacgaggaaacggaaccatctacgaaaaccgtcagattgcctgtgccatatcaactccctccacaaccttacggcccagaagatgtcccttggtcatgggatcggaggtacacaaagaaggatgtgtatggttcagtctggcctcgtcatggctagctactgtctgtgcgaggtagtgacggttcccaaaccctgttccatggttaacgtcggtatagcggtgtagccagtgattcactggcccctggattattggtcaaatatgagtcgaaccgttcttgtttagagccggcccgattcctcagcttctcatctataatcttaatacaatagtgtc

SEQ ID NO: 6666 - protein, 143 aa, Panicum virgatum
  misc_feature: Ceres CLONE 1880575
  misc_feature (327)..(443): Pfam Name: Tyr-DNA_phospho Pfam Description: Tyrosyl-DNA phosphodiesterase
MPHIKTFTRYDGQNIAWFLLTSSNLSKAAWGALQKNNTQLMIRSYELGVLFLPQTLKSIPQFSCTEKNRPSQDGLTLGKTIKTKLVTLCWKGDEETEPSTKTVRLPVPYQLPPQPYGPEDVPWSWDRRYTKKDVYGSVWPRHG

SEQ ID NO: 6667 - DNA, 918 bp, Panicum virgatum
  misc_feature: Ceres CLONE 1880614
  misc_feature: Encodes the peptide sequence at SEQ ID NO. 6668
actctgaccgctagctttctttcttccccaacaatcttcgggaggcttcttccctccgccgccatgcccgccgcccgcctgctcccgctgctcagacgccgcctcgccaccacgatctccgacgcgcacgctccctcctcccgagacgagttgagtgctgaactgagaggtcgtgtcgtcgcaggattttcgtttcctccaaccacatctgtggggctaagatccctcctgacagttaccgaagcaagcaccaatgcatccgacaacaatcctttggaccaagagcaagacagctccaaaactgacacccctccagcttcagcccctgcaccggagcccagcttcaaggtcagagatacctccaacctgaagatctcgcccaggcatgaccttgccatggtcttcacatgcaaggtctgcgagacaaggtcaatgaagatggccagccgggattcgtacgagaatggagttgtggttgcacgctgtggtggctgcaacaacctccaccttatagcagataggctaggctggtttggggagccagggagcattgaggacttcctagcagggaaaggagaggaggtgaagaaaggttcaacagatactctcaacttctctctcgacgacttggttgggtctcaggtcagttcaaaggggccttctgaacaaaattaggcttcttcctgatatggcggtagcttttcgaccagcaagtacctgtagaggcaacattagtattagggaagtcccacaaattttgttcaacttcatggcttctcatgtgtatctctcaagcccatcgagtgcatgtcattgtgatctattgcagtgtagctgttttactgaaaactcatccatgggttttaagcccacataaatgactggtgaatttcttgtgaaaaaaaaaaaaaaaaaaaa

SEQ ID NO: 6668 - protein, 203 aa, Panicum virgatum
  misc_feature: Ceres CLONE 1880614
  misc_feature (1)..(65): Pfam Name: zf-DNL Pfam Description: DNL zinc finger
MPAARLLPLLRRRLATTISDAHAPSSRDELSAELRGRVVAGFSFPPTTSVGLRSLLTVTEASTNASDNNPLDQEQDSSKTDTPPASAPAPEPSFKVRDTSNLKISPRHDLAMVFTCKVCETRSMKMASRDSYENGVVVARCGGCNNLHLIADRLGWFGEPGSIEDFLAGKGEEVKKGSTDTLNFSLDDLVGSQVSSKGPSEQN

SEQ ID NO: 6669 - DNA, 583 bp, Panicum virgatum
  misc_feature: Ceres CLONE 1880654
  misc_feature: Encodes the peptide sequence at SEQ ID NO. 6670
agctgccgaccaccgagtccaacgagaagacgcgatccaacaaccacgccgatcgagagcgatctcgatcgatcgccggacagacgccgccgcacgcccgcagctcggtccgtccagccatggtgtggaagaggaagagcggcggcggcggggacgaggaggagagggtgcccaggggccacgtccccatggtggtggccggcggaggcgagcgcgtgctggtgccggtgcggctgctcagcgacccgcgcgtcgcggagctgctggacatggcggcgcagcggtacgggtacggccagccgggcgtgctgcgggtgccctgcgacgcggggcggttccgccaggtcgtcgacggcgccatgcagagactagtagagctgcatggccacgagatgtgaggacgcgccccccatgtgtgcggcgacagtgcttgtagtcttgtactcctaccagatgattgattagcttaatctgtgataggatagatcgaccatatttcctagatgtagggagcttaccaatgaatgatgattcttattagctgatattctccgttgttgaataaacggtgcaaattaggtgc

SEQ ID NO: 6670 - protein, 92 aa, Panicum virgatum
  misc_feature: Ceres CLONE 1880654
  misc_feature (1)..(95): Pfam Name: Auxin_inducible Pfam Description: Auxin responsive protein
MVWKRKSGGGGDEEERVPRGHVPMVVAGGGERVLVPVRLLSDPRVAELLDMAAQRYGYGQPGVLRVPCDAGRFRQVVDGAMQRLVELHGHEM

SEQ ID NO: 6671 - DNA, 579 bp, Panicum virgatum
  misc_feature: Ceres CLONE 1880853
  misc_feature: Encodes the peptide sequence at SEQ ID NO. 6672
aactcggcttttacatttctgcccttttctctctccgtcccggcggcgttgccgttgctctgcgccgctctcctgtctccccaccagtagccgctgcgagagtagagtagcagaccccgccgccgcggccatgttctcctggatcctccgcggctgccgcgacgagtgctccgcctccgatcagctcaagcaggctcgtgatgtcttcatggcaaaagaggcagtcttgcaaaagaagatttctcaagagatggaaagggccaaggagttcacaaagtcaggaaacaaacaagcagcaatgcagtgcttgaagaggaaaaagtactatgagagccaaatgagccaggttggaagtgtccagttacgcattaataccaaggagaaaatgatcgctgatcacatgggaaacaaataacacaaagtgagatcgcggctcttgaactaatgtctcaactcacctttgttttgttcagatacgtagtcttcaaatcttgtgaaaagtcaattgttgctgttctctgccacactgacaccaagcttaacattaatgtgcccttaacataagatggtacatttcag

SEQ ID NO: 6672 - protein, 94 aa, Panicum virgatum
  misc_feature: Ceres CLONE 1880853
  misc_feature: Great-hit functional homolog of the protein sequence given in SEQ ID NO 9393
  misc_feature: Useful for making plants with modulated nitrogen use efficiency
MFSWILRGCRDECSASDQLKQARDVFMAKEAVLQKKISQEMERAKEFTKSGNKQAAMQCLKRKKYYESQMSQVGSVQLRINTKEKMIADHMGNK

SEQ ID NO: 6673 - DNA, 514 bp, Panicum virgatum
  misc_feature: Ceres CLONE 1880880
  misc_feature: Encodes the peptide sequence at SEQ ID NO. 6674
agcaacgaagtactcgagatagattcagagagtgcagggcagttgattccaggccaagaatcattccactttgcttgctgacagcctactacctagtaggatccgtggatccatggaggtggccggaggagatgtcggcgcgccgtccccgccgcggcgcgtggtggtggcggtggacgagagcgaggagagcatgcacgcgctctcctggtgcctctccaacgtcgtctccgccgccagggccgccgcggcaccaggcggcgccgcggatcgatctaggcggctctagaggccgtagccgtaagcgcacacgagcacgactcgcctcgcctcggccaaacgtgacggtgggcgcccgtgtgtacatacttcgcttttgttcggtgcctgtatctccctgagtataatgttttcagttcacacaaaatattgtaacgtgtcatgtaatggacgtgtgtacattctatatatatatagtcgtttcgaatatgcagtctaagttaagaagggacat

SEQ ID NO: 6674 - protein, 58 aa, Panicum virgatum
  misc_feature: Ceres CLONE 1880880
  misc_feature (2)..(29): Pfam Name: Usp Pfam Description: Universal stress protein family
MEVAGGDVGAPSPPRRVVVAVDESEESMHALSWCLSNVVSAARAAAAPGGAADRSRRL

SEQ ID NO: 6675 - DNA, 879 bp, Panicum virgatum
  misc_feature: Ceres CLONE 1880948
  misc_feature: Encodes the peptide sequence at SEQ ID NO. 6676
agagcaccaagctcactcatctaaccaagccacagcttgacagcgctagctaccgagcctctaccattcacaagcattagcaaaaagaagagagcaacacgagcaagatgtaccacaatcatttccatggcgaggtggccagcctccgcttcctctccccaccgagcgcttccttcgcgcaccaccacatgaacatggccttgccgcctcaggcctacttcccgccgtccttcgagccggcctcggctttccatgacgacgccgctgcttctctgctctccgtcgacggcggcgacgtgcccagttttgaggtcgacaccgttgtccgggaagcggcggctcacctcgccggccgcaatggcgcctcgcccagctcgggctcgggctcagacggcggcgccgcgggcagcggctaccagatgaacgcggtggcggtggcggccgaggaggagcgccggcgccgccggatggtgtcgaaccgggagtcggctcggcggtcgcgcatgcgcaagcagcggcagctcaccgagctgtgggcgcgggtctcgcacctccgcggcgccaaccgccgcctcctcgacgatctcaaccgcgcgctgaggggctgcgccgacgcccgccgcgagagcgcgcggctcagggacgagaaagccgagctggccaagaagctcgagcacctgctgcagtcggccacggccacggagaagggcgcctcctccgccgccgccgccgcctctagcgatcgcagctgctcatcggagccaggcaacaccaccgccagcgccgatacctctgaatgacccgactacattatcccacccaatttttacttgaggataatataattggagtatatattaaaaaaaaaaaaaaaaaaaa

SEQ ID NO: 6676 - protein, 230 aa, Panicum virgatum
  misc_feature: Ceres CLONE 1880948
  misc_feature (3)..(51): Pfam Name: bZIP_2 Pfam Description: Basic region leucine zipper
  misc_feature (1)..(65): Pfam Name: bZIP_1 Pfam Description: bZIP transcription factor
  misc_feature: The sequence is a functional homolog of  SEQ ID NO 1226 in the  10/412,699 US patent application
  misc_feature: The sequence is a functional homolog of  SEQ ID NO 1342 in the  10/374,780 US patent application
  misc_feature: The sequence is a functional homolog of  SEQ ID NO 1343 in the  10/374,780 US patent application
  misc_feature: The sequence is a functional homolog of  SEQ ID NO 923 in the  10/374,780 US patent application
  misc_feature: Useful for making plants with modulated growth and phenotype characteristics
MYHNHFHGEVASLRFLSPPSASFAHHHMNMALPPQAYFPPSFEPASAFHDDAAASLLSVDGGDVPSFEVDTVVREAAAHLAGRNGASPSSGSGSDGGAAGSGYQMNAVAVAAEEERRRRRMVSNRESARRSRMRKQRQLTELWARVSHLRGANRRLLDDLNRALRGCADARRESARLRDEKAELAKKLEHLLQSATATEKGASSAAAAASSDRSCSSEPGNTTASADTSE

SEQ ID NO: 6677 - DNA, 883 bp, Panicum virgatum
  misc_feature: Ceres CLONE 1881049
  misc_feature: Encodes the peptide sequence at SEQ ID NO. 6678
aaacccggcccctgcgcccgcgcccgcgccgccgccgccgacgacgacaacatctcatcgttcttcttgggcgcctcatcggtagcatcctcgatctaccccgtcgtatacaagggtgcaggtgcttctccaaatctccagagcttagtctgctcgtcccccccgcttgatctgtgggaacccatccgtacgactgtaccaccatttttttttctggttgttggacacttggatatgggaacatacagccatctctggtcaatttccaagaggaatgtaatggcagttttacttggcatcaccatttccgaacgttttgtgactttcgtctctgtgaccggtgaatcgatgcatcctacgttcacagcagcaaacaatgtcttgcagggtgatttcgttttagcagaaaggagatgccttgagaagtacgagttctcacatggtgatgtggttttgttcaagtgccctagcaatcataaggagttgtttgtgaagagattgattgcgcttcctggtgagtgggtacagctccctgggtcccttaaggttactgagatcccagatgggcattgctgggttgaaggtgataacgctgctcgtagttgggattctagagcatttggccctattcccttaggtctagttgaggggagggtgacccacatcatttggccgccctcgaagattagccaagtggagagaaagatgcctgaaggaagaattttgcctgtttgatttgactctactatattgggtgaaaatccatttataacataaacctgctttattaccatttattatgtgatagaagaagtgtagattgaaatgtgaagcttacaaggtttgacaaaagttttgtctacaaaaaaaaaaaaaaaaaaaa

SEQ ID NO: 6678 - protein, 166 aa, Panicum virgatum
  misc_feature: Ceres CLONE 1881049
  misc_feature (1)..(43): Pfam Name: Peptidase_S24 Pfam Description: Peptidase S24-like
MGTYSHLWSISKRNVMAVLLGITISERFVTFVSVTGESMHPTFTAANNVLQGDFVLAERRCLEKYEFSHGDVVLFKCPSNHKELFVKRLIALPGEWVQLPGSLKVTEIPDGHCWVEGDNAARSWDSRAFGPIPLGLVEGRVTHIIWPPSKISQVERKMPEGRILPV

SEQ ID NO: 6679 - DNA, 949 bp, Panicum virgatum
  misc_feature: Ceres CLONE 1881050
  misc_feature: Encodes the peptide sequence at SEQ ID NO. 6680
atcacagcatcacaacaagaactagctcacatcctctcactaatacattgagatcgcagctgagaatctgacatggtttccaagaaaaccatgtcctccctcgtggcgctgctgctcgcatgcagttccatgagcagcgcggctcggtacctggaggagacgaagcccgagtacccgccgcaccccgccgtgccggagatccccaagccagagtacccgccgcaccccaccgtgccggagatccccaagcccgagctgcctccgcaccccaccgtgccggagatcccaaagcccgagctgcctccgcaccccaccgtgccggagatccccaagcctgagctgccaccacaccccaccgagccagagcaccccaagccggagctgccgccacacccaaccctgccggagctgcccaagcctgagctgccaccgcaccccaccgtgccggggcaccctgtgccagagctgccacagcccgccgtgccggaggtgcctcaccccgtgcctgaagtgccaaagcccgagctgccccaccctgccgtgccggaggtgccgaagcccgagctgccgcctcaccccgaggtaccggagctgccgaagaagccggaagctcctcacgtgccggaggtgccgaagcatgagcttccgcccctgcccgaacccgagctgccgaagccggagagccactacccggtgccagaggccaagccatgatcgaatgaatgaactgcacatgcgcccgtgttgctccagctagtaaaaacgcgttctgtttctgtacttggtgtgcatacatacgatggagtagtataggagcgtgacgttcagtgttgtacgttgtgcttgctgctttgatttatccgttgatgtcctacctgtatatgtatattgccttcggcgtatcatcatatatatacacgaataatttcaaaaaaaaaaaaaaaaaaaa

SEQ ID NO: 6680 - protein, 213 aa, Panicum virgatum
  misc_feature: Ceres CLONE 1881050
  misc_feature (60)..(118): Pfam Name: Trypan_PARP Pfam Description: Procyclic acidic repetitive protein (PARP)
MVSKKTMSSLVALLLACSSMSSAARYLEETKPEYPPHPAVPEIPKPEYPPHPTVPEIPKPELPPHPTVPEIPKPELPPHPTVPEIPKPELPPHPTEPEHPKPELPPHPTLPELPKPELPPHPTVPGHPVPELPQPAVPEVPHPVPEVPKPELPHPAVPEVPKPELPPHPEVPELPKKPEAPHVPEVPKHELPPLPEPELPKPESHYPVPEAKP

SEQ ID NO: 6681 - DNA, 870 bp, Panicum virgatum
  misc_feature: Ceres CLONE 1881106
  misc_feature: Encodes the peptide sequence at SEQ ID NO. 6682
accgcccagcacaaccagatcgaagcttttttggttgcctcgactcatccatcacacgcacacacaccacctgcgaacaagaagccagaagatgaagcatccgagggaccagcagcatcaggaggaggtgtcgctggcgctgtcgctgagcaccacgacgacggactcgtccaccacctccgactcgtccgccacggcgcccccggcggcggcggccaagcgcgcgcggaggcggaggggcccggtggtggccacctccggggagggcgacttcgtctgcaagacctgcagccgcgccttcacctccttccaggcgctgggagggcaccggaccagccacctgcggggccgccacgggctcgagctcggcgtcggcgccaaggcgctcaggcagcacaaggcggcggccggcggcggcgacaagcggcggcagcagcagcagcagcaccagacccacgattgccacatctgcgggctcggcttcgagttgggccaggcgctcggcggccacatgaggaggcaccgcgaggagatgggcgccgccgaggccgccgacgcttgggtctggcgcagcgtcgcacgcctcccggaggagctcgaggtccagagcgccgccgccgacccgcccgtcttgctcgagctgttcgcctagatcatcctccgttccgtccatcggattagccgcccctgatttcggccgggctgacgcgcgtaggccatgtaaatgatattgtttatttggtctcccattaattagatccttttaggaattgagatcgttctctcttaatttgtaactacagtatgctaggagttttgcattggttcgttgctgattagtggttccatcaaaaaaaaaaaaaaaaaaaa

SEQ ID NO: 6682 - protein, 186 aa, Panicum virgatum
  misc_feature: Ceres CLONE 1881106
  misc_feature (1)..(23): Pfam Name: zf-C2H2 Pfam Description: Zinc finger, C2H2 type
  misc_feature: The sequence is a functional homolog of  SEQ ID NO 1288 in the  10/666,642 US patent application
  misc_feature: The sequence is a functional homolog of  SEQ ID NO 1290 in the  10/666,642 US patent application
  misc_feature: The sequence is a functional homolog of  SEQ ID NO 622 in the  10/374,780 US patent application
  misc_feature: The sequence is a functional homolog of  SEQ ID NO 624 in the  10/374,780 US patent application
  misc_feature: Useful for making plants with modulated growth and phenotype characteristics
MKHPRDQQHQEEVSLALSLSTTTTDSSTTSDSSATAPPAAAAKRARRRRGPVVATSGEGDFVCKTCSRAFTSFQALGGHRTSHLRGRHGLELGVGAKALRQHKAAAGGGDKRRQQQQQHQTHDCHICGLGFELGQALGGHMRRHREEMGAAEAADAWVWRSVARLPEELEVQSAAADPPVLLELFA

SEQ ID NO: 6683 - DNA, 1075 bp, Panicum virgatum
  misc_feature: Ceres CLONE 1881206
  misc_feature: Encodes the peptide sequence at SEQ ID NO. 6684
atcacttggcaagtgcgagaagctttcctagcgccggccggcgatatcgatggggatggcgaccagggccagcaacagttgcctcctcctccctctcgcgcttgccatcgtcgtggcggcgggaagtacggcggctgctccggccactgcagccccaccggcatcgccgccgttccggacggtgtacgcgttcggcgactcgttcacggacacggggaacacgcactcgaccacgggtccctactcgttcggctacgtgtccagcccgccctacggcgccaccttcttccaccgctccaccaaccgctactccgacggccgcctcgtcgtcgacttcctggcggaggcgctcaagctgccctccttcctcccgccctacctctctgtctcttccaccgccgcctccaacacctcggcggcggaccaagcagaagaagttggcgtcaacttcgcggtggccggtgccacggccatcgagcacgacttcttcgccaggaacaacctcagcttcgacatcacgccgcagtccatcatgacgcagctggggtggttcgacgcgcacctccgcgccgccgccggcaacggcaagggcagcaagaccaacaacaaggtcggcgacgcgctcttctgggtgggcgagatcggcgccaacgactacgcctacaccgtcgtcgcccgcgacaccatcccgcccaagatcgtccgcgacatggccgtccagaggctcaccaccttcgtcgccggcatgttcttccagggcggggacgcctactgccgcccgtcattcagcgatcttcttgccaggaaagcccagggcaagccgtgaccgccggcttcccatcgatcagctagctgacaccaagagaataatctttatttatcagtgcagcttgctagatgctagctagggtcagcagaattgcaattcagttgtgacaaaatgcatgccatttcgatcttgaacaattgccatttctcaggcacaattgaagctgtgatgatgaactgaaaggatttctaataacgagtatgcaatgcgcttgacgtgttctgcgaaaaaaaaaaaaaaaaaaaa

SEQ ID NO: 6684 - protein, 258 aa, Panicum virgatum
  misc_feature: Ceres CLONE 1881206
  misc_feature (1)..(177): Pfam Name: Lipase_GDSL Pfam Description: GDSL-like Lipase/Acylhydrolase
MGMATRASNSCLLLPLALAIVVAAGSTAAAPATAAPPASPPFRTVYAFGDSFTDTGNTHSTTGPYSFGYVSSPPYGATFFHRSTNRYSDGRLVVDFLAEALKLPSFLPPYLSVSSTAASNTSAADQAEEVGVNFAVAGATAIEHDFFARNNLSFDITPQSIMTQLGWFDAHLRAAAGNGKGSKTNNKVGDALFWVGEIGANDYAYTVVARDTIPPKIVRDMAVQRLTTFVAGMFFQGGDAYCRPSFSDLLARKAQGKP

SEQ ID NO: 6685 - DNA, 695 bp, Panicum virgatum
  misc_feature: Ceres CLONE 1881210
  misc_feature: Encodes the peptide sequence at SEQ ID NO. 6686
acaactcacatctcgaccagtcggagttcatccccgagcagacctcgcaagtcgcacaacttcttctcctcctgctccagatctcaggcgaaagcttgtccaccatccaccgccacagcatcccaatggctcgcttcgccatcgtcgccgccatcgtcgcgctcctcgccgtcaccgtggccgcgcaggccccggccgcgacgcccaccccggcgcccaggatggccccgctgccgcctcctccggcgcggtacccggccaccgccccggccccggccccggccgcgaagccgcccaccgcctcggcgccgtccccgctgtcctctcccccggccccgcccgccgagggcccctccgcgatgaccccgaccacctccgtctccgccgcccccgccggcgcccccaccgccacgcccaccgggaacggcgccgcctcctccgccgtcagcttcgtcgccgtcgccgccgcggtcgccgccgccgtcgtgttctagatggggacgcgttgtgacgacgggatctcgagctgtttatactgccatattctttttttgcgattcttttttactgtattagatactgatgatgagagagcagaggagaggacatttgagggggattcacccagtgctgctagttacacatcatgcatgattcatgatgatatgattattaatggaattctttcatttgtt

SEQ ID NO: 6686 - protein, 122 aa, Panicum virgatum
  misc_feature: Ceres CLONE 1881210
  misc_feature: Great-hit functional homolog of the protein sequence encoded by LOCUS At1g35230
  misc_feature: Useful for making plants with altered cell wall content and/or composition
MARFAIVAAIVALLAVTVAAQAPAATPTPAPRMAPLPPPPARYPATAPAPAPAAKPPTASAPSPLSSPPAPPAEGPSAMTPTTSVSAAPAGAPTATPTGNGAASSAVSFVAVAAAVAAAVVF

SEQ ID NO: 6687 - DNA, 806 bp, Panicum virgatum
  misc_feature: Ceres CLONE 1881465
  misc_feature: Encodes the peptide sequence at SEQ ID NO. 6688
gagacacccggagagggagagggagaggggcatcagggcaggcatggcggcggcgtcgccgatgtgggtgttcgggtacggctcgcttatctggaaccccggcttcgcctacgacgcccgcgtcgttggcttcgtcccggactaccgccgcgtcttctaccaggggagcacggaccacaggggcacgccgcagttccccgggaggaccgtcacgctcgagcaccatcccggagcgacttgctggggaattgcctacaaaataagggaggaggataagcagacagctttggagtatctagaagtcagagagaagcaatatgatgagaagattcaccttgatttgtatccagactcatcacccaaagtaccagcagtagaaaatgtaacggcatacttagccacaacgaataaggagagcaacaaaaactatcttggtcctgcgcctctagaagaaatggccaggcaaatttaccttgctgaaggcccatctggacctaacaaagagtatgtgttcaaacttgaggatgccttaaataaactaggagttgtagacccacatgtccaggaactggcgaatgctgtgcgtgagtattcagatgccaagttgtccaagtaaaaaaaaaacacatttcccccttctttgagggtaaagatttcagaagaaagtcaaaattcattcatgctcaaacatcactatgttcttgtaagctgcttgttatgtggctaccttgtgacttgttattcctgtgacagcctgcccgtccatgaaaactaaattttctagctaaaaaaaaaaaaaaaaaaaa

SEQ ID NO: 6688 - protein, 190 aa, Panicum virgatum
  misc_feature: Ceres CLONE 1881465
  misc_feature: Great-hit functional homolog of the protein sequence given in SEQ ID NO 9670
  misc_feature: Useful for making plants with modulated nitrogen use efficiency
MAAASPMWVFGYGSLIWNPGFAYDARVVGFVPDYRRVFYQGSTDHRGTPQFPGRTVTLEHHPGATCWGIAYKIREEDKQTALEYLEVREKQYDEKIHLDLYPDSSPKVPAVENVTAYLATTNKESNKNYLGPAPLEEMARQIYLAEGPSGPNKEYVFKLEDALNKLGVVDPHVQELANAVREYSDAKLSK

SEQ ID NO: 6689 - DNA, 1868 bp, Panicum virgatum
  misc_feature: Ceres CLONE 1881711
  misc_feature: Encodes the peptide sequence at SEQ ID NO. 6690
tctccgactccaaccattcaaccgccgccgggattggtggacgcgccggcctcaccctctcaccatcatccgcgagacggcgacctcaccgccgtgggcggcgggggtgaagccagccgagccgagtctctcttcccactcacgtcttgtcttgcctcgtcgagggtcgtcgctcccttcctcatcctcaccatccgggcttccatcgatttcttctgctgccgttaggttcttcgttcttcagtgcccaaggatcgatcttggaagtggatgcgccatgaaatccaacaggagcagcggcggcggtgtgtgccccgcgaaatctgacaggaacgtcagcgccagcggcgcatgccccgtcaccgggaagaaccagggtggcgcggggcaccagggcggcgcgagcggcgctgatgaaggaaggagctcggatccccggctggtgccggcgaggtgcccgttcggctacgactccggcacgttcaagctgggcccgctcagctgcgtggtctgccaggcgctgctccacgaatgcagcagatgcaacccctgctcccataagttctgcagggcttgtgtatcgcgctttaaggactgcccgttgtgtggtgctggtatacagggcattgagcccgattctgaacttcaggctctcgtcgatcgtttgggtggcaagagcaaggtgatatatgaggatgtttcaatggagagaggagcttttctggtgcagcaagctatgagggctttccgtgctcagaacattggaagtgcgaagtcaaggcttagtatgtgtgcagaagacatcagggaggagttgaaatcttcagaagataatctagacctgcgctctcaacttggagctgttttaggaatgcttggggattgctgtcggaccttgggagattctccttcagcaatcagttactatgaagaaagcgctgagttcctctcaaaattacccgtaaaggatcttgagttggtgcatactctctcagtttcacttaataaaattggcgaccttcgctactatgatggggacctgcaatctgcacgaagttattattcccgttcgttggattttcgcagaaatgcagtgaaagaacactcagcagcggcctcccaggtaattgatctagcaacttctcttgcaaaagttgtggatgttgatagaaaccttgggaatgaaagcactgcagtcaagggtgtcaaggaagcaattgaatgccttgagaaactgaagcttggtcctgagcaagctagtcttgagcaaaggcgcctatctgttttagacttcctgcacaaccaattggcagttaaataaagtacagtggcatcctaaaatcatacccataggatacatattcaccaagatggattgaagaactccagttttcatgtgatgcatatgaaggaatttccctgtggtaattagagggtggtattgaaagcaacacaaaatacgagctctgccattgtaaatatatccatgtgctgggcgtggagtttctgcagttgggcgcaaacctgaaatggtgcggtgcggaagatgaaacttctcaaaagtcatgtgtgaatattatccctttgtacattgactaagatgaaggaattgtatgtcctttgtgcttcatcagttccccatgtcaagctgtttgcatattagtggatcgggaatctataagtcgtggatcgggaatctgtaagtcgagaaacattcatatcttataacattattagtataattgtgataagaggatatttgacgaatagcaagtgtctgctttgtaaagttctatatgctgacaatttattgttcgtcaccagcagtatgtgactgattaccaacgcaaaaaaaaaaaaaaaaaaaa

SEQ ID NO: 6690 - protein, 347 aa, Panicum virgatum
  misc_feature: Ceres CLONE 1881711
  misc_feature (1)..(35): Pfam Name: zf-C3HC4 Pfam Description: Zinc finger, C3HC4 type (RING finger)
MKSNRSSGGGVCPAKSDRNVSASGACPVTGKNQGGAGHQGGASGADEGRSSDPRLVPARCPFGYDSGTFKLGPLSCVVCQALLHECSRCNPCSHKFCRACVSRFKDCPLCGAGIQGIEPDSELQALVDRLGGKSKVIYEDVSMERGAFLVQQAMRAFRAQNIGSAKSRLSMCAEDIREELKSSEDNLDLRSQLGAVLGMLGDCCRTLGDSPSAISYYEESAEFLSKLPVKDLELVHTLSVSLNKIGDLRYYDGDLQSARSYYSRSLDFRRNAVKEHSAAASQVIDLATSLAKVVDVDRNLGNESTAVKGVKEAIECLEKLKLGPEQASLEQRRLSVLDFLHNQLAVK

SEQ ID NO: 6691 - DNA, 674 bp, Panicum virgatum
  misc_feature: Ceres CLONE 1881742
  misc_feature: Encodes the peptide sequence at SEQ ID NO. 6692
acaccagtcaaccttttcaaatcatctgcaactctaattaaggagagacactagctagctagctgtgctgtgtctactctagaaccctctagaagcttccattggatcgagatcgatggaccgcgtggcgaggctggcgtcggagcgggcggtggtggtgttcacggcgagcaactgcagcatgtgcgacgtggtgacgtcgctgctgggcagcctgggcgtgaacgccgccgtgcacgagctggacagggacccacgcggccgggagatggagcgggagctcgccaggaggctcggcgccggcgccgtgcacggcggcggcacacccaccgtgccggcggtgttcgtgggcggcgacctcgtcggcggcaccaacagggtcttggcgctccacctcgccggcgagctcgtgcccatgctcaggaacgccggcgcgctctggctctaggagctcagaccacgccggcagcgcacatgcagccatgcacgcgcgtgcaagcatatcttagctttttttttttccgtcagacgtgtacgagtgcgtgaatgccaggtttttttgtatcctgtgcttggaataagtcaaataaatatggcatcagtattaacatgattttcgatatatatttatattaatactactattcgatgtttaaaaaaaaaaaaaaaaaaaa

SEQ ID NO: 6692 - protein, 110 aa, Panicum virgatum
  misc_feature: Ceres CLONE 1881742
  misc_feature (1)..(69): Pfam Name: Glutaredoxin Pfam Description: Glutaredoxin
MDRVARLASERAVVVFTASNCSMCDVVTSLLGSLGVNAAVHELDRDPRGREMERELARRLGAGAVHGGGTPTVPAVFVGGDLVGGTNRVLALHLAGELVPMLRNAGALWL

SEQ ID NO: 6693 - DNA, 1983 bp, Panicum virgatum
  misc_feature: Ceres CLONE 1881792
  misc_feature: Encodes the peptide sequence at SEQ ID NO. 6694
ttccaagcccacaccgtccctccccttccttccctcctcgactccacccggcagctcagctagcaagccttgcccttgcctatctggccgcctcgccacgctaggccgggcaccatgagcggcgccgcccagcagcaagcggagcccgccgccgcggcttccctcgccggcgccactgccgccgggagcactccgccagcggcggtgatccgcaacgcgcgccaccgacccagcaccctcaagctgtgctaccacctcgcggtctccaactccctctacctcctcctggcgcccttcgccgccgccctggcccaccgcctctcccgccacccgctccccgccctcgccgccgccgcccgctccgcgctcgccgcgaacccgcccctcgccgccgcgctcctcgccctcgccgccgtcctcgccacagtctacctcgcgcgccgcccgcgcgccgtctacctgctcgacttcgcgtgctacaagccggggcccgagcacgtggtcacccgcgagaggttcatgcggcagtcggcggcggcgggggtgttcaccgacgagaacctggcgttccagcgcaagatcctggagcggtcggggctggggcaggagaccttcttcccccgcgccgtgctcgccgcgccgcccaacccctgcatggcggaggcccgcgccgaggcggaggccgtcatgttcggcgccatcgaccaggtgctcgccaagaccggcgtccggccgcgcgacatcggggtcgtcgtcgtcaactgcagcctcttcaacccgacgccgtcgctctccgccatgatcgtcaaccactacaagctccgcgggaacgtcgccagctacaacctcggcggcatgggatgcagcgccggcctcatctccatcgacctcgccaagcagctgctccaggtgcaccggaacacgtacgcgctggtggtgagcatggagaacatcacgctcaactggtactggggcaacaaccggtcgatgctcatgtccaactgcctcttccggatgggcggcgcggcggtgctgctgacgaaccgcggcggcgcggcgcggcggcgcgccaagtaccagctggtgcacacggtgcggacgcaccagggcgccgacgaccgcgcctaccgttgcgtgttccaggaggaggacgcggccgggcgcgtcggcgtggcgctctccaaggacctgatggccgtcgccggcgaggcgctcaagaccaacatcaccacgctgggcccgctcgtgctccccatgtcggagcagatcctcttcctggcgtccctcgtcggccgccgcgtcttcggcctccgctcgctccgcccctacctcccggacttcaagatggcgttcgagcacttctgcatccacgccggcggccgcgccgtgctcgacaccatcgagcgcaacctggggctcagcgcctggcacatggagccgtcgcggatgacgctgtaccggtggggaaacacctccagcagctctctgtggtacgagctcgcgtacacggaggcgcagggccgggtgcgccgcggccaccgcgcgtggcagatcgccttcgggtccgggttcaagtgcaacagcgccgtgtggcgggcgctgcgggacgtcgacccggcggaggagaaggtggggaacccatgggtggacgagatccacaggttccccgtcgaggtgcccaaggtcgagagcgtcatcgtcaccgacgcggcggcgccggagccggagccggagccggcagcgtcgtcgtgaggcagcgcttgtgtttgtcctgtttgtttggagaatggtgaagtgtgttgtgtccgagtcaaagtgtgggtggctgggggtagagtgaaggtgttgaactgtgtaaacatacaagaaatttggttgttgattgagatgtagctgatgacctaatgttgattctttgggccgggttcatttggcattgggaaataaagactggacgggctgcaaaaaaaaaaaaaaaaaaaa

SEQ ID NO: 6694 - protein, 545 aa, Panicum virgatum
  misc_feature: Ceres CLONE 1881792
  misc_feature (1)..(290): Pfam Name: FAE1_CUT1_RppA Pfam Description: FAE1/Type III polyketide synthase-like protein
  misc_feature (29)..(521): SWISSPROT Homolog: EC 2.3.1.- 3-ketoacyl-CoA synthase 1
  misc_feature (42)..(527): SWISSPROT Homolog: EC 2.3.1.- 3-ketoacyl-CoA synthase 11
MSGAAQQQAEPAAAASLAGATAAGSTPPAAVIRNARHRPSTLKLCYHLAVSNSLYLLLAPFAAALAHRLSRHPLPALAAAARSALAANPPLAAALLALAAVLATVYLARRPRAVYLLDFACYKPGPEHVVTRERFMRQSAAAGVFTDENLAFQRKILERSGLGQETFFPRAVLAAPPNPCMAEARAEAEAVMFGAIDQVLAKTGVRPRDIGVVVVNCSLFNPTPSLSAMIVNHYKLRGNVASYNLGGMGCSAGLISIDLAKQLLQVHRNTYALVVSMENITLNWYWGNNRSMLMSNCLFRMGGAAVLLTNRGGAARRRAKYQLVHTVRTHQGADDRAYRCVFQEEDAAGRVGVALSKDLMAVAGEALKTNITTLGPLVLPMSEQILFLASLVGRRVFGLRSLRPYLPDFKMAFEHFCIHAGGRAVLDTIERNLGLSAWHMEPSRMTLYRWGNTSSSSLWYELAYTEAQGRVRRGHRAWQIAFGSGFKCNSAVWRALRDVDPAEEKVGNPWVDEIHRFPVEVPKVESVIVTDAAAPEPEPEPAASS

SEQ ID NO: 6695 - DNA, 2600 bp, Panicum virgatum
  misc_feature: Ceres CLONE 1882035
  misc_feature: Encodes the peptide sequence at SEQ ID NO. 6696
aaaacacggctaagttatcgcgctgctgagaccgcggccgccggctcctccgcagagcaatgtcggtagcctccccccatcaccgcagcaccgtcatgccgacgccgcggcagcagatgatggcgcagctcgagcacgggtccctgctggtcggcgggcgcgaactcctcgcccgcgcaccgcccaacgtcaccctccgccccgccggcgtcgccgacgccgaggctgccccgggcaccgcgttcctgggagccagggcggcggagccgtccagccgccacgttttctcggtcggcaccctggctagtggatggaggtggatgtccctgttcaggttcaagatctggtggatggccccggccaccggcgcgggcgcggcggccgtgccggcggagacgcagatgctgctcttggagtccagggatgaggcgggttctgccgccgcggaggggagcgcggtgtacgcgctgatgctgccggttcttgacggcgatttcagggccagcctccaggggagcccccagaacgagctccagttctgcttcgagagcggtgatcctgatgtccagacgatggaagcagttgatgcagtattcatcaactcaggggataacccattcaagctaatgaaggaatccatcaagctgctatcgaagatcaaaggaactttcaggcatatagaggataaggagattcctgcaaatttggactggtttgggtggtgcacatgggatgcattttacaaagctgttaacccagcagggatcgaggagggcattcagagtctgcacgaaggtggtgcgccaccgaggtttctgattatagatgatggttggcaagaaacagttgacgaattcaaggaagtggatgaaaccctccgtgagcagactgtgtttgcacagaggctaattgatcttaaggagaatcataagttcaggggagaaacctgcaagaatcttggaaacctcgtgaagaagatcaaagaaaaacatggagtcaagtttgtttacatgtggcatgctttacttgggtattggggaggcgtcttagcaacatccgatgcgatgaagaagtacaatccaaagcttgcttacccagtccagtcaccaggtaatgttgccaatctgagggacattgccatcgacagcttggagaaatttggagtgggcatcattgatcctgacaagatttatgagttctacaatgatcagcacagctacctttctagtgtgggtgtggatggtgtgaaggttgatgtgcagaacgtgttggaaactcttgtgcatggcttcggtggccgtgttgcagtaacacgaaagtatcagcacgctcttgaggactccattgcccagaacttcaaaagaaacaacctaatctgctgcatgagtcacaattcagacagcatctttagtgccttgaaaagtgcggttgctagagcctctgaagatttcatgcctcgggaaccaacactgcaaactctgcacatcggttatgtggcattcaatagcattttgttgggagaaatcttcatacctgactgggatatgttccttagcaagcatgaaacagcagaatttcacggagcagctagagcactgagtggaggtggcgtctatgtgagtgacaaacccggggtgcatgacttcagtgtcctcaaaaagcttgttctaccagatggctcgattctaagagcaagatatgctggccggcctacacgtgattgtctgttcaatgacccggtcatggatggcaaaagtctgctgaaaatatggaacctgaacaattcttctggtgtcatcggtgcgttcaattgtcagggagccgggcaatgggtttggccagtgaaagacattgcttatgttcccaccagcatcaacatcaccgaccatctctctccttcagatgtagaatctcttgatgagattgccggtgataattggagtggagagactgcagtatatgctttcaattcatgttctctttcaaggcttcagaagcaccaaaatttggaggtttcactgtctaccatggcatgtgagatctacaccatttcaccgataaaggttttcagcaaagccattcagttcgcacctctgggactgatcaacatgttcaactctggcggcgcacttaatgatgtttcgagcacatctgattcttcagctaccacaattcacgtcagatgccgagggccagggcggttcggggcgtattcagccaccaggccggagctctgcagagttgatggccagcaagtggagttcagtcatacagaggatggcctgctagcctttgaccttcctcactgctcatcccacgacggcgacctgtggcgcattgagattctctacagaattccctgaatccgtttaccctcccaacatgcgaggattttcggaggaagttttcagagaagccattgttcagagaaagttttcagagaagccattgttcagttggttctgatggtgctgcattctgctatggccgtgttgtgtgtaattttattcacaatgtgattgttgtgttgtactggtattactgtgattttggtataaaagagagcagcagcgccaattcaaaaaaaaaaaaaaaaaaaa

SEQ ID NO: 6696 - protein, 767 aa, Panicum virgatum
  misc_feature: Ceres CLONE 1882035
  misc_feature (1)..(718): Pfam Name: Raffinose_syn Pfam Description: Raffinose synthase or seed imbibition protein Sip1
MSVASPHHRSTVMPTPRQQMMAQLEHGSLLVGGRELLARAPPNVTLRPAGVADAEAAPGTAFLGARAAEPSSRHVFSVGTLASGWRWMSLFRFKIWWMAPATGAGAAAVPAETQMLLLESRDEAGSAAAEGSAVYALMLPVLDGDFRASLQGSPQNELQFCFESGDPDVQTMEAVDAVFINSGDNPFKLMKESIKLLSKIKGTFRHIEDKEIPANLDWFGWCTWDAFYKAVNPAGIEEGIQSLHEGGAPPRFLIIDDGWQETVDEFKEVDETLREQTVFAQRLIDLKENHKFRGETCKNLGNLVKKIKEKHGVKFVYMWHALLGYWGGVLATSDAMKKYNPKLAYPVQSPGNVANLRDIAIDSLEKFGVGIIDPDKIYEFYNDQHSYLSSVGVDGVKVDVQNVLETLVHGFGGRVAVTRKYQHALEDSIAQNFKRNNLICCMSHNSDSIFSALKSAVARASEDFMPREPTLQTLHIGYVAFNSILLGEIFIPDWDMFLSKHETAEFHGAARALSGGGVYVSDKPGVHDFSVLKKLVLPDGSILRARYAGRPTRDCLFNDPVMDGKSLLKIWNLNNSSGVIGAFNCQGAGQWVWPVKDIAYVPTSINITDHLSPSDVESLDEIAGDNWSGETAVYAFNSCSLSRLQKHQNLEVSLSTMACEIYTISPIKVFSKAIQFAPLGLINMFNSGGALNDVSSTSDSSATTIHVRCRGPGRFGAYSATRPELCRVDGQQVEFSHTEDGLLAFDLPHCSSHDGDLWRIEILYRIP

SEQ ID NO: 6697 - DNA, 1710 bp, Panicum virgatum
  misc_feature: Ceres CLONE 1882062
  misc_feature: Encodes the peptide sequence at SEQ ID NO. 6698
cgatcgagagcgagatctgcatcgctagctcgtcccggcccggcgctttcctagggatcgccacgcgcagggggggaagcgaaaaagcccttcttggagccctctgcttggcctctccctctctcgtgttgcaaagctgcaggcgggcagcatggccgcaccgccgctgctgctgctggtactggtaggcgcgctggcattgctagccctggagcaggtggcgcggtgcgacgccgcggcgacgtgcgtcggcgtggccccggcgaagcgccggcccgaggtggtgtccatcgcggacttcggcggcgtgggcgacggccggacgctcaacacgtgggcgttccgcaaggccgtgtaccgcatccagcaccggcggcggcgcggcggcaccgagctgcgcgtgccggcggggacgtggctcaccggcagcttcaacctcaccagccacatgacgctcttcctcgccaggggcgccgtgctcaaggccacgcgggacgccgcggggtggccgctggtggagccgctgccgtcgtacggacgggggcgggagctgccggggccgaggtacgccagcttcatcaacggcaacggcctccgcgacgtcgtcatcacaggtgacaagggagtcatcgacgggcaaggtgaggtgtggtggaacatgtggaggcagaggactcttcagcacaccaggcccaaccttgtggagttcatgcattccactggcattcacatctccaacatcgtcctcaagaactcacccttctggaacatccatcctgtttactgcgacaatgtggtcgtgaccaacatgatgatcttggcaccacacgactccccaaacacagatggagtcgacccagattccagcaccaacgtgtgcatcgaggactcgtacatctccaccggcgacgacctcgtggcgatcaagagcggctgggacgagtacgggatcgcctacgggcggccgagctccggcatcaccatccgacgcgtgcggggctcgtccccgttcagcggcatcgccatcggcagcgaggcctccggcggcgtgcgcgacgtcctggtggaggactgcagcatcttcaacagcggctacggcatccacatcaagaccaacgtcggccgcggcggctacatccggaacgtcaccgtcgacaacgtgcgcatgagcggcgtgcgcagcggcgtccgcatcgccggcgacgtcggcgaccaccccgacggccggttcagccagctcgccgtgccgacggtggacgccgtgcggatccggaacgtgtggggcgtcggcgtccagcagccggggtccctggaggggatcaggaactcgccgttcacgcggatctgcctctccaacgtcaagctcttcgggtggaggagcggcgcggcttggaggtgccgggacgtgcgcggcgccgcgctcggggtgcacccgtcgccgtgcgccgagctcgccaccagcttcgcgtcggctgcagggtcctgcagctattagtgcttaacccggctggcaggatgctgaatctctgctctgtttctttagcttgagcttgtgttttagttgtgttagagattcatgtcctgggatcaccttattaggctttctgctaattgttcagggaaccttagatataatttggtagtagtataatgctcagcttctgtgtgcttaatctgatgccaagtgcagaaaaaaaaaaaaaaaaaaaa

SEQ ID NO: 6698 - protein, 447 aa, Panicum virgatum
  misc_feature: Ceres CLONE 1882062
  misc_feature: Great-hit functional homolog of the protein sequence encoded by LOCUS At4g23820
  misc_feature (1)..(355): Pfam Name: Glyco_hydro_28 Pfam Description: Glycosyl hydrolases family 28
  misc_feature: Useful for making plants with altered cell wall content and/or composition
MAAPPLLLLVLVGALALLALEQVARCDAAATCVGVAPAKRRPEVVSIADFGGVGDGRTLNTWAFRKAVYRIQHRRRRGGTELRVPAGTWLTGSFNLTSHMTLFLARGAVLKATRDAAGWPLVEPLPSYGRGRELPGPRYASFINGNGLRDVVITGDKGVIDGQGEVWWNMWRQRTLQHTRPNLVEFMHSTGIHISNIVLKNSPFWNIHPVYCDNVVVTNMMILAPHDSPNTDGVDPDSSTNVCIEDSYISTGDDLVAIKSGWDEYGIAYGRPSSGITIRRVRGSSPFSGIAIGSEASGGVRDVLVEDCSIFNSGYGIHIKTNVGRGGYIRNVTVDNVRMSGVRSGVRIAGDVGDHPDGRFSQLAVPTVDAVRIRNVWGVGVQQPGSLEGIRNSPFTRICLSNVKLFGWRSGAAWRCRDVRGAALGVHPSPCAELATSFASAAGSCSY

SEQ ID NO: 6699 - DNA, 2062 bp, Panicum virgatum
  misc_feature: Ceres CLONE 1882221
  misc_feature: Encodes the peptide sequence at SEQ ID NO. 6700
ggaagaagccacagcaacaggaacaattcctccgctctctggagaaagcaacagggcggttgcgtgctcgcgagaaggcggcccgggggagccctctcgccccgccgggagggaggcggcgccgcgccgattcgacccgccgatcggccgtccgcgaaggttaaagaaaatctaatctcactgttcacttactatggcgggacatcataataacaacacacatatgtccaggatggatcatgtgaaccggttccagaatgaaccactgccttttggtccaaagatatttatgcatcctagaagtgatgcggtaaatggacctctatcaccaggttatgggggagcgacaataagatcaaatgaccttccatcctcaagccacattggccaacctcatacccagccgattgaagcccctggaaccatgcttgcaccctacgctggctatcctcatgctggaatctccagtagcatctatgcacctgcaccacataatactcagcatccgcctgctttgagttatccacatagatctgaggatagcttcactccaagttcccatatggatgacagaagggttgcacagaagcggaagaacccaattattcatccaatggatggatccagtgtttggagctgttatgcttctagttcgtctaatcctcaattcccccagtacatgcctccaaatcctattcctgttactgaaccctgccctcctcgaatgccctcaaatatgggttcaagctattggagtgatcatcgctttggtaatcatggagcatctcagaggaatgtaagagggcgacatgatcacaattctatccatttgggacacagtccagctgtagcttgctcatcaagcagcactcatgggccaccacaccatggtaatgcaattggtccttctctaactacagcagtgccacaagatagagctcctttgtctgtacctccaagacttgtccccccaggggctgatggaaactctagcatcacattcagagagagaccatactatcctgctccacagaggaccaacataaatgccccccctgtcccagcactttctggttcttctgatagcatggcctttgtgcatggtggatatgtaccccgagcaattcctcttaacaccatccgctcttatcctgccccaggatttgggacttcctccaactctgctgcggtctcccatgagcctggtatccctagctatccacctgctgcccctagctacccacctgctgctacctttgcagcaacatcaagtgcaccaccatttcatgctgaagctgctgcatcttcaagacatctggggcatgtggctccaggacctggtggtagtgcttggagtagaaggctgagggatgcctaccatgctttccatccattgatctttgaggaaaataatttgagaggatcagcagctgagaggtttatgatgctggaccagttagttatccatgaatcaagagaagattctgatcctcactgggacatgagattggacattgatgacatgagttatgaggaactgctcgctctggaggagcgtataggcagcgtcagcactggtttggctgatgaaaaaatttcaagctgtgtgatggaggtaacatgctgcagctctgctcgagcccaggatggcattggcaaggagaacgcaagatgcgtgatttgcctggaggaatacaaattcaaggattccatggggaagctgaaatgtggtcatgactatcacgccgactgcatcaagaaatggctgcaggtgaagagcgtctgcccaatctgcaaagcttctgtggcagacgacagcggagggaccaaatgaagcgtggcttccacagttccactccattcgtcctagaacaggcccaactgtatctattcactgatccattttcgctgtgtaaataagtggtggtcctgaaacggaattatttgtgagcacggtttgaactctgacatcttatccgatgtaaatcttattcctcaagttagttgctaatcgatggcagggttgcattgttcagtgattcaaaaaaaaaaaaaaaaaaaa

SEQ ID NO: 6700 - protein, 546 aa, Panicum virgatum
  misc_feature: Ceres CLONE 1882221
  misc_feature (1)..(41): Pfam Name: zf-C3HC4 Pfam Description: Zinc finger, C3HC4 type (RING finger)
MAGHHNNNTHMSRMDHVNRFQNEPLPFGPKIFMHPRSDAVNGPLSPGYGGATIRSNDLPSSSHIGQPHTQPIEAPGTMLAPYAGYPHAGISSSIYAPAPHNTQHPPALSYPHRSEDSFTPSSHMDDRRVAQKRKNPIIHPMDGSSVWSCYASSSSNPQFPQYMPPNPIPVTEPCPPRMPSNMGSSYWSDHRFGNHGASQRNVRGRHDHNSIHLGHSPAVACSSSSTHGPPHHGNAIGPSLTTAVPQDRAPLSVPPRLVPPGADGNSSITFRERPYYPAPQRTNINAPPVPALSGSSDSMAFVHGGYVPRAIPLNTIRSYPAPGFGTSSNSAAVSHEPGIPSYPPAAPSYPPAATFAATSSAPPFHAEAAASSRHLGHVAPGPGGSAWSRRLRDAYHAFHPLIFEENNLRGSAAERFMMLDQLVIHESREDSDPHWDMRLDIDDMSYEELLALEERIGSVSTGLADEKISSCVMEVTCCSSARAQDGIGKENARCVICLEEYKFKDSMGKLKCGHDYHADCIKKWLQVKSVCPICKASVADDSGGTK

SEQ ID NO: 6701 - DNA, 1890 bp, Panicum virgatum
  misc_feature: Ceres CLONE 1882233
  misc_feature: Encodes the peptide sequence at SEQ ID NO. 6702
tggcgccccaccggcggccgcgatatgcgctttccatttcgcttcctccccgtcctcctctcctggccgccggcttccccccttcctcctcttctctccttccagagcacgaggattcttccgaagcagaccacagcgaagccctaaccggagagggagagggagatggcgctggcgatcctcgcgcggcggcgcgcggcggaggccgtgctccggcggccgcaggcggcggccgtgtccgcgtggcgggcgtacgcggcggtggggggcgaggagagcgacgtcgtcgttctgggcggcgggcccggtgggtacgtcgcggcgatcaaggccgcgcagctggggctcaagaccacctgcatcgagaagaggggcaccctcggcgggacctgcctcaacgtcgggtgcatcccatccaaggctcttctgcactcatcacatatgtaccatgaagcaaagacttcttttgcgcaccatggagttaagctctcaaatcttgaagtcgaccttccagccatgatggctcagaaagacaaggctgtggcaggactaacgaaagggattgaagggctctttaaaaagaacaaggtgacttacgtaaaaggctttgggaaattggcttccccctcagaagtgtcagttgatttgattgatggcggtagcactgttgtcaaagggaaaaacataatcattgcaactgggtctgatgtaaaatcacttcctggaatcaccattgatgagaagaaagttgtttcatctactggtgctttgtgcttgtctgagatcccaaagaaactggtggttattggagcaggttatattggccttgagatgggttcagtctggaaccgccttggttcagaggtcactgttgttgaatttgctccagatatagtaccatcaatggatggcgagatcaggaagcagtttcaacgcatgttagagaagcataagttcaagttcatgctcaagacaaaggtagtcggatgtgataccagtggagatggtgtgaagctgacacttgagcctgcagctggtggtgatcagaccatccttgaagcagatgttgtccttgtctctgctggcagaaccccatttacttctgggatcgggctggaaactattggtgttgaaacagataaggctggcaggatcctagttgataagcgcttcatgaccaatgtgaagggcgtctatgcaattggggatgccatccctgggcctatgcttgcccataaagctgaagaggatggtgtcgcatgtgttgagttcattgctggaaaggaaggccatgttgactatgacacagttccaggagtagtctatacacatccagaagttgcctctgttggcaagactgaggagcaggtgaaggctttaggaattgcctaccgcgtcggcaaattcccactgctggctaacagccgtgcaaaggccattgatgatgctgaggggatagtcaaggtggtggctgagaaggaaaccgacaagattctcggtgtgcacataatggcgcccaatgctggtgaaatcatccatgaagccgtgcttgctttgcagtatggagcatcgagcgaggacgttgcccgcacttgccatgcgcatcccactgtgagcgaggccctcaaggaggcttgcttacaaaccttctccaaggctatccacatatgattcctgttttttttttcttatcatccaaatgttggatctggaagttaattttggatctttggtaccaaaaggcctctgactgtcgcatttcattttgttggcaatactgcgaattgacccatgccatcttatagcagtctgttttgattttacatgtctgctatatacatcccaataaaactatcctggtactttgtgcaaaaaaaaaaaaaaaaaaaa

SEQ ID NO: 6702 - protein, 501 aa, Panicum virgatum
  misc_feature: Ceres CLONE 1882233
  misc_feature (1)..(315): Pfam Name: Pyr_redox_2 Pfam Description: Pyridine nucleotide-disulphide oxidoreductase
  misc_feature (1)..(501): SWISSPROT Homolog: EC 1.8.1.4 Dihydrolipoyl dehydrogenase 1, mitochondrial precursor
  misc_feature (1)..(501): SWISSPROT Homolog: EC 1.8.1.4 Dihydrolipoyl dehydrogenase, mitochondrial precursor
MALAILARRRAAEAVLRRPQAAAVSAWRAYAAVGGEESDVVVLGGGPGGYVAAIKAAQLGLKTTCIEKRGTLGGTCLNVGCIPSKALLHSSHMYHEAKTSFAHHGVKLSNLEVDLPAMMAQKDKAVAGLTKGIEGLFKKNKVTYVKGFGKLASPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEIRKQFQRMLEKHKFKFMLKTKVVGCDTSGDGVKLTLEPAAGGDQTILEADVVLVSAGRTPFTSGIGLETIGVETDKAGRILVDKRFMTNVKGVYAIGDAIPGPMLAHKAEEDGVACVEFIAGKEGHVDYDTVPGVVYTHPEVASVGKTEEQVKALGIAYRVGKFPLLANSRAKAIDDAEGIVKVVAEKETDKILGVHIMAPNAGEIIHEAVLALQYGASSEDVARTCHAHPTVSEALKEACLQTFSKAIHI

SEQ ID NO: 6703 - DNA, 2357 bp, Panicum virgatum
  misc_feature: Ceres CLONE 1882300
  misc_feature: Encodes the peptide sequence at SEQ ID NO. 6704
aatccccaccacaccaagccaccaggccactagtcgtctagtcgcccgccggttgctttttgcaagcagcagccaatcgcgcgggaggcgggggaggaggagagagggggtcacgactcacgaggcctgcgccgcgcgctcgtcctcgccgccgttggacgaggcagcggcttccttttaaaatcctcggcagatggctgcggggcttccgcatccccaccacgtcctcctggtactggccctcctgccttcccttctccgtccccgcgcggtcgagatggcgccgactcccgccgccgccgggtccggcgacgagggcgccagcgcgctgctcgggctcctgctgcgggtgcagtcggaggcgctgcgcgcgctggggcccgacggcttcgaccccaagctctacgtcgacctgccgctggcggccgacgagcgcgccgcggcggccgcgctgccgggccagggccgggcgccgccgtcgcgggcggagctggagtcctacctcgcgcgctacttcggggcggccgggtccgacctcgtggcggcggacccgccggacttcgagcccgagccgcgcgggttcctgccccgcgtcgagagccccgaggcgcgggcgtgggcgctggaggtgcacgcgctctggaaggacctggcgcggcgggtggcgcccggcgtcgagaagcggccggaccggcacacgctgctgccgctgcccggcggggtcgtcgtgccgggctccaggttccgggaggtctactactgggactcctactgggtcgtcaggggattactggtgagcaaaatgtacgacacagcaaagcatgttgtgcttaaccttgtatacctggtggaaaaatatggttttgttctgaacggtgcaagatcctactacactaaccgaagccaaccaccacttttaagctcgatggttttggaagtatacagggcaactggtgatgtggagtttgtcaagggagcattccggtctctgctgaaagagcatagcttctggatgtcagagattcataatgtagctattagggacaatcatggccaggtccataacttgtctcgataccaggcaaggtggaacaaacctaggccggaaagtgcgacaattgatgaggaacttgcttcgaagatcaattctatagctgataaggaaaaactttaccaccaaattgcttcaacagcagagtcaggatgggattttagctctcgatggatgagaaattctactgacatgacaacgttggcaacaacttacattatacccgtggacctgaacacattcatatttaagatggagcaggatatagctgcctttgctaaaatcattggagagaaagcaacctctgaaaagtttttagaggcttcaaaagcacgccatattgcaattgactctattctgtggaactctgagatggagcaatggcttgactactggcttcctactgatggagattcccagcagggagtctaccaatggaagtctgactcacagaaccgcaaaatatttgcttccaatttctttccgttgtggttaaatgcttatcattcaggatcagcgaaatttgccgacactgcaaaatccgagagagtcatggcaagcctccagaaatctggattactctgtgccgcaggaatagcaacttctctaacaaacacaagccaacaatgggatttcccgaatgggtgggctccggtgcagcatctcatagctgaggggctgttgcattctggatcagaggaggcagtaaaattagctgaggacattgctacaaggtgggtgagaacaaactacgccgcctacaaagcaaccggcgcgatgcatgagaagtacgatgtggaggcctgtggaaaatctggaggcggtggtgaatacaagccccagactggttttggctggtccaatggtgtggtattatcattcttggaagaattcgggtggccgaagcacaaggaaataggttgctcacgacagggtgaagttggtctcgccggagcgcagtctgattaggcttacaactgtacatacacgaatacacgatcgagtgggtgtaatgtaactcgtgggcgcgcatagccgcacacagcatatatgcaggtatttgcattgcattgtgcagtcagccggcaagtgtttgtgtgtgtgtgtgtgtgtgtgtgtgttctgttgtttgctcgttgttgtaccacgagccaagacccacgaggtagcagaatctccatgtatctgctggacaatgtacattatgtacggtagtcccgagcccccgtgttaaagtgaaatatcctttttgccctcttgaataaatcagctttatggtagcctagaaaaaaaaaaaaaaaaaaaa

SEQ ID NO: 6704 - protein, 608 aa, Panicum virgatum
  misc_feature: Ceres CLONE 1882300
  misc_feature (5)..(521): Pfam Name: Trehalase Pfam Description: Trehalase
MAAGLPHPHHVLLVLALLPSLLRPRAVEMAPTPAAAGSGDEGASALLGLLLRVQSEALRALGPDGFDPKLYVDLPLAADERAAAAALPGQGRAPPSRAELESYLARYFGAAGSDLVAADPPDFEPEPRGFLPRVESPEARAWALEVHALWKDLARRVAPGVEKRPDRHTLLPLPGGVVVPGSRFREVYYWDSYWVVRGLLVSKMYDTAKHVVLNLVYLVEKYGFVLNGARSYYTNRSQPPLLSSMVLEVYRATGDVEFVKGAFRSLLKEHSFWMSEIHNVAIRDNHGQVHNLSRYQARWNKPRPESATIDEELASKINSIADKEKLYHQIASTAESGWDFSSRWMRNSTDMTTLATTYIIPVDLNTFIFKMEQDIAAFAKIIGEKATSEKFLEASKARHIAIDSILWNSEMEQWLDYWLPTDGDSQQGVYQWKSDSQNRKIFASNFFPLWLNAYHSGSAKFADTAKSERVMASLQKSGLLCAAGIATSLTNTSQQWDFPNGWAPVQHLIAEGLLHSGSEEAVKLAEDIATRWVRTNYAAYKATGAMHEKYDVEACGKSGGGGEYKPQTGFGWSNGVVLSFLEEFGWPKHKEIGCSRQGEVGLAGAQSD

SEQ ID NO: 6705 - DNA, 952 bp, Panicum virgatum
  misc_feature: Ceres CLONE 1882481
  misc_feature: Encodes the peptide sequence at SEQ ID NO. 6706
gattccggccgaaaaccagtctgcatcggcacttccgcccggggccaccaaccgcgactcgattcctcacgctcctgagatcctgaacccctctcgccctctcccgtccgttccccattctcgcatcgacggcgacaccatcgccagtggccccttcaggcaccccgccgccggcatgacctacgggtcgccgccgggttcgcccccctcccaaggctcccagagaaaaagaggttcaaccaaagattctgttggcttgtatgcggtgcaatgctatgtgtgctacaaatggcgtatgattccaactaaagaagaatttgaaacacttcgtgagaacttcactgaggatccatggttctgcagcagaagaccagactgctcttgtgatgatcctgctgacattgagtatgactgcagccgtatttgggtcatcgacaagcccaacataccgaagcctccaccagagacggagaggctagtgattatgaggcgtgatttcactaaaatggacacctactatgtcatgccaaatgggaagcgtgcaaggtgtgcgggggatgtggataagtttctggaggcaaatcctgagtacaaaaaccgcatatctgtttctgacttcaactttgcaccacccaaggttgttgaggagactgtttctcacaactctgcctggaaggctgccaaagctaagaagcaggacaaggcagacacatcaagtgcacaaaagtgatagaaactctgaaccttgcctttgctatgtttaggtgatagtcctctcaggatcatgtcacattcctatctatgtccaactgaagttaatgtaggttttattgctgtgactttgctctgaatgcactgatgcatgtgtaaccaaacccttgtgttaatctctgaggtggttaataagttctgtaggcctctagctcatttccaaaaaaaaaaaaaaaaaaaa

SEQ ID NO: 6706 - protein, 184 aa, Panicum virgatum
  misc_feature: Ceres CLONE 1882481
  misc_feature (1)..(51): Pfam Name: MBD Pfam Description: Methyl-CpG binding domain
MTYGSPPGSPPSQGSQRKRGSTKDSVGLYAVQCYVCYKWRMIPTKEEFETLRENFTEDPWFCSRRPDCSCDDPADIEYDCSRIWVIDKPNIPKPPPETERLVIMRRDFTKMDTYYVMPNGKRARCAGDVDKFLEANPEYKNRISVSDFNFAPPKVVEETVSHNSAWKAAKAKKQDKADTSSAQK

SEQ ID NO: 6707 - DNA, 1007 bp, Panicum virgatum
  misc_feature: Ceres CLONE 1882598
  misc_feature: Encodes the peptide sequence at SEQ ID NO. 6708
aaagaagggtttttggctgggagaccgaccgcaccagagaggggaaggtcagccagacaccaccgccgccttgctcgcgccgcacgctactctcaaactcggcgagagagagagagagagagagagagagagcggccaaggaagaacgagggacggagggagcgcgaggatgggcgctggggacggggaggccgcagcgagcaaggagaagggcggcggcggcgccgagcggacgtcgctggacggcgtgcgggacaagaacgtgatgcagctcaagaagctcaacacggcgctcttccccgtccgctacaacgacaagtactaccaggacgccatcgcatccaaggacttctccaagctcgcttactacagcgatatatgtgtcggtgcgatagcgtgtcgcctggagaagaaggaaggaggggctgtccgagtttacatcatgaccttgggtgtattggcaccttaccgtggccttggtatcgggacgaagttgctgaaccatgtttttgatctctctgcgaagcagaacatctctgagatatacttgcatgttcagacaaacaacgacgacgccatcgctttctacaagaagtttggattcgaaataacacagacgatacataactactacatgaacataacgccaccagattgctatgtccttacgaaatttattggactggctgctacaaagaaatgatcagccgcctgtccatcttttgtaagaccaccaccacctgagttatggcggaaggtagttgtggttctgtcgcagtttgtgctgtgtattcatttttgtgagatctaaagctatggacgcctgggtagctttgctacagaactgagactatcgtttacattgagactgctcttttttttcctccgtctttgcttcagggcacggattcatgcctgaacagtttttttatttgcctgttcgttggagagctacgatctaacatgggaatcagcataggtctctataaaaaaaaaaaaaaaaaaaa

SEQ ID NO: 6708 - protein, 177 aa, Panicum virgatum
  misc_feature: Ceres CLONE 1882598
  misc_feature (1)..(84): Pfam Name: Acetyltransf_1 Pfam Description: Acetyltransferase (GNAT) family
MGAGDGEAAASKEKGGGGAERTSLDGVRDKNVMQLKKLNTALFPVRYNDKYYQDAIASKDFSKLAYYSDICVGAIACRLEKKEGGAVRVYIMTLGVLAPYRGLGIGTKLLNHVFDLSAKQNISEIYLHVQTNNDDAIAFYKKFGFEITQTIHNYYMNITPPDCYVLTKFIGLAATKK

SEQ ID NO: 6709 - DNA, 790 bp, Panicum virgatum
  misc_feature: Ceres CLONE 1882678
  misc_feature: Encodes the peptide sequence at SEQ ID NO. 6710
tagccatccccgcgagatggagctcggcgtgcggcttggtagctgccagccgcctcccaacaccagccaaccgccgcctccagcgatcagcttcggagcctggccgcgctccagccacctcgtcgtcctccgtgcccgggcgtgtccgcgtcgtccccgccgcgccagggctccgcgggtcgctgccccggactcccgccccctcgagaccatctgcgccaacagcaccggtcagggcactaagttgaggggggaccagttcttcccggtggagatgacggtccgcgactgcgagcttgaccactacggggtcgtcaacaatgctgtgtacgcggactacatcgaaaaagctcgggaagagttggcttccagccttggcatcagctcatgctcgatcgcgagcacaggcaacgccatggcactctccgacctgaggcagctcgtcctggaggcaacggccaccgtggtgtgcctgaacaaggactaccgcccgacgcgcgtgttcccggaggtggcgtccaagctgcggcgtttcttctcgtcctagctacgatacgtacgtaccaaggactgatgccaacaagccgaccgacgtcgtcgtattagatatacgtggacacgtgatcgatcgtacttgtgtacataagtacgtgctctggagtctggacgagggatcccctgtgtatagtagaagcctggactggaaaggctctgtttgatgggagtcatcataagagatcaccccagcaaaagaaccgtcactgtctgtcaaaaaaaaaaaaaaaaaaaa

SEQ ID NO: 6710 - protein, 176 aa, Panicum virgatum
  misc_feature: Ceres CLONE 1882678
  misc_feature (1)..(43): Pfam Name: 4HBT Pfam Description: Thioesterase superfamily
MELGVRLGSCQPPPNTSQPPPPAISFGAWPRSSHLVVLRARACPRRPRRARAPRVAAPDSRPLETICANSTGQGTKLRGDQFFPVEMTVRDCELDHYGVVNNAVYADYIEKAREELASSLGISSCSIASTGNAMALSDLRQLVLEATATVVCLNKDYRPTRVFPEVASKLRRFFSS

SEQ ID NO: 6711 - DNA, 2199 bp, Panicum virgatum
  misc_feature: Ceres CLONE 1882863
  misc_feature: Encodes the peptide sequence at SEQ ID NO. 6712
aaccaaaggtccaaagcccgccggccagctaatgcagacatggctgagacctgagagcggccacctcctcccctcttttccccataaaacgcggaagaatctcgaagagcccgcttcgtcccatcgcccgccccgctctcctctgtctccgtctcgcctcgccccagagtcccagacgcatcaaaccgctcttctcctgtccttttctcccctctcaaccccaaagaagccgcactcgcaaaggcagcgaacgcgccgcgcaccggaagatcccagagagcggcacgagcggggccccattgcggcatggctgctgtggccgccggcgctggcgtcgggctccagctcattggcgccgccgcggccacgctcctagtggcggtccttgttgccgccgtgctggggcgccgccgccggccgccggcccgggcgcctctggtggaagggaagcccgcgccggaggatggccgcgcggtcggcgacggcgagggcgccgccggtgacggtgggacggacgtaatcatcgttggcgccggggtagctggatctgcgctggcatatacgctcggaaaggatggccgtcgggtacatgttattgagagagatctgacagaacccgacagaattgtgggtgaactgttgcaacctgggggttacttgaaattaatcgagttgggcctcgaagattgtgtggaagaaattgatgcccaacgtgtccttggttatgctttattcaaagatgggaggaacacaaagctcgcttatcccctggagaaattccattctgatgttgctggtaggagctttcacaatggaaggtttatacaaaggatgcgtcaaaaagccgcttctttgcccaatgtccaattagagcaaggaactgttacatcacttcttgaagaaaatggtaccgttaagggtgtacaatacaaaaccaagtcaggtgaagaactaaaggcttttgcacctttgacgattgtatgtgatggctgcttttcgaatttacgacgtgccctttgctctccaaaggttgatgttccgtcttgctttgttggactggtcttggagaattgccaacttcctcacccaaaccatgggcatgttatcttggccaatccttcgcccatcctattttacccaataagcagcactgaggtgcgttgtttggtcgatgtccctggtcagaaggtgccatccatagcaaatggcgaaatggcaaattatctcaaaactgttgttgcacctcagattcctccagaaatctatgactcttttatagcggccattgataagggaagcataagaacaatgccaaataggagcatgccagctgcaccacatccaacacctggcgcacttttgatgggggatgccttcaatatgagacatcctttaactggtggaggaatgactgttgcgttatctgacattgttgtcctacgcaatcttctcaagcctcttcgcaatctgcatgatgcatcttctctgtgcaaataccttgaatcattctatacattgcggaagccggttgcttcaactataaacacattggctggtgctctgtacaaggtcttcagtgcctcgcctgatcaagctaggaatgagatgcgccaagcttgctttgattacttgagccttggaggtgtcttctcgaatgggcctattgctctactttctggtcttaatcctcggccattgagtttagttgcacacttctttgctgttgctatctatggtgttggccgactgatgctccctcttccttcacctaaacgaatgtggattggagccaggctgatttctggtgcatgtggcatcatcctccctatcatcaaagctgaaggtgtgagacaaatgttcttccctgctaccgtgcctgcatactaccgggctgctccttctgcagagtaagctggaactaggaaccgactctttgctgctgatctgatggcaactgctgtttcacggatggcatttttcctgccttagtggtcgttcgtcgtcatcgttagccggttgttcgtgctgtcagtggaatcagaggaacctgtatagtgtctgcagcaggaacctgttattcgagttagaaatgtgttgggtttcttccgtacgcatgtcgattcctgccaagttgtatatgattctgttgaactagtgaagagatacgtcgttcgtcgtcaaaaaaaaaaaaaaaaaaaa

SEQ ID NO: 6712 - protein, 534 aa, Panicum virgatum
  misc_feature: Ceres CLONE 1882863
  misc_feature: Great-hit functional homolog of the protein sequence encoded by LOCUS At1g58440
  misc_feature (1)..(274): Pfam Name: SE Pfam Description: Squalene epoxidase
  misc_feature (1)..(31): Pfam Name: DAO Pfam Description: FAD dependent oxidoreductase
  misc_feature (66)..(533): SWISSPROT Homolog: EC 1.14.99.7 Squalene monooxygenase 1,1
  misc_feature (67)..(531): SWISSPROT Homolog: EC 1.14.99.7 Squalene monooxygenase
  misc_feature: Useful for making plants with altered cell wall content and/or composition
MAAVAAGAGVGLQLIGAAAATLLVAVLVAAVLGRRRRPPARAPLVEGKPAPEDGRAVGDGEGAAGDGGTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAFAPLTIVCDGCFSNLRRALCSPKVDVPSCFVGLVLENCQLPHPNHGHVILANPSPILFYPISSTEVRCLVDVPGQKVPSIANGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPSAE

SEQ ID NO: 6713 - DNA, 2033 bp, Panicum virgatum
  misc_feature: Ceres CLONE 1882897
  misc_feature: Encodes the peptide sequence at SEQ ID NO. 6714
agcgagcccccatgtgttcgtgctgagtctcgacaatactctccccgcccagccagccagctcccctcccccatcacctcgtgctctccacggccgcatgcgctgcgcccccttgtcctgaccccctcctcctcccaccacctcgttctttcctcccatcccgccctgtctcggcgcgaggcagcgccggtcagctgacagggacagctagaacgcgcgggcggagccacctgcgttccctgaacacttgttgatttcttgatgagttggcgtcggcagcggcaaggcggaggaggggattcggcttccccagcgccggcggccgcctgaacatcccttcttcttcctctacggtgcgctctcgcgaggtacaagcgccatggggctcttaggtatgatgggcgattcattcgggtgctcagctaccggtgagcgactcgtctctgccgcaagggatggagacattcaagaggctagagccctcttggagctcaacccccgccttgcccggtattccacttttgggatccggaactcgccactacattactcggctgcgaagggtcaccatgagattgtatccctcctaatcgaatccggggttaatatcaaccttagaaattgcagaggacagactgctctgatgcaagcttgtctatatggtcactggaaagttgtacagattctagttcttttcaaagctaatattcacaggagagattgttttagtggcgcaacagctattcattttgccgcccttaaaggtcatgctcggtgcattcggcttcttgtggctgattacgtgccgagcttgtcagagttttggaacgttatgcatggaaagtccagggatgaagcaaaaaaggatgtcttcgatgcagtatctctccagaggctaattaatggaaagtcggatggtggcgtcaccccgcttcacttggcagcccttcatggccatgctgagagtgttcagctgctattagatcttggagcttctgtctctgaggtcacagtcaatgatggttcaactattgacctcattggttcaggtagcactcctctccattacgcggcatgtggtggaagtgctgtctgctgccaacttctcattgcagcaggagcgaacattggagctgaaaatgctaatgggttgactcctcgagatgtggcacgttcgtggcacaaaaatagcgttgaaggcatcctaagcaaacagccagaaggccgaatacgcattcttccttcaccatatctgtgtctaccattgatgagcattgtcaaaattgctcgtgagtgcggatggagaaagacttctgcctcctccacatgtcaggatccatgcgtcatatgcttggaggtggaatgcacggtagctgcagaaggttgcggccatgagttctgcaccaaatgcgcactctatttgtgctcgaccacaagcagctcaacatctatccgtggcgttcccggctccgtatcatgccctttgtgccgtcatgccattgtctctttcatgaagctcacgagtaccactccaataaaggagcttccatggacaagcacaacactagctctatgtgtcgcaggcgcaagcactggttccaatcatgccagctccttgcatcgtcggcctgacacgcatcgactgcgctcctcctcggttcagttgggatgctcctcttttagatccattggctctgggaaactttcgtcattcaagttgaactgcacaggagctgaagaggcggtgccttgcctcatcagttgtctccggccagatgtgcagcggtcgtcatcgtacagggaaagaattaggagatattcagagttttgatagcagccctctgtttgttctctgcctcccttcctgcgagtttttggggtttggcagatcaaacttgtttagtgtccatgtttctctttgcttctgtgtttcttgtcatgtaatatgcatgcagtcctcgtgctgaagatctgtttgtgtacatgactcgtttatctacttatatgtgaagtatataccatctccgttttac

SEQ ID NO: 6714 - protein, 483 aa, Panicum virgatum
  misc_feature: Ceres CLONE 1882897
  misc_feature (1)..(50): Pfam Name: zf-C3HC4 Pfam Description: Zinc finger, C3HC4 type (RING finger)
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHARCIRLLVADYVPSLSEFWNVMHGKSRDEAKKDVFDAVSLQRLINGKSDGGVTPLHLAALHGHAESVQLLLDLGASVSEVTVNDGSTIDLIGSGSTPLHYAACGGSAVCCQLLIAAGANIGAENANGLTPRDVARSWHKNSVEGILSKQPEGRIRILPSPYLCLPLMSIVKIARECGWRKTSASSTCQDPCVICLEVECTVAAEGCGHEFCTKCALYLCSTTSSSTSIRGVPGSVSCPLCRHAIVSFMKLTSTTPIKELPWTSTTLALCVAGASTGSNHASSLHRRPDTHRLRSSSVQLGCSSFRSIGSGKLSSFKLNCTGAEEAVPCLISCLRPDVQRSSSYRERIRRYSEF

SEQ ID NO: 6715 - DNA, 1923 bp, Panicum virgatum
  misc_feature: Ceres CLONE 1882899
  misc_feature: Encodes the peptide sequence at SEQ ID NO. 6716
agtgcacccatagctttgccaacatgtacacacccagccagcaatactgaccgagatccactagtgcgcagcgcagggcgcgccatggcgagcgccagcgccagcgccacctccagcctcctcgtcccggcgacaaggtcacggacaagctggtggagtgctcggacccgacccgcggccccccgtgcccgccgccgacgcccacccccatcgtcgtcgacttccagccggaagccaccgtgaagcgcgtccgccgcccggcgcacctcctcgaccgggagcacaaggagaagtaccgggaggccgtcggcaagatgcgggcgctgccggcgacccacccgctgagcttcgcggcgcaggcggccgtccacgaggcctactgcgacgggcactaccggtacgacccggcggagaagaaccggcccttcgacgtgcacttctcctggatcttcgcgccgtggcaccgcatgtacatctacttctacgagaaggccctcgggcagctcatcggcgacgacaccttcgcgctgcccttctggaactgggacgcgccggcgggcatggggatcccggccatcttcaaggacgacgactccttcgccaacccgctctacgacccctaccgcgaccagacccaccgcgacgccctcatcgacctcgactacatccactcccccaaagacgtgccccccatccccttcgtgcgcacgccggcgaccgccgcagcctacgatgaggccgtgcagaagaacctctgcaccatataccagcagcaaatccggggaggcaagggcgcgcgggcgtacctcggggagaagctgtgcagcgaggcgagcgtccgggtgaaggagatgaacgagcggtcgaggaggaggcaggaggacgggcagcagatcaagccgaacccgacggcgagccagggcacgctggagcggatggcgcacaccgccgtgcacgtctgggtggggcggccggaccccaagggcggctgcgcgaccctcgccggcggcgccgtgctggggcacgacggcaagccgcactgcggcaacgacatgggcttcctcggcacggcggcgcgggacccgctcttctactcccaccactccaacgtcgaccgcatgtggcacctctggtccaccaagctcggcggcgccgccgccggcttcgacgacccggagtggctcgacgccagcttcgtcttctacgacggcgtcgagaggccgcggccggtgcgcatcaggttccgcgacgtgctcgacacgcgcaacctcgggtacacctacgacgacgagtcggagaaagcggcgctcccgtggctcgacagcaggccgacccggctctcccccggcggcagcaagaagggtgggtcgtcgtcgagcagggcggcggcggcgccgccggagttcccggtgaccctgcgcggcggcgaccaggccgtggtggtgccgggcgtggccgtgccggcgagggaggcggggaaggagctggtgctggtggtggagggcatcgagtacgacccccggacgagcaacaagttcgacgtggccatcaacgtggccggggaggacgccctcaaggtgggcccgcagtgcagcgagtacgccggcagcttctccgccgtgccgagctccaaggcggacggcgggacgctgctcgggaaggtcagcctcttcgtcgacggcgtgctggccgacctcggactcggagcgggcggcaacgccaccgtcgacgtcgtgctcgtgccgcgcacggcgggggaggtgaaggtctaccttccgccgacgatccagactgcgtgacatgtcgtcaccggtgtccgcaaaaataaatcgccttgcagtagtttgctcgtgacatttgtattatatactaggcaattatgtccgtgtgttgctacaaacaaaattggtataagtatcggat

SEQ ID NO: 6716 - protein, 494 aa, Panicum virgatum
  misc_feature: Ceres CLONE 1882899
  misc_feature (50)..(219): Pfam Name: Tyrosinase Pfam Description: Common central domain of tyrosinase
MRALPATHPLSFAAQAAVHEAYCDGHYRYDPAEKNRPFDVHFSWIFAPWHRMYIYFYEKALGQLIGDDTFALPFWNWDAPAGMGIPAIFKDDDSFANPLYDPYRDQTHRDALIDLDYIHSPKDVPPIPFVRTPATAAAYDEAVQKNLCTIYQQQIRGGKGARAYLGEKLCSEASVRVKEMNERSRRRQEDGQQIKPNPTASQGTLERMAHTAVHVWVGRPDPKGGCATLAGGAVLGHDGKPHCGNDMGFLGTAARDPLFYSHHSNVDRMWHLWSTKLGGAAAGFDDPEWLDASFVFYDGVERPRPVRIRFRDVLDTRNLGYTYDDESEKAALPWLDSRPTRLSPGGSKKGGSSSSRAAAAPPEFPVTLRGGDQAVVVPGVAVPAREAGKELVLVVEGIEYDPRTSNKFDVAINVAGEDALKVGPQCSEYAGSFSAVPSSKADGGTLLGKVSLFVDGVLADLGLGAGGNATVDVVLVPRTAGEVKVYLPPTIQTA

SEQ ID NO: 6717 - DNA, 2594 bp, Panicum virgatum
  misc_feature: Ceres CLONE 1882906
  misc_feature: Encodes the peptide sequence at SEQ ID NO. 6718
gtacgggaatcgatagcttgcaagtttcctccttcccctgcctgtgttgcccggtccgctttcccacatcagctccaaatccctgacgccgatggaccccgccgtgtcccccgccggccggcgcgcggccgccatcgcgcggcacctcgccgccggcgcgctccccgttccaccgcccctcgctgccgcggccgcgctgctgggcccctccccttgcctcagctacgcgccgccggagtcggccgagaacgcgccggctttcccgcccacagagctccgtgcgctacttgacgggcaccatctcatggagcgcgactgggtgtttcgcgtcatggaggagagccagctattttgcccgcgtcagcgtggcggcgggagtagggtcttcgtggcgccggattacaacgacgggaaggaggcgcagcgggaggccacgatgcggcgcatcgcgcacctggcgcagcgagatgtgttccgcgggtggctcaccgagcccggagccgaggttgagctccgcaagctcgcgctgctcgagtgcctaggtgtctacgaccactccctcgccatcaagatcggcgtccacttctttctctggggcagtgctatcaagtttcttggaacaaagcgccaccatgacaagtggttgttggccacggaaaattatgatgtcaagggttgttttgcaatgacagaactaggccatggaagcaatgtgcgaggaatagagacaatagcaacttatgattcaaaagcaagagagtttatcataaatactccatgtgaatcagctcagaagtactggattggtggagctgctaaccatgcgacgcatacaatagtcttttctcaactccatataaatgggaaaagtgaaggagtccatgcttttctggctcaaattagggatgaagatggaaatgtattgcctgatatccatatagctgactgtggccataagattggattgaatggtgttgataatggccggatttggtttcagaatatacgtgttcctcgcgagaacttgcttaattttgttgctgatgttttgccaaatgggcaatatgttagcgtgatagatgatccggatcagaggtttgcagctttcctttctccacttacacttggtcgagtaaatattgcagttaactcagtctacatttcaaaggtaggcttagcaattgctgtgagatacggtttgtcgaggagggccttttcattaacaccagatgatcctgaaatgttgttgcttgattatcccagtcaccagcgacgccttctaccactgctagcaaaagtatgtctgatgagcagtgctggtaattttatgaaaaagatgtatgtcaagagaactcctgaaatgagcaaagccatacacatttattctagtgccctgaaggccacactaacttggcagaatatgattacacttcaggagtgtcgtgaagcctgtggaggccaaggtctaaagactgagaaccgcataggaattttcaaagctgaatttgatgtccagtccacatttgagggtgataataatgttctaatgcagcaggtaagcaaagcactttatgctgaatttttggctgcacaaaagaagaagaagccattcaagggattgggattggaacacttaaatggtcagaaccctgttattcctgataagctgacaagtagcatattaaggagctccaagttccagatggacctgtactgcttaagggagagagatttactaaagcagttcacggaggaggtttctctccatctcgcacaaggaaaaagcagagaaaaggctttgatgctgagctaccaacttgctgaagatttagctagagcttttactgagcgtacaatcctccaaatatttttggcagacgagatgaatgttccttctggttccctaaaggaggtgctgctcttgctgaggtctctgtatgttatggtcagcatagatgaatctgtgtctttcttaagatatggatatttgtcacgtgacaacgtagccagtgtgcggaatgaagtcctgaaactgtgcagtgaactcaagccccatgcgcttgctgttgtcagttcttttggaatccctgatgcattccttagtccacttgcttttgactggattgaggcaaatgctctgtcaactgggagccactaatctcagaattccatatagaacccactaagccaggtatcgagtggaagtacaggtggatttgctgcttcctgtcgtttacaaagtttatgataattgttgtgaagtgtatacttggaaacgcagatgctttttcaaaatgggaaggaaatgcagatgctgatccaagatgcaactggagacttcttgaacttgttgtgtagagtagcatgcttcaataagcaaacgtagcttacaggctacagtccatgtaatggagcttccaacagtaattgcttacagagtgatgttaccgctgtttgaacagtaacaaaaaaaataagctggtaatgctgccttcaggaatcaggatgctcaagcagcgatcccatgttcaaattcatgttgatcaaattattgatgcagttataaaggcatcagtatggatatatttgagtac

SEQ ID NO: 6718 - protein, 688 aa, Panicum virgatum
  misc_feature: Ceres CLONE 1882906
  misc_feature (1)..(61): Pfam Name: Acyl-CoA_dh_M Pfam Description: Acyl-CoA dehydrogenase, middle domain
  misc_feature (1)..(147): Pfam Name: ACOX Pfam Description: Acyl-CoA oxidase
  misc_feature (1)..(162): Pfam Name: Acyl-CoA_dh_1 Pfam Description: Acyl-CoA dehydrogenase, C-terminal domain
  misc_feature (10)..(685): SWISSPROT Homolog: EC 1.3.3.6 Acyl-coenzyme A oxidase 3, peroxisomal precursor
MDPAVSPAGRRAAAIARHLAAGALPVPPPLAAAAALLGPSPCLSYAPPESAENAPAFPPTELRALLDGHHLMERDWVFRVMEESQLFCPRQRGGGSRVFVAPDYNDGKEAQREATMRRIAHLAQRDVFRGWLTEPGAEVELRKLALLECLGVYDHSLAIKIGVHFFLWGSAIKFLGTKRHHDKWLLATENYDVKGCFAMTELGHGSNVRGIETIATYDSKAREFIINTPCESAQKYWIGGAANHATHTIVFSQLHINGKSEGVHAFLAQIRDEDGNVLPDIHIADCGHKIGLNGVDNGRIWFQNIRVPRENLLNFVADVLPNGQYVSVIDDPDQRFAAFLSPLTLGRVNIAVNSVYISKVGLAIAVRYGLSRRAFSLTPDDPEMLLLDYPSHQRRLLPLLAKVCLMSSAGNFMKKMYVKRTPEMSKAIHIYSSALKATLTWQNMITLQECREACGGQGLKTENRIGIFKAEFDVQSTFEGDNNVLMQQVSKALYAEFLAAQKKKKPFKGLGLEHLNGQNPVIPDKLTSSILRSSKFQMDLYCLRERDLLKQFTEEVSLHLAQGKSREKALMLSYQLAEDLARAFTERTILQIFLADEMNVPSGSLKEVLLLLRSLYVMVSIDESVSFLRYGYLSRDNVASVRNEVLKLCSELKPHALAVVSSFGIPDAFLSPLAFDWIEANALSTGSH

SEQ ID NO: 6719 - DNA, 1721 bp, Panicum virgatum
  misc_feature: Ceres CLONE 1882920
  misc_feature: Encodes the peptide sequence at SEQ ID NO. 6720
ataacacatatagtatggcttgaatagtatgagctcaaagttgttgccagtgccaccatgacggtcacaactgccatgaccctcaaggtcacacagatttgccaatactggctgctcacctggtccactactaccaccccactcatccactacctttgggcattcttactcctaactgtaatagctgtcaaatatcttatgcaacgtccacgtactgtataccttgttgactatgcttgttttggccccaactcaaactaccgtctcaacccggcctcctgggccgagtctcttcgcttgtttcttgataaagataccatttccttcctagcaaacgtttttagacgctctggccttggtgatgagacttgcctcccctcttcacttagttatatccccccgacctatagtttaagcttagcccgtgaggagacagagatgatcatcttcactgtcattgatgatctattttccaagacatccaacaagcctcatagtgtcgacatactgattgtcaattgcagcctcaccacaatgataccatccatgactgacatgatcataaatagatacaaactgcgtagcgacatccagaacatacaactctctgggatggggtgcagtgcaggactgattgcggttggtctagccagaaacctcttgcaaaccatgccttacggtgcacgtgcgctagtggtatccacagagatcataactggcaactattatgtagggaagaagcgatcgatgcagctgaccaacatgttgttccggatgggaggcgctgccatgctactctcgacttcaagggccaatgctcgattcgagcttacgcacattgtgcgaaaatccacagccgcccaggacagtgcataccattgtgttttccaagaggaagacgacgagggaaacaggggaattgatttgtctaaggaccttgtggccatcgctggtgaggcactcagagccaacatcaccacaattgcccccgttgtgctccaattctctgagcagttatcatttgttctctccttcgttgcgcaaaaggtgttcgtcaaaaaaagtgcaagtacaaagcagtatgttcctaatttcggcttgaaagttgagcatttctgcatacatgctggtgggagagctgtgatcgatgcagtccaacgcagcctcaacctgtccgacgagcaggttgagccgtcgaggatgacactgcatcgatttggaaacacatcgagcagctcactatggtatgagatggcgtattgtgaggccaagcaactgatgcggaagggggatcgagtttggatgattgggtttgggtctggatataagtgcaacagcgctgtgtggaagtgcattctaccagctcgtggggctgactcggcatgggcaaactgcatccatcgttacccaatggatgtcacaaaacaagtctctgtctaaggatgccctgacaaaaagttaataatgtcgagtacttttcagcgggaggaacaatatataatgatattttggggcatgttctcttaagcatgctgcggtcttctatgtcacccaaattgtcggagtaatcatgcaccattttttttttctagatatgtaaatgtagcatgtagcagatgcatggacatgttgcaactacggtgttgatatttgtatttcccatctaaattaaaggcaataagataagtctgaagttttcagaaaaaaaaaaaaaaaaaaaa

SEQ ID NO: 6720 - protein, 460 aa, Panicum virgatum
  misc_feature: Ceres CLONE 1882920
  misc_feature (1)..(293): Pfam Name: FAE1_CUT1_RppA Pfam Description: FAE1/Type III polyketide synthase-like protein
MTVTTAMTLKVTQICQYWLLTWSTTTTPLIHYLWAFLLLTVIAVKYLMQRPRTVYLVDYACFGPNSNYRLNPASWAESLRLFLDKDTISFLANVFRRSGLGDETCLPSSLSYIPPTYSLSLAREETEMIIFTVIDDLFSKTSNKPHSVDILIVNCSLTTMIPSMTDMIINRYKLRSDIQNIQLSGMGCSAGLIAVGLARNLLQTMPYGARALVVSTEIITGNYYVGKKRSMQLTNMLFRMGGAAMLLSTSRANARFELTHIVRKSTAAQDSAYHCVFQEEDDEGNRGIDLSKDLVAIAGEALRANITTIAPVVLQFSEQLSFVLSFVAQKVFVKKSASTKQYVPNFGLKVEHFCIHAGGRAVIDAVQRSLNLSDEQVEPSRMTLHRFGNTSSSSLWYEMAYCEAKQLMRKGDRVWMIGFGSGYKCNSAVWKCILPARGADSAWANCIHRYPMDVTKQVSV

SEQ ID NO: 6721 - DNA, 1826 bp, Panicum virgatum
  misc_feature: Ceres CLONE 1882921
  misc_feature: Encodes the peptide sequence at SEQ ID NO. 6722
atcacagaaaaggattgcccctgctttctctggtgtggatgccacggacgcttcaggcgccccacaatatttcgacattggacttaatacttggcaatctttgttgtactgcacgttgcagatttcactaccttgctgcttcaaccaaggacgtttcttcttttctaactacaaccagaccttttccttcttcatttccaattttgtatctctttattatctattctatatcttactactaaaagaggaccgcaatattctccctatggccaagacatcgcttcctcctggattccggtttcacccaactgatgtggaactcaccgtctactatttaaagaggaagttgttgggaaaacatttacgctgcaatgctattacagagattgatctatacaagtttgctccttgggatcttccagagaaagcttccttggagagtaatgatctagtgtggtatttcttttgcccacgcgataggaaatattctagtgggttaagaactaaccgatcaaccggagtcggatattggaaagctactgggaaggacaggccggtgttttataattctagaactgttgggatgaagagaactttggtgtttcatcttggcaagccaccacggggtgatagaactgactgggtaatgtatgaatataggctggaggatgaggaactagttgcttctggtgttaagctggatgcctgcgttctttgcaaaatttttcagaaaagtggtccaggacccaagattggggcacaatatggtgctccattcaatgaagaggactggaatgatgccagcaatgcggagtgttcaccatttgcatcttctaaggccccttgtgcacctgaatcaagtcatggtgggttgaactctgctggtcaacacctggctgtgagttatgatgacaaggtttctttgcccctcttgtcagaaagcaacaacgaacatgctgtcaatcatgttcatccttatagaccttcttccaatatacctatcgatagcatacacatacagctgctagctgagatcatcagatgtccctcaacaaatcttcgatgtactgctgctgaagatggttcactgcctgattcaactgctggtcatgatgatgatggagaatcaggggatgatattgaaacaatattctgtggagtggatgagcttgcgtctcagcctttggtgaacaactctaaccattgtgactcgtgtgaacacttgattcaccgtatgccggaagcacgaggaactgaacaatacttggagctaaatgacctatccttttctcttgctgagggccctgattcccgtggcatgctgttgtccaatgaaatatctgttgagcaaccgcttgatcttgagcccaggtttgagcgagactctttgggctgcatctccaatactgttaatacttccacatcgacagctgatggttcatttccttcagcgtgcgcggttgatgtgcatggaacctgattcagagtgagttgtcaaagctcgcattttagtggagtcttttcaatgaagtgagcactatgctgttgagaattcgggacatgaaggcaggtccccagctgacaccatgagtcatctttgttatgcagctactggttgaatagcctcaacccaggagcattcctctgtcatccctagtcccgcaccgtggcaatgggctcggcatgaataatgcactcctaatgtaatttttcatcttttagctagagtggggtacctgcagctgttgtgatgtagtaacatgtgctggtttcgtttcatggaatggatttgttagcaacttttgcaaaaaaaaaaaaaaaaaaaa

SEQ ID NO: 6722 - protein, 404 aa, Panicum virgatum
  misc_feature: Ceres CLONE 1882921
  misc_feature: The sequence is a functional homolog of  SEQ ID NO 582 in the  10/666,642 US patent application
  misc_feature: Useful for making plants with modulated growth and phenotype characteristics
MAKTSLPPGFRFHPTDVELTVYYLKRKLLGKHLRCNAITEIDLYKFAPWDLPEKASLESNDLVWYFFCPRDRKYSSGLRTNRSTGVGYWKATGKDRPVFYNSRTVGMKRTLVFHLGKPPRGDRTDWVMYEYRLEDEELVASGVKLDACVLCKIFQKSGPGPKIGAQYGAPFNEEDWNDASNAECSPFASSKAPCAPESSHGGLNSAGQHLAVSYDDKVSLPLLSESNNEHAVNHVHPYRPSSNIPIDSIHIQLLAEIIRCPSTNLRCTAAEDGSLPDSTAGHDDDGESGDDIETIFCGVDELASQPLVNNSNHCDSCEHLIHRMPEARGTEQYLELNDLSFSLAEGPDSRGMLLSNEISVEQPLDLEPRFERDSLGCISNTVNTSTSTADGSFPSACAVDVHGT

SEQ ID NO: 6723 - DNA, 1977 bp, Panicum virgatum
  misc_feature: Ceres CLONE 1882945
  misc_feature: Encodes the peptide sequence at SEQ ID NO. 6724
aaaacgctcagacgctctcgctcccatcactctcactgtctcacagcctcactcactccccagctcgctcgctccccatttcgcttcgccgtacgaccaagctcacccttggctccaccggcgggcgcagcagagcagggcgggatgccggccggcgtggtggacgcggccgccaagggcgtcaggctggagcggcacgcggcgggggccgccgtgctgctgcggcgcgcgtcgggcgccaagcagctcgcgtcggcgtcctcgcacctgctcttccgcgccacggtcctcgccacgctcgcgctcgtcgtcctcttcgccgtgcactacccgtccctgctctcgcgctccttcagcctctccgccgcgccatcgtccggctcgccgtccgcggcggcggcgcggtcgcggccgtcgcaccggagcctgctgggctcgggggcctcgtacgggggcgccgcgtgggagcgtgaggtgcggcgcagagccacgccgcggcgggacgggggcctgtccgtgctggtcaccggcgccgcggggttcgtgggcgcgcactgctccctggcgctccgcgggcgcggcgacggcgtgctcggcctcgacaacttcaactcctactacgaccccgccctgaagcgcgcgcgccagcgcctgctcgcgtcgcgcggtgtggtggtgctcgacgccgacatcaacgacgccgcgctgctcgagcggctcttcgccgcggcgccgttcacgcacgtgctgcacctcgccgcgcaggcaggggtgcggtacgcgatgcaggcgccgcagacgtacgtggcctccaacgtggcggggctggtcagcctcttcgaggtcgcggccaagcacgccgacccgccgccggcgatcgtgtgggcgtcgtcgtcgtcggtgtacgggctcaacaccgacgcgcccttctccgaggagcaccgcacggaccggcccgcgtcgctgtacgccgcgaccaagaaggccggcgaggccatcgcgcacgcgtacaaccacatctacgggctctccatcaccggcctccgcttcttcaccgtctacgggccgtggggccgccccgacatggcctacttctccttcgcccgcagcatcgtcgccggcgagcccatcacgctcttccgcaccgccgacggcgccgacgcgcgccgcgacttcacctacatcgacaacgtcgtcaagggatgcctcggcgcgctcgacacggccggcaggagcacgggcgacaagtccggcaagaagcgcgggcctgcgcccctccgcgtgtacaacctcggcaacacctcgccggtgcccgtcacccgcatggtcgccatcctcgagaagctcctcggcaagaaggcgaacaagcgcgtcgtcacgatgccgagcaacggcgacgtgccgttcacgcacgccaacgtcacccacgccgcgcgcgacttcggctaccgcccggccacctcgctcgaggccggcctccggcatttcgtcgactggttcgtgcagtactacaagctcgacatcaagggcagcaatgtcctcgccggcaagaccaccaagaagaaatcaatggccatgtctgcagcatcatgaggtgtcgaggtgccgccgccgccgccgtggcgtgttccccggtccggccgtccaccactaagtgtgcattctcttgtccttggaggttagctaggagagccctgtaactttgtaagtgcttatttgtttaagccttgctgctttgcgtcttcatgatgctgccatggtagtgcttagtggcaaggaaaaggatccatggccaaattaagcttaagaaaaagtagaaaaaaaaggagggtatgggatagatagacaacagagcaaagcaaaggacagccatggctgagcaaagatgaggtcattggcatccttttggttcagattattctgctcagattattactattttttggtcagatactagatttcactgacctatgaatc

SEQ ID NO: 6724 - protein, 482 aa, Panicum virgatum
  misc_feature: Ceres CLONE 1882945
  misc_feature: Great-hit functional homolog of the protein sequence encoded by LOCUS At3g23820
  misc_feature (1)..(260): Pfam Name: Epimerase Pfam Description: NAD dependent epimerase/dehydratase family
  misc_feature: Useful for making plants with altered cell wall content and/or composition
MPAGVVDAAAKGVRLERHAAGAAVLLRRASGAKQLASASSHLLFRATVLATLALVVLFAVHYPSLLSRSFSLSAAPSSGSPSAAAARSRPSHRSLLGSGASYGGAAWEREVRRRATPRRDGGLSVLVTGAAGFVGAHCSLALRGRGDGVLGLDNFNSYYDPALKRARQRLLASRGVVVLDADINDAALLERLFAAAPFTHVLHLAAQAGVRYAMQAPQTYVASNVAGLVSLFEVAAKHADPPPAIVWASSSSVYGLNTDAPFSEEHRTDRPASLYAATKKAGEAIAHAYNHIYGLSITGLRFFTVYGPWGRPDMAYFSFARSIVAGEPITLFRTADGADARRDFTYIDNVVKGCLGALDTAGRSTGDKSGKKRGPAPLRVYNLGNTSPVPVTRMVAILEKLLGKKANKRVVTMPSNGDVPFTHANVTHAARDFGYRPATSLEAGLRHFVDWFVQYYKLDIKGSNVLAGKTTKKKSMAMSAAS

SEQ ID NO: 6725 - DNA, 3311 bp, Panicum virgatum
  misc_feature: Ceres CLONE 1882998
  misc_feature: Encodes the peptide sequence at SEQ ID NO. 6726
gatgatgatataggatttacaatagagagggagagagagagggaggtgtgcagtagtaatggagtttgctctctgataggccgcggctaagcaccaaaccttggggaattggagcggcgcggtggcgcagcggcagcttggggaagcggaggctcgcgagcagccagaggagaggagcactagccattacccatcagatcagctcagcgctaccctacactgacatccatcgatccgatcgcgctgccgcgcagtgcggccaccgcgtgtgtacaaaaggccgtgaaggcggtaagagaccgggcaggccagccagccagccaggtaaagaaaggcgtgaggcagaagcgagaagcccgtgagctcctgcggtgcggtgtgcaggggagcgacgagggtttcgtctcgtctcacccctccccctggccggcgcggccatggacgcctacgaggcgaccaaggtggtgttctcccggatccaggcgctggacccggaccacgccgccaagatcatgggcctcctcctcatccaggaccacggcgagaaggagatgatccgcctcgccttcggcccggagtcgctgctccacgccgtcatggccaaggcgcgcaaggacctcggcctgctcctcccggcctcgcccacctccgtcgccgccgcgggccacgtgccgttcctgcagctcccgcgccagaactccggccgcgccggcgcgccgtctccgctatcggtatcctcgccgtcgtcgtgggcgcaggcgccggccttctcgaggagcaacagcacgagtaataatggcgccgcggaggaggcggcgggggctggggatgagctgcctagtcccgtgaacggtggggcggcgcccttctttcctcaccagggcggggacgcgctcctggacgatttgcagctgcaggagcagctcgcgttcctcaacgagggcggcgtgagccccgcgcaccagctcccggggctcgacgccggcgagtgctggagccccggcccgggcgatggcggcgggatgctcccgttcggcctcgggtggtccaacggcggccccgtgcaccgccggagcgcgtcggtgaacgagctctgcctcggcgggggcggcggcggtgacggattcgggtggaagccctgcctctactacgctcgcggcttctgcaagaacggcagcagctgcaggttcgtccacagcggcctccccgacgacgcggccgcgctcgccgccaccaagatggaagccaccgccgatcagcagcagcagcagcagtgccaggacttcctccgctccaagagccagcgcctcggccccgccgccttcccctactcccccaccggctccctcccaggctcgccctccgccgccagcaagtgcctcagcttcctgctgcagcagcagcagcagcaacaacagcacgacagagccgccgcggccgcggcgctgatgctgggctgcggcgacgacgcgcacaagttcatgggccgcccgcgcctggaccgtgccgacttcgcgagcatgatgagccccggctcgcgccagatttacctcaccttcccggccgacagcacgttccgcgaggaggacgtctcgaactacttcagcatctatggcccggtccacgacgtgcgcatcccctaccagcagaaacgcatgttcgggttcgtcaccttcgtgtacccggagacggtgaagctcatcctggccaagggcaacccgcacttcatttgcgacgcgcgcgtgctcgtcaagccctacaaggagaagggcaaggtcccggacaagtacaggaagcagcagcaaggggacttctccgggtgcacgacgcccaccgggctagacggtagagacccctttgatctccaccaactcggtgcgaggatgctgcagcactcgaacagcgccaatgagctgctgttgcggcgcaagcttgaggagcagcagcaggccgctgagcttcagcaggccatagagctccagaaccgccgcctcatgggccttcagctgcttgatctcaaggcacgcacagctgcgtctgcgacatcgtcgccactgcccacaccaattgcaaattccttttcttctggccaacccgtgagcaccaccgcagtcgagtcgccaccggagtgcggggagcagctcaagttcagcggtggctttgctctagaggggaaggtcaacggtgctgataaggaggaacctgctggcgaggcgagcccgaacgctgccgatagcgaccaaagtggagaacacaatttgccagacagcccattcgcttccccgaccaagtctgcttcatttgcgcatgagagcttcccatctgccgagactgagaacgccgcatcccgtatgggtgcggactctagcagcaacaccgacggcggtggtaaccatctccgtccccccacgttggacattccttcgccgaggccctacttcttccccatgcacaggctctcctccgatcacggagctatggggttgtaaagttcaccattggagcctaatcatagaatacaacaagccaagaaaagcgatggtggaatatagggaaaaaaggagtgaagtgtcagcatagtgtttgttccctttcttttgttcttagtccactctttttagtggatagctctactaaaccacaagagaagatgccattagccttgattaagaaagcggcggcatatgaagtattgctagatatatataatatatatatatacaagtaatccagtgttacccctagttattagaagacatatatactactagttgtccttagttttaccagtcgctgattccatcagcacaaatgattttactgttccaagatccttgatgtactctgcaactacagccacctctactaggtttactaaatcgtgaggttaatccacaatgctggtaccagccaacagccacaggtctcatgtaacaccagtacagctacagcctgctgcaagctgcagatattgtatacaggggcggcccagggactggagaaggagcacatggccatggcagtgatctgtgaggtattttaactgcaagatcccaagccattccgatggagtatattacagcagctgtgtgagatctcatatgtctataatcttcagtcgctccctgtgtttatgtctccaagtatcaacccctgatcagcacaggcaagtcgctacaaaatatgtgattattttgcttttgttcccatctggttgagtggatcccacatcccagtgtagttgacacctctacagaaagaatgaaagtaaagtgagaaagaaaatttcggaaaaaaaaaaaaaaaaaaaa

SEQ ID NO: 6726 - protein, 683 aa, Panicum virgatum
  misc_feature: Ceres CLONE 1882998
  misc_feature (2)..(26): Pfam Name: zf-CCCH Pfam Description: Zinc finger C-x8-C-x5-C-x3-H type (and similar)
MDAYEATKVVFSRIQALDPDHAAKIMGLLLIQDHGEKEMIRLAFGPESLLHAVMAKARKDLGLLLPASPTSVAAAGHVPFLQLPRQNSGRAGAPSPLSVSSPSSWAQAPAFSRSNSTSNNGAAEEAAGAGDELPSPVNGGAAPFFPHQGGDALLDDLQLQEQLAFLNEGGVSPAHQLPGLDAGECWSPGPGDGGGMLPFGLGWSNGGPVHRRSASVNELCLGGGGGGDGFGWKPCLYYARGFCKNGSSCRFVHSGLPDDAAALAATKMEATADQQQQQQCQDFLRSKSQRLGPAAFPYSPTGSLPGSPSAASKCLSFLLQQQQQQQQHDRAAAAAALMLGCGDDAHKFMGRPRLDRADFASMMSPGSRQIYLTFPADSTFREEDVSNYFSIYGPVHDVRIPYQQKRMFGFVTFVYPETVKLILAKGNPHFICDARVLVKPYKEKGKVPDKYRKQQQGDFSGCTTPTGLDGRDPFDLHQLGARMLQHSNSANELLLRRKLEEQQQAAELQQAIELQNRRLMGLQLLDLKARTAASATSSPLPTPIANSFSSGQPVSTTAVESPPECGEQLKFSGGFALEGKVNGADKEEPAGEASPNAADSDQSGEHNLPDSPFASPTKSASFAHESFPSAETENAASRMGADSSSNTDGGGNHLRPPTLDIPSPRPYFFPMHRLSSDHGAMGL

SEQ ID NO: 6727 - DNA, 2316 bp, Panicum virgatum
  misc_feature: Ceres CLONE 1883062
  misc_feature: Encodes the peptide sequence at SEQ ID NO. 6728
gtgagcttagcggagcaattccccacccctcctcgccgccgccgccgcccccaccgcagccaccaactccaccgcatccgtagccatattcaccggccgcgactgccgcggcgaccggtgccccctatgcgcccagttcccacggcgcgccgtgggcctgctcgcgcgtgccccgtccctgggcgtgcgacggtggcgtggagataggaaaggcgcgagcttagggaattctgacctcgccggcggggggcaagaggcgcgggagcgcgtggccgaggtgggctcctcgcccgccggatggccgccgatgacgcggcgcggagcagcagacggatggatctgaacctctacctcggcctcccccgcgcgccgcgcgcccgccgccccgatctcggctccgacctcgcgctcggcaccccgatgctgtcttcgtcgtcgccctcctcctcggccgcatccgcggacgcgccgccgccggagggcgagccgttccacccgccctactcgccgtcccgcgccgacctggtgcgcccgccgaccccggcgcacgagccctacgacccgttcgcgcccgaggctatcccgccctacatgcctccaccgccccttccggttccaggggcgttacctgtgcttgccgatgagcttgagtttggtttctccgacgcgcacctgggtctggtcgagcggttagcagaccgaccgtcgtcgtcgacggcatcctcttccttccgcccggatcgtgccgagcgcttccgccgcttgatgtgcttgactgggtctcgctacatccggccaagaagattccggtcagaccttccacctctcagctcagaggcccctagcctggagaatgatgctgcaccacaacaacctgaaccggaagagcccgtgcatgatactgtggaggagaacaaggtggttgccgatggcgctgttgtgggagtctcagaggacgagggagccgagcatggtaagagtgccgcaatgttcgagtgtaatatctgctttgaaatggctgctgagccagtggttacctcctgcggccatcttttctgctggccatgtttatatcagtggttgcatgtccactacagtcataaggagtgccctgtctgcaaaggtgaggtgactgaagggaacattactcctatctatgggagagggaattcaggctcggatgtggagaagaaggtttcggaggatgggaatgcatctggccccaagattccaccgaggccgcatgggaatcggctagagagcttccggcagcaattccaccatttgcgacccatatctagaaggcttggtgaggcacatggttttttgtctacgtggaggcgcattcttgatcagcatttaatgaatagcgtgagtagatttgaagggccttctgaagcagctgcccatgaaattcctcagaatgcaagccgttttagccgaatgactactaggttgagagcaaggaggttgcaaagagaagcggaaaaccttacatccattatttcatctgctccaggtagtgttgggctgcatggaaacaatacatccgatctgccaaggcgcactttaagcccatttcctccagaagggatggatttattgcgagacttagacttttctgaccttgatgactcggaaaggtttgtgactgctttcagtgaacttaggcgaattgcaaggccaagccattatggggcatcaacctcatcaaacccaccaaatcctgaacctgctgatggaactcatattgtcacgggactggctgcagatcaagcttctaattcaagcaccatggctgtgattcaggaagatgcggcttttactgaaagcgctggggaacctagtaatgcagggtcttcaagatccctgaggaggaggagaggaagtgatgccttaggttctttggatgtagatggtggggacctacatcagaacaagagaagacgcctaaactaaagctgaagacagctgaattgaagcctccaggtggcagcattcttctcatatgcttgatgtgctgttctcagtttagccttttttacctctttggtaggtaatatctactcggtatgaagttcttcctcttctactagtttactaggtagagcggagctggttgccttagttccttccaacgatttgtgcgatcattcaaggcatgcatactgaggaaacctgacggttgtgatcagatgaattttccttgatagtaaattgtatgtgcagatctgtactttccttgatagtaaattatatgtgcaaatctgtactcaatgaaatcaatcactagttcaaaaaaaaaaaaaaaaaaaa

SEQ ID NO: 6728 - protein, 553 aa, Panicum virgatum
  misc_feature: Ceres CLONE 1883062
  misc_feature (1)..(41): Pfam Name: zf-C3HC4 Pfam Description: Zinc finger, C3HC4 type (RING finger)
  misc_feature: The sequence is a functional homolog of  SEQ ID NO 2412 in the  10/374,780 US patent application
  misc_feature: The sequence is a functional homolog of  SEQ ID NO 496 in the  10/412,699 US patent application
  misc_feature: The sequence is a functional homolog of  SEQ ID NO 766 in the  10/666,642 US patent application
  misc_feature: The sequence is a functional homolog of  SEQ ID NO 767 in the  10/666,642 US patent application
  misc_feature: The sequence is a functional homolog of  SEQ ID NO 982 in the  10/225,066 US patent application
  misc_feature: Useful for making plants with modulated growth and phenotype characteristics
MAADDAARSSRRMDLNLYLGLPRAPRARRPDLGSDLALGTPMLSSSSPSSSAASADAPPPEGEPFHPPYSPSRADLVRPPTPAHEPYDPFAPEAIPPYMPPPPLPVPGALPVLADELEFGFSDAHLGLVERLADRPSSSTASSSFRPDRAERFRRLMCLTGSRYIRPRRFRSDLPPLSSEAPSLENDAAPQQPEPEEPVHDTVEENKVVADGAVVGVSEDEGAEHGKSAAMFECNICFEMAAEPVVTSCGHLFCWPCLYQWLHVHYSHKECPVCKGEVTEGNITPIYGRGNSGSDVEKKVSEDGNASGPKIPPRPHGNRLESFRQQFHHLRPISRRLGEAHGFLSTWRRILDQHLMNSVSRFEGPSEAAAHEIPQNASRFSRMTTRLRARRLQREAENLTSIISSAPGSVGLHGNNTSDLPRRTLSPFPPEGMDLLRDLDFSDLDDSERFVTAFSELRRIARPSHYGASTSSNPPNPEPADGTHIVTGLAADQASNSSTMAVIQEDAAFTESAGEPSNAGSSRSLRRRRGSDALGSLDVDGGDLHQNKRRRLN

SEQ ID NO: 6729 - DNA, 1687 bp, Panicum virgatum
  misc_feature: Ceres CLONE 1883185
  misc_feature: Encodes the peptide sequence at SEQ ID NO. 6730
aacccagcaccgagtcaccaaccacgcacccgccactgtctccgactggccgctctcccgccatgatgaagcagctccacaagtcatccccgacccacgcgccgtcgccggcgcacgctccggcgccgaaggccgccaagccggcgcgccccggcccgcgctcctggatcgggtacctcctccgcgagcagcgcctcctcttcgtcctcctcggcgcgctcatcgcctccaccttcttcctcctccggccctacctctcgctctccgcatcctcccacctccccgacgcccgcccgctcttctccttcgccgcccgctccggcgtccccgccgggttccgcccgccgccgcgccgggtcgtcgtcaccggcggggctgggttcgtcggcagccacctcgtggaccggctgctggagcagggcgacagcgtgatcgtggtcgacaatttcttcacgggcaggaaggagaacgtcgcgcaccacctccggaacccgaggttcgagctgctccgccacgatgtcgtcgagccaatcctcctcgaggtcgaccggatctaccacctcgcgtgccccgcgtcgcccgtgcactacaagtacaacccaatcaagacgatcaagacaaatgttatgggtaccttgaatatgttgggtctggcaaagcgaattggcgcaaggctcttgttgactagcacaagtgaagtttatggtgatccacttgagcatccgcagaaggagacttactgggggcatgttaatcctataggtgttaggagctgttatgatgaggggaagagaacagcagagacgttaaccatggactatcaccgtggtggtggtgttgaggtgcgtattgctcggattttcaatacatatggtcctcgtatgtgccttgatgatggccgtgtggtcagcaattttgttgcacaggcgctacgtagacaaccaatgacagtttatggtgatggaaaacaaactcgaagtttccaatatgtttctgatctggttgctggactgatggctctcatggagagtgatcatattggtccgtttaacttgggaaacccaggagagtttaccatgttggagctagcacaggttgtgaaggaaacaattgatccaatggcaaccattgagttcaaacctaatacggctgatgatccccatatgagaaagccagatatcaccaaggccaagcaactgttacattgggagccaaaggtctctctcaaggaaggccttccgttaatggtgacagacttccgtcaaaggatctcggatgagtaaccaaagaaatgttgtgatattggtgccccatttgattcgaatgatgctgcgagaagctcttcaccaactgtagccacacagtacaatttactgtatacatgatagattctgtagaatctaggccccatttgaactatggggatccggtagtttttctatgggaatagcacttttccctgtgaaatagctgcaaaggtcatgtgaaattcatatattaaatttatttgtgccttggtgagacagtacagaagtagccagttattttttgtgcacgtgtggaagaattctagatgtggtcgactggtcggtgagaggtaggatataacgttgtatttcgtgatgttctgtaacacgacattatggattcttgattttgtgaagaatgtaactgaatgtgttttgcc

SEQ ID NO: 6730 - protein, 406 aa, Panicum virgatum
  misc_feature: Ceres CLONE 1883185
  misc_feature: Great-hit functional homolog of the protein sequence encoded by LOCUS At3g53520
  misc_feature (1)..(234): Pfam Name: Epimerase Pfam Description: NAD dependent epimerase/dehydratase family
  misc_feature (97)..(403): SWISSPROT Homolog: EC 4.1.1.35 UDP-glucuronic acid decarboxylase 1
  misc_feature: Useful for making plants with altered cell wall content and/or composition
MMKQLHKSSPTHAPSPAHAPAPKAAKPARPGPRSWIGYLLREQRLLFVLLGALIASTFFLLRPYLSLSASSHLPDARPLFSFAARSGVPAGFRPPPRRVVVTGGAGFVGSHLVDRLLEQGDSVIVVDNFFTGRKENVAHHLRNPRFELLRHDVVEPILLEVDRIYHLACPASPVHYKYNPIKTIKTNVMGTLNMLGLAKRIGARLLLTSTSEVYGDPLEHPQKETYWGHVNPIGVRSCYDEGKRTAETLTMDYHRGGGVEVRIARIFNTYGPRMCLDDGRVVSNFVAQALRRQPMTVYGDGKQTRSFQYVSDLVAGLMALMESDHIGPFNLGNPGEFTMLELAQVVKETIDPMATIEFKPNTADDPHMRKPDITKAKQLLHWEPKVSLKEGLPLMVTDFRQRISDE

SEQ ID NO: 6731 - DNA, 3050 bp, Panicum virgatum
  misc_feature: Ceres CLONE 1883216
  misc_feature: Encodes the peptide sequence at SEQ ID NO. 6732
gtagctcgcgcgcacagactactggtccaaaaggaaaacacgccggaacaactcctccgaccctcgctcgccgcagctgacgcgagctgtcttgaccgggagcgatttctttccttttctcttcccgtgcgccaaccttaactgctccgatcaatcgatcgagttccagccccgcagcacatggcgccgccggcgatggagatgctggggaggtccttcttgccgggcccggcgggcgcggcgggccgggagcacggaggcgggccctgcttcgccgcggtcgggcgggaggggaggaggagggggccgctgcggtcggcggcgccggtgggggcgctggccgagcgggccgtcgtgacgccggcgccggcggagagggccggggcggctgcggccccgccggaggagccgccgcacccgcggaccgtcgcggcgcgggccgtggtcaccgtgcggcggtggcgcaaggaggacgccaagcgccggctcgccgagcagctggacgcctacgccgacagggtcggctggagcgtcctcctcgagctcgtcagcacggagatcgacccaggaaatgggggccccaagaagagcgagccgtcggcgctggtggggtggttcgagaagaaggacgtcaaggcggagcgggtggtgtacacggcggacttcgccgtcgacgcctccttcggcgagcccggcgcggtgaccgtgctcaaccggcaccggcgggagttcttcatcgagagcatcgtggtcgagggcttcccctccggcccggcgcacttcacctgcaactcgtgggtccagcccgaccgcgccccgcgcgtgttcttcaccaacaggccgtacctgccggacgagacgccgccggggctccgggagctccggcggcaggagctcagcgacctcaggggcgagggcgccgccgccgccgcgggcggcgagcccaggctcaccgaccgggtgtgggagtacgacgtgtacaacgacctcggcgaccccgacaagggcgccgagttcgcgcgccccgtcctcggcggcgaccggctgccgtacccgcgccggatgcggacgggccggcccaagaccgtcacagacgatggcgcggagagcagggtggagtacccggagcccatctacgtgtcgcgggacgaggagttcgaggagggcaaggacgagatgctgtcggagggcgcgctcaaggcgctgctccacaacttcatgccgctgctggtgagctccgtgtcgccggacatccgcgacttcgccggcttccacgacgtcgacaacctcttcaaggagggcctccggctgaagcaggcgctgcaggaccagctgttccagaagatccccttcgtgcgcaagatccaggagaacagcgagggcctcctccgctacgacacccccgacatcatcaagaaggacaaattcgcgtggctgcgcgacgacgagttcgcgaggcaggcgctggccggcatcaaccccgtcaacatcgagcgtcttcaggcgttcccgccggtgagcaagctggaccctgccctgtacggcccgccggagtcggccctcaccgaggagcacatcgccgggcagctggacggcatgtcggtgcggcaggcggtggaggacagccggctgtacatgctggactaccacgacatcttcctgccgttcctggaccggatcaacgcgcaggacggacgcaaggcctacggcacgcgcacgctcttcttcctgacggccgcgggcacgctcaagcccatcgccatcgagctcagcctgccgcccatgaccgacggctgcaagcgcgcaaagcgcgtgttcacgccgcccgccgacgccaccagcaactggctctggcagctcgccaaggcgcacgtctgctccaacgacgccggcgtccaccagctcatcaaccactggctgcggacgcacgcgtgcgtggagccgttcatcatcgcggcgcaccggcagctgagcgcgatgcaccccatcttcaagctgctcaagccgcacatgcggtacacgctcaagatcaacgcgctggcgcggcagatcctcatcaacggcgacggcgtcatcgagtccggcttcacccccggccgctactgcatggagatgagcgccttcgcctaccgggagctctggcgcctcgaccaggagggcctccccgccgacctcatcagaagaggcatggccgtggaggacccgacccagccgcacggcctccggctgctgatcgaggactacccgtacgccgccgacgggctgctgctctggtcggccatcacgcggtggtgcggcgcctacgtcgccatgtactacccgtccgacgagtcggtgcgcggcgacgccgagctgcaggcgtggtacggcgaggcggtgcgggcggggcacgcggacaagcgcgacgcgccgtggtggccgcgcctggcgtcgccggcggacctggcgtcgctgctggcgacgctggtgtggctggcgtcggcgcagcacgcggcgctcaacttcgggcagtacccgctgggcgggtacatccccaaccgcccgccgctgatgcggcggctggtgcccgccgagggcgacccggagtacgcgcacctggtggcggacccgcaccgcttcttcctctcggcgctgcccagcctgacgcacgccgacaccggccgccgcaaccgctgtggtgccggagtgctgccgtacgagctcatggcgcccacgtccgggccagggatcacctgccgcggcgtccccaacagcgtcaccatttagtctccgtacggacagcggcagccatgggcggataataataacagagatgattcggaagtggattttttttcccctggcgaggagaaatctaggcggaagaagcagatgattttagccataattctcccccgttaatttgggtttcggaatccgaataggaggaacttgattttgacatggggtgggaggaattgatattgtagagggagtggggtgtaaataacacaatcaattgaatatagtcatataatatagagttctctcaaaaaaaaaaaaaaaaaaaa

SEQ ID NO: 6732 - protein, 861 aa, Panicum virgatum
  misc_feature: Ceres CLONE 1883216
  misc_feature (1)..(590): Pfam Name: Lipoxygenase Pfam Description: Lipoxygenase
MAPPAMEMLGRSFLPGPAGAAGREHGGGPCFAAVGREGRRRGPLRSAAPVGALAERAVVTPAPAERAGAAAAPPEEPPHPRTVAARAVVTVRRWRKEDAKRRLAEQLDAYADRVGWSVLLELVSTEIDPGNGGPKKSEPSALVGWFEKKDVKAERVVYTADFAVDASFGEPGAVTVLNRHRREFFIESIVVEGFPSGPAHFTCNSWVQPDRAPRVFFTNRPYLPDETPPGLRELRRQELSDLRGEGAAAAAGGEPRLTDRVWEYDVYNDLGDPDKGAEFARPVLGGDRLPYPRRMRTGRPKTVTDDGAESRVEYPEPIYVSRDEEFEEGKDEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPVSKLDPALYGPPESALTEEHIAGQLDGMSVRQAVEDSRLYMLDYHDIFLPFLDRINAQDGRKAYGTRTLFFLTAAGTLKPIAIELSLPPMTDGCKRAKRVFTPPADATSNWLWQLAKAHVCSNDAGVHQLINHWLRTHACVEPFIIAAHRQLSAMHPIFKLLKPHMRYTLKINALARQILINGDGVIESGFTPGRYCMEMSAFAYRELWRLDQEGLPADLIRRGMAVEDPTQPHGLRLLIEDYPYAADGLLLWSAITRWCGAYVAMYYPSDESVRGDAELQAWYGEAVRAGHADKRDAPWWPRLASPADLASLLATLVWLASAQHAALNFGQYPLGGYIPNRPPLMRRLVPAEGDPEYAHLVADPHRFFLSALPSLTHADTGRRNRCGAGVLPYELMAPTSGPGITCRGVPNSVTI

SEQ ID NO: 6733 - DNA, 1312 bp, Panicum virgatum
  misc_feature: Ceres CLONE 1883227
  misc_feature: Encodes the peptide sequence at SEQ ID NO. 6734
aagcggcttcaattcattcgcactgcctcatactgttgctcatctgctctccgaattaatctgcccagtgtgttccctcctttgatcctccatggagaagatgctccacctgaccccggcgcacgcgtcgtcgatcccggacggcttcctcctgccggccgaccacctccggccggcgaccgccgccgccgctgtctctcttcccgtcatcgacatgtcccgcggccgcgacgaggtccgccgcaccatcctcgacgccggcaaggagcacggcttcttccaggtggtgaaccatggcgtccccgagcaggtgctgcgggacatggaggcggtgtgccacgagttcttccagctgcccgcggcggacaaggcggagttctactctgaggacaagagcaagcccaacaggctcttctccggcaccaactacgagaccctcggcgagaggtactggcgggactgcctccgcctcgtctaccccttgccctccggcgacaccaaggactggccgcacaagccgcagaggctccgggaggttgtcgggaattacaccgcgctggcgagaggcctggccatggagattctgcgcctgctctgcgagggcatggggctccggccggactacttggagggagacatcagcggcggccgcgtggccctcgacatcaacagctacccgccgtgcccggacccgagcaggacgctgggcctgccgccgcactgcgaccgggacctcatcaccatcctcctccccggcgcggtgcccgggctagaggtcgcctacaggggcgactggatcagggtgcagcccgtgcccaactccttcgtcgtcaacttcggcctgcagctggaggtcgtcaccaacgggatgctcaagagcgtggagcaccgcgccgccaccaactcggcggcggcgaggatttcggtggcgacgttcatcgtgccggcggacgactgcgtcgtcggccccgccgaggagttcgtcggcgagggcaacccgccgcgctaccgcacgctcagggtcggcgacttcaagcgcatgcacaacgttgtcaacctgggctccaagctcaaccaaattaccaacctcaaggccaaccagaagcaggagatatgaagaagcaaattaaaaaccagggcaagtagtccttgacaaggatttgccttgattaagcttcttccatcgtcatgccaagtttatttccatgtctctcaagtgttatctctcgatcggtcacatctccagctgctgagtatgtgatccgtacgatatacgacgatgcaataaaaaacgacatgcaagttgtgtggc

SEQ ID NO: 6734 - protein, 341 aa, Panicum virgatum
  misc_feature: Ceres CLONE 1883227
  misc_feature (1)..(100): Pfam Name: 2OG-FeII_Oxy Pfam Description: 2OG-Fe(II) oxygenase superfamily
MEKMLHLTPAHASSIPDGFLLPADHLRPATAAAAVSLPVIDMSRGRDEVRRTILDAGKEHGFFQVVNHGVPEQVLRDMEAVCHEFFQLPAADKAEFYSEDKSKPNRLFSGTNYETLGERYWRDCLRLVYPLPSGDTKDWPHKPQRLREVVGNYTALARGLAMEILRLLCEGMGLRPDYLEGDISGGRVALDINSYPPCPDPSRTLGLPPHCDRDLITILLPGAVPGLEVAYRGDWIRVQPVPNSFVVNFGLQLEVVTNGMLKSVEHRAATNSAAARISVATFIVPADDCVVGPAEEFVGEGNPPRYRTLRVGDFKRMHNVVNLGSKLNQITNLKANQKQEI

SEQ ID NO: 6735 - DNA, 2296 bp, Panicum virgatum
  misc_feature: Ceres CLONE 1883236
  misc_feature: Encodes the peptide sequence at SEQ ID NO. 6736
gaaaccgcccaaatcaaaccccgcgcgtcgcgagcagcagcaaatggcgagcgtcgccgcgctcctcgcctctccggcgctccttcccttcccctccaccgccttgtccacggccacgtcctcctgctcgtgccgcctccgcctccgcccccgccccgccgtcgtcgcccgcgcaccgcgccagcagccgcgagggcgacgcgcgctccggcgcttcgatgaggtggagggggtgtcgaagaagcggcgcggcatcggtggaggagccggcggtgctgcggggttgcaggcgtcgtctccgcgcagggacaaggggctcgccgtcgacttcaaggagtcgcaggttgctgagtttgaagaccttgaagaggacaaattccttaatgctgttgtcaaggtctattgcactcatatcgcacctgattatggtctgccttggcaaaagcaaaggcaacattcaagcagtgggagcgcttttatgattggtgatggcaaactcttgacgaatgcacattgcgttgagcatgacacccaggtcaaagtaaagagaagaggagatgacaagaagtatattgccaaggttttagctaggggtatcgaatgcgaccttgcattgctatctgttgagaatgaagagttttggaaaggaacagaggcactttcttttgggcgtttgccttgccttcaggattcagtaactgttgtgggatatcctcttggtggagacacaatatctgtaacaaaaggcgttgtatcgcgcattgaggtcactccatatgcacatgggacatcagaccttcttggcattcaaattgatgcagccataaatccaggaaacagtggtgggccagcctttaatgagcaaggggagtgcattggtgtggcatttcaggtgtacaggtcagacgaagctgaaaatattggatatgttattccaactacagtagtgtcccatttcttaaatgactatcagaaaaatggaaagtacacaggatttccttgcttgggtgtcttacttcagaaattggaaaatccggcattgcgtgaaagcttaaaagtaccttcaagtgagggcgttcttgttcgtcgggttgagcctactgctccagcaagcagtgttttgcgaaagggagatgtaatagttagctttgatggtatcacagtaggatgtgaagcaacagtaccttttcggtccacggagcggattgctttccgctatctcacaagccaaaagtatgcaggtgatattgctcagctaggaatcattcgggatggaaattccatgaaagtccaaactattttgcagccaagaaaacatttagtgccatttcatgtcgaagggggccagccttcttatctgatagttgccggccttgtattcacacctttaacagaaccatttatagaggaggagtgcgaagatacacttgggttgaaattattggcaaaagcgcgttattctctagcaacctttgagggggagcaaattgttattgtatcacaggttctggcgcacgaggtcaacatcgggtatgagcacatgggcaatcaacaagtcataaaattaaatggaactgcggtaaagaacatccaccaccttgctcatctagtggacacttgtcaagacaagttcctgacgttcgaattcgaagatgacttcctcgttgttttgcatcgggaagaagcggccgcagcatcgtcagacattctcaaggaacatgccatcccctccgtacggtcatctgatctatcagaaccatacgtagaaggaaagaatgaggtgcaaaaaacaagtgaagatttcggcgaaagtcccgtgacaaacttcgaaatgggaatcgattgtctcttgtgggcatgaccgttctcttttaatggatgagacactgggaacgaagttccgttgaagctgcagatcagagaagtgggaacatcttccggtgttcaccggctgcgggatcaccactacttctcgtcttctcccattgtgcgggcgtacacgtctcatcgcggcaaagccgagtcatgttgtatgtttagattagacagaattcagagtcatgttgtacactaggagccatagcgtgatttattcctcttcatatttagggggtttataggaactgaggaagggccgtacaaattggccgtgagcagtaattgtatatttcaggcacatcgtccagaaattttgttggtttactcctgtttttgtgctacccctaactgattgcagaacaacgcatctctgcatgatggcaggatgttattctttcaaaaaaaaaaaaaaaaaaaa

SEQ ID NO: 6736 - protein, 605 aa, Panicum virgatum
  misc_feature: Ceres CLONE 1883236
  misc_feature (1)..(188): Pfam Name: Trypsin Pfam Description: Trypsin
MASVAALLASPALLPFPSTALSTATSSCSCRLRLRPRPAVVARAPRQQPRGRRALRRFDEVEGVSKKRRGIGGGAGGAAGLQASSPRRDKGLAVDFKESQVAEFEDLEEDKFLNAVVKVYCTHIAPDYGLPWQKQRQHSSSGSAFMIGDGKLLTNAHCVEHDTQVKVKRRGDDKKYIAKVLARGIECDLALLSVENEEFWKGTEALSFGRLPCLQDSVTVVGYPLGGDTISVTKGVVSRIEVTPYAHGTSDLLGIQIDAAINPGNSGGPAFNEQGECIGVAFQVYRSDEAENIGYVIPTTVVSHFLNDYQKNGKYTGFPCLGVLLQKLENPALRESLKVPSSEGVLVRRVEPTAPASSVLRKGDVIVSFDGITVGCEATVPFRSTERIAFRYLTSQKYAGDIAQLGIIRDGNSMKVQTILQPRKHLVPFHVEGGQPSYLIVAGLVFTPLTEPFIEEECEDTLGLKLLAKARYSLATFEGEQIVIVSQVLAHEVNIGYEHMGNQQVIKLNGTAVKNIHHLAHLVDTCQDKFLTFEFEDDFLVVLHREEAAAASSDILKEHAIPSVRSSDLSEPYVEGKNEVQKTSEDFGESPVTNFEMGIDCLLWA

SEQ ID NO: 6737 - DNA, 1767 bp, Panicum virgatum
  misc_feature: Ceres CLONE 1883361
  misc_feature: Encodes the peptide sequence at SEQ ID NO. 6738
agcttcctccgcggccacccgcccctttcccttccctcccctgcacggccgtgtccaccgtcaccaccggcccccgtcgccaccgctgtcagctcggcggagcggccgtcctcctcgaattcgcgcgtcacctcgctgcttccccttctccgcggccatcccgctgctactgccgtctgcccacgcagtttggtctctagtgcttggagccttctcggttgcaccaaatttggcctttttaggcggggagcgccgatcttttcagctacagatttgtttccttgcagtgtttgtgctacagatttgctgcatctgggcctcggacgattaccgctgagccatcctccccgatccgatcagatgagctgtgggtgtctcctccacccaatccgaaattgcaggagatggttgtaacagtagcttcgtcccaatctccttccacgccgctatccgctttcccgtatcctttgcccagcctccgcggcttcatcagggatgcgccgccatacaacactcagtccccaccgcaggtgcagacggctagtgtcggcggcggcggcaacgggaagatcagccctgcggtgctgttcatcatagtgattcttgcggtcatcttcttcatctccgggctgctccacctcctcgtgaggctgctgataaagaagcagcacggccgtggtgccgccacgggggagtctgttgcgtcgccgcaccggacaggcgcgcgggacgcggcgatggaccggcagctgcagcagctgttccatctgcacgactcggggctcgatcaggccttcattgatgcgctgcccgtgttcgcgtaccgcgaaatcattggtggcaacaaggagccgttcgactgtgcagtgtgtttgtgcgagtttgatggggaggacaggctcaggctattgccggtgtgcggacatgccttccacctgcagtgcatagatacatggctactgtccaattcaacatgcccgctttgccgtggtacactctttattcctgggatgacgatagagaacctgttgtttgattttgacgagaggttggaggaggagcctctacctgaggagtgtgaggatggatcgcaagtttccaggcagaaatccattgatgaggagcagctagtgaccgagaagagggtctatccggtaaggcttgggaagttcaagaatgttggaaaccagggtgcggtcgacggtgttggcaatgtcaatgcagccggtatagtgagcaaggagcctggggaaagtagcagttgcagcttggatgcaaggagatgtttctctatgggcacttaccaatatgttcttggggcttctgaacttcgagtagctctccagccaggtcgcagcagaaatggtgcaagcagcagatttaaaggaagaggttctgctggcttaagttctgcaaatgctgacattatggagggcaagaggatttgtgcgaggagcaaaggcgagagcttctctgtgtcgaagatttggcagtggtctagtgtgaagggcaagctgccagctcctccagacacttgctcagatactgggaccctaccatggatgaaaagaaatgctgctggagataagttaaatatgtgactctgtctatagtcctatggtttttttcccgcctgatgttagctgctaaattgtttagctctagctatttcatctgatttagggtgtctcagcgctcatcaaaacgatcattctcatcaagggataatttttgacaggcttgctacaaaaaaaaaaaaaaaaaaaa

SEQ ID NO: 6738 - protein, 398 aa, Panicum virgatum
  misc_feature: Ceres CLONE 1883361
  misc_feature (1)..(42): Pfam Name: zf-C3HC4 Pfam Description: Zinc finger, C3HC4 type (RING finger)
  misc_feature: The sequence is a functional homolog of  SEQ ID NO 1939 in the  11/479,226 US patent application
  misc_feature: Useful for making plants with modulated growth and phenotype characteristics
MVVTVASSQSPSTPLSAFPYPLPSLRGFIRDAPPYNTQSPPQVQTASVGGGGNGKISPAVLFIIVILAVIFFISGLLHLLVRLLIKKQHGRGAATGESVASPHRTGARDAAMDRQLQQLFHLHDSGLDQAFIDALPVFAYREIIGGNKEPFDCAVCLCEFDGEDRLRLLPVCGHAFHLQCIDTWLLSNSTCPLCRGTLFIPGMTIENLLFDFDERLEEEPLPEECEDGSQVSRQKSIDEEQLVTEKRVYPVRLGKFKNVGNQGAVDGVGNVNAAGIVSKEPGESSSCSLDARRCFSMGTYQYVLGASELRVALQPGRSRNGASSRFKGRGSAGLSSANADIMEGKRICARSKGESFSVSKIWQWSSVKGKLPAPPDTCSDTGTLPWMKRNAAGDKLNM

SEQ ID NO: 6739 - DNA, 1928 bp, Panicum virgatum
  misc_feature: Ceres CLONE 1883427
  misc_feature: Encodes the peptide sequence at SEQ ID NO. 6740
gatgatatcttctctctccttcgttctctttcctatatggatttgctatcgagagcctaactacgcctttgtccatgcccggtcaaataatagtttgatttcagtatccccatcaattggtttactcataggagtaattcggcggagtcggataccgcgtcgtcgtgtccccctctctcttcgattacaaagagagctcccgccatgattcgtcctgctcccgccaatccactccacctccgtctccgtgtcggcttcgttccgcctcttcctggaacccctgattggttccgccaaggcggccggacgggtcgtcacaaatactaacaatcttgtctccgtccctccctctgactccgagcgcttggttgatggtgatctcggcgaggtgatcgaggaggcgagcgagagcccccgctgctattcctgtaatcttgttgttgtcgggagccgaggaggaaggaggatgccgtactgcgtggtgaccgcggcggcggcggccgtcgccggcggcgcccacgcgcaggaggaggaggaggtgcggatcttctatcagccgtatggccacggcgcaaccaaggtcctcctcatcatcggtttcgcggggacgtacgagtcgtggggcccgcaggtgaagggcctgaccggcgccatggagcccgtcgacgaggaggccccggccggcgacgactccggcgcggcggagggcgtcgaggtctgctgctacgacaaccgcggcatgggccgcagctccgtgccggagcagaaatcgcagtacacgacggcgatcatggcgaaggacgcgctggcgctcatggatcacctgggatggagaaaagcgcatgtcttcggccactccatggggtccatgattgcttcgaaactggccgcaatggcgccggaccgggtcgcgtcgctggcgctgctcaacacgacaggaggaggctaccagtgcatcccaaaggtcgattggcacacgatatctctcgcctgtcgttttctacgggcaagaactcctgagcagagagcgattcttgatcttgaagtccattatacgagggaataccttgaggaaactgttggatcaagtaccagaagacaaatgctttatcaggaatacgtgaaaggtttatcatctggtggcatgcaatccagacatggatttgaggggcagttgaatgcatgctggacacataagctctcaacaaaagaattagacagaattcgcttagcaggtttccttgttctaatcattcatggcagggatgatgttattgctcagttgtattatgcaaggaggcttgcagaaaagctccagcctgctgccaaactggttgagctacatggaggccacctagtgagtcatgaaagatcagctgaggttaatatgtccctgatggagatgattaaggcatcaaaatcgaatacagacctagaggagtggtcaaaccttccaaagaaggccgatgctggttctctcagtaagcgagatggtgatggggtgaattacctcatagttacatacaacctacttgggaagctccatcttattttgctcttcttgtttggagtgttctacgttattcttgagcacgcgaggagggccctaagagttttgaagcctgtcagagtttctgcttccacgctatagatagccaatgagagattatggtggaagttcttcgttctttggacaagtgtgaattcagagagaattcagagatagtactgccggcaaaagtgctgttgcagagtctggatgtgactggtcctccatggaattgttttgtaacttgcccccctggttttgtgagtgagaggcaagtcattttctgcaatccagtggggatttgtactgcattgtattgtattgttgttcaacataaatggacacatttttttctcatcaaaaaaaaaaaaaaaaaaaa

SEQ ID NO: 6740 - protein, 394 aa, Panicum virgatum
  misc_feature: Ceres CLONE 1883427
  misc_feature (1)..(231): Pfam Name: Abhydrolase_1 Pfam Description: alpha/beta hydrolase fold
MPYCVVTAAAAAVAGGAHAQEEEEVRIFYQPYGHGATKVLLIIGFAGTYESWGPQVKGLTGAMEPVDEEAPAGDDSGAAEGVEVCCYDNRGMGRSSVPEQKSQYTTAIMAKDALALMDHLGWRKAHVFGHSMGSMIASKLAAMAPDRVASLALLNTTGGGYQCIPKVDWHTISLACRFLRARTPEQRAILDLEVHYTREYLEETVGSSTRRQMLYQEYVKGLSSGGMQSRHGFEGQLNACWTHKLSTKELDRIRLAGFLVLIIHGRDDVIAQLYYARRLAEKLQPAAKLVELHGGHLVSHERSAEVNMSLMEMIKASKSNTDLEEWSNLPKKADAGSLSKRDGDGVNYLIVTYNLLGKLHLILLFLFGVFYVILEHARRALRVLKPVRVSASTL

SEQ ID NO: 6741 - DNA, 2135 bp, Panicum virgatum
  misc_feature: Ceres CLONE 1883442
  misc_feature: Encodes the peptide sequence at SEQ ID NO. 6742
gcgtcaagctcctccctctcacccccacccggatctcgcgcgccgcaggcagaccccgccaccctccagaagcttctagaaggccctccccggcgccaccccgctcccgcgcggatgagcggcggttcgggccccctcccctactcgatgcgtgatgtgggcgccggcggcgcctacaacaacgccaagttccgccaccgttcccgcctcaagatgtttgtacagtccctggctactaacagcagcaagtaccgttgtggaaagttcactgttggtaaattcttgagcctgttgatggtttctggcctattatacttatttctgcacaaaagcccagagggtcttgtacctgatgagctacatggcaaagaagtaaataataacaatgtcaggagagctcccagtattcgcacattttggagaaaagcaccaaggctgcccccacgtctcccaccaaatgaaatctacaaaaataattctctgcttcagcagtctccatctgagtggacgtctaggcagaagaaagttaaagaagcatttgaacatgcatggtctggttaccggaattatgcaatgggttatgatgagcttatgcctttgagccacaggggcactgatggattaggaggtttaggtgctacaattgtggattctttggacactgcgataataatgggtgctgatgatgttgtttctgaagcgtcaaaatggatcgaggagaacctaatgaaaagaatcagtgagaaagggcaggttaatttatttgaaactaccatccgtgtcttgggagggcttcttagtgcataccatttgagtggtggcgatcatgcaggatcagttgactctgggataccagcatcatataaaaaggctaatccggagagacttttggaagtttcaaaggatttggcagacaggctattgttggcttttacatcaagcccaacagctatacctttaagtgatgttattcttcgtgaccgcactgcacatgcagccccagatggcttaagcagtacctcagaggcttcaacattgcaactagagttcagttacctcagcagagtatcaggggatccgaagtatgacagggaggcaatgaaggtgttagagcatatgagaacactcccaaaggtgcagggactggtgcctatttacattaacccctcctctggtcaatttagtggcgagaatattagattaggatctcgtggtgacagttactatgagtatctactaaaagtgtggattcagcaagtggaaagtcgtgacagtagtttgaagtatctgtttgaaatgtatactgaagcaatgagaggggtcaagcatcttcttgttcggaaaactgttccaaacaagttggtctttgtcggggagcttccatttggacgaaatggtgatttcagtcctaaaatggatcacctggtgtgttttcttcctggtacccttgcccttggtgcaactaaaggtatcaccaagaaaaaagctcttgagagtaatttgttgactgatgaagacatcgaaaatctccagcttgctgaagatcttgccaaaacatgtgttgagatgtactttgtcacctctactggccttgctcctgaaatagcttatttccacattgagggtaatccagaagggggacctgatggcggtaacaaaagcaacaaatatgtcaatgatattataataaaaccacttgatcggcacaatcttctacgcccagagactgtggaatcactatttgttttgcacagaattacagaggatcccaagtatagggagtggggttggcagatctttcaggcgtttgagaaatacacaaaagttgattcgggtggttacagttccttagatgatgtcacgagcctacctcctcataggagagacaaaatggaaactttcttccttggagaaacattgaaatatttgtatttgctgtttgatgaaagcaatactcttccgctagataagtatgtattcaatacagaggcccatcctcttccagtcatgaggtctatggaacaggcttcacattctgtatagtttagaagtgtataactgttgtatgatcatgatgagagaagtaacagatatatgagaaatatacttgacagcaaaaaaaaaaaaaaaaaaaa

SEQ ID NO: 6742 - protein, 642 aa, Panicum virgatum
  misc_feature: Ceres CLONE 1883442
  misc_feature (1)..(486): Pfam Name: Glyco_hydro_47 Pfam Description: Glycosyl hydrolase family 47
  misc_feature (471)..(631): SWISSPROT Homolog: EC 3.2.1.113 Endoplasmic reticulum mannosyl-oligosaccharide 1, 2-alpha-mannosidase
MSGGSGPLPYSMRDVGAGGAYNNAKFRHRSRLKMFVQSLATNSSKYRCGKFTVGKFLSLLMVSGLLYLFLHKSPEGLVPDELHGKEVNNNNVRRAPSIRTFWRKAPRLPPRLPPNEIYKNNSLLQQSPSEWTSRQKKVKEAFEHAWSGYRNYAMGYDELMPLSHRGTDGLGGLGATIVDSLDTAIIMGADDVVSEASKWIEENLMKRISEKGQVNLFETTIRVLGGLLSAYHLSGGDHAGSVDSGIPASYKKANPERLLEVSKDLADRLLLAFTSSPTAIPLSDVILRDRTAHAAPDGLSSTSEASTLQLEFSYLSRVSGDPKYDREAMKVLEHMRTLPKVQGLVPIYINPSSGQFSGENIRLGSRGDSYYEYLLKVWIQQVESRDSSLKYLFEMYTEAMRGVKHLLVRKTVPNKLVFVGELPFGRNGDFSPKMDHLVCFLPGTLALGATKGITKKKALESNLLTDEDIENLQLAEDLAKTCVEMYFVTSTGLAPEIAYFHIEGNPEGGPDGGNKSNKYVNDIIIKPLDRHNLLRPETVESLFVLHRITEDPKYREWGWQIFQAFEKYTKVDSGGYSSLDDVTSLPPHRRDKMETFFLGETLKYLYLLFDESNTLPLDKYVFNTEAHPLPVMRSMEQASHSV

SEQ ID NO: 6743 - DNA, 2119 bp, Panicum virgatum
  misc_feature: Ceres CLONE 1883475
  misc_feature: Encodes the peptide sequence at SEQ ID NO. 6744
atgcagcgtatttcacgtttgtggaaaggaaacaggctcatctatttcccccttgtgagtactgtaacccttgcaatgtaattatatgtatatatatatttataaaatcagtaacttttttatttatatatgcaaatgtgatggtgcacttgcaagtacaacctctgcagttgtgcacacgccgaagtccgttcgactccagcaggcagcaggtcacgtccagcgcatcgccgcgcacaagggcgaacagaaaagagaaactattcgggagccgttggctgtcccccctccattgccggccacccatcaccttcccctcccgcccgcgccctcgcccccgcgtcctcgccaccgcctaatcggctgacccgcccgccttcccacatccgctcccccgcgcgcccggccacgctccgccaccccgatggccgccaccccgccgtcgtcgcgggacccgtcgccgcagccccggcggccggcctcctccgcgggggcccccaagcgcgcgggcctcctgctcggtcgctacgagctgggccgcctcctcggccacggcaccttcgccaaggtctaccacgcccgccacgccgacaccggcgaggccgtcgccatcaaggttctcgacaaggagaaggccctccgcaacggcctcgtcccgcacatcaagcgcgagatcgccatcctccgccgcgtgcgccaccccaacatcgtccgcctctacgaggtcatggccaccaagtccaagatctacttcgtcatggagtacgtccgcggcggggagctcttcgcgcgcgtcgccaagggccgcctcaaggaggacatcgcgcgcaggtacttccagcagctcatctccgccgtcggcttctgccacgcccggggcgtcttccaccgcgacctcaagcccgaaaacctcctcgtcgacgagcgcggcgacctcaaggtctccgatttcggactctcggccgttgccgaccagttccacaccgacgggcttctccacaccttctgcggcacgccctcctacgtcgcgccggaggtgctcgcgcgccgcggctacgacggcgccaaggcggacatatggtcgtgcggtgtcatcctgttcgtgctcatggcaggctaccttccgttccacgaccagaacctcatggcgatgtatcgcaagatttacaggggggaattccggtgcccgaggtggttctccaaggatcttaccagtctcctgaatcgtgtgcttgacaccaacccagagacgaggatcaccgtggctgaaatcatggagagcagatggtttctgaaggggttccgaccggtcaggttctatgtcgaggatgaccaggtgcacagtttggcagacgatgagaatgaggtgccggacctggggcctagtcagcctcctcctcagccaccgccaccgccaccgcagcaagaggacgaaggtgatgactctgggtgggaatcagattcgtcagtagcatcctgcccagccacattgtcatcggaggagagaagacgacaccttgggtctctcacacggccagtaagtctaaatgcgtttgatatcatatcattctcaagaggattcaatttgtcggggttgtttgaggagcgtggcaacgaagtgaggtttgtctcagcacaacccatgcaaacgattgtaacaaaactggaggagattgcaaaggtgaagagctttgtagttcggcggaaggattggcgggtgagcctggaaggcacgagggaaagtgagaagggtccattgacaattgcggccgaggtatttgagctcacaccaagccttgtggtggtggaggtgaagatgaaggcaggggacagggaagagtatgaggacttctgtgagagggagttgaaacctgggttgcagaaccttgtgcaccatacagcctccgttccagatataccttctgatactgagtagcttgtcaggtagacctcttgcttggaaggaatatgtatataaaagaagaaatttggattggaaggatgcacctttctgtttcagcataagcatctgttcagaaaaatgttattcatagatttccttagttacttcttttttagtaatattctttctgcaatccaaaaaaaaaaaaaaaaaaaa

SEQ ID NO: 6744 - protein, 503 aa, Panicum virgatum
  misc_feature: Ceres CLONE 1883475
  misc_feature (21)..(307): SWISSPROT Homolog: EC 2.7.11.1 CBL-interacting serine/threonine-protein kinase 11
  misc_feature (26)..(303): SWISSPROT Homolog: EC 2.7.11.1 CBL-interacting serine/threonine-protein kinase 15
MAATPPSSRDPSPQPRRPASSAGAPKRAGLLLGRYELGRLLGHGTFAKVYHARHADTGEAVAIKVLDKEKALRNGLVPHIKREIAILRRVRHPNIVRLYEVMATKSKIYFVMEYVRGGELFARVAKGRLKEDIARRYFQQLISAVGFCHARGVFHRDLKPENLLVDERGDLKVSDFGLSAVADQFHTDGLLHTFCGTPSYVAPEVLARRGYDGAKADIWSCGVILFVLMAGYLPFHDQNLMAMYRKIYRGEFRCPRWFSKDLTSLLNRVLDTNPETRITVAEIMESRWFLKGFRPVRFYVEDDQVHSLADDENEVPDLGPSQPPPQPPPPPPQQEDEGDDSGWESDSSVASCPATLSSEERRRHLGSLTRPVSLNAFDIISFSRGFNLSGLFEERGNEVRFVSAQPMQTIVTKLEEIAKVKSFVVRRKDWRVSLEGTRESEKGPLTIAAEVFELTPSLVVVEVKMKAGDREEYEDFCERELKPGLQNLVHHTASVPDIPSDTE

SEQ ID NO: 6745 - DNA, 2002 bp, Panicum virgatum
  misc_feature: Ceres CLONE 1883782
  misc_feature: Encodes the peptide sequence at SEQ ID NO. 6746
agcccaagcatcggcccatttgccccccacacccgtcgcactcctccctacctccacccgcgccgcagcgccgccatccgccgcggcattccaccgagcatctcgcgcgcgcgcatggccgccgtggccccgcaccaccacctctcccgccccgctgccgccgccaccgccgcggcatccggcgccgtttcgggtgctctcaacaggcatggcgccttctcatccgcctcctgctcccctctccgcctcccgctcctccgcgccgccgccaccaggcccgcgcgcctctcggccgctgtttccaccgccaccccgactatggaggccgcagcgatggacgccgtggcgaagtgggggctgacctcgctctccgaggccgacccggaggtctacgacctcatcgagcgcgagaagcggcggcagcgcgcgggcatcgagctcatcgcctccgagaacttcacctcgctcgccgtcatggaggcgctcggctccccgctcaccaacaagtactcggagggcatgccgggggcgcgctactacggcggcaacgaggtcatcgacgaggtcgaggagctctgccgcgcccgcgcgctcgccgcgttccacctcgacccgacacgctggggcgtcaacgtgcagccctactcggggtcgccggccaacttcgccgcctacacggggctgctccagccccacgataggatcatggggctcgacctgccgtcgggcggccacctcacccatgggtactacacggccggcggcaagaagatttccgccacgtccatttacttcgagagcctgccgtacaaggtcagctccgacaacgggtacgtcgactacgacaggctggaggacaaagccatggatttccgccccaagctcattatctgcggtgggagcgcgtacccgcgggactgggattacgccaggctcagggctatcgcagacaaatgtggcgccatgctgctatgtgacatggctcatatcagtggtctcgtggccgctcaggaggcattgaatccctttgagtactctgatgtggttaccacaaccacgcacaagagtcttcgagggccaaggtctggtatgatcttcttcaggaagggcccaaagcctccgaaaaaaggccagcctgagggtgctctgtatgactatgaggacaagatcaactttgcagtattcccttcactccaggggggtcctcacaatcatcaaattgctgcactggctgttgcattgaagcaggccatgtcacctggattcaaggcctatatccagcaggttaaggcaaatgcagttgcccttggaaaccatttgatgagcaagggctacaagttgggtactgatggaacagagaaccaccttgttctctgggatctccgtcctcttggcttgactggtaataaagttgagttgctctgcgacctatgcagcattacactgaacaaaaatgctgtcttcggtgacagtagtgcattatcacctggcggcgtgcgcattggtacacctgcaatgacctctaggggtttggttgagaaggactttgtgcaaattgctgagtaccttcaccaggctgtgatcatctgcttgaaggtccaggaggagcatggcaagattctcaaggacttcaagaagggattggtgaacaaccaggacattgaaaacctaagggcggaggttgagaagttcgccacatcgtttgatatgcctggcttcagggtgtcagacatgaagtacaaggattagatcacgaaggccgtgcaaactctctttactgccgtggaacatgtggtatctgaatttggcgtaactagagccagtaactcctatacatagtgccgccctttctgttggtgtgctactcgatcggtccattttgttggaactgttaagtgtatgattagagaataataatggtggcgagcatgcttgacatggattatgatcgctgaccttggtcttccaaaaatcccattgataaagcttcccgtgttagctt

SEQ ID NO: 6746 - protein, 544 aa, Panicum virgatum
  misc_feature: Ceres CLONE 1883782
  misc_feature (1)..(400): Pfam Name: SHMT Pfam Description: Serine hydroxymethyltransferase
  misc_feature (24)..(544): SWISSPROT Homolog: EC 2.1.2.1 Serine hydroxymethyltransferase, mitochondrial precursor
  misc_feature (85)..(542): SWISSPROT Homolog: EC 2.1.2.1 Serine hydroxymethyltransferase, mitochondrial precursor
MAAVAPHHHLSRPAAAATAAASGAVSGALNRHGAFSSASCSPLRLPLLRAAATRPARLSAAVSTATPTMEAAAMDAVAKWGLTSLSEADPEVYDLIEREKRRQRAGIELIASENFTSLAVMEALGSPLTNKYSEGMPGARYYGGNEVIDEVEELCRARALAAFHLDPTRWGVNVQPYSGSPANFAAYTGLLQPHDRIMGLDLPSGGHLTHGYYTAGGKKISATSIYFESLPYKVSSDNGYVDYDRLEDKAMDFRPKLIICGGSAYPRDWDYARLRAIADKCGAMLLCDMAHISGLVAAQEALNPFEYSDVVTTTTHKSLRGPRSGMIFFRKGPKPPKKGQPEGALYDYEDKINFAVFPSLQGGPHNHQIAALAVALKQAMSPGFKAYIQQVKANAVALGNHLMSKGYKLGTDGTENHLVLWDLRPLGLTGNKVELLCDLCSITLNKNAVFGDSSALSPGGVRIGTPAMTSRGLVEKDFVQIAEYLHQAVIICLKVQEEHGKILKDFKKGLVNNQDIENLRAEVEKFATSFDMPGFRVSDMKYKD

SEQ ID NO: 6747 - DNA, 1739 bp, Panicum virgatum
  misc_feature: Ceres CLONE 1883917
  misc_feature: Encodes the peptide sequence at SEQ ID NO. 6748
cccaaagcccggacgcaaccccctccctgctcgtgctccctcttcgcttcctcccattccctcacgctgaagctcctggcgctccgttcaccgatcccgcgctgcaggccgccgatcgggatggcgcgctgagccccgtgccgtgcgcgcgtctcggcgggcgcgatgctggcggcgatccggcaaaccaccagggtctgctccaggctcgcttctccgcacgcctcctcgcccgccgccgccgctgctgctgcggcggcgctggcgagctcccccgtgctgggctccgggatgagcggcctggagaggcagcccgctcctacggttgccgggatcggcggcactacggggaggagtcgcggggccgatcacccgccaccgcggccttgcagctcgtccggcgagtcgagggaaggatatcagtggggcggagtgccgtatcaaaggcagccgatgccacatcatcgcaaagtgatcgctggatctaaccatcatgtttctggtgcaagctgttcctcactgtatcagcagagttgcagatatttttcatcctcttctgatcaggagaggatacgggctggaaacaagcttataagtgatctgccaaggtgtgtaaaaattgtggaagttgggccacgagatggactgcaaaatgaaaaggacactgtaccaacacctgtaaaggttgagcttatacggagactggctgcctcgggattatccgttgttgaggcaactagtttcgtatctccaaaatgggtaccacagctagctgatgcaaaagatgtcatggaagcagttcggaatactgagggtgtacgtcttcctgtattgaccccaaacattaaggggtttgaggcagctattgcagcaggggcaaaagaaattgcagtatttgcatcagcttctgaaggattttcaaagtcaaacataaactgcacaatcaaagagagtcttgcccgctataatgatgttgctcttgctgccaaagagagagaaattaatgtccgagggtacgtctcttgtgtggttggatgcccagtagatggaccagtaccaccgtctaatgtagcttatgtagccaaagagctttatgacatgggctgctatgaggtttcacttggcgataccattggagttggtaccccaggcaccgtggttccaatgcttgaggccgccatgtctgttgttcctgtggagaagcttgctgttcatttccacgacacctacgggcaatctctctcaaacattctcatctctctccagatgggcgtcagtgtcgtggattcctccgtcgccggccttggcggctgcccttatgcaaagggcgcgtcaggtaacgtcgcgaccgaggacgtagtgtacatgctcaacgggttgggtatcaggacaggcgtcgacctgggcaaggtgatggctgcaggcgagttcatctgcaagcacttaggacgccagtctggttccaaggctgcgactgcactgagcaaggttactgcaaaagcctcaaaactctgaggcttgagaaatttaccatggtactctgttccagataataactgtaaaatgagcacaatattgtgaaataaacaatactattccgtcgtgaggtgtctgttcaagacaaataaatactataccaagcaccggaggtggcatgtgccatcttcatctggcgatataagcacaagattgtgagtcatgtaagtcgagcaaacctgacaaatgtgaccactttcacc

SEQ ID NO: 6748 - protein, 449 aa, Panicum virgatum
  misc_feature: Ceres CLONE 1883917
  misc_feature (138)..(442): SWISSPROT Homolog: EC 4.1.3.4 Hydroxymethylglutaryl-CoA lyase, mitochondrial precursor
MLAAIRQTTRVCSRLASPHASSPAAAAAAAAALASSPVLGSGMSGLERQPAPTVAGIGGTTGRSRGADHPPPRPCSSSGESREGYQWGGVPYQRQPMPHHRKVIAGSNHHVSGASCSSLYQQSCRYFSSSSDQERIRAGNKLISDLPRCVKIVEVGPRDGLQNEKDTVPTPVKVELIRRLAASGLSVVEATSFVSPKWVPQLADAKDVMEAVRNTEGVRLPVLTPNIKGFEAAIAAGAKEIAVFASASEGFSKSNINCTIKESLARYNDVALAAKEREINVRGYVSCVVGCPVDGPVPPSNVAYVAKELYDMGCYEVSLGDTIGVGTPGTVVPMLEAAMSVVPVEKLAVHFHDTYGQSLSNILISLQMGVSVVDSSVAGLGGCPYAKGASGNVATEDVVYMLNGLGIRTGVDLGKVMAAGEFICKHLGRQSGSKAATALSKVTAKASKL

SEQ ID NO: 6749 - DNA, 1683 bp, Panicum virgatum
  misc_feature: Ceres CLONE 1884250
  misc_feature: Encodes the peptide sequence at SEQ ID NO. 6750
cgaacactcatcaccggatcgaacaagggtacccatcgaacaatctccccgcctgccgcatcgccgccgcctgccatggccgccgtcgctcccgtcgtctccgacctcgtcgacttcctcaacacgtcgcccaccgccttccacgccgtcgacgaggcgaagcggcggctgaaggcggcggggttcgcgcagctctcggagcgggaggagtggtcggggctcgagcccggccgcaagtacttcttcacccgcaaccactccaccatcgttgccttcgccatcggcggcaagtacgttgctggaaatgggttccacttcatcggtgcccacactgacagcccttgcctcaagctcaagcccgtctccaaggtaaccaaaggaggttatcttgaggttggggtacaaacttatggtggtggattgtggtacacatggttcgaccgtgatcttactatagctggtagggtgattatacgggagaagagggatggcggggtctcttatgcacataagcttgtacgggtgcaagagccgatcctgaggattcctactttggctattcaccttgacaggactatctcctcagaaggcctcaaaattaacaatcagagtcatcttgttccggtgctggctacatctatcaagaatgaaatgcagaaaatagtgggagaaaatggcccaaaggagtcatcggagaataagaacacaaagcaccatccattattattgcagttgattgctaaagaggctaactgtgagcctgatgaaatatgcgacttcgaactgcaactttgtgatactcaaccaagcgctgtagcaggtgtcatgaaagagttcatcttttcaggacggcttgacaacctttgcatgtcattttgttcattgaaggccctaatcgactcaacttctgctgaacaatcacttgatcatgaatctggcgtgcgaatggtagctctctttgaccatgaggaagttgggtctgattctgctcagggagctggctcctctgccatgttggacgctttatcaagaatcacggggtcttttaactcttcaaattccaagttgctagaaaaagctattcagaggagctttctggtgtctgccgacatggcacatgctttacaccccaattatatggacaagcatgaggagaaccaccaaccaaaattgcatggaggacttgtgatcaagcataacgccaatcaacgttatgcaacaaatgctgtgacagcatttattttccgagaaattgctgagaagcaccaactacccatccaggattttgttgttcgaaatgacatgggttgtggttcaacaattggcccaatacttgccagtggtgttggtatccgtactgttgatattggtgcaccacaactatcaatgcacagcatcagagaaatgtgtgccactgacgatattagccacgcgtatgagcgtttcaaggcatattttgaagaattcactgagttggatagtaaggtcaaggtggattattaaggtagtgaaacacaatagggtagctttgttgcaacgtataaggaaaaagacaaattcaggaggatgtattattgtgttctaaatttttagcttagcacttgcaagatatttcttaagaagcatttggcttgtggttgcatgcttaaaatacattgttacaaagctctcttatttattggc

SEQ ID NO: 6750 - protein, 475 aa, Panicum virgatum
  misc_feature: Ceres CLONE 1884250
  misc_feature (1)..(440): Pfam Name: Peptidase_M18 Pfam Description: Aminopeptidase I zinc metalloprotease (M18)
  misc_feature (3)..(474): SWISSPROT Homolog: EC 3.4.11.21 Aspartyl aminopeptidase
MAAVAPVVSDLVDFLNTSPTAFHAVDEAKRRLKAAGFAQLSEREEWSGLEPGRKYFFTRNHSTIVAFAIGGKYVAGNGFHFIGAHTDSPCLKLKPVSKVTKGGYLEVGVQTYGGGLWYTWFDRDLTIAGRVIIREKRDGGVSYAHKLVRVQEPILRIPTLAIHLDRTISSEGLKINNQSHLVPVLATSIKNEMQKIVGENGPKESSENKNTKHHPLLLQLIAKEANCEPDEICDFELQLCDTQPSAVAGVMKEFIFSGRLDNLCMSFCSLKALIDSTSAEQSLDHESGVRMVALFDHEEVGSDSAQGAGSSAMLDALSRITGSFNSSNSKLLEKAIQRSFLVSADMAHALHPNYMDKHEENHQPKLHGGLVIKHNANQRYATNAVTAFIFREIAEKHQLPIQDFVVRNDMGCGSTIGPILASGVGIRTVDIGAPQLSMHSIREMCATDDISHAYERFKAYFEEFTELDSKVKVDY

SEQ ID NO: 6751 - DNA, 973 bp, Panicum virgatum
  misc_feature: Ceres CLONE 1884582
  misc_feature: Encodes the peptide sequence at SEQ ID NO. 6752
aagcacaaaattaatttcccgaaaacctcacccctccccaatctaccccccgccccgcacgccatagctcgtgcccgcggcgcgcaagtccaagctcccacgactccaccgcgaccgcggagacgcccgcgccccagatcggccggggcgaatggcggcgccgacctttccggcgctgctgctatcggcggtgctgctgctgctgctgccgccgcctcccggggcggaggcggtgtggctcgagctgccgccgtcggggaccaagtgcgtctccgaggagatccagcccaacgtcgtcgtgctcgcggactacgccatcatgtacgagtcccaccccacctcgcaccccaccgtcgcggtcaaggttacctcaccatatggcaatacagtacatcacaatgagaatgccacaacgggtcagtttgcattcactacctcagaagctggaaactaccttgcatgcttctggatagacagtgcagagaaaggatcaggaacatctctaaatcttgattggaagatggggattgcagcaaaggactgggatacaattgctaagaaggagaaaattgagggtgtagagctagagcttaggaaacttgaagctgctgttgaatccatccatcataacttgctgtacctcaaagcaagggaagcggatatgcggacggtgagcgagaaaacaaattctagagttgcctggttcagcgtcttgtcacttggagtctgcattgtggtctctgtgctgcagctgtggcatcttcaaggtttcttccggaagaagaagctcatatagattcaccctcagccgtttgatgtgtgtactccgttgttaactaccttaggaaaagcacatttttgccatatttatttcgaggaactcataaggtggacaaaacagctagttgatacatgatacatggtttcaatagcaagcaactaatattgtacgcaaaaaaaaaaaaaaaaaaaa

SEQ ID NO: 6752 - protein, 214 aa, Panicum virgatum
  misc_feature: Ceres CLONE 1884582
  misc_feature: Great-hit functional homolog of the protein sequence encoded by LOCUS At1g09580
  misc_feature: Useful for making plants with altered cell wall content and/or composition
MAAPTFPALLLSAVLLLLLPPPPGAEAVWLELPPSGTKCVSEEIQPNVVVLADYAIMYESHPTSHPTVAVKVTSPYGNTVHHNENATTGQFAFTTSEAGNYLACFWIDSAEKGSGTSLNLDWKMGIAAKDWDTIAKKEKIEGVELELRKLEAAVESIHHNLLYLKAREADMRTVSEKTNSRVAWFSVLSLGVCIVVSVLQLWHLQGFFRKKKLI

SEQ ID NO: 6753 - DNA, 2201 bp, Panicum virgatum
  misc_feature: Ceres CLONE 1884585
  misc_feature: Encodes the peptide sequence at SEQ ID NO. 6754
ggacagcccaccacactccactctctcccctcccggccccgatcgactcccaccgcccaacaaccgacgggtgccgccgccgccgccgctgctacctgctacgtacgcgcacgtaccaccaacctccacgtaccccgccgattgatcggacggccagcgcgcgcgccgctccgacgagctagccaccgacgtcgtgcgtacgggacgacgccggacggccatccgtcccgggcgccgccgccggccgggacacgccaacaagctcctcctggtaggcacggcgccagcagcagcagcgtcggcagcgacattttagaggcgcggcgatgaggatcacggggagcggcgccaccgcagtagcggcggccagcctgcggctccggcccggccggctcggggaggttctcgccgtcgcgctcctcttcgcgtcggcgtcgctgtcgtccctggcgggcgccgagtcgccgccggcggcggcggcggggcggcatgactacgaggacgcgctgcacaagagcctgctctacttcgaggcgcagcggtcggggcggctgccgcacggccagcgcgtggcgtggcgcgaccactccggcctcaccgacggcctcgagcaaggggtggatttggtgggcgggtactacgacgccggcgaccacgtcaagttcggcctgcccatggccttcaccgtcaccatgctctcctggagcctgctcgagtacggcgccgacgtcgccgacgccggcgagctcgcccacgcgctcgagtccatcaagtggggcaccgactacttcatcaaggcgcacacccagcccgacgagctctgggcagaggtgggcgacggcgacacggaccactactgctggcagcggccggaggacatgacgacgtcgcggcaggcgtacaaggtcgaccgcgagcgccccgggtcggacgtcgccggcgagaccgccgccgccatggccgccgcctccatggtgttccgggagcacaacccgcactacgccagcctcctcctgcaccacgccctgcagctgttcgagttcgccgacaagtaccggggcaagtacgacagcagcatcgcggaggtgaagagctactacgcctccgtcagcggctaccacgacgagctcctctgggcggcgctctggctccaccgcgccaccggccgcgccgagttcctcgactacgccgtcgacaacgcccacgccttcggcggcaccggctgggccatcaccgagttcagctgggacgtcaagtacgccggcgtccagatcctcgccgccaggctgctgctgcggggggagcactcgccgcgccaccgggagacgctggagcggtaccgggccaaggcggagcactacgtgtgcgcgtgcctgggccggaacgcggccggcggcgccgacgccaacgtggagcggagccccggcgggatgctctacatccggcagtggaacaacatgcggtacgtgaccagcgccgcgttcctgctctccgtctactcgggctacctcctctcgcccgccgccgccggcgccgccggggaggccgtggcggcgtgcgcgggcggcggggcggccaccgccggcgaggtgttcgcgatggcgcggtcgcaggtggactacgtgctggggagcaacccgcgcggggtgagctacctggtcgggtacggcgcccggttccccgcccgggtacaccaccgcgccgcctccatcgtgccgtacaagcacagcagggagttcatcggctgcgcgcaggggttcgacgactggttcgtccgcaagggcgccaaccccaacgtcgtcgtcggcgccatcgtcggcgggcccgaccgccgcgaccgcttccgggaccaccgggagaactacatgcagacagaggcgtgcacctacaacacggcgcccatggtcggcatgttcgccatgctcaacaggctggcccgggacgaggtcacggcggcggcggcggacacaagtgtaaatagatagtgatacagagggggtttgtacaattttgcccctattcttttgttcattctttctctactactagatgtgaagccaggtgaaggcgctcgctcttcacatgaaattatttgtatacgagggggggaaaaagataggcggagggatttggcaaagcaaatgcaaatgcaaatcccctccccgtaaatataagaggaaaaaagaataatgtcttaggtt

SEQ ID NO: 6754 - protein, 552 aa, Panicum virgatum
  misc_feature: Ceres CLONE 1884585
  misc_feature: Great-hit functional homolog of the protein sequence given in SEQ ID NO 9633
  misc_feature (1)..(470): Pfam Name: Glyco_hydro_9 Pfam Description: Glycosyl hydrolase family 9
  misc_feature (18)..(549): SWISSPROT Homolog: EC 3.2.1.4 Endoglucanase 16 precursor
  misc_feature (26)..(551): SWISSPROT Homolog: EC 3.2.1.4 Endoglucanase 7 precursor
  misc_feature: Useful for making plants with altered Lignin content
  misc_feature: Useful for making plants with altered cell wall content and/or composition
MRITGSGATAVAAASLRLRPGRLGEVLAVALLFASASLSSLAGAESPPAAAAGRHDYEDALHKSLLYFEAQRSGRLPHGQRVAWRDHSGLTDGLEQGVDLVGGYYDAGDHVKFGLPMAFTVTMLSWSLLEYGADVADAGELAHALESIKWGTDYFIKAHTQPDELWAEVGDGDTDHYCWQRPEDMTTSRQAYKVDRERPGSDVAGETAAAMAAASMVFREHNPHYASLLLHHALQLFEFADKYRGKYDSSIAEVKSYYASVSGYHDELLWAALWLHRATGRAEFLDYAVDNAHAFGGTGWAITEFSWDVKYAGVQILAARLLLRGEHSPRHRETLERYRAKAEHYVCACLGRNAAGGADANVERSPGGMLYIRQWNNMRYVTSAAFLLSVYSGYLLSPAAAGAAGEAVAACAGGGAATAGEVFAMARSQVDYVLGSNPRGVSYLVGYGARFPARVHHRAASIVPYKHSREFIGCAQGFDDWFVRKGANPNVVVGAIVGGPDRRDRFRDHRENYMQTEACTYNTAPMVGMFAMLNRLARDEVTAAAADTSVNR

SEQ ID NO: 6755 - DNA, 2366 bp, Panicum virgatum
  misc_feature: Ceres CLONE 1884723
  misc_feature: Encodes the peptide sequence at SEQ ID NO. 6756
acccgcccagtccgagcccagcttatttcgttctctccgcaaaaactccatcctctcgcaggctctctccatctccgtccgcgccgaacacgccgcgccatttagatccaggcatcctacccattgcaaccgcgcctcgcctctgttccccgtaggcatcctggttgtgctcgtctccgggccccttcatcgccgccgccgtggagtgcagatccgccagaactagcggcggatccattcgatttgttgtgctgcaaatactgcaaattgcattgtaaagccattctaaggaatgcagaaagatgtatttgcatgctaaagatttcacttgtgaagaggagggcatttctccaactcatttaaaatcattggttcttcatgagcaagggtttcaagtgtgcattaggtgcatatcagaaagtaactgtgatgccactaatgtcaacaatatcactatgctagatcgtataatttctgaagacggttgaggttttctattttaccaactagctacagttaatataagattataataatcatttgcaaggacttgtttatgatggaagcagagaagaatggaaatattttgatgcaaaagtatgagattggcaaattattggggcagggaacttttgccaaggtatatcatgctaggaacatagtgacgtcacaaagtgttgctatcaaggtgattgataaagacaaaatttttaaggttggcctaatggagcagatcaaaagggagatatcagtcatgaagttagtgaggcacccaaacattgtacaactttatgaggtcatggctactaagacaaaaatatattttgctcttgaatatgtcaagggtggtgaattatttaacaaaattgctaaaggtaagttaagagaagatgctgcaagaaagtactttcaacagttggttagtgcagttgatttttgccacagtaggggtgtgtatcatcgtgatctgaagccagaaaacctactagttgatgagaatgggaacctgaaaatttcagattttggattgagtgcacttgctgagtcaaggcgccaagacggccttctacacacaacttgtggtaccccagcatatgtggcacctgaggttatcagccgaaaaggatacgatggtgcaaaggttgacacatggtcctgtggggtgatactatttgttcttatggctggttatttgccattccaagattcaaatttgatggagatgtatagaaagattgggaaagcagatttcaaatgtccaccttggtttccatcagatgtacgaaagctagtgtcaagaattcttgatccaaaccctaggactagaatgtcaattacaaaaatagtggaatgcttttggttcaaaaagggccttgacagcaagctaatccgaaagaatattgagatgaaggggaaagtttcagctctaactgatgttaatgtggttttctcatccacaggtagcagtagcgggaacaataaaatggttgatcagaaacaagattcagcaaaagtcactaaccttaatgcttttgatattatttccctttcagaaggcttcaatctttctggcttatttgaggagactgagaatagaaaagaggcaaggttcacatctagccaatcagcttcaactattatatcaaaactggaggatgttgccacatgttcaaaacttactgtaaagaagaaagaaggtggtgtgctaaaaatggaaggtgaaagtgaaggaaggaaaggtgtcttgtctattgatgcagaaatctttgaagttacaccttcattccatctggtagagataaaaaagaacaatggggatacactagaatatgaaaatttgtttaagcaagacatgaaaccagcactcaaagatattgtttgggcatggcaaggcgaacatcaaggtcagcgaactgaagatcataagcagctatagatttaccttaatattgaactagcatgtttccacagtaaagcccatcattagttagcattcaaatattgtatcttcttgtaactttttttattcattttatcttatggcctttttgaattattgcttctctgaaattgacatgaacatctgattggattgtgaacatattaagcatcatcatgttgttatgatgagtctatcattaactattgtttatgttgtcgccaatccaccactgaattggtgaatgtagaactgttccatcaaattagttctagcaatatgctagatgattattgtttcacaatataacagtctcgaatattataggcattatatttcattaggtttctattataattgtaaagtctggcaaagctggaaaggaagcaagttacaatgtttgattcaaaaaaaaaaaaaaaaaaaa

SEQ ID NO: 6756 - protein, 459 aa, Panicum virgatum
  misc_feature: Ceres CLONE 1884723
  misc_feature (14)..(450): SWISSPROT Homolog: EC 2.7.11.1 CIPK-like protein 1
  misc_feature (5)..(390): SWISSPROT Homolog: EC 2.7.11.1 CBL-interacting serine/threonine-protein kinase 15
MMEAEKNGNILMQKYEIGKLLGQGTFAKVYHARNIVTSQSVAIKVIDKDKIFKVGLMEQIKREISVMKLVRHPNIVQLYEVMATKTKIYFALEYVKGGELFNKIAKGKLREDAARKYFQQLVSAVDFCHSRGVYHRDLKPENLLVDENGNLKISDFGLSALAESRRQDGLLHTTCGTPAYVAPEVISRKGYDGAKVDTWSCGVILFVLMAGYLPFQDSNLMEMYRKIGKADFKCPPWFPSDVRKLVSRILDPNPRTRMSITKIVECFWFKKGLDSKLIRKNIEMKGKVSALTDVNVVFSSTGSSSGNNKMVDQKQDSAKVTNLNAFDIISLSEGFNLSGLFEETENRKEARFTSSQSASTIISKLEDVATCSKLTVKKKEGGVLKMEGESEGRKGVLSIDAEIFEVTPSFHLVEIKKNNGDTLEYENLFKQDMKPALKDIVWAWQGEHQGQRTEDHKQL

SEQ ID NO: 6757 - DNA, 2613 bp, Panicum virgatum
  misc_feature: Ceres CLONE 1885079
  misc_feature: Encodes the peptide sequence at SEQ ID NO. 6758
aacagcaaactttgcagcagcaaaaccaaacaaaccggcgcgatgctccgccggcgcccgcggcccgccgcgttcctccgcctcttcgccacctcctgccgccgcagctccctccacccctcgcagccgcagctcccgaaccctgccgatctcccgccgccgccggtggcgaagaaggtcccgttcaccgtgtcggcgcacgggaggtcgtggagtgacccgtaccactggatgcgcgatacctccgacccggacctcgctgctctcctcgccgcagagaacgcctatgccgacgccttcgtcggctcggctggcggcggcggcctccgcgcgcgcctcgccgccgagatgcgcgcccggctgcccccttccgccgccacaccgccccagccgtggggcccttggttgtattatcagtatgttccagagggaaaggaataccctgttttatctaggaagttgaagccctctcatggtctagcacgagctctgctggattatctttctggttcagagaaggagcaagtgttgcttgactggaatgaggttgcagagaaaaatggttatgtgcacattgggagttgtcgaatctctccagatcataggttccttgcatatacagttgatacatctggtggtgaactattttcccttgaagtaaaagatcttcaatctgagcatgtcatctttagctcaccagacaaaggaatagttagtttagcatgggctcgcaacagtgaaagtttgttttacactgtctgcgatgagactctacgtcctaaccaggttttctgtaaaaagttacaatcgcatgaagcagggtttctagttttcacagaggaggatgttaactgttgtgtagatattacaagcacaaaagattttaagtatataactgtcaattctaacacaaggacctcatctgaggtttttgtgatggaatctgataatgtaagggagggcttatggcctatacggaaacgtgttgataaagttcagtactttttggagcaccaccatgggttcttttacatccttaccaatgctcctgtaaatgacactgaaatgatgactgaaggctactatctggccaggtgtcaggatgaaaagtcattggtggataggtggcagatagtgacattccctgggtcggactgcaccattcaggatatggatatttttcatgataatttagttctctttcttcgaaagaatggaagccctcttttttgctccatcaatatgccaattgatgttgatgttcaggggccaaaggaagttaatgatctcaacccatggtatttcccggtaccatcaaacatgtgcagtattattccgggatccaacaatgatttcatgtcatctacttatcgtctggttgtttcatcgcctgtgattccagacttaactgtggactacgatttgagaaaaaagactttcaccattcttcatcaagaggaagtaactagcctgtctgcaaatctaggcaccgtgggcaaatccaatgtttcaagcatccaacaaaacctgcagcttgttgaaacttcacaaagttggagtgatctttccaagctatacttatgtaaaaggatcgaagttatatcacatgatggtgttttgataccattagtcattttgtattcacgggaagcacatcgtcatggagaatcacctgggatcttatatggctatggatcttatggagaagatttggacaaaagctggtgttcagagaggttaagtctcctctctcgaggatgggttcttgcatttgcagatgttaggggtggaggagatttatcttggcatcatgcaggaaccaaatctaacaagataaattcaattcatgattttgctgcatgtggtatgcatctcatcaaggcaggcttggttcaccaaaatcgtctttgtgctataggctgtagtgctggcggtctgctggtgggcgcagtcattaatatgcttccagacttattttctgctgcagttctcaaggtcccttttctagatatctgcaacacaatgttggatcctactttacctctcactgtcttggactatgaagagtttggtgaccctaatatcccagctgaatttgaggcgatctgcagttattctccttatgataacttgtcatctggtgtctgctatccaccagtcctggtgactgcctcgtttaatgatacaagggtagggatttgggaagctgcgaagtgggttgcaaaagtgagagatatcacatgcagatcctgttccaaatcagttattctcaaaactaatatgcaaagtggccattttggtgagggtgggcgcttcatgcactgtgatgagacggccctcgattatgcatttctcatgaaggccttgcagttggatgacaactattgcttaatggacccatgcctgaggcttctcacggaacagatttgtgcgacttagtgcaaaactgaggtaattaccttttgtgctctgtgtcatagtggacaagattgcatcctcataattgttgattaagacctttcattggaaagtgatgcacccttgaagtgtcttttggcttttaatagacaagttgtggattttggaactgcagaaaaaaaaaaaaaaaaaaaa

SEQ ID NO: 6758 - protein, 798 aa, Panicum virgatum
  misc_feature: Ceres CLONE 1885079
  misc_feature (1)..(435): Pfam Name: Peptidase_S9_N Pfam Description: Prolyl oligopeptidase, N-terminal beta-propeller domain
  misc_feature (1)..(219): Pfam Name: Peptidase_S9 Pfam Description: Prolyl oligopeptidase family
MLRRRPRPAAFLRLFATSCRRSSLHPSQPQLPNPADLPPPPVAKKVPFTVSAHGRSWSDPYHWMRDTSDPDLAALLAAENAYADAFVGSAGGGGLRARLAAEMRARLPPSAATPPQPWGPWLYYQYVPEGKEYPVLSRKLKPSHGLARALLDYLSGSEKEQVLLDWNEVAEKNGYVHIGSCRISPDHRFLAYTVDTSGGELFSLEVKDLQSEHVIFSSPDKGIVSLAWARNSESLFYTVCDETLRPNQVFCKKLQSHEAGFLVFTEEDVNCCVDITSTKDFKYITVNSNTRTSSEVFVMESDNVREGLWPIRKRVDKVQYFLEHHHGFFYILTNAPVNDTEMMTEGYYLARCQDEKSLVDRWQIVTFPGSDCTIQDMDIFHDNLVLFLRKNGSPLFCSINMPIDVDVQGPKEVNDLNPWYFPVPSNMCSIIPGSNNDFMSSTYRLVVSSPVIPDLTVDYDLRKKTFTILHQEEVTSLSANLGTVGKSNVSSIQQNLQLVETSQSWSDLSKLYLCKRIEVISHDGVLIPLVILYSREAHRHGESPGILYGYGSYGEDLDKSWCSERLSLLSRGWVLAFADVRGGGDLSWHHAGTKSNKINSIHDFAACGMHLIKAGLVHQNRLCAIGCSAGGLLVGAVINMLPDLFSAAVLKVPFLDICNTMLDPTLPLTVLDYEEFGDPNIPAEFEAICSYSPYDNLSSGVCYPPVLVTASFNDTRVGIWEAAKWVAKVRDITCRSCSKSVILKTNMQSGHFGEGGRFMHCDETALDYAFLMKALQLDDNYCLMDPCLRLLTEQICAT

SEQ ID NO: 6759 - DNA, 1884 bp, Panicum virgatum
  misc_feature: Ceres CLONE 1885333
  misc_feature: Encodes the peptide sequence at SEQ ID NO. 6760
aaaactgccacacccgcacgcctccccagtcaaacacagctcagctctgctagcgaactcctcttatctacacagccccccaacgcacgccctgatccctgcttctccttggctgcttcccttctccctccctcctcccgctcgatcggtttcaccgttcactgtccgcgctctccagtctccacccgccgcggtcagcccggcagcgtcgtgctcctccgaccagtgactagtgtcgggaggtgagagaggtggggttgattgcaagtggggaggtggggtgggtgatgtacggctcgccggtgcccaaggacctcaacctgccagcagcccagccgcagccgaccaggacgccgccgcagatgagctcaccgggcctgctgcggtacaggtcggcgccgagcacgctgctcggcgaggtgatgtgcggggatcacgacttccacgaggcggcggcggcagggcacggcccggcgcacgccgccgcggacaacgtcctggcccggtttctcgccgggcaccacgcggacatcccggactgcaagcctccccgccccgccgcggccgccgcccacttcatggaggacgccgcgtccatggccaccccacagcagcagcagcagctcatgtaccagtcgcagcagcagatggccgctatggaggggctctaccgcaacgtcagctccggcggcacggagcaggctgtcgccgccggcgccagcggcggcgccgtgctccgtcagagcagctcccccgctggtttcctgaaccatctgaacatggacaacgggtacgggagcatgctccgggcgggcatggccggcgggttcaggaacggcgtcgtcagcgacgcgcggctcaaggggcagctgagcttctcgtcccgccaggggtcggtgatgtcgcagatctccgaggtgggcagcgaggagcttgacggcggcggcagccccgaggcggccggcagcaacggcgcggcgcgcgggtacagcggcatcccggggtacccgatgggcggcgcgtccggcgcctggacggacgagcagtcgccgacgtcgtccggcgcgaagcgcccccgcgactccggcccgccgccgcagaacgggcagcagcagccgccgccgcctctggcgccgcagctcagcctgcccggcggcaccggcaggaacggcgtcgggaagcagtcctcggcggagacggcggcgatcgagaagttcctgcagttccaggacgccgtcccctgcaagatccgcgccaagcgcgggtgcgccacccacccccgcagcatcgccgagcgggtgaggaggacgaagatcagcgagcggatacggaagctgcaggagctcgtgcccaacatggaaaagcaaaccaacactgccgacatgttggatctggccgtggactacatcaaggatcttcagaagcaggtcaaggtgctgaacgacggccgcgccagctgcacctgctccgccggcaagctgctgcagaaccagttcgccagctgaaacagccgccacctctcacggctcgatgcggcgcggcacggccgcaaggcctggccggaggagaggcctctgcgccggcgccggcagctcgttcctcctcctttggtcctagtcctaccggtgtactacttgtcagcgtatatgtgaggaggtgaaaccgtacaaaaaaaagagaaaaagatacggaaatgagattagtctggagtacatgcatggccattagcaggcagggccccacaaggaccgccggccccacgtgttagtgatagctgcgggctcggttacttggttgattcttcttgctgtgaagggtggtgaaatcacccatcagaaatggacaggcctcgtctcgtctttagaaaaaaaaaaaaaaaaaaaa

SEQ ID NO: 6760 - protein, 405 aa, Panicum virgatum
  misc_feature: Ceres CLONE 1885333
  misc_feature (1)..(49): Pfam Name: HLH Pfam Description: Helix-loop-helix DNA-binding domain
  misc_feature: The sequence is a functional homolog of  SEQ ID NO 1258 in the  10/412,699 US patent application
  misc_feature: The sequence is a functional homolog of  SEQ ID NO 172 in the  10/714,887 US patent application
  misc_feature: The sequence is a functional homolog of  SEQ ID NO 172 in the  11/435,388 US patent application
  misc_feature: The sequence is a functional homolog of  SEQ ID NO 192 in the  10/714,887 US patent application
  misc_feature: The sequence is a functional homolog of  SEQ ID NO 192 in the  11/435,388 US patent application
  misc_feature: The sequence is a functional homolog of  SEQ ID NO 198 in the  10/714,887 US patent application
  misc_feature: The sequence is a functional homolog of  SEQ ID NO 198 in the  11/435,388 US patent application
  misc_feature: The sequence is a functional homolog of  SEQ ID NO 974 in the  11/435,388 US patent application
  misc_feature: Useful for making plants with modulated growth and phenotype characteristics
MYGSPVPKDLNLPAAQPQPTRTPPQMSSPGLLRYRSAPSTLLGEVMCGDHDFHEAAAAGHGPAHAAADNVLARFLAGHHADIPDCKPPRPAAAAAHFMEDAASMATPQQQQQLMYQSQQQMAAMEGLYRNVSSGGTEQAVAAGASGGAVLRQSSSPAGFLNHLNMDNGYGSMLRAGMAGGFRNGVVSDARLKGQLSFSSRQGSVMSQISEVGSEELDGGGSPEAAGSNGAARGYSGIPGYPMGGASGAWTDEQSPTSSGAKRPRDSGPPPQNGQQQPPPPLAPQLSLPGGTGRNGVGKQSSAETAAIEKFLQFQDAVPCKIRAKRGCATHPRSIAERVRRTKISERIRKLQELVPNMEKQTNTADMLDLAVDYIKDLQKQVKVLNDGRASCTCSAGKLLQNQFAS

SEQ ID NO: 6761 - DNA, 1107 bp, Panicum virgatum
  misc_feature: Ceres CLONE 1885464
  misc_feature: Encodes the peptide sequence at SEQ ID NO. 6762
acggttactaccacggctgaggggcgcaccaccttaaccaccaatcacccagctcccgcgcaccgagctagaggagcagcagctaggaccagcgccgaggagaaccccgggtcccaccgcagccgaccgccgggaaggaggaggaggaggagctagggacggaaggatgcttccgggcgtggatcttgcgcggcggcggcgcgtgcgctaccgcggcgacgccgcgtcctcgggcgcgggggagcaccaccaccacctcctccacgcgggcgcccaccgcgcgggggccgcggccgtggcggggcccgcgctggcggcgcgcgcccggctcgaggagaagctgcgcggcgcggcgctgccgctgccgctgccactgccgccgccggcgtcgccgtgcccgtccaggtggagccggttgatgggcgagcgggaggggagagcgacctccggcggtcgtcggagccaccaagaccaccagcagcaggccgagctcggcggggcaccgccgccggccccgacctccgcggtgccgtcgggcggcggcggcggtgaccggcggcgcgccgagctgacgcggacgctgtcgatggtggacgtgtgcgcggtgtgcctggacgaggtccgggagcggcggcagcgggtgacgcggctgccctgctcgcacaagtaccactccgagtgcgtcctcccctggctcgccatccaaccggactgcccctgctgccgggcgctcgtgccggccgccgccgacgccctcgccgcctagcgccgccgccgccgctgctgctgacgtggacctgttctgccccggccctccggtgacgtggcacgtggcacgtggcagtccagctctgcttgaggctgcagctatactgcaagtctgcaactgacaggagctctctctctctctctcttttggttggtttgttttagactgcaactgaaagtttgtttttttttttgaaaagcaactgaaagtttgtaacatagagaaaactgtagatgcagggtgtacagtggttggagtattggcagatgagcttctgaatcctgatgctgtgtctctgttcaattccgaaaaaaaaataaaaaaaaaaaaaaaaaaaa

SEQ ID NO: 6762 - protein, 199 aa, Panicum virgatum
  misc_feature: Ceres CLONE 1885464
  misc_feature (1)..(42): Pfam Name: zf-C3HC4 Pfam Description: Zinc finger, C3HC4 type (RING finger)
MLPGVDLARRRRVRYRGDAASSGAGEHHHHLLHAGAHRAGAAAVAGPALAARARLEEKLRGAALPLPLPLPPPASPCPSRWSRLMGEREGRATSGGRRSHQDHQQQAELGGAPPPAPTSAVPSGGGGGDRRRAELTRTLSMVDVCAVCLDEVRERRQRVTRLPCSHKYHSECVLPWLAIQPDCPCCRALVPAAADALAA

SEQ ID NO: 6763 - DNA, 884 bp, Panicum virgatum
  misc_feature: Ceres CLONE 1885675
  misc_feature: Encodes the peptide sequence at SEQ ID NO. 6764
gcacggtccacacgctccccattccccaagccgacgcctccacaatccaaatccatggccgccctccgcgcgtccccgctcttcctcccgcagcccctctcgccgtcctcccggtcccgccgttgcgccgcctgccgcggggtagccgccgcggccaggcccggccccgctccctacaggcccggcgtccatggaggaggcgccaagaagaggcttcttgcgagcaggaggaggccgggatgggtggggctgccttgctgcctgcccgcgacggaggagggggttgctgcggcggccgctgctactgaagaggaggacgggtacctggcgcgggaggccgggtggggcgtgcggcggatggggcgggtcggggaggagatgcggcgggtggcgcaggtccaggccgaggccttccacgtccccgtcgccctcttcaacgactttttcttcgacttcttcaaagccgaggtgctgtcggcgctcatctacagggtgaggaactcgccgccggacaggaggaggaaggtagggacggcactgctgaaggcttgtgaggcactagggttccaatggaagcacagattcatggttctcagggcatatgaggatgacgatggcgctcgaggcctctacgccaaagcagggtacagggttgtgtcaagggatcctgactgggtcacctgggtggggaggagaaggcgtgttctgatgataaaagagttgccagttcacgatgacatgatacagcagcaatgatcccggcatgtttcctgaattgggatgcattgcttcttgtgtatacgagtagcaccatgtacatgtcgttttgtagtatacaagagagctgcccatctttccttcaacaaaaaaaaaaaaaaaaaaaa

SEQ ID NO: 6764 - protein, 233 aa, Panicum virgatum
  misc_feature: Ceres CLONE 1885675
  misc_feature (43)..(91): Pfam Name: Acetyltransf_1 Pfam Description: Acetyltransferase (GNAT) family
MAALRASPLFLPQPLSPSSRSRRCAACRGVAAAARPGPAPYRPGVHGGGAKKRLLASRRRPGWVGLPCCLPATEEGVAAAAAATEEEDGYLAREAGWGVRRMGRVGEEMRRVAQVQAEAFHVPVALFNDFFFDFFKAEVLSALIYRVRNSPPDRRRKVGTALLKACEALGFQWKHRFMVLRAYEDDDGARGLYAKAGYRVVSRDPDWVTWVGRRRRVLMIKELPVHDDMIQQQ

SEQ ID NO: 6765 - DNA, 1737 bp, Panicum virgatum
  misc_feature: Ceres CLONE 1885700
  misc_feature: Encodes the peptide sequence at SEQ ID NO. 6766
atttctctattcccatttcgatacttgcaacccagccagccagctcgtctcccccctccaccccacccgatccgcgccgccgcgtctcgcatgcccggcaacctctctcgccgtcacccttctgatccgcgctggtattccgccggcgcgagaccgggacccctaccgagcttagtgttacatcagcatcagcctcgaccccatccctcgctgcccccgccctgatctcggttcctccgtccgcgtcccggccgcgatccgtcctttgccgggcaggcaatttgatttcagttcctgaatgctgctacctccacagacctctattcgtgctgttggtccttgcggattgcgcgctgtcaggtctggatagtgcgggtggtgcagtgtgtcctccgttcttcctcgcccggccccaaaagatttcgcgagcaattaggtgcagttttgtttatttggctctgcaaagtctagacggccgagagaatccccttctagtgacgggatgacggcatcaattcttgtgatgttttgtggctaggacaccatcactactgcttactcttgcttagttggccttgagccctttccctttcgcgtgttgtgtcagttaattagcctgtggttgttggggagatcacgaggttttcttgcccttgttgtctatccgtagtaggtattgttgcagtttacttcattggcacaatggtacctcttaagtgttggtcaatcactattgcgtagagctctttacctcgctatatttttttagaccagttgggctaaaataaaggtagattgtgttggatattttccggtaggacattgtgggttcgtgatgtcttgcacctccccagatccgccagactactgctcggccgaatcgcctgagctcaagctgtaccaggccttcatcttctcggtgcctgtcttctttacatttgtcttgctcctcttcttctacctgttctacctgaggcggcgcagggccaattggcagtccttgaggatgaggacgaataatttgatacgagataaccccaggctggagtgtggtttgaagaaggagatgcgggaaatgttgccagtggttatctataaagagagtttcttgatcagggagacacagtgctctgtctgcctagcagactatcaaccagatgagcggcttcagcgaatacctccttgtggccataccttccatatcaattgtatcgaccactggctctctaaaaacacaacctgccccctttgtcgagtctcgctccttccagcccccaaagcaaccagcattgacccggatttggaagcacaaactgtagaggaatctctgaatgtacaccatcaggaggacctctccaacaggaacacatcacaggaagatcagacagccgaaggtggtggagccgctggtggtcaggccgaagaacaacgtagcgatgctgtcgagccgttgactgtcagggtggtcactgagcctcaagctgacacggaagggtcaccaagcacaacctgccaacccgacaaagcaaagaaataaaggtgacaatgatatatttcttgtaagttgtaacattgtatgtttagctgatcaggagggacatacacataaagatcaccattgatgttgtaatacctgtttaccagggaaaaaaggaaaaattaagtgctgaagaaatatttatgggtacataattaacatgaccgatacaataccagtgacctgtttttcattttggt

SEQ ID NO: 6766 - protein, 233 aa, Panicum virgatum
  misc_feature: Ceres CLONE 1885700
  misc_feature (1)..(42): Pfam Name: zf-C3HC4 Pfam Description: Zinc finger, C3HC4 type (RING finger)
MSCTSPDPPDYCSAESPELKLYQAFIFSVPVFFTFVLLLFFYLFYLRRRRANWQSLRMRTNNLIRDNPRLECGLKKEMREMLPVVIYKESFLIRETQCSVCLADYQPDERLQRIPPCGHTFHINCIDHWLSKNTTCPLCRVSLLPAPKATSIDPDLEAQTVEESLNVHHQEDLSNRNTSQEDQTAEGGGAAGGQAEEQRSDAVEPLTVRVVTEPQADTEGSPSTTCQPDKAKK

SEQ ID NO: 6767 - DNA, 640 bp, Panicum virgatum
  misc_feature: Ceres CLONE 1885723
  misc_feature: Encodes the peptide sequence at SEQ ID NO. 6768
tcagcaacgaagtaatcttgccactttgcttgccagcctactagtacctagtaggatccgttgatccatggaggtggccggaggagctgtcggcgcgccgtccccgccgcggcgcgtggtggtggcggtggacgagagcgaggagagcatgcacgcgctctcctggtgcctctccaacgtcgtctccgccgccagggccgccgcggcgccgccccccgccgtggtgctcgtccacgcccgctcgccgcgcccgttctactgccccgccgtcgacggcgccgggtacctcctgacgcagccacggctacggcttcctgcagagggcgctgcgggggagcgtcagcaaccactgcgtgcagaactgcaagtgccccgtcgtcgtcgtcaagaggcccggcggcgagcgccgcccggcgccgccgcggatctaggctcttgatgaggccgtatataatataataaccgtaagtgaataggagcccgactcgcctcggctaaacgtgacggtggccgcccgtgtacatatctcgcttgttcggggcctgtatctccccctgagtatataatgttttcggttcacacaaaatattgtaacgtgtcatgtacattctatatagtcgtttcgaatatgtaagatgag

SEQ ID NO: 6768 - protein, 123 aa, Panicum virgatum
  misc_feature: Ceres CLONE 1885723
  misc_feature (2)..(57): Pfam Name: Usp Pfam Description: Universal stress protein family
MEVAGGAVGAPSPPRRVVVAVDESEESMHALSWCLSNVVSAARAAAAPPPAVVLVHARSPRPFYCPAVDGAGYLLTQPRLRLPAEGAAGERQQPLRAELQVPRRRRQEARRRAPPGAAADLGS

SEQ ID NO: 6769 - DNA, 690 bp, Panicum virgatum
  misc_feature: Ceres CLONE 1885730
  misc_feature: Encodes the peptide sequence at SEQ ID NO. 6770
actcctgactcccctgtcgctgcgccgccgcacctccgctcgtccctcgatcgaccgtagtggagatccatccggacgcggattcgtctgctctgtttctcggactgaagaattgacaaacatggcatctagtggcatgaaagatttttaccggcagaaaaagaaaggaggtgtgaccaaggcggcatcaccttccaataagaaaacaaagcagtacactgtcggggcctccgtcggggccccagatactgctcagacatcagcacttgtttctcatggctcctgggatctcaaagatgattttggtgagcaagaggagcagctgcggcaatacgacttggacatgaagtttggcccatgtattggtgtcacccggcttcagcgctgggagcgcgcttctgccatgggcctccagccaccagcccatctccgggatctcttgctgcgtgttccatcaacgaaggatcgcagtgatccttatgtcgggtgcctatgggagggtaaagtctagaagcatcttctatgacaaagcaccgccttggcgccttgttcatagtaacctagtgtgacatgttccgctgcttccacttcgtagctgggggtccagtagttcactctgcaacctcctgtaatcctgctgatgtatgatggcactgttttgtttctctttgagtacgctcagtttgtccg

SEQ ID NO: 6770 - protein, 129 aa, Panicum virgatum
  misc_feature: Ceres CLONE 1885730
  misc_feature (1)..(41): Pfam Name: DNA_pol_delta_4 Pfam Description: DNA polymerase delta, subunit 4
MASSGMKDFYRQKKKGGVTKAASPSNKKTKQYTVGASVGAPDTAQTSALVSHGSWDLKDDFGEQEEQLRQYDLDMKFGPCIGVTRLQRWERASAMGLQPPAHLRDLLLRVPSTKDRSDPYVGCLWEGKV

SEQ ID NO: 6771 - DNA, 723 bp, Panicum virgatum
  misc_feature: Ceres CLONE 1885937
  misc_feature: Encodes the peptide sequence at SEQ ID NO. 6772
acctgccataaagcagcagcagctactctagctagctagtcgccgagctcgatctttagctgcatcttctacttgcttccactccactagctagctagatattcgatatatataatataatcagggttgagtatgtcgagcagccgcaggtcacgcacgcggcgtgcggggagttcgctgtcgtcgtcgtcgtcgaggtccatctcggaggaccagatctcggagctcctgtccaagcttcaggcgctgctcccggagtctcaaactcgcaatggcgcgcataggggctcggcggcgagggcgctgcaggatacatgcagctacatcaggagcctgcaccaggaggtggacaacctcagcgagacgctcgccgagctgctctcctccgccgacgtcaccagcgaccaggccgccatcatcaggagcctcctcatgtgatgtgatctcatctcctccggcggcaaagctcggtgcgcgcgcatgcacggccgctcgctcgttagatctccaggcgtgcctagctagctagctaccgtaacttctcgcaactgctcattagctgcgccctggcgctgcacgtctagctactacggagtactgctcaagtacatctgtagctagagagctatgctcattattagcagcttatagcagcactgtgtgattcttgtactttgatgtaagcttgcattgtggtcatcgtaaaaaaaaaaaaaaaaaaaa

SEQ ID NO: 6772 - protein, 101 aa, Panicum virgatum
  misc_feature: Ceres CLONE 1885937
  misc_feature: Great-hit functional homolog of the protein sequence given in SEQ ID NO 9678
  misc_feature (1)..(43): Pfam Name: HLH Pfam Description: Helix-loop-helix DNA-binding domain
  misc_feature: Useful for making plants with modulated nitrogen use efficiency
  misc_feature: Useful for making plants with modulated seedling growth
MSSSRRSRTRRAGSSLSSSSSRSISEDQISELLSKLQALLPESQTRNGAHRGSAARALQDTCSYIRSLHQEVDNLSETLAELLSSADVTSDQAAIIRSLLM

SEQ ID NO: 6773 - DNA, 1062 bp, Panicum virgatum
  misc_feature: Ceres CLONE 1885951
  misc_feature: Encodes the peptide sequence at SEQ ID NO. 6774
gcagcacaagaagatacggagaagaactccgactccggcggcgtgccggccggagctgcctttaagcaaagcgagccctctccccttccccaaccgcgcttcgcaaattcgcatcagttcctgctcaaaaaaaaaaaaatcgcatcagttcatctgggatcagacccgagagcgaagcaagagacgagtgaatctcgtagcggaggcgatggccaggttcgacccgtacgagaacaacggcggcacctgcgtggccgtcgccggcgccgactactgcgtggttgccgccgacacccgcctctccgtcggatacagcatcttgtcccgcgaccactccaaggtcgcccaactggcagaaaaatgtgttttggcctcatctggcttccaaggtgatatcaaagctttgcagaagaatctggcagccaaggaattggtttatgagcacaatcataacaagaagatgagctgccctgcaatggcgcaactgctgtcgaacacgctctactacaagagattcttcccatactacgcattcaatgtattgggtggactggacagccaaggtaaaggatgtgtctttacatacgatgctgttgggtcttatgagaggacaggttatagtgctcagggaacgggtgcagcattgatgatgcctgttcttgacaatcagttgaaatcccctagtcctctactactgccagctagggatgcagtgacgcccttatctcaatctgaggcagttgatctggtgaaggacgttttcgcatcagctacagaacgagacatatacactggagatagattggaaattgtggtcatcagcagctccggcacataccgagagtacattgaacttaggaaggactaatgcattgttcctgtgaaatggcactaccattattaagcataaggatatttgtttctgttgtcagatgtgtttgaatttcctctaaaaagaaagatgtatttgaatttccaatttgttgattctagcacgaagtgataattcatcattttatctgttatacttagacggcaccgaaaaaaaaaaaaaaaaaaaaa

SEQ ID NO: 6774 - protein, 219 aa, Panicum virgatum
  misc_feature: Ceres CLONE 1885951
  misc_feature (7)..(219): SWISSPROT Homolog: EC 3.4.25.1 Proteasome subunit beta type 1
MARFDPYENNGGTCVAVAGADYCVVAADTRLSVGYSILSRDHSKVAQLAEKCVLASSGFQGDIKALQKNLAAKELVYEHNHNKKMSCPAMAQLLSNTLYYKRFFPYYAFNVLGGLDSQGKGCVFTYDAVGSYERTGYSAQGTGAALMMPVLDNQLKSPSPLLLPARDAVTPLSQSEAVDLVKDVFASATERDIYTGDRLEIVVISSSGTYREYIELRKD

SEQ ID NO: 6775 - DNA, 696 bp, Panicum virgatum
  misc_feature: Ceres CLONE 1886296
  misc_feature: Encodes the peptide sequence at SEQ ID NO. 6776
gtagcagcaccacagagctcactggaacaatggaagggagcctctgccatgagttcccgactgacctcccagccatcgacgtgtgggaggtctatggcagcctcactctagcgcaattggttccccaattgcttcctcatgtgctatcaaaggttgagcttgtagagggagatggtggcgtcggaacaatactgcttgtcactttcccaccctcaggaacttccggactagcaagttacaaggagaagttcaccgtggtcgacaatgaaaagtacatcaaggaggcagaagcgattgaaggaggctttctagatcttggctttgagaaatatttagtgcgatttgagattgtaggacaagaagatggcccgaccattataagatcaaccatcaagtataaagttgatgccgagcatgaaagcaatgcctcccttgtcagtacaggagctgtggcagccattgctgatgccatcaccaagtacatcaaagagcataagactcccaagcaagccagcgaacaaacttcggaagaacaagcgaccagacaaaagtcaggagaacaaggcgtctgaagtgatggcaaacaagtttgagcaaattcccttatactattttgttatatatttttctcatgtctctgggatctcctactgccatgtacaaatttatagaaaattatatatatggatattctag

SEQ ID NO: 6776 - protein, 180 aa, Panicum virgatum
  misc_feature: Ceres CLONE 1886296
  misc_feature (1)..(154): Pfam Name: Bet_v_I Pfam Description: Pathogenesis-related protein Bet v I family
MEGSLCHEFPTDLPAIDVWEVYGSLTLAQLVPQLLPHVLSKVELVEGDGGVGTILLVTFPPSGTSGLASYKEKFTVVDNEKYIKEAEAIEGGFLDLGFEKYLVRFEIVGQEDGPTIIRSTIKYKVDAEHESNASLVSTGAVAAIADAITKYIKEHKTPKQASEQTSEEQATRQKSGEQGV

SEQ ID NO: 6777 - DNA, 2185 bp, Panicum virgatum
  misc_feature: Ceres CLONE 1886520
  misc_feature: Encodes the peptide sequence at SEQ ID NO. 6778
ttcaatagctttagcccttattgcatatgattggagtatttgcatttcctttatattcctgaacctgaattatattgggagtgctggggttcagctggagttaatttcaatagctttagccctttttggttgaaaccttgtcgctagcggtgatatacattagctaactgaattatagcaaaaaaaaaatatttccttccaaatcagggttacaatcagaactgtttggaaacttgctgaaaggattaaaaccatatatcacggccttccacagttgttgactccaatatctgccaattaccgcttagcctactgcgctgacatctatttttgtatggcacttcagtatattcattaattactctgctatctctgtatgtatgacaaaaggtacatcagaaatcctttgtttcaaatttgtagcttaggctgcctcgatcttccatgaagcaagtgaagttacctagaatacaactcaaagttcagtagatgattgtggaccaacatttcagccatctgtgcttttcactaacatggtggccagtggttacttctggttaaaaagatagcgactcattattgcatacatatggttggccataatgacaatgttagtgcctttttgccataagaactgagctggaaattgatgatccaagttattgatggagcatgcttgctgtgatgatgtacatgagcatgttataaatgtgacacatggggaaactgcatcaacatcaaccagtcatcaagatatgtacagtgactcagatgaaccacaccaggaagataggccatcaacaagcactcgaaccccatcatcacagtcttctccatcaacatcaccaactgcatatagctccagaaatttatcttttcctagaagagatagtatatatggtcatggaaggagtccttggaactctggtttatggatctcgtttgaaattgtcatgtatatagctcaggttgcagctgctattgtcatcctaatcttttcgagacacgagcatccccatgctcctttgtttgcatggataattggatatacagttggctgcattgctagtcttcctcttatttattggcgctatgttcatcagaacagacctttggaccaagaacctcagcagccacctacaacatatcctactttgactccctctcagtcatcagaaggacgcaatcatcgtagcagtggtactgtctggcatcttggatgtataacaattacttgcccaaggcttagcgtactggcttatcatttcaagacagcggtcgactgtttctttgctgtatggtttgttgttggaaatgtgtggatttttggtgggcgcagtatttcatccgatgctcaagacgctcccaatatgtacaggctatgtttggcattccttgcacttagctgtgttgggtatgccattccttttatcatgtgtgcagcaatttgctgctgctttccatgcttgatatctgttttgcgtcttcaagaagatttgggtcaaactagaggagctactcaagagcttatagatgcattgccaacctacaaattcaaaccaaaacgaaacaaaaactgggggattgaccatgcttcaagctcagagaatcttgatgagggtggcatactgggcccaggaactaagaaggaaagagttgtttcagctgaagatgctgtgtgctgcatctgtctaaccaagtatggcgatgatgatgagctccgtgagcttccttgcacacacttctttcatgtgcaatgtgtcgataaatggctcaagataaacgcagtatgcccgctctgcaagacagagattgggggtgtggttcgatcctttctcggcttgccctttggccgccgacgtgttgataggatggcaggaagaggtgtagctagctcgagattcagtgtatagaagatgttttgtttctatgacatcctctcttacacaaaaaagagccatgctctcggcgttgcaatggtttgattgattgtcaaggaaagcgctgaactgcattcagcgtgcttgacttcatgacactgactccagatggagagacctggtgcttgtgaaggcaagttttcgtagtactgtggaggtgctgttatattctgatgtaagatttttaaccaaggacgtaaataagaaacacgaagttcacttgtcaaaaaaaaaaaaaaaaaaaa

SEQ ID NO: 6778 - protein, 415 aa, Panicum virgatum
  misc_feature: Ceres CLONE 1886520
  misc_feature (1)..(41): Pfam Name: zf-C3HC4 Pfam Description: Zinc finger, C3HC4 type (RING finger)
MEHACCDDVHEHVINVTHGETASTSTSHQDMYSDSDEPHQEDRPSTSTRTPSSQSSPSTSPTAYSSRNLSFPRRDSIYGHGRSPWNSGLWISFEIVMYIAQVAAAIVILIFSRHEHPHAPLFAWIIGYTVGCIASLPLIYWRYVHQNRPLDQEPQQPPTTYPTLTPSQSSEGRNHRSSGTVWHLGCITITCPRLSVLAYHFKTAVDCFFAVWFVVGNVWIFGGRSISSDAQDAPNMYRLCLAFLALSCVGYAIPFIMCAAICCCFPCLISVLRLQEDLGQTRGATQELIDALPTYKFKPKRNKNWGIDHASSSENLDEGGILGPGTKKERVVSAEDAVCCICLTKYGDDDELRELPCTHFFHVQCVDKWLKINAVCPLCKTEIGGVVRSFLGLPFGRRRVDRMAGRGVASSRFSV

SEQ ID NO: 6779 - DNA, 2513 bp, Panicum virgatum
  misc_feature: Ceres CLONE 1886532
  misc_feature: Encodes the peptide sequence at SEQ ID NO. 6780
acaatatcttgtcgcgattggacgccacggcttcatcactcctgtcgccggcttcggctgatgcagcggcgagaggcgcgaggacgccgacgggacggacgccccaaaggtctccaccgccactgcgtcgcgtttgcctcagtaggccttctgctccagcatccgaggcggagagcacggcgacgatctggtcagccctcatcccctttccatcgattccgtcgatttggttcaagcacccaattgttgaatcatggaatgtgtaacgtactttcctgttgcgctgaaatttcatctcggcttgctactatatcgtctcctcgccgcatatccgccacctcgaatcttcgatgtagacgtatgcagatatgctgagagccgcgcagtctcagagcacactggcccggtcttgggtgtttcctggtggaattttagcgtgtctgtccaatttacattgtaacaactggtcagggagaggatgccctgatcagaagcatgcatcctgatggttcttagtcggtaagatggttatatgacatatagtaatgcttggcttttttgtggtaccactttagctactatcgtagtaatttcagactctcaacttctcaattattttacacataagcaagagcacaagatgactttcagtgcaatgcttaccttcataggttgaagtatctttaatcataagtgtatttgaatatatgactatcatttcagcatcttgctttgtcaggggctcagggcataaagctctagttaacatatgtcacttgagaaaggtggtttctttgaaaacattatggtgccattgttttcctggattgaacagtagctagttgtattttaagtgctggagtattgtgcttagcaattctgccactcaatgtcatcatcttacaaaattgctgggctgatgcagtgccaagaagtatttaaatcagattcatggaaattgcatcagaaggaagttccataccataagaataagtgatttgtgtagtagttttatggaacaatagaagtggtatatattacataatatgccagatccttattattggcatgcctatccttttactgagtattggagcagttaccaatttttcacctggaattacactgatacaaaatcaccacaccaactctcagagttctgttcaagcacatgagactgttagctctgtgagtgtctccagggatgtgggtcaaggtaataaaagtccacgagctcggtggcccagaagtccttagttgggaagaggttgagattggggatcccaaagaaggagaaatccggatcaagaacaaggccggagtcaattatgtcgatatatattaccgtaccggattacatcgagctcctcttccatttattcctggcaaggaagcagttggtgttgtgtctgccgtgggtcctggtgttactagtttcaaagtcggtgatgttgtcagctatgctgataatccaatgggttcttatgctgaagaacaaatcatcccagcaagtgtggccattcctataccccctgcaatagactacaaaactgcagcatctgttttactgaagggaatgactgcatatgtccttgtgcgacaagcctttaaggtccagagaggccacactgttctagtccatgctgctgctgctggagtcggctctctcctctgccagtgggcaaatgcccttggcgccactgtcattggcactgtttcaactgaagagaaggtcggccaagcaacccaagacggatgccggcatgtgatagtgtacacgaaggaggactttgttacccgggttgctgagatcacgtcaggcgaaggtgttcatgttgtctacgatgccgttgggaaggacacattccaggctccacactttgttgagcagggatcgttggcatgcttgatgtcgcgcggctgcatgatctcctacggccagtcttcaggtagcaggccagacccagtccggttgagcgatctcgcgccaaaatcgttgatcctgggcagaccaggactgatgcactacaccaccaaccacgacgaattgctgcaggctgccagtgaagtctttgccagcatcatggccggcgtgctgcaggtgcactccaaccacgtgtacctgctgtcggaggctgcccgcgtgcacaaggatctcgaggctaggaggacatctggttccatcgtgctgatacctgacggccaaaggttgtaggagaatgcaagtgttagccgtggcctctggttctgcattgccatattcagagttttgtgcatgataatgttgctctgggatgcactctgctaaacagtttacgacaattctcaggtactgtgagatttcaaaaaaaaaatcagattgtcttggtggatgaatccatcaatccatcatgtgaaacagtatatgctgtctgtctatattgtgaggtactgtgagacttataaaattctatcagattttcttggtgaatgaatccatcatgtgatgctaccaaaaaaaaaaaaaaaaaaaa

SEQ ID NO: 6780 - protein, 336 aa, Panicum virgatum
  misc_feature: Ceres CLONE 1886532
  misc_feature (1)..(81): Pfam Name: ADH_N Pfam Description: Alcohol dehydrogenase GroES-like domain
MWVKVIKVHELGGPEVLSWEEVEIGDPKEGEIRIKNKAGVNYVDIYYRTGLHRAPLPFIPGKEAVGVVSAVGPGVTSFKVGDVVSYADNPMGSYAEEQIIPASVAIPIPPAIDYKTAASVLLKGMTAYVLVRQAFKVQRGHTVLVHAAAAGVGSLLCQWANALGATVIGTVSTEEKVGQATQDGCRHVIVYTKEDFVTRVAEITSGEGVHVVYDAVGKDTFQAPHFVEQGSLACLMSRGCMISYGQSSGSRPDPVRLSDLAPKSLILGRPGLMHYTTNHDELLQAASEVFASIMAGVLQVHSNHVYLLSEAARVHKDLEARRTSGSIVLIPDGQRL

SEQ ID NO: 6781 - DNA, 2088 bp, Panicum virgatum
  misc_feature: Ceres CLONE 1886602
  misc_feature: Encodes the peptide sequence at SEQ ID NO. 6782
aaggaagagatcggcttatcttcctcccaactcctgatcccctcgccgcctcgtctcctcccacgcacaccagacaccacacctgacacgcgagagctgcttcactcaactctccactccactgtccactccgagccgcggccatggagctcgccaccacggccgcggccgcagccgcctccgccgcgcgcccccacggccccttctcaacccctccggcggtatcagtctccgtctcgtgggccagcccctcgctcgcctccacctcccgctccctctccacgtcctcctccgcctccacctcgcggcgccgacggcggtggctccccgtcgcctcggccgccgtggagctccgcgaggccgcggctgggggcggcgactccgtccgcgtcaccgagacgccgcagcctgggtccagtgttaagttcagcgtggaggtgcctacctcgatcattcaggagtgttaccaattaacgctgcaggagtacgcaaagcgcttcaaggttcctggatttcggcctgggaagatcattccagagaaccttcttataaactatgtaggaccacaacatgtacaggacgccacaattgaagctatcctaaagcatacacttcctcaagcattatcctccgtagagaacaaggcattagaagattctgttcgcattctgactcagtttgatgatatgagaagttctttcacactcaatgatgtgtttaggtatgatgttgctgtggatgttgcccctgaagtccgatggttatcagaagacaaatataagaacctcaaagtcatcgttgaaatagatgaagctgttgatgcagaaaaggcagcagaaaaagagctccagcgtcgtcataaagcactgggcttacttagaatagtggctgacagaggcctccagattggtgatctgggggtactagatatatttgcagaaagtattaacagtgatggatctaaaggtgaaaaaattttgtctgctgagagtacaggtttccacttggacactgaggaaaataataaccttgttcctggatttcttggttcgttaattgggattcgtcctggtgagactagatcgtttcctattcagttcccagagtcatttgagcaagaaagcctacgaggtgttcgtgcacaattcactgttgtctgtaaagagctcttctgtagagaactgccagaaatggatgattcgcttgctggaaagctccttccaggatgcaataccatagctgaggttcgagaacgcatattggaaagatgtaaagaagtggagaaaacagccatagaacaagcaacagataacgcaatccttgatcagctgggaaagttggttgaagttgatattccacgtgccttgtttcaagaacaaggccaacaactttatggagccaaacttctgcagcttcaggcagaaaggaagctagataaagaccagctagcatccctatcgagccagaggtcagttcaggcgtacctagaagatgagaaggagaacattactagaatcattaaacaaatgctggctgttggtgacattttcaagtccgaaaatttgcagtactcaactgaacagctcatcaaggaagttgaaaactctgtggcagagttcaaacagtataatcaagactatgatgaggacaacatcaagcagcaggtccaggatgttctagaggcagcgaaggtgcttgaatggctcaaggagaactgcacgatcgagtacgtcagaagatgagtctaatgttccagggttcagagttcagactattgtgaaagagatggctggtgcagcagactgcaggacagtgacttaaactggacgcacggcttgcagatcacatgagctatgttccttctcgtcaggataaagtacgaagttcaatacaaacaacattaccaacagttcccgaacatgaatccgtgtgtttatttcaaaggtttctcagggcagtttgcagccttttactgaaatcatactggatgctacaatattatgtactcggaatctcccgtggttgattaccatttgggtgtagattttgaagtatgttttccgagccgaaaaaaaaaaaaaaaaaaaa

SEQ ID NO: 6782 - protein, 532 aa, Panicum virgatum
  misc_feature: Ceres CLONE 1886602
  misc_feature (1)..(93): Pfam Name: FKBP_C Pfam Description: FKBP-type peptidyl-prolyl cis-trans isomerase
MELATTAAAAAASAARPHGPFSTPPAVSVSVSWASPSLASTSRSLSTSSSASTSRRRRRWLPVASAAVELREAAAGGGDSVRVTETPQPGSSVKFSVEVPTSIIQECYQLTLQEYAKRFKVPGFRPGKIIPENLLINYVGPQHVQDATIEAILKHTLPQALSSVENKALEDSVRILTQFDDMRSSFTLNDVFRYDVAVDVAPEVRWLSEDKYKNLKVIVEIDEAVDAEKAAEKELQRRHKALGLLRIVADRGLQIGDLGVLDIFAESINSDGSKGEKILSAESTGFHLDTEENNNLVPGFLGSLIGIRPGETRSFPIQFPESFEQESLRGVRAQFTVVCKELFCRELPEMDDSLAGKLLPGCNTIAEVRERILERCKEVEKTAIEQATDNAILDQLGKLVEVDIPRALFQEQGQQLYGAKLLQLQAERKLDKDQLASLSSQRSVQAYLEDEKENITRIIKQMLAVGDIFKSENLQYSTEQLIKEVENSVAEFKQYNQDYDEDNIKQQVQDVLEAAKVLEWLKENCTIEYVRR

SEQ ID NO: 6783 - DNA, 2074 bp, Panicum virgatum
  misc_feature: Ceres CLONE 1886628
  misc_feature: Encodes the peptide sequence at SEQ ID NO. 6784
acccaactccaaccaaacgcaaccaagtcccgcgcacgcaaagaactcgagcttagctcacgtccaaaccgacgcgaccatggaggccgcgccgtcaacggccgcggtcatggagcgcgagcgcctcacggcggagctgcacgtcgtcgccgaggccgcggcggagcccatgcccagcagcttcgtcgtcaagattcgccgccggctgccggacttcgcgcgcagcgtcaacctcaagtacgtccgcctcggcctgcgctccggcggcatccccgcaccctcgtcctgggtcccgctcgcgctcgcgccgccgctcctcaccgcggcggcgcactcgctcgtcggcgcggataggctctactcgctcgacctactcacctgcgtcgcgtggctcggcgcggccgtgctgctgctcaccgtgtacttcctcaagcggccgcggccggtgtacctcgtggacttcgcgtgctacaggcccggcgacgagcactccatctccaaggagggtttcctggagatgaccgagtgcacgggccgcttcaacaccgaggcgctcgagttccaggccaagatcaccacacgctccgggctcggcgaccggacgtacctcccgccggggatccaggcgcggccgccgcggctgtccatggccgcggcgcgcgcggaggccgaggccgtcatgttcgggtgcctcgacgcgctgttcgcgtcgacggggatcgacccgcgccgcgacgtgcgcgtgctcgtcgtcaactgcagcctcttcaacccgacgccgtcgctggcgtccatggtggtgcaccggtacaagatgcgcgaggacatcaagtcgttcaacctcggcggcatgggctgcagcgcggggctcatcgccgtggacctcgccagggacatgctccaggcgaaccccgggtgctacgccctggtggtgagcaccgagaacatcaccctcaactggtacttcggcaacgaccgctccatgctgctgtccaactgcatcttccgcatgggcggcgccgccgcgctgctctccaaccgccgcgccgacgccgggcgcgccaagtaccggctcctccacacggtgcgcacccacaagggcgccgcggaagagtgctacggctgcgtgtaccagcgcgaggacggtaccgggcgcgtcggcgtgtcgctggcgcgcgagctcatggccgtcgccggcgacgcgctcaagacgaacatcacgaccctgggcccgctggtgctcccgctgtcggagcagctcaagttcctcaagtccctggtgctccgccgcgtgctccgcgcccgcggcgtccgcccgtacatcccggacttccggcgcgcgttcgagcacttctgcgtgcacgccggcgggcgcgccgtgctggaggaggtgcagcgcagcctggggctcggggacgccgacatggagcccagcaggtgcaccctgcaccggttcggcaacaccagcagcagctcgctctggtacgagctcgcctacgcggaggccaagggccgcgtccggcgcggccaccgcgtgtggcagattggtttcggctccgggttcaagtgtaacagcgccgtctggcgtgcgctccgcgatgtggcgcccgtgcccgccggcggcggcggcggcaggagcagcaactgcaacccgtgggtggacagcattcagagctaccagccgaaagcgtacatctaaaacagagcgtccgttggatcagatgcagctgcacgagaactgtatgataaaaggacacacaaaattaaaggttataattttcgtttaatttgtttcttgatcaggtaggatcggagttgctgatcgaatcttgttctatctgttgcatgcaagaccacaatgtctgtaatactgtgctgtggttgggtgagtggttaggataatgatattgataccaattaccaagcactggcctgcctttttcacgtttcttattcttattaggtaggagtagagatcaggggtgccgttggaagttgtaacagatgctggtagtaatgtgaatgcgtgtgtaaattaatttgcgttgccatgatactgatcagaagttagtcc

SEQ ID NO: 6784 - protein, 539 aa, Panicum virgatum
  misc_feature: Ceres CLONE 1886628
  misc_feature (1)..(292): Pfam Name: FAE1_CUT1_RppA Pfam Description: FAE1/Type III polyketide synthase-like protein
  misc_feature (11)..(536): SWISSPROT Homolog: EC 2.3.1.- 3-ketoacyl-CoA synthase 1
  misc_feature (41)..(533): SWISSPROT Homolog: EC 2.3.1.- 3-ketoacyl-CoA synthase 11
MEAAPSTAAVMERERLTAELHVVAEAAAEPMPSSFVVKIRRRLPDFARSVNLKYVRLGLRSGGIPAPSSWVPLALAPPLLTAAAHSLVGADRLYSLDLLTCVAWLGAAVLLLTVYFLKRPRPVYLVDFACYRPGDEHSISKEGFLEMTECTGRFNTEALEFQAKITTRSGLGDRTYLPPGIQARPPRLSMAAARAEAEAVMFGCLDALFASTGIDPRRDVRVLVVNCSLFNPTPSLASMVVHRYKMREDIKSFNLGGMGCSAGLIAVDLARDMLQANPGCYALVVSTENITLNWYFGNDRSMLLSNCIFRMGGAAALLSNRRADAGRAKYRLLHTVRTHKGAAEECYGCVYQREDGTGRVGVSLARELMAVAGDALKTNITTLGPLVLPLSEQLKFLKSLVLRRVLRARGVRPYIPDFRRAFEHFCVHAGGRAVLEEVQRSLGLGDADMEPSRCTLHRFGNTSSSSLWYELAYAEAKGRVRRGHRVWQIGFGSGFKCNSAVWRALRDVAPVPAGGGGGRSSNCNPWVDSIQSYQPKAYI

SEQ ID NO: 6785 - DNA, 2307 bp, Panicum virgatum
  misc_feature: Ceres CLONE 1886745
  misc_feature: Encodes the peptide sequence at SEQ ID NO. 6786
actcgttaacgttcacatttcccacgccacactgcgcctgctactccgtagtgccgtcccgtcccgtcccagccgcctcgctcctccggctccgttcccccacctcaccccgccgccgcccccggataggcttccgcgaccacccgcctccctccccgctgtgcgggccctgcggctcgcggcgagcattccgagctccgggtcgccgggggccgacggttgccgcgcggatctgaggctgctgggtcggaattcgggcgaatagctggcagagcgggggttgggtcgggttggtttggcgagtttaggcgggttcgcgcggtgggaggaagagttggttaggtcgtcgctgggtacatgcgcatgcgccccggaggcctctgccgccgccgccgccgcctcgctgtcgtcgggaagcgatgatcgagcagttcgtcaacttcgtcatccggccgcctcgagtacaacccagatcagtatttatgggagcccgagtttacacttgccggaaggaagtacaaaaggctagatttggagcttactaatgaaagaggtcagactctaaaatgcagccactatgttcctgctgtcataccggaagacactgcccttccatgtgttatctactgtcatgggaatagtggatgcagagcagatgcaaacgaagccgctgtaatacttcttccgtctaacattaccctttttacgcttgactttgcgggatcagggctatcaagtggacagtatgtcagcctaggttggcatgagaagcaggatctcaaatgtgcggtgtcctttctacgtaacaataagcaagtttcttgtattggcctttgggggcgctcaatgggtgctgttacaagcctgctgtatggagcagaagacccctcaattgccggcatggttttggacagtgctttctccaacttatatgacttaatgatggagcttgtagaagtttataaaatacgagttcctaagttcacggttaagatggctgttcagtacatgcgacgcgtcattcagagaagagctaaatttgacataatggatcttaatgttgtccagtttgcaccgaagacgtttattcctgcactattcggacatgcatcgaatgatatgttcatccagccacatcacacagaacgtattcaccaggcatatgcgggggataaaaatttaatcaaatttgagggtgatcacaattccccaaggcctcaattttactatgactctgtttctatattcttctataatgttctttacccacctcaatttccttcaacatgctccgataaatttgacaagtattacaaccttggtgcttttaagggtggtcctggtacaaatgagagcttattgtatgagatcatcaatggtctacgggcagccggcactgatgcaggcagttcatcatctgctacaactaatttcacaaatgctacaaaatcagtagttgagttgctgacagagagggtaaatcaactatgtgtcaaaaatgataatgacttggatttccttttggatgaaaatcataacctcactgagatggacagcaacacagctgagtgtcatttagaggataaagcaaacagacaaactgtggagtgctgctcatacaccagctcaaacagagagagctggggaagatgttcttccttgggcgcagctagtgatggatcatcttcaggcgagcagcctgggatacccaatcatgagcataagagcataactctaagggctttagcaacaccactgagacggatacgaaggaagcctctcacgatcccaaaggagaagaagaatcggtccctgtagaagaggctaaaaaaagagaggcaagagatgggggagaacttatcccagcgtctccggctgtgtctccaaggccaggctcgacacaagagaaccaagtcgtcttgactactgtgaatacacaattaactaaggcaaatctgctaggaactcactgatgattcaccaacaagactgcaccgtgacttgagtttctgacattcagcgccatatcatgctgtgtacattggttgaacattacttagaatcttttgtcagatcatggagtgtcccagccccactgtgtgttaactgccaatcttccacattcgttccttattattctttccaatttaatcctgtaaattccatggctgtagaattgttctgtgtgacttgtggacttgtggttggggaaggggcatcagtgcatcgctttcaggatttgtgtagggtttgaaggtcgagttgtatcgatagaatctctcatttcaaaaaaaaaaaaaaaaaaaa

SEQ ID NO: 6786 - protein, 323 aa, Panicum virgatum
  misc_feature: Ceres CLONE 1886745
  misc_feature (52)..(98): Pfam Name: Abhydrolase_1 Pfam Description: alpha/beta hydrolase fold
MGAVTSLLYGAEDPSIAGMVLDSAFSNLYDLMMELVEVYKIRVPKFTVKMAVQYMRRVIQRRAKFDIMDLNVVQFAPKTFIPALFGHASNDMFIQPHHTERIHQAYAGDKNLIKFEGDHNSPRPQFYYDSVSIFFYNVLYPPQFPSTCSDKFDKYYNLGAFKGGPGTNESLLYEIINGLRAAGTDAGSSSSATTNFTNATKSVVELLTERVNQLCVKNDNDLDFLLDENHNLTEMDSNTAECHLEDKANRQTVECCSYTSSNRESWGRCSSLGAASDGSSSGEQPGIPNHEHKSITLRALATPLRRIRRKPLTIPKEKKNRSL

SEQ ID NO: 6787 - DNA, 2343 bp, Panicum virgatum
  misc_feature: Ceres CLONE 1886767
  misc_feature: Encodes the peptide sequence at SEQ ID NO. 6788
gccagcctccaatcgccagcccaccgcgcgcgcgctctcccgatccagcgatggctgcctccgcagctccccaggtcgtggtcctcgggctcctcctgctcgcggggctcgcggcggcgcagagggggacgacgcccgcggccgccgcccccgcgcccgaccccggctgcaacggcatccagctcacctacagctttcagggccgcaccaagatccgccccttcgtcagcgacattaacaagcagccctacgcgttccgcgccaacgccaccgtgctcaactccggcacccgcccgctcaagtcgtgggcgatactcgtcgagttcgcccacggcgagatcctcgtcggcgtcgacggcgccgtgctcacgggcggcggcgagctgccctacaacaccacggaggacgccggcaacgccacctccttctcggggtacccgcagacggacctcctcacgcctatcgccaccgccggcgacctctcgcagatccaggcctccgtcggcatcgtcggcacgctcttcgccgggcccgacccgttcgatccgttccccaccaagctgtcgctggacaacccggattacgcgtgcccggcggcgagaaacgccaccccggcaaccctgtccacgtgctgcgtcctcacgccggaggccgaggccaacgccacggtcatcgacgccaacgccaccgacccgaccaagaacttcctcccgcgcggcaccggcgacctcgtcatcacctacgacgtgctccaggcgtacccctccagctacctcgcgctcgtcacgctcgagaacaacgccaagcttggccgcctcgacaactggcggctgtcgtgggagtggcggcgtggcgagttcatctactccatgaagggcgctcacacgtcggaggtggacacttccggctgcatctatggggcgcaggggcagtactaccagagccttgatttctctcaggtgctcaattgcgaccgcaagccggtgatccttgacctgccgctgtcccggtacaatgacacccagattgggaagattgacaactgctgcaggaatggcacaattctgcccaagtccatggacgagaagcagtccaaatcggcgttccaaatgcaggtgttcaagatgccaccggacctgaaccggaccaagctgttcccccctgccaatttcaagatcgccggtgcttcatcgctgaacccggactatacctgcggccagccagtgcctgtcagcccaacggcaatcccagacccaagcgggcttgactcgacgacactggctgtggcgacatggcaggtggtgtgcaacattaccagaactaaggaggccaagcccaagtgttgtgtgaccttctcggcatactacaatgactcggtgatcccctgcaacacttgtgcatgtgggtgccctgcaaataggcgagggccgacatgcagcacgacagcgcaatccatgctcctgccaccggaagcgctgcttgtgccgttcgacaaccgcacacagaaggccatggtgtgggctgagctgaagcaccacaatgtgccccgcccaatgccatgtggtgacttctgcggcgtgagcatcaactggcacgtctcgacagactacaccaagggctggagtgctcgggtgacattgttcaactgggaggatgtcgacatggccaattggtttgctgccattgtcatggacaaggcgtatgatggctttgagaaggcgtactcgttcaatgccaccgcggtgggcaagaacaccatcttcgtgcagggtctggaggggctcaattacctggggaagcagaccaacatgagtggaacggactaccttgtacccgggaagcaacagtcagtactctcgttcacaaagaagctgacccctgggatcgacgtggtggctggggatgggttcccaacaaaggtcttcttcaatggtgacgaatgtgccatgccgcaaaggattcctatgagcagcggattcaggacccgtctcagcagtgcctttgctttggtgttggtccttgctgcttcagctttcctgttgcttcagcaatgatcctcgggcctctgattcttttattctttcaggtggttcgatctatgccatttgtaagaaagcctttttgtttctgttgatttcttagtagaccttatttagctgctgtttgttagtcaaatggagcggcactcgtgcaaacagtatgaatacttgggtagtgaggaaaaaagaggcgaggacaggcatttgttgcgcgtttgcaacattagttcctccctctgatgacatttacatgtttacaccagatgaacgatctgtatatctctaaaaaaaaaaaaaaaaaaaa

SEQ ID NO: 6788 - protein, 667 aa, Panicum virgatum
  misc_feature: Ceres CLONE 1886767
  misc_feature: Great-hit functional homolog of the protein sequence encoded by LOCUS At4g16120
  misc_feature (1)..(182): Pfam Name: Phytochel_synth Pfam Description: Phytochelatin synthetase-like conserved region
  misc_feature: Useful for making plants with altered cell wall content and/or composition
MAASAAPQVVVLGLLLLAGLAAAQRGTTPAAAAPAPDPGCNGIQLTYSFQGRTKIRPFVSDINKQPYAFRANATVLNSGTRPLKSWAILVEFAHGEILVGVDGAVLTGGGELPYNTTEDAGNATSFSGYPQTDLLTPIATAGDLSQIQASVGIVGTLFAGPDPFDPFPTKLSLDNPDYACPAARNATPATLSTCCVLTPEAEANATVIDANATDPTKNFLPRGTGDLVITYDVLQAYPSSYLALVTLENNAKLGRLDNWRLSWEWRRGEFIYSMKGAHTSEVDTSGCIYGAQGQYYQSLDFSQVLNCDRKPVILDLPLSRYNDTQIGKIDNCCRNGTILPKSMDEKQSKSAFQMQVFKMPPDLNRTKLFPPANFKIAGASSLNPDYTCGQPVPVSPTAIPDPSGLDSTTLAVATWQVVCNITRTKEAKPKCCVTFSAYYNDSVIPCNTCACGCPANRRGPTCSTTAQSMLLPPEALLVPFDNRTQKAMVWAELKHHNVPRPMPCGDFCGVSINWHVSTDYTKGWSARVTLFNWEDVDMANWFAAIVMDKAYDGFEKAYSFNATAVGKNTIFVQGLEGLNYLGKQTNMSGTDYLVPGKQQSVLSFTKKLTPGIDVVAGDGFPTKVFFNGDECAMPQRIPMSSGFRTRLSSAFALVLVLAASAFLLLQQ

SEQ ID NO: 6789 - DNA, 1971 bp, Panicum virgatum
  misc_feature: Ceres CLONE 1886783
  misc_feature: Encodes the peptide sequence at SEQ ID NO. 6790
gggtcactgttccgcccgcctcgtgcgagagccgacgtgtacccgcgccccaacccaactggcagccgcgctccagcttcagaggcggccgggccggcactcggccgccagcccccagccccgcctcggcctctccggccggcagcgctttgtttccgccacctcgccgcgatccggcggccaaacccacccggatccgcgtcggtccgccgagcaggttgttgtccgaaaggaaagccgtccgttcccttctccctcccggttagttatagcttgcgtcgcgccgcgaaatccagccccgcccgtctctcctctcctctcctcttccccccgaacgagtcgagccgggctatgtagcttgcgcacctgcgcttggcctcgttgttgcctgcagcgagacgcgagaggaggaggaggaggaggcaatggggggagcggaggggccgggccacccgaacggccacgcgaacggggccgtcgtggaggagaagctggacgagctgcggcggcagctggggaaggcggacggggacccgctccggatcgtcggcgtcggggcgggcgcgtggggcagcgtcttctgcgcgctgctgcaggacgcgtacggccacctccgcgacaaggcgcaggtccgcatctggcgccgccccggccgcgccgtcgaccgcgccaccgccgagcacctcttcgaggtcatcaacgcgcgcgaggacgtcctgcgccgcctgatccgccgctgcgcctacctcaagtacgtcgaggcgcgcctgggggaccgcacgctctacgccgacgagatactcagggacggcttctgcctcaacatgatcgacaccccgctctgcccgctcaaggtcgtcaccaacctgcaggaggccgtctgggacgccgacattgtcgtcaacggcctgccctccaccgacaccagggaggtcttcggggagattgggaggtactggaacgagaggattacggcccccatcatcatctcgctggccaaggggatagaggcctccctggatccactgccacggatcataactcccacgcagatgattagcaatgcaactggggttcctctggagaacattctatatcttggtggcccaaatattgcctctgaaatttacaacaaagaatatgcaaatgcgcgtatttgtggagctgacaaatggaggaaacctcttgcgaagttcctgaggcagcctcattttattgtgtgggataatagtgacctcatcactcatgaagttatgggaggcttaaaaaatgtatatgctattggtgctggtatggtagcagcactaaccaatgagagtgcgacgagcaaatctgtttactttgcactttgcacatctgagatgatctacatcacacaccttctggaagaagaacccgaaaaacttgccggaccgttattagcagacacttatgtcacattgttgaaaggtcgtaatgcctggtatgggcagaagttagctaaaggggaattgacattagaaatgggtgacagcataaaaggcaaagggaccattcagggtgtctctgcagttgatgcattttatgagcttcttagtcaggatagcttaagtgtgatgcatccagaagccaacagatctgttgcgccggttgagatgtgcccaattttaaaagcactgcatagaattttgatcaagagggaccgtcctgctgactcgattcttcaggctataagagatgagacaatgtatgatccacgtgaaagaattgagatggcacaaggtcactcactttaccgaccatctcttcttggtcaaccaaaaggagatgtaaaagcctagaattatttcccccactttgtcttgttggttagaatttagatgatgttctaagatatctatgtcgttatgtgctcttacgcatgctgtacctgttgttataacattagtgaaatctgaggggatatttattgaaaaaaaaaaaaaaaaaaaa

SEQ ID NO: 6790 - protein, 464 aa, Panicum virgatum
  misc_feature: Ceres CLONE 1886783
  misc_feature (1)..(204): Pfam Name: NAD_Gly3P_dh_N Pfam Description: NAD- dependent glycerol-3-phosphate dehydrogenase N-terminus
MGGAEGPGHPNGHANGAVVEEKLDELRRQLGKADGDPLRIVGVGAGAWGSVFCALLQDAYGHLRDKAQVRIWRRPGRAVDRATAEHLFEVINAREDVLRRLIRRCAYLKYVEARLGDRTLYADEILRDGFCLNMIDTPLCPLKVVTNLQEAVWDADIVVNGLPSTDTREVFGEIGRYWNERITAPIIISLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALHRILIKRDRPADSILQAIRDETMYDPRERIEMAQGHSLYRPSLLGQPKGDVKA

SEQ ID NO: 6791 - DNA, 2023 bp, Panicum virgatum
  misc_feature: Ceres CLONE 1886828
  misc_feature: Encodes the peptide sequence at SEQ ID NO. 6792
gtggcttagcggaggtttgttttctttctttctcgctgcgtgagggtgggaaaccgtgtgaattttggattaggaaagggctttctgatcagacttctccgtggattctggaagggaaaacgatggtgccggattttgttggtagcctcatgtagccattcttgagcgccttccctttgaagtagaagtggtttcgttcgtccgcgagcttttgagaccctgcggattttggattggggcagggtattgtgatgaaacccctccgccgctagatgccgatcggaggcgtaattttgatgaggtggtgctcttgtttggggactggtagcggatgcgcaccatttgtcgaagtgtgtctctgagtagtcgttttatttgatcatcaaaggtgctgtgttcgaatttctccaaaggctgcttaagatgttctgactatgaatttgcccttagccacaagattcttctgcgtagaattgcttgatttcggatcaatagtgttccctcctctcacatggattgttaatttatctgcatgttaacctttgtcacttcgagatacacaatgcatctttgtcatgagcttttatccttgcatcgatggaattttcttctcagaccctccttgcatacatcacacaggtagttcacctggtggatttaggtcctagcaacaattttaactcgaacttccgttgtcaactccttagaaacagttctctaaacatgaaggttatcttttattatatgtttgtattcgcgaccattttaaagcctcatgatcaaaacgttcctggctttggcaaacaagttaatatgacaatttagctattagctcctgaactcttgtttctgcagtcgtgactgcctgattcctggaatcaagcgcatcgcggagaacatgagcaaggcaggttctcagcgtggatatcatacccggagcaatgagccctggactcgcctttcccatagagagaagaaaccgggatggtttgcgtataatccaaggaccatgaggcctccaccacttagcagtgataccaattctatgaagattctgtcctggaatgttaatggactgcaaactgctgtagattcaggattttctgctgatcaactggctactagggagaactttgacgttctatgtcttcaagagacacacttgcaggagcgcaatgtcaacgcttttaagaatctgatacaaatacaagacttcgataacagctattggtcatgcagtgtcacaaggctcaattactcaggaactgcagtgatttcacgggtaaaaccaatctctgtccaatatggacttggcacaccagagcatgatcaggaaggcagggttattactttggagtttgatgatttttacttgatcaatgcttacgtgccaaattctggccgtggtttacagagattgaattacagggttaatgattgggatttatgcttcagtgacttcataaagaaactggaatgttccaaaccagtaattgttgctggtgatctcaactgtgctcgccaaagtattgacattcacaatcctcaagcaaaaactgaggctgcaggtttcacaattgaagagagggagtcatttgaggagaacttttctagcaaaggccttgttgatactttccggaaacaacacccgaatgctgtggcctacaccttctggggtgacaaccagcgcattagcaacaaaggctggagattggattactttcttgcgtcagaatccattgccgacaaggtccatgattcgtacatcctaccagatgtatcgttcagcgaccatagtccaattggccttgtgctgaagctgtaggcgctgatgcgtctctcaactgaagactaaataacatagcgtcatcctcgatagaagactcgtacaaaatttgcgtgtccaggctggtaggatcactccgtgttcctgaaattggatgtctacatacattgagcgatttggctatctttttgagatacctcgtgaagcattccaccgaaaaaaaaaaaaaaaaaaaaa

SEQ ID NO: 6792 - protein, 308 aa, Panicum virgatum
  misc_feature: Ceres CLONE 1886828
  misc_feature (1)..(255): Pfam Name: Exo_endo_phos Pfam Description: Endonuclease/Exonuclease/phosphatase family
  misc_feature (15)..(308): SWISSPROT Homolog: DNA-(apurinic or apyrimidinic site Apurinic endonuclease-redox protein
MSKAGSQRGYHTRSNEPWTRLSHREKKPGWFAYNPRTMRPPPLSSDTNSMKILSWNVNGLQTAVDSGFSADQLATRENFDVLCLQETHLQERNVNAFKNLIQIQDFDNSYWSCSVTRLNYSGTAVISRVKPISVQYGLGTPEHDQEGRVITLEFDDFYLINAYVPNSGRGLQRLNYRVNDWDLCFSDFIKKLECSKPVIVAGDLNCARQSIDIHNPQAKTEAAGFTIEERESFEENFSSKGLVDTFRKQHPNAVAYTFWGDNQRISNKGWRLDYFLASESIADKVHDSYILPDVSFSDHSPIGLVLKL

SEQ ID NO: 6793 - DNA, 1906 bp, Panicum virgatum
  misc_feature: Ceres CLONE 1886906
  misc_feature: Encodes the peptide sequence at SEQ ID NO. 6794
attcgagctagccaagaaaagattgtcacctgcagtgattgcgagatgcctgtcaaaactcacaactcattgattcttttgttactctaggcatttttcagtttctgtaaagggtatgaaccactctgcaaagatgacaccggctctgaggctgttgctagcatttctggcaattggatcctgcatcgctgctgacaacatcgacttgtggccgatgcccaagatggtgtcccatggaacacagaagctctacatcaagaaagatatcacaatgtcaatggtgggaagcacctattctgacgataaatcaatcctgaaggacgccttccagaggatggttgatttgatcacactaaaccacgtcgtcgatggaatgaacccaagttctttggttctcacctgtattaatatagttgtccatacaactgaagatgagctcaactttggggcagacgagtcatataacttaacagttccaactacaggagatccactgtatgcacaaattgaggctcaaaccgtttttggagcacttcatggcttacagacatttggtcagttgtgttactttgatttcacatcacgactcatcggactcaattcagctccttggataattactgacacaccaagatttccttacaggggactgcttattgatactgcaaggcactacctacctgttaagataatcaaaggagtgattgatgcaatgacctacagtaaaatgaatgttctccattggcacatcgtagacgagcaatcctttcccattgaaataccttcatatcccaaactgtggaatggttcatactcttattcagagagatacacaatgtctgatgcgatggacattgtacggtatgctgaaaggcgaggtgtaaatgtgttggctgagattgatgttcctggtcatgcccgttcatggggcgttggctacccgtcattatggccatcagatagctgcagagaaccacttgatgtcagtaaaaactttacatttgaagtcattgatggcattctttcagattttagcaagatttttaagttcaaatttgcccacttaggcggtgatgaagtaaacacaagctgctggaccaaaacaccacacattgaaggatggttgaataatagccatatgaacgcatcagatgcatacagagatttcgtactaagatctcaaaagatagcaatatcacatggctatgatatcattaactgggaagaaacgtttaacaattttggagataaattggatcgtaaaaccgtggtgcataactggcttggagaagatgtagcaccaaaagttgttgctacggggcttagatgcatagtaagcaaccaggataagtggtacctggatcacttggatgcctcatgggaaggattttacatgaacgaacccctgaaaggtatagatgacacaaaacagcaacatttggtcatcggaggtgaagtatgcatgtggggcgaggaaattgatgcatcagatattgaacaaacaatctggccacgtgctgcagcagctgcagagagactttggactccgattgagaagcttgcaaatgacacaagattagtcacatcaagattggcacgcttcaggtgtttgctgaaccaaagaggagtagctgctgcaccactagctggttatggtcgtgcatcaccagcagaacctggtccctgtgtaaggcaatagaatatccataacaaaagggaaacaggtattcacagaggaaaaccagtcattccatgaaggaaaaggaatccttttacccccgttgatatgttcaacatagtctacgtcagataggtatctttgtttgtgtagaaggtttcatgtcttttttttcctgttcttcaaccccaattttcttccataataattcggatggctatgaggtcc

SEQ ID NO: 6794 - protein, 527 aa, Panicum virgatum
  misc_feature: Ceres CLONE 1886906
  misc_feature (1)..(306): Pfam Name: Glyco_hydro_20 Pfam Description: Glycosyl hydrolase family 20, catalytic domain
MNHSAKMTPALRLLLAFLAIGSCIAADNIDLWPMPKMVSHGTQKLYIKKDITMSMVGSTYSDDKSILKDAFQRMVDLITLNHVVDGMNPSSLVLTCINIVVHTTEDELNFGADESYNLTVPTTGDPLYAQIEAQTVFGALHGLQTFGQLCYFDFTSRLIGLNSAPWIITDTPRFPYRGLLIDTARHYLPVKIIKGVIDAMTYSKMNVLHWHIVDEQSFPIEIPSYPKLWNGSYSYSERYTMSDAMDIVRYAERRGVNVLAEIDVPGHARSWGVGYPSLWPSDSCREPLDVSKNFTFEVIDGILSDFSKIFKFKFAHLGGDEVNTSCWTKTPHIEGWLNNSHMNASDAYRDFVLRSQKIAISHGYDIINWEETFNNFGDKLDRKTVVHNWLGEDVAPKVVATGLRCIVSNQDKWYLDHLDASWEGFYMNEPLKGIDDTKQQHLVIGGEVCMWGEEIDASDIEQTIWPRAAAAAERLWTPIEKLANDTRLVTSRLARFRCLLNQRGVAAAPLAGYGRASPAEPGPCVRQ

SEQ ID NO: 6795 - DNA, 1780 bp, Panicum virgatum
  misc_feature: Ceres CLONE 1886911
  misc_feature: Encodes the peptide sequence at SEQ ID NO. 6796
caaactcctctaacgatcgatctgacttgttaaagcatcgagatgctctacactccagctgccccagccagccagccaccggcggaagattgcaaggaaaccatggcagcctcccctccgccgccgagcaagaagctgcgcgtccttctcatccccttcttcaccaccagccacatcggccccttcgcggacctcgccttccacctcgccgcggcccggccgggcgccgtcgaggccaccgtcgccgtcaccccggcgaacgtcccggtcctccggtcggcgctcgcccggcgcggccccggccccgacggcgccgccccggtccagatcgcgacgtacgcgttcccgcccgtggacggcctcccgccggaggtggagaaccactccgccgccagcgccgcggacgcgcagcgcatcgacgacgccgccggcgacgagcagctgatgcggccgcggcacgagggcctcatcagggaccactcgcccgacgccgtcgtctccgacctgcacttctactggaacgccgacatcgccgccgccaccggcgtgccgtgcgtcacgttccacgtcataggggtgttcccgatgctggcccagttctgcttgacgggtgcggaggccgccggcggggcggtgactcttcccgagtttctggccggaccggacacacggatcccggtcaccgagctgccggaggtggtgaggaaccagcggccggaggacagcgccaggggagcccgagcaagctcagcgcacaacgggggcttcgggctcgtcgtcaactctttcttcgatttggagaacaagtattgcgacatgtacgcgagccacatgaaacgcgcctacttcgtcgggcccttgtcgctgccgccgccaccgtcgccgccggccgccggcgacggcgacgacggctccggctgcatcgactggctggataggaagccggccgggtcggtcgtgtacctgtgcttcggcagcttgacacacatgtccgaggctcagctccgcgagctcgccctcgggttggaagcctccgggaagccgttcctgtgggtggtcaggtcggcggcggcggcgtcggcgctgccggaggggtggaaggagcgtgtcggggacagagggatggccgtcacggggtgggccccgcagacggcgatcctcgcgcacccggcggtgggggcgttcgtgacgcactgcgggtggaactcggtgctggagaccgccgcggccggcgtgccggtgctgacgtggccgatggtgttcgagcagttcctcaccgagaggttcgtgacgcgggtgctggggatcggcgagcgcctgtggccggagggcgccggggtgaggagcacgaggtacgaagagcacgagctggtcccgagcgaggcggtggcgcgagcggtgaccgggttcatggagcccggaggggcgggggaggccgcgaggagcagggtcaaggagctcgccgccaaggctcacgcggccatggcggaaggtgggtcctcgcacggcgacctgcgccgcctgattgatgatctcatccaagaaagaacggctggcgcagggacgacgccatagtctgatgccctgatcggttctagctcatgatgaagcaagcgtgtctctttttttttaagaataagcgtgtcgcatttatctgtctgttttcggtttggattttccactgtttggttagtaagctccagtacacctgagcttcaagatcttattttcagaataagatgacgtatttcacctcttccaaaaaaaaaaaaaaaaaaaa

SEQ ID NO: 6796 - protein, 510 aa, Panicum virgatum
  misc_feature: Ceres CLONE 1886911
  misc_feature (2)..(125): Pfam Name: UDPGT Pfam Description: UDP-glucoronosyl and UDP-glucosyl transferase
MLYTPAAPASQPPAEDCKETMAASPPPPSKKLRVLLIPFFTTSHIGPFADLAFHLAAARPGAVEATVAVTPANVPVLRSALARRGPGPDGAAPVQIATYAFPPVDGLPPEVENHSAASAADAQRIDDAAGDEQLMRPRHEGLIRDHSPDAVVSDLHFYWNADIAAATGVPCVTFHVIGVFPMLAQFCLTGAEAAGGAVTLPEFLAGPDTRIPVTELPEVVRNQRPEDSARGARASSAHNGGFGLVVNSFFDLENKYCDMYASHMKRAYFVGPLSLPPPPSPPAAGDGDDGSGCIDWLDRKPAGSVVYLCFGSLTHMSEAQLRELALGLEASGKPFLWVVRSAAAASALPEGWKERVGDRGMAVTGWAPQTAILAHPAVGAFVTHCGWNSVLETAAAGVPVLTWPMVFEQFLTERFVTRVLGIGERLWPEGAGVRSTRYEEHELVPSEAVARAVTGFMEPGGAGEAARSRVKELAAKAHAAMAEGGSSHGDLRRLIDDLIQERTAGAGTTP

SEQ ID NO: 6797 - DNA, 2248 bp, Panicum virgatum
  misc_feature: Ceres CLONE 1886919
  misc_feature: Encodes the peptide sequence at SEQ ID NO. 6798
atctccccgcctcctccactcgcgcactccctcgcacagcagcggccactagggtttaaacttcctccgccgcggatccgcctcgccgccggcccccagatcgccgcccgccggagaccgaggatggtggggctgggcgcgatgccggggtacgggatccagtcgatgctcaaggagggccaccgccacctctccgggctcgaggaggccgtgctcaagaacatcgacgcctgcggcgagctctccgccatcacgcgcacttccctcggacccaacggaatgaacaaaatggttattaatcacttggacaagctgttcgtgacaaatgatgctgccaccatcgtgaacgagctcgaggttcagcacccggctgctaagatcctggtactagctggcagggcacagcaggaggagattggggatggggctaatctcaccatatcgttcgccggtgaactgcttcagaaggcaggggagctcatcaggatgggcttgcatccgagcgagatcatcattggctacaccaaggccatcaacaagactattgagatcttggaggaccttgtcgagaaaggctcagagaacatggatgtaagaaataaggaggaggttgtgttgaggatgagatcagctgttgcgagcaagcaatttggccaggaggatattctgtgccctcttgtggctgatgcctgcatgcaagtttgccccaaaaatcctgcaaacttcaatgtcgacaatgttagagtggctaagctggttggaggtggtttgcgcaattctactgttgtccgcgggatggttctaaaaaatgatgccgttgggagcatcaaaagggtggaaaaggcaaagattgcagtatttgctggtggcgttgatacttctgcaactgaaacaaagggaactgtgttgatacattccgctgagcagctagaaaattatgctaagaccgaggaagctaaggtggaggagcttatcaaagctgttgctgactcaggtgccaaggttattgtcagtggggcagcagttggtgatatggcgctacatttctgtgaacgttacaaactaatggttttgaaaatcagctcaaagtttgaattgagaagattctgccgtactactggggctgttgcaattttgaaacttagccaaccaaatgtggacgaattaggatatgcagactctgtttcggtggaggaaattggtggtgctcgagtgactgttgtcaagaatgaggaaggtggaaattctgtggctactgttgtcttgaggggcagtactgacagtatactagatgatcttgaaagagctgtcgatgatggtgtcaatacttacaagtcaatgtgcagggacagtcggataattcctggtgcagctgcgacggaaatagaactggcaaagagattgaaggagttttctttgaaggaaacagggttggaccagtacgccattgcaaaatttgctgaaagttttgaaatggttccaagaaccctatctgaaaacgctggacttaacgcaatagagataatatcatctctttatgctgagcatgctgctgggaatacaaaagttggcattgacctggaggaaggtgtttgcaaggatgtctctgtcttgaaaatatgggacctctacgtcacgaagttttttgccctaaaatactctgctgatgctgtatgcaccgtactacgggttgaccagatcatcatggcaaagccagcaggagggccaaggagagatgcccagcctggtggtgggatggatgaggattagtttctcactttcgcttgtgtacgcttgttttcactgtgtcacgcttgcgaggtttcagagcagagtacatctgtatcttatctaggctttggttctgtagaagattttgggtgccctggagctcacgtttgggagcattgcatggttgagccgagtccttccctggtatattgtggtggtgatgtatcaaatgattgactccagggtttgttctttcagtttatcacaaaaactgagctcatgtaagtgatactttagttctagctggaagactgcaagttgtcttattattagtcaatttacgaaggcagtttatcacaaatgctccgatggtgagcattttgtgtgagcatggcataactaaggaatggtgattggactatccacccccgtattatcctagctgcaaatgttgtacttaattataatcattttcgatcaagtaattttgtacctccaaaaaaaaaaaaaaaaaaaa

SEQ ID NO: 6798 - protein, 548 aa, Panicum virgatum
  misc_feature: Ceres CLONE 1886919
  misc_feature (1)..(490): Pfam Name: Cpn60_TCP1 Pfam Description: TCP-1/cpn60 chaperonin family
MVGLGAMPGYGIQSMLKEGHRHLSGLEEAVLKNIDACGELSAITRTSLGPNGMNKMVINHLDKLFVTNDAATIVNELEVQHPAAKILVLAGRAQQEEIGDGANLTISFAGELLQKAGELIRMGLHPSEIIIGYTKAINKTIEILEDLVEKGSENMDVRNKEEVVLRMRSAVASKQFGQEDILCPLVADACMQVCPKNPANFNVDNVRVAKLVGGGLRNSTVVRGMVLKNDAVGSIKRVEKAKIAVFAGGVDTSATETKGTVLIHSAEQLENYAKTEEAKVEELIKAVADSGAKVIVSGAAVGDMALHFCERYKLMVLKISSKFELRRFCRTTGAVAILKLSQPNVDELGYADSVSVEEIGGARVTVVKNEEGGNSVATVVLRGSTDSILDDLERAVDDGVNTYKSMCRDSRIIPGAAATEIELAKRLKEFSLKETGLDQYAIAKFAESFEMVPRTLSENAGLNAIEIISSLYAEHAAGNTKVGIDLEEGVCKDVSVLKIWDLYVTKFFALKYSADAVCTVLRVDQIIMAKPAGGPRRDAQPGGGMDED

SEQ ID NO: 6799 - DNA, 2620 bp, Panicum virgatum
  misc_feature: Ceres CLONE 1886946
  misc_feature: Encodes the peptide sequence at SEQ ID NO. 6800
ctttctctctccttccgtcgtcttgccatttcctccctcttctgcgcactgcaaactaaccaaaccttcctcccttggctctctctctcctctcctccctcgccgccctgcgtgaaccgcggagcaagaaggaaggcggggcgttgcctcgtttggggggctggggctgggaggacgcctacaaatcgcttgtttctccaattcgggcgcggtttgggctgagaggaaaggaatccgtggggctgtagcccccatcgggggtgcggtgcggtcgttcggattgaaggaatcgtcccatttcgtgtgctccccgattggtgcggggcaagggttgcaactttctggccatcgcatcctgcgctacgcgattggggattcggccatcgcagcctgcgctgcgcgattggggattccgccgtcggcggggcgaagtgacggttctgcgccacttttccccaattcctgatttaatttgcctggaacgcgagatgggattgtaatctcggtcgctgttctgcgcggctctctgagggtttcctccatcctggattgggaaggaagaaacccttggatatccgtctccatggcgtccactttgtagtttccggaatctaacttggtagtgctagtgtaaatattagtggtagcagctgttgaggaagctccggcctctttagtagcctccctgtgaagatgtcggccgcaggtgtcattgccctcgggccagtcccggaagaccctgccttccttcccatctgcttcaacgccagccgctcgccgcactgcttgtctgggtcgcagctgcaggattccattcttattttcctcgctgtgcccggcatgccgcccatgcccatgagcgtgctgggatctgagtccatcgcctcagtcaagctgcgcatccagcggttcaagggttttgtggtgacgaagcagcggcttgtgctggatggccatgagctggcacgcaacaactgccctgtcaaggattatgggctggctgagggaaatgttctgcaccttgttattcggctatctgatctccgggtgattaacattgagacagccgctgggaagaagtttcagtttcaggtggaccaaagccgcaatgtcaaatatctcaagactaagctggcagatgagggtgatgaggatattggtaacccggaggatcacaagcttgagtatgatggtgaggagctcgaggaccaccagcttattgctgatattagcaagagggatgatgccgtgattcacctgttcatccgcaaaccagcaaaggtacgaacacagcaagttgatagagatactttggtcacagttgtcaatccacaggagaaagggaacctgcaaaatgaagctcatgctgtgaaatcagcaaaatcagctgggtttaggcctgctcctgttgaaccagttattgttaatagaaaagtgaaattgtcacctgaagtgatgagaatgataagttcaaccatagctggcctggagaaaggacacctgcctgtcatgtcagctgaaggttcaggaggggtttacttcatgcgagatgcaacaggtcagaagaatgttgccgtgtttaagcctattgatgaggaacctatggctgaaaacaacccaaggggccttcctttgtctactgatggtgtaggaatgaaaaggggaacaattgtaggggaaggagcacttagggaagtcgcagcttatattctcgaccatccagttggtgatcatatatctggtcacactgttgggttttctggtgttcctcctacaacattggtccgaagcatacatagggggaagagctttaagattgggtcactgcagatgttcatggagaacaatggaagcactgaggatatgggtcctcgagctttccctgtcaaggaggttcacaaaatagcagttttagatattaggttagcaaatgctgatcgtcatgctgggaatattctagtgcacaaggaggaagaaggtgacaactacaagctgattccgattgatcatggctactgcttgcctgagaagtttgaagattgtacgtttgagtggctctactggccccaagcccgtgaaccattcaatgatgaaaccattgaatacatcaaatcacttgatgctgaaaaggacattaaacttctcaagttccatgggtgggagctgtctccaaaatgtgctcgtgccctgcgcatcagcaccatgcttctcaagaaaggtgcagctcgtggcctcacaccatttgacatagggcgcatactgtgtagggaaactgtgaatagagactctgagattgaggacatcatccaggaagcagaggatgctgttctcccagggtcaagcgaaaatatgttcttagaaaccatatctgaaatcatagaccatcacctcgacaaggagtttgcttagagtttcagaataactgatctagttgttccagctgtatccagttcgttgtaagtatgttgacaaggcactggtcaagagactaatgatttcatttgtttgtatcctcaaatgatttcacttggttgtagttcctcaagtactttgcttatgcacattttgtgaatatatgcctgttgggtcagactttatcgaaaaaaaaaaaaaaaaaaaa

SEQ ID NO: 6800 - protein, 571 aa, Panicum virgatum
  misc_feature: Ceres CLONE 1886946
  misc_feature (1)..(250): Pfam Name: PI3_PI4_kinase Pfam Description: Phosphatidylinositol 3- and 4-kinase
MSAAGVIALGPVPEDPAFLPICFNASRSPHCLSGSQLQDSILIFLAVPGMPPMPMSVLGSESIASVKLRIQRFKGFVVTKQRLVLDGHELARNNCPVKDYGLAEGNVLHLVIRLSDLRVINIETAAGKKFQFQVDQSRNVKYLKTKLADEGDEDIGNPEDHKLEYDGEELEDHQLIADISKRDDAVIHLFIRKPAKVRTQQVDRDTLVTVVNPQEKGNLQNEAHAVKSAKSAGFRPAPVEPVIVNRKVKLSPEVMRMISSTIAGLEKGHLPVMSAEGSGGVYFMRDATGQKNVAVFKPIDEEPMAENNPRGLPLSTDGVGMKRGTIVGEGALREVAAYILDHPVGDHISGHTVGFSGVPPTTLVRSIHRGKSFKIGSLQMFMENNGSTEDMGPRAFPVKEVHKIAVLDIRLANADRHAGNILVHKEEEGDNYKLIPIDHGYCLPEKFEDCTFEWLYWPQAREPFNDETIEYIKSLDAEKDIKLLKFHGWELSPKCARALRISTMLLKKGAARGLTPFDIGRILCRETVNRDSEIEDIIQEAEDAVLPGSSENMFLETISEIIDHHLDKEFA

SEQ ID NO: 6801 - DNA, 1423 bp, Panicum virgatum
  misc_feature: Ceres CLONE 1887066
  misc_feature: Encodes the peptide sequence at SEQ ID NO. 6802
accaaacacacactcgagctaagctcagagcctcacagcttccctcgagctaccagtgttagcttaggaggagaaggaaaccaagcaagctactgcagcagcaatggcgaagtctcgcaccttgctgttcggcgcactagtcgtgctcgcgcttctggtgagccccattgcttgctcccgcaagctcgccaagcccaacaagcacaagccgagccacaagccggctgtcggggcccgcggcaactacaccgccaccccatcggcctccgacgcctacggctccggtggctggctgtccgccggcgcgacgtactacggcgcccccaacggcgacggcagtgacggcggcgcatgcggctaccagaccgccgtcgggcagcggcccttctcgtcgatgatcaccgccgggagcccgtcgctgttcaagggcggcaaggggtgcggcgcctgctacgaggttaaatgcgacagcaacccggcgtgctccgggcagccggccaccgtggtcatcaccgacgagtgccccggcggggtctgtctcgccgaggccgcccacttcgacatgagcggcacctccatgggcgccatggcgaagcccggcatgactgacaggcttcgcgccgccggcatcctgaagatccagtacaagagggtgccgtgcaagtacagcggcgtgaacatcgcgttccgggtggaccagggctccaacccgttctacttggaggtgctggtggagttcgaggacggcgacggcgacctcagcgccgtcgacctgatggaggccgggtgcggcacctggacgccgatggtgcagaactggggtgcgctgtggcgctacaactccaacaccggcaaggcgctgagggcgcccttctcgctccggctcacctccgactccggcaaggtcctcgtcgccaacaacgtcatccccgccggctggaaggccggagccacgtaccgctccttggtgaattactcttaattattgaaccgcggcgcggtttaattttcacccccgctgcgcttggccggatttattacgcgcggccaagaattgctcgcaggggtgtggtggctaagaacgagtcttcgagtttgtttcgtgtgaaatctgtgtccggggtgcctgcgagaggcggtgtcagaagaggaggaggaggaggaggaggttaaagagccgtgttcttcactccctccacggtctctgcagtcccctagtgatgtgtgccagtgtgaagtcgtcgtgtcgagttctctgtagtagactgtagttccttttgctgtgctgctgagagaagctcgagctgcgactaaaaaggttgcaagccggcagttgtatcaagttgtgtgaatgtttttttgtaccacgcaatcatttcagagtaatgaattactgctatctcaaaaaaaaaaaaaaaaaaaa

SEQ ID NO: 6802 - protein, 292 aa, Panicum virgatum
  misc_feature: Ceres CLONE 1887066
  misc_feature: Great-hit functional homolog of the protein sequence encoded by LOCUS At2g45110
  misc_feature: Useful for making plants with altered cell wall content and/or composition
MAKSRTLLFGALVVLALLVSPIACSRKLAKPNKHKPSHKPAVGARGNYTATPSASDAYGSGGWLSAGATYYGAPNGDGSDGGACGYQTAVGQRPFSSMITAGSPSLFKGGKGCGACYEVKCDSNPACSGQPATVVITDECPGGVCLAEAAHFDMSGTSMGAMAKPGMTDRLRAAGILKIQYKRVPCKYSGVNIAFRVDQGSNPFYLEVLVEFEDGDGDLSAVDLMEAGCGTWTPMVQNWGALWRYNSNTGKALRAPFSLRLTSDSGKVLVANNVIPAGWKAGATYRSLVNYS

SEQ ID NO: 6803 - DNA, 2039 bp, Panicum virgatum
  misc_feature: Ceres CLONE 1887148
  misc_feature: Encodes the peptide sequence at SEQ ID NO. 6804
ctcaagaatctccccgtcccttccccccactccactctttcatccacgagcacgagctccgcgcgatcatagaacccactctccgggcctggttccggctgacgaggggttgggattgcggcgaaaggttggagcttttcttgatttgcactgccgccggcattgggaggagagggggtcctgttcttgacgttcttgggagctcgctgagccgagttgcgggcgttcttgggtcgggtgcgggtgtccaggttctgaagcatgaacttatggtttatctttctcttgcctcttctctgtctgcctgcacgggttcgatcagaggattactcggatgtgactgtaattgttcgaggctctgagacaattgcttcaaccagcgatgagtttgtctgcgccaccattgattggtggcccccagagaagtgtaactatgaccaatgtccatggggaagggcttctgtcttaaatttggacttgactaatcctttgttggctaaagctattcaagcctttagcccactacgaatcagagtcggaggctccttacaagatcaggtgctatatggcacaccaaatttgggatctccatgcgatccatttactaaggtttcaggcggtctgtttgggttttctcaaggatgcataaccttggaaagatgggatgctattaatgatctgttcctgaatacaggtgcagttgttacatttggtcttaatgcacttcaaggacgacggcagataagcagaagtgtttggggaggtccttggaattcgagcaatgctcgagagttcatggaatacacagtttcaatgaactatcctatagattcttgggaatttggtaatgaattgagtggaagtggaattggtgcgagtgtgggagctgaacaatatggaaaggacctagttgaactccaaacaatcatcaacgagttatatggagattccaggaaaccactggttgtagccccaggaggattttatgaccaaaaatggtttgctcaacttcttaaggtatccggcccaaatgttctcaatgcaatgactcatcatatttacaaccttggtgctggtaacgatccacaagttccagatagaattttgaacccacaatatttgagccggacttccgacacattcagaagtctccaactaacaatacaacgccatggaccatggtctgctccatgggttggggaagctggtggcgcatataacagcggcagccgtctcgtgtctaatactttcctgaatagcttctggtatcttgatcaatttgggcaatcagcaaagtatgacaccaaggtttactgcagacagacgctgattggtggcaattacgggcttcttgacactgacactttcgtaccaaacccggattactacagtgccttgctgtggcatcggctcatggggacaggagttctttccacagacatcagtggttcttcatacttgcgtgcttatgttcattgcgggaagcagaaggggggcgtcgcactcctcttgttgaacctgcaccaaagcatgggattcatggtttcagtcaggaacgacctcaatgtcaatctcgcagaggggcaagggatcagaagggacaatgtgtttgtccatggctttaaaaggacggtttcttgggtcgggagcaaagcttcagacgggtattccaagagggaagagtaccatctctcggcgaaagatgggaacccctttgcccggaccatgctcctgaatggagttcctctagaactcactgaagatggtgacatccctccattatatcctgtggaagtttcggtcaattcaccaatctatgttgctcctctgaccattgcgttcgtcgtgttcccagacttcgaggctgaagcttgtggtcgatgattaactgtagagatgttctgaagagtgaagagcatggacactgtaaagatacgtgtttttgttttctgacgatctgtgtcccaattgggggccgcattttcccaacaaatagagttccctggttactaatgttataaaaaaaaaaaaaaaaaaaa

SEQ ID NO: 6804 - protein, 540 aa, Panicum virgatum
  misc_feature: Ceres CLONE 1887148
  misc_feature (1)..(319): Pfam Name: Glyco_hydro_79n Pfam Description: Glycosyl hydrolase family 79, N-terminal domain
MNLWFIFLLPLLCLPARVRSEDYSDVTVIVRGSETIASTSDEFVCATIDWWPPEKCNYDQCPWGRASVLNLDLTNPLLAKAIQAFSPLRIRVGGSLQDQVLYGTPNLGSPCDPFTKVSGGLFGFSQGCITLERWDAINDLFLNTGAVVTFGLNALQGRRQISRSVWGGPWNSSNAREFMEYTVSMNYPIDSWEFGNELSGSGIGASVGAEQYGKDLVELQTIINELYGDSRKPLVVAPGGFYDQKWFAQLLKVSGPNVLNAMTHHIYNLGAGNDPQVPDRILNPQYLSRTSDTFRSLQLTIQRHGPWSAPWVGEAGGAYNSGSRLVSNTFLNSFWYLDQFGQSAKYDTKVYCRQTLIGGNYGLLDTDTFVPNPDYYSALLWHRLMGTGVLSTDISGSSYLRAYVHCGKQKGGVALLLLNLHQSMGFMVSVRNDLNVNLAEGQGIRRDNVFVHGFKRTVSWVGSKASDGYSKREEYHLSAKDGNPFARTMLLNGVPLELTEDGDIPPLYPVEVSVNSPIYVAPLTIAFVVFPDFEAEACGR

SEQ ID NO: 6805 - DNA, 1800 bp, Panicum virgatum
  misc_feature: Ceres CLONE 1887154
  misc_feature: Encodes the peptide sequence at SEQ ID NO. 6806
gccgctttgcccccagccggccagctccccagcctttccgcaacaagttgcgtgcggcgggcgccttgcccctgggatcaccagcgagccaccccttccttactccgggctctcggccctgacgaccgggcccttccccgaccgggctccaccggtcatcgagacgtgaccacaacacgacaaagcggcaggccgcggcgctggcgctgccgcgctggcgaggcccgagcccgaggcacagcggcgccaggccagggaccacgcgcggccgcggccacggccgcgtctagggctcgcgcgcggcagccaccgcgcgccgcgccaccacccatcgcccccgctcgcgtccacgtgagccgcaccgccgccgccaccaccaccacctcctcacccctccgccgcggccgatggcccaacccccacccagaaaacccgaaccgcccaccacccataccccgcccctcctcgccttatcctcctccaccgccgccgccgccgccatctattgcgcctaactactccccagccgccgcccgccccagatctagatctgggatccccgtgaccgcggatgatggccgcgggggcgcacgacgacgccgacgagccgccgcggcggttcgcgctgaagaagagcgcgccggcgcagccgtggtcggagctcgagaccttccacctcatcgacgcgtacgacgagcgctggacggcgctggggcgcggccagctcaaggcgcagcagtgggaggagttggcggcggacgtcgccgctcgctgcgccgccacgccgggggtcgccatccaccgcaagaccgggacccagtgccgccacaagctggagaagctccgcaagcgctaccgcaccgaggccgcccgccccgtcacctcgctctggaccttcttccgccgcatggatcagctcgagcgcgggcccctcgccgcctccgccgcctatccacccgcggctggctccccgacgggagccgcctctgacgaggaagaggaggaagagaaggaggaagaagaggaagaagaaaacgaggagcaggaggaggaagaggaagagctcgtcccccggaacaacaacaccaggagcatcaacggcatcatccgggaattcggcagcggcctcgccccgcgccacccgcagctgcagttgcagcagccgccttcttcaatcacgccgtccaccgcgcctccgcggaagagagtggcctacgaggcgttccaggccaaggccgccgcggccgctgttgcggcggacaaggccaaggaagaggaggtggagctggttcgccgcccctctggccgagggggaaccaacacccagctctcggcggtgctgagggatttcagcgaggggttcatgcggctggagcgccggcgcatggagatgcagtgggacatcgaacgagggtggcaggagacggaggcccggcacgccaagatgctccaggatgcgcagcgccagcttcgggacaccgtcgccgcctccttcgccctgccgccgaagaaggccaggagggactatggcagcagcggcgactcctagcaactgacggttggtgatctgatggtagggatcccagttgttcctcctatgttcaggaatttagtcgtagttcgtactatatggtagtactgatttgcactagcatttttaactatctctattatgcctagtatctgtgtttagcattcttaatttaggtcgtatatggtgaatggcgatgcttttggacgatgaaggctagtgtagtacatgcatctgtgtttgtgttgcaaaaaaaaaaaaaaaaaaaa

SEQ ID NO: 6806 - protein, 325 aa, Panicum virgatum
  misc_feature: Ceres CLONE 1887154
  misc_feature: The sequence is a functional homolog of  SEQ ID NO 190 in the  10/225,068 US patent application
  misc_feature: The sequence is a functional homolog of  SEQ ID NO 2858 in the  10/374,780 US patent application
  misc_feature: Useful for making plants with modulated growth and phenotype characteristics
MMAAGAHDDADEPPRRFALKKSAPAQPWSELETFHLIDAYDERWTALGRGQLKAQQWEELAADVAARCAATPGVAIHRKTGTQCRHKLEKLRKRYRTEAARPVTSLWTFFRRMDQLERGPLAASAAYPPAAGSPTGAASDEEEEEEKEEEEEEENEEQEEEEEELVPRNNNTRSINGIIREFGSGLAPRHPQLQLQQPPSSITPSTAPPRKRVAYEAFQAKAAAAAVAADKAKEEEVELVRRPSGRGGTNTQLSAVLRDFSEGFMRLERRRMEMQWDIERGWQETEARHAKMLQDAQRQLRDTVAASFALPPKKARRDYGSSGDS

SEQ ID NO: 6807 - DNA, 1990 bp, Panicum virgatum
  misc_feature: Ceres CLONE 1887173
  misc_feature: Encodes the peptide sequence at SEQ ID NO. 6808
gagcccccgtcttcctccctcctccccctccgacacacacgcctctttaactcgcctccgcttccaaaaaattctccagttagtttaatccagacgaggaacctcctcgccccggatctctcccccgcgaatccccaggcccgctcgccggccggccggtcccccgcgatcggctccgcctgcgtccccggcgggaggttgacctcgcgttgcggcgggggcctcgcctcgccgccgctcggctcggggggctcggcggttcggcggtcgctttcgggttccgtccggtcgaggccagcggtgccggggcaatgcggtcggtccgcggggctgcttgaggcgcgtggctgggatctggagcggagcggtgtcggtggggagtcggtggtgggcgtagcgctagctcacgcgtttggctgccgggatggagcaggtggttggggggaagttcaagctcgggaagaagatcggtagcggatccttcggggagctctacctcgccgtcaacgtgcagaatggtgaggaggtggccgtcaaactggaatcggtgaaatcacggcaccctcagcttcactacgaatcaaaactgtacatgcttttgcagggtggaactgggattccacatctgaagtggtttggggtggagggcgagtacaatgtcatggtgattgatctgcttggtccaagtctggaggacttatttaactactgcagcagaaagttctccctcaaaactgtactaatgcttgcagatcagatgatcagtagagtagagtatatgcatacaaaggggtttctacatcgtgatatcaagcctgataatttcctcatgggtttagggcgtaaagcaaaccaggtatttgtcatcgactatggccttgcgaaaaaataccgagacctccaaactcataagcacataccatacagggaaaacaaaaatctcacagggacagcgcgatatgccagtgtaaatacccatcttggagtagaacaaagcaggagagatgatctggaatctcttggttatgtgctgatgtatttcttaagaggaagccttccttggcaaggattgaaagctggcacaaagaagcaaaagtatgatagaatcagtgaaaagaaaatgttaacgccagttgaggtcctttgtaaatcatatccaacagagtttagtcattacttccattattgtcgatccttacgatttgacgataaaccagattactcctatttaaggagagtcttccgtgacttatttatccgcgaagggtaccaactagattacgtatttgactggaccattatgaagtatcctcaatttagagataaaagcaaacttcagtctagcggcaagactagtgggttggcaggcccttctgcagaacgaactgagagaactgcagctgaagctttgtttaaaagaactggatctggttccggtcacaatagagaacacaccaagcacagaagtcttctagagtccctgatgccatccaaggctgttgattcagatagaacaaggccgtcatcatcatcgcgcaacggaagcacatcaagaagagccatcctttcatcaagcaaaccaagctcttctggagatccaagtgacccaaaccgcatgggccgcatggtctccagtgccagcagccgcccatcaaccactgcccaaagggtgcaccacctgggtggagctgagatcaggtcctcatctttatcgaagatcagagggtcttcacatgatgacgctatcaggaactttgagctgctctcaattggcgctgacaggagaaaataaggcgctcatgaaatgggccaggttctggactctggaagatgaggatttagtgctggggtggtgtaatggctaatgagccggcagctcccaggatttgtatgctgaaaagtttcttctcgaagtaaaagagattatgtaacttatgagactgtttccaagagctgtgttgcccccaatctaatagatgagctagaagct

SEQ ID NO: 6808 - protein, 455 aa, Panicum virgatum
  misc_feature: Ceres CLONE 1887173
  misc_feature (1)..(390): SWISSPROT Homolog: EC 2.7.11.1 Casein kinase I isoform delta-like
  misc_feature (1)..(409): SWISSPROT Homolog: EC 2.7.11.1 Casein kinase I isoform epsilon
MEQVVGGKFKLGKKIGSGSFGELYLAVNVQNGEEVAVKLESVKSRHPQLHYESKLYMLLQGGTGIPHLKWFGVEGEYNVMVIDLLGPSLEDLFNYCSRKFSLKTVLMLADQMISRVEYMHTKGFLHRDIKPDNFLMGLGRKANQVFVIDYGLAKKYRDLQTHKHIPYRENKNLTGTARYASVNTHLGVEQSRRDDLESLGYVLMYFLRGSLPWQGLKAGTKKQKYDRISEKKMLTPVEVLCKSYPTEFSHYFHYCRSLRFDDKPDYSYLRRVFRDLFIREGYQLDYVFDWTIMKYPQFRDKSKLQSSGKTSGLAGPSAERTERTAAEALFKRTGSGSGHNREHTKHRSLLESLMPSKAVDSDRTRPSSSSRNGSTSRRAILSSSKPSSSGDPSDPNRMGRMVSSASSRPSTTAQRVHHLGGAEIRSSSLSKIRGSSHDDAIRNFELLSIGADRRK

SEQ ID NO: 6809 - DNA, 2057 bp, Panicum virgatum
  misc_feature: Ceres CLONE 1887249
  misc_feature: Encodes the peptide sequence at SEQ ID NO. 6810
aaattggagttttcccgataataaacaacacacacgcctgctgctgcctcctctctttcccaccttcctcctccctccctccgctcgtctacctcgctcgctccgggtctccgtctcgagccttccccagcctccacacccactccccacgtcccgttcctcttcctccctctgttgcgcgttcgcctctcaccgctacctctctcgccgacccccacccccgccctccccgattcacctctcttctctcccggtcttccttttcccggcggcgacgactgggcttcggcacgtcttcgccggcgacgaacccaccaggaacaaatcggcgactgcttctgtgtaggcacacccaaaagcagcaatcccctctggggtggcgtgatctccactgttccataagcggagccactaggaaggctgttggagaccttccctgctatatattcgcaggctaagccccaaggttcttgtaggccttacagctctgttctggttggcgtagatgtcgtttcgcagcattgttcgtgatgttcgggatggttttggtagcctgtcgaggcggagctttgaggtgaccatagcaggcctttccggactcactgggcatcacaggggcaaatctcagagcacggtgcatgagctccgtgatacagatctcataatccaggagagccattgggctaatctccctcccgagctcctccgggatgtgatccggaggctggaatccagcgagagcacctggccaaatcgcaagaatgttgtatcctgcgctgctgtttgtcgggcatggagggagatgtgccgggagatcgtgctcagcccagagttctgtgggaagcttaccttcccagtttctttaaagcagcctgggcatcgagatggaatgattcagtgtttcataaagcgggataaatcaaagtctacatatcatctctacttgtgcctgagcactgctgtacttacggagaatggcaagttcctcttatcagctaaaaggaaccgcaaaacaacctgcacagagtatgttatctcgatggatgctgacaacatctcgagatcaagcagcacatatattggaaaacttaggtccaacttcctaggcacaaaatttatgatctatgacacacagcccccgtataatggggctgttgtccctcatgccggacggtccagccggagattcaactccaagaaagtctcccctaaggtgccaactggtagctacaacatagctcaggtgacatatgagctaaatgttcttggcacaaggggccctaggcggatgcactgtgtcatgcactccatacctgcctccgcagttgagcctggcgggatagtccctggacagcccgagcagattctgcctcgagcattagaggagtcttttcgcagcactacctctttctccaagtcatccatcatgggccgatacatggatttcagcagctcccgtgacttcagcagtgtccgtgacttcagcagcgcccgcttttccgacattgctggaggtgccagagttgcagatgaagagggacaaaataaggagaggccgcttgtgcttcggaacaaggccccaagatggcacgagcagttgcaatgctggtgccttaacttccgcggccgtgtaaccatcgcgtcggtgaagaatttccagctgattgcctcatcaagccagcccccagctgctggggctccaaccccatcacaacctgctccatctgaccaggacaaagtcattctgcagtttggcaaggtagcgaaagatatgttcaccatggactaccgctacccgctctcagccttccaggctttcgcaatctgtttgagtagctttgacaccaaattagcctgtgagtagatagacaccatggaatcgctggacgtggagctggaaatgcacaaaagaagagatgcatttggccctaggattctagcttgatgcttttgcactttgttgtgttctctcatggttgtattgtgttctgcttcatgctgtagctgtagccttggaaccggatttctgtgcatgtatgcttcacctgcctgccggt

SEQ ID NO: 6810 - protein, 452 aa, Panicum virgatum
  misc_feature: Ceres CLONE 1887249
  misc_feature: The sequence is a functional homolog of  SEQ ID NO 130 in the  10/225,068 US patent application
  misc_feature: The sequence is a functional homolog of  SEQ ID NO 2896 in the  10/374,780 US patent application
  misc_feature: The sequence is a functional homolog of  SEQ ID NO 458 in the  10/666,642 US patent application
  misc_feature: Useful for making plants with modulated growth and phenotype characteristics
MSFRSIVRDVRDGFGSLSRRSFEVTIAGLSGLTGHHRGKSQSTVHELRDTDLIIQESHWANLPPELLRDVIRRLESSESTWPNRKNVVSCAAVCRAWREMCREIVLSPEFCGKLTFPVSLKQPGHRDGMIQCFIKRDKSKSTYHLYLCLSTAVLTENGKFLLSAKRNRKTTCTEYVISMDADNISRSSSTYIGKLRSNFLGTKFMIYDTQPPYNGAVVPHAGRSSRRFNSKKVSPKVPTGSYNIAQVTYELNVLGTRGPRRMHCVMHSIPASAVEPGGIVPGQPEQILPRALEESFRSTTSFSKSSIMGRYMDFSSSRDFSSVRDFSSARFSDIAGGARVADEEGQNKERPLVLRNKAPRWHEQLQCWCLNFRGRVTIASVKNFQLIASSSQPPAAGAPTPSQPAPSDQDKVILQFGKVAKDMFTMDYRYPLSAFQAFAICLSSFDTKLACE

SEQ ID NO: 6811 - DNA, 2182 bp, Panicum virgatum
  misc_feature: Ceres CLONE 1887274
  misc_feature: Encodes the peptide sequence at SEQ ID NO. 6812
attgagcttcatctcttggagctccgacctcctccttgcacccgaccgcccgcgccccgcctccaaccctatatccctgcgcctccgtcggccgctgcccgcctgagcctccgtccgccccacgccgtgccgtcgcctgccccttgactcccgcggacccctgcggggagctggcctgctgggggcgactccgcagccccgcacccagcggtcaccgtcctgctcccaccgcctcccgcccgccgccccgagcgcgcgcacctcgagcggcagggggcacgagcactagccgcagcaggccagcagccattccgggttccggcatctagcatccccagttctcgaatctccactgcccaattgcaatcccctccccatcactggtgcaccaaagatgccgcaggtaatggtggtggcgcggaacttcatggatatggtggctgcgctgcctgcctccaagcttgatatgctctatgactcggccttcatctgtgaggctgtactcaggtcactcccaccattggcaaagaaatatgcactgcagatgctgtacgtgttggcaccggtgaccgctgcagctatggaagagtgggtgatcaatgaatatgctgccaagcatagggttgccattgataagctgctccaactcagggtcttcgttgaagtgcgcgatagacgaaaggaggtgagctacaagatgaatcaaaagttccagggtaacatgcagaagtatttggttgacggtggaagtttaccaagggaaccgataccattaagtgttactggtagattgcctgcatcagcagatctggaagcctatgctcttgatcagtgggagtgcttcttgttgcaattgatcaattcatctcaagttgaaaaagggacgagtttcagctcctccatgatgaagacatttcagcgtggccttctgagttcaagggatggtgaagctccaaagttgactgagaatggcttccaatttcttctgatggaaacaaatgcacaactttggtacataatgagagaatacatttcctctgcagaggaacgtggagtggatcctacggagctgatatcatttctcttggaacttagttttcataaattgggagcggcttatagtttgaacactctgactgatgtccaaagaattgccatcagggatcttgcagagttgggattagtcaagctgcagcagggtcgaaaggatagctggttcattcccacccaattggcaacaaatctctcagcaagcttgtcagattcatcgtctagcaaagagggctttgtggttgtggagacaaactttagaatgtatgcatactctacttccaaattgcactgtgagattctgcgccttttctcaagggtggagtatcaacttccaaacctcatcgtgggagctattacaaaagaaagtatttatggtgcttttgagaatggaataactgctgaacagataatttcatttctcaagcaaaacgctcaccctcgtgttgccgacaagatacctgctgtcccggagaatgtcacagatcagattaggctgtgggaaactgatcgcaacagggttgagatgattccatcacatttatatgaagattttcctagcaaggaatggtttgaacaatgctgtgatcatgcaagggatcatggatacttgctctgggaggactcgaggaggatgaggctaattgtgcgaggggagttccaccctgaaatgagggagttcctccgcaggcaaagatgaaaagggaccatgcgtttgttctggtacactcctttatgattgaagggaagggccattttggatagaacaaacaatctgtgtgcataaagctcctctacgcaaatgccttccatttatactagtctgccagcaattgttccatttgctccagcaattgcgtcaacagatggtgcatacactgtaggcatataagcttagtttagattactgaaagttccatttgtagtgatgtgatcaacgcgacattgtgagtgggttgtggtgatacccaggggcggtctctgttttttttttttctttggtgtctctgatgatccagggtgagtatcctcagctggtggctgctgctgtaaaatctcaaatgactctgaacgataaatattcattttttcggttttcatttctgtagacgaaaaaaaaaaaaaaaaaaaa

SEQ ID NO: 6812 - protein, 451 aa, Panicum virgatum
  misc_feature: Ceres CLONE 1887274
  misc_feature (1)..(354): Pfam Name: Tfb2 Pfam Description: Transcription factor Tfb2
MPQVMVVARNFMDMVAALPASKLDMLYDSAFICEAVLRSLPPLAKKYALQMLYVLAPVTAAAMEEWVINEYAAKHRVAIDKLLQLRVFVEVRDRRKEVSYKMNQKFQGNMQKYLVDGGSLPREPIPLSVTGRLPASADLEAYALDQWECFLLQLINSSQVEKGTSFSSSMMKTFQRGLLSSRDGEAPKLTENGFQFLLMETNAQLWYIMREYISSAEERGVDPTELISFLLELSFHKLGAAYSLNTLTDVQRIAIRDLAELGLVKLQQGRKDSWFIPTQLATNLSASLSDSSSSKEGFVVVETNFRMYAYSTSKLHCEILRLFSRVEYQLPNLIVGAITKESIYGAFENGITAEQIISFLKQNAHPRVADKIPAVPENVTDQIRLWETDRNRVEMIPSHLYEDFPSKEWFEQCCDHARDHGYLLWEDSRRMRLIVRGEFHPEMREFLRRQR

SEQ ID NO: 6813 - DNA, 1818 bp, Panicum virgatum
  misc_feature: Ceres CLONE 1887278
  misc_feature: Encodes the peptide sequence at SEQ ID NO. 6814
  misc_feature (504)..(504): n is a, c, t, g, unknown, or other
accaaccgagggggtccgaactgtggccccgtcctccgctcagtcacgagtgctgccaagaggaaataaatggccactgatccggcggccgcagccaccgccgccggcggcatggacgaccgcagcggctactgcgaggcgaccaagacgttccgcagcctgcggccgccggtgccgctgccgccgcaggacgccccgctctcgttcccggcgttcgcgttctcgctcctgccgtccccgccccccgcgcgcccggccctcctcgacgccgccaccggcgaggccgtgccgttcccggcgttctggtcccgggtgcgcgcgctagcgggggccctgcgctcgcagctcgggctccgcggcggcgacgtcgcgttcgtgctcgcgccggcgcggctggacgtcccggtcctctacttcgcgctgctctcgttcggcgccgtcgtgtcgcccgccaacccagcgctcaccgccgccgaggccgcccgcctcgtcgcgctgtccggngcgtccgtcgccttcgccgtgtcgtcaaccgccaccaagctgccggctggcctccccaccgtcctcctcgattccgatcaattccgttccttcctgcgcagcgacggcggcggcgagggcctggcggctgaaacggtggcggtgcgccaatcggcgacggccgcgatccagttctcgtcgggcacgaccgggcgggtgaaggcggcggcgctgtcgcaccggaacttcatcgccatggcggcggggtctcacgctctgtccccaaagccgagacatggctgcgacgacaggatgctcctaagcgcgcccatgttccactccctggggttctacttcgcactcaaggccgtggcgctggggcagacgacggtgctggtgacggacccggtggcgcggcgcggcgtgaaaggggtggtggaggcggcggagaggtgggcggtcaccgagatgacggcgtcgccgccggtggtgatggccatggcgaaggagccgcgcgtcctggaggccctggagcgggtggtgtgcggcggcgcgccgctgccgacaacggcagccgagaggttccggcgacggttcgccaacgcggatctctgcatgggctacggttcaactgaggctggtggcatctcactgatgatcggccgggaagagtgcagccgcatcggctccgccggccgtgtctcggagaacgtggaggtgaagatcgtggaccacgcaaccggcgagcccctgtccgtggggcagaaaggggaactattggtgagagggcctgccgtcatgacaggatacgttggagacgatgaggcgaacgccggcactttcgactctgagggctggcttaagacaggggatcttggctacatcgatcaggacgggttcctgttcgtggtggataggctcaaggagctcatcaagtacaggggctatcaggttccacctgcggagctggagctcgtcctgcaaacgttgccagaagttgtcgatgcagcagtcatgccgtatccgcatgaggaggcaggacagataccgatagcgcttgtggtgaggcaaccaggaagcaatgtcaccgaggcgcagatcatggatcatgttgcgaagcgggtagccccgtataagaagatccgcaaggttctgtttgtcgactccataccaaaatctccagctggaaagatactgagaaggcagttggcgaactatgtgcagtttaacgctgtctctaggttgtgaactttttttacctgtgcatgcatgtacgggagacacagaactacagaagcagtaaaacattgcatgtaaagataaattagtgcgacc

SEQ ID NO: 6814 - protein, 553 aa, Panicum virgatum
  misc_feature: Ceres CLONE 1887278
  misc_feature: Great-hit functional homolog of the protein sequence encoded by LOCUS At5g63380
  misc_feature: Useful for making plants with altered cell wall content and/or composition
MATDPAAAATAAGGMDDRSGYCEATKTFRSLRPPVPLPPQDAPLSFPAFAFSLLPSPPPARPALLDAATGEAVPFPAFWSRVRALAGALRSQLGLRGGDVAFVLAPARLDVPVLYFALLSFGAVVSPANPALTAAEAARLVALSGASVAFAVSSTATKLPAGLPTVLLDSDQFRSFLRSDGGGEGLAAETVAVRQSATAAIQFSSGTTGRVKAAALSHRNFIAMAAGSHALSPKPRHGCDDRMLLSAPMFHSLGFYFALKAVALGQTTVLVTDPVARRGVKGVVEAAERWAVTEMTASPPVVMAMAKEPRVLEALERVVCGGAPLPTTAAERFRRRFANADLCMGYGSTEAGGISLMIGREECSRIGSAGRVSENVEVKIVDHATGEPLSVGQKGELLVRGPAVMTGYVGDDEANAGTFDSEGWLKTGDLGYIDQDGFLFVVDRLKELIKYRGYQVPPAELELVLQTLPEVVDAAVMPYPHEEAGQIPIALVVRQPGSNVTEAQIMDHVAKRVAPYKKIRKVLFVDSIPKSPAGKILRRQLANYVQFNAVSRL

SEQ ID NO: 6815 - DNA, 3449 bp, Panicum virgatum
  misc_feature: Ceres CLONE 1887355
  misc_feature: Encodes the peptide sequence at SEQ ID NO. 6816
acccctctctccctctctctgtctctcctcgcctcgcctccggtagcgaagacgcgaacccaccacctccctccctcgccgcctccctcagatcagatcaaagcggaacaccgaactcctccgcttcatccgcctactagggtttggtgaaaccctccgccccgtggatcggaagggctagctagggtttgatcacctctcgcgcgaagctttctctttcatctgctattctgctcggtgtttcagccatgatgtcgcggtcgtataccaacctactcgatctcgcggagggcaacttcgcggcgctgggcctggccggcggcggggcgcggcggaggcaagggtcgttcgggctgaagcggatgtcgcgggtgatgaccgtgccggggacgctgtcggagctcgacggcgaggacgagtcggagcccgcggcgaccaacagcgtcgcctccgacgcgccctcgtcggtggcggtcgaccggatgatcgtcgtctccaaccagctgcccgtcgtcgcgcggcggcggcccgacggccgaggatggtccttctcctgggacgaggactcgctgctcctccagctccgcgacggcattcccgacgagatggaggtgctctttgtcggcttcctccgcgccgacgttcccatagccgagcaggacgaggtgtcgcaggcgctgctcgatcgattccgctgtgcgccggtgttcctccccgaccacctcaacgaccgcttctaccacggcttctgcaagcgccaactctggcctctgttccactacatgctccccttttcatcatccgcgtccgacgcaaccacctcttcgtcgcccggcaacggcagattcgaccgtagcgcttgggaggcgtacgtgctcgctaacaagttcttcttcgagaaggtcgttgaggttatcaacccggaggacgactacgtctgggttcatgactaccacctcatggcgctgcctaccttcctccgccgccggttcaaccgcctccgcatcggattcttcctccacagccccttcccctcgtcagagatctaccgcaccctccctgttcgtgaggagatattgaaggccctgcttaattgtgacctcattgggtttcacacttttgattacgccaggcactttctctcgtgttgcagtagaatgctgggaattgaataccagtcaaagcgtgggtacattggattggattactttggccgcactgttgggatcaaaatcatgccagtgggaattcatatggctcaattgcagtcaggtctgcgcttgcctgacagggaatggaggctttccgagcttcaacagcaatttgaggggaaaactgtcttgcttggtgtggatgatatggatatcttcaaggggatcaatttgaagcttcttgcctttgagaatatgctgaggacccatcccaagtggcagggccgagcagtattagtgcagattgctaacccagcccgtgggaagggtaaggatcttgaaaccatccaggctgagattgaggagagctgccggaggattaatggggactttggccagtcagggtatagccctgttgttttcattgatcgtgatgtgtcaagtgttgagaagattgcctattatacaatagcagaatgtgttgtggtgactgctgtgagggatgggatgaacttgacaccatatgaatacattgtctgtaggcagggtgccccaggatccgagtccatatcagaggtgagtgggccaaagaagagcatgctggttgtgtcagagtttatagggtgctcaccttcgctgagtggtgctattcgggttaacccatggaatatagaggcaaccgcagaggggatgaatgaggccatttcaatgcctgaacaggaaaaacaattgaggcatgagaagcattaccgttatgtcagcagccatgatgttgcttactggtcaaggagcttcatccaagacttggaaagggcttgtaaggaccactttaggaggacttgttggggcatagggttgggtttcggtttcagggtggtggccttggaccctcatttcacaaagcttaacatagattcaattgttaatgcttatgaaatttcggagagcagggctattttgcttgactatgatggaactttggttcctcagacttccatcaataagccacctagcccagaagtagtcagtattatcaataccctttgctcagataggagaaatattgtttttcttgtcagtgggcgagacaaggatacgttgggagagtggtttgcctcatgtccaaagctggggattgcagctgaacatggttacttcttaaggtggtctagagacgaagagtggcaaacctgcacccaggctttggactttggatggatggaaatggcaaagccagtgatgaatttgtacacagaagcaactgatggatcctccattgagaccaaggaaagtgctttggtgtggcaccatcaggatgctgacccaggctttggatcatcacaggcaaaggaattgcttgatcacctggaaagtgtactagcaaatgaaccagtcactgttaaaagtggccagttcattgttgaagtcaagcctcagggtgtaagcaagggagtagttgctgagaggatacttgcatcaatgaaggagggaggaaagcaggctgatttcgtactgtgtattggtgatgacaggtccgatgaggacatgtttgaaaacattgccgatatcatgaagaggaatatggttgctccaagaacaccactgtttgcgtgcactgtcggacaaaaaccaagcaaagccaaattctacctggacgatacatttgaagtggtcaccatgctgagtgcactggcagatgccacagaacctgaactggagactgattcggctgatgaattggctgcatctatttcatcagttgacattggtgatgaacaatcagaatccactgatggaccaattggaggatcttagcgcacttccagaatatgatgattgattcaatagtctcttctgcacatttttctgatggatatgaagttcaatgactaacacctgggcctacgaatgctcgagaggaaggcttctcaatctgctgcactaagtttcttttgtcgggcaagacaatatgaccttttgctgcaagacgtaggcccatatgtccatagctgacttgccgactttgcacgtttctttttcactttttcgttcctttggttgaagtaaaatgaaagcttcagggaaggcaagtgaatcgtggggctgatgtaatgggatgggaatagaagtggcacatgtgaaaggagttcgtgcaatccgtgatttgatctcttattaacaagttacaaagtggtggcaccttttgaattataagttgtagcaatctcaagggtgaggtctgaattatttcgttgcttcaaagctggatcttggctccaaaaaaaaaaaaaaaaaaaa

SEQ ID NO: 6816 - protein, 905 aa, Panicum virgatum
  misc_feature: Ceres CLONE 1887355
  misc_feature (2)..(489): Pfam Name: Glyco_transf_20 Pfam Description: Glycosyltransferase family 20
MMSRSYTNLLDLAEGNFAALGLAGGGARRRQGSFGLKRMSRVMTVPGTLSELDGEDESEPAATNSVASDAPSSVAVDRMIVVSNQLPVVARRRPDGRGWSFSWDEDSLLLQLRDGIPDEMEVLFVGFLRADVPIAEQDEVSQALLDRFRCAPVFLPDHLNDRFYHGFCKRQLWPLFHYMLPFSSSASDATTSSSPGNGRFDRSAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGIHMAQLQSGLRLPDREWRLSELQQQFEGKTVLLGVDDMDIFKGINLKLLAFENMLRTHPKWQGRAVLVQIANPARGKGKDLETIQAEIEESCRRINGDFGQSGYSPVVFIDRDVSSVEKIAYYTIAECVVVTAVRDGMNLTPYEYIVCRQGAPGSESISEVSGPKKSMLVVSEFIGCSPSLSGAIRVNPWNIEATAEGMNEAISMPEQEKQLRHEKHYRYVSSHDVAYWSRSFIQDLERACKDHFRRTCWGIGLGFGFRVVALDPHFTKLNIDSIVNAYEISESRAILLDYDGTLVPQTSINKPPSPEVVSIINTLCSDRRNIVFLVSGRDKDTLGEWFASCPKLGIAAEHGYFLRWSRDEEWQTCTQALDFGWMEMAKPVMNLYTEATDGSSIETKESALVWHHQDADPGFGSSQAKELLDHLESVLANEPVTVKSGQFIVEVKPQGVSKGVVAERILASMKEGGKQADFVLCIGDDRSDEDMFENIADIMKRNMVAPRTPLFACTVGQKPSKAKFYLDDTFEVVTMLSALADATEPELETDSADELAASISSVDIGDEQSESTDGPIGGS

SEQ ID NO: 6817 - DNA, 1954 bp, Panicum virgatum
  misc_feature: Ceres CLONE 1887908
  misc_feature: Encodes the peptide sequence at SEQ ID NO. 6818
agccagtcaccacgaacagcggaaaggcctcggaagcttcccgcttccagatctccaccaaaaccctaacccaccgaaccttctagaacctcctgcctcccgtcccccgcatggacggcctcgcggcgccgtccccgtcccactccggtgccacctccggcggcggggcctcccaccgcaagcggaagctcccgccgtcgtctctctccgacgccaccgccgacgaggacgacgacaccactgcgccgtcgtccccctcatcggccccttcctctccttcccgcccgtcatccccatcctcctcccactctgacgacgacgatgacgactcgctgcacacgttcactgccgcgcgcctcgacggcgcgccgggtgggggctccgcctccggtcggcccccgaagccggattcctcttccgtgtctgccgcagcggcagctgctgccgttgcggcgggggcgggaccgaagcctgaacccggctctaccgccgccggcgacggcaaggaggaccccaaggggctgttcactgataacctccagaccagcggtgcgtacagcgcccgcgaggagggcctcaagcgcgaggaagactcgggaaggctgaagtttctctgttattctaatgatggtattgatgaacacatgatatggttggtaggcttgaagaatatcttcgcccggcagcttcctaatatgcccaaagaatatattgtgcgcctcgtcatggatagaactcacaagtcaatgatggttatcaggaacaatattgtcgtgggaggcattacttatcgcccttatgcaagccagaggtttggagaaatagcattttgtgctattacagctgatgagcaagttaaaggctatgggacacggttaatgaatcatttgaagcaacatgcacgagacactgatgggctcacacatttcttaacctatgctgataacaatgctgtaggctattttgtaaagcagggtttcacaaaggagatcacattggacaaagaaagatggcaagggtacattaaagactatgatggaggaatattgatggagtgtaaaattgacccaaagctgccatacgttgatctggcaacgatgattcggcgtcaaaggcaggccattgatgagaagataagagagctttctaactgccatattgtttattcaggaattgattttcagaagaaagaagccggtattccaagaagactgatgaaaccagaagacatccctggtctgagggaagctgggtggacacctgatcagtggggccattctaaatcacgttcagcattctcccccgattataatacttacagacaacagcttactaaccttatgcggatattgttgaagagtatgaatgaacatcctgatgcttggccgttcaaagatcctgtggattcacgtgatgttccagactattatgacattatcaaagatcctatagatttgaggacaatgtcaagaagagtcgagtcggaacaatattatgtgaccttagagatgtttgttgccgacatgaagagaatgttcaacaatgcaagaacctacaactctcctgatactatctactacaaatgtgccacacgactcgagaatttcttctcgggcaaaattgcgtcgcagcttgcacaagcctcaaccaagagctagactggtgcgggttgactggacacatttgcttgttgtaaaattgttctgtatctgttatagtcgttgcctcccttattgtgacgtacagtgctgaactgttagtttagcatgtaacccgtaggattaatcatgattttacatatgttggggcttaacctgggggtttactgattgtattcatacaataatagagtgaggagataagttcttgaagaatatcatgtcatcatcaattcttcattttccagcacctaagaataagagtttaccttccttaaaaaaaaaaaaaaaaaaaa

SEQ ID NO: 6818 - protein, 515 aa, Panicum virgatum
  misc_feature: Ceres CLONE 1887908
  misc_feature (1)..(79): Pfam Name: Acetyltransf_1 Pfam Description: Acetyltransferase (GNAT) family
  misc_feature (1)..(515): SWISSPROT Homolog: EC 2.3.1.48 Histone acetyltransferase GCN5
  misc_feature (9)..(515): SWISSPROT Homolog: EC 2.3.1.48 Histone acetyltransferase GCN5
MDGLAAPSPSHSGATSGGGASHRKRKLPPSSLSDATADEDDDTTAPSSPSSAPSSPSRPSSPSSSHSDDDDDDSLHTFTAARLDGAPGGGSASGRPPKPDSSSVSAAAAAAAVAAGAGPKPEPGSTAAGDGKEDPKGLFTDNLQTSGAYSAREEGLKREEDSGRLKFLCYSNDGIDEHMIWLVGLKNIFARQLPNMPKEYIVRLVMDRTHKSMMVIRNNIVVGGITYRPYASQRFGEIAFCAITADEQVKGYGTRLMNHLKQHARDTDGLTHFLTYADNNAVGYFVKQGFTKEITLDKERWQGYIKDYDGGILMECKIDPKLPYVDLATMIRRQRQAIDEKIRELSNCHIVYSGIDFQKKEAGIPRRLMKPEDIPGLREAGWTPDQWGHSKSRSAFSPDYNTYRQQLTNLMRILLKSMNEHPDAWPFKDPVDSRDVPDYYDIIKDPIDLRTMSRRVESEQYYVTLEMFVADMKRMFNNARTYNSPDTIYYKCATRLENFFSGKIASQLAQASTKS

SEQ ID NO: 6819 - DNA, 1127 bp, Panicum virgatum
  misc_feature: Ceres CLONE 1887922
  misc_feature: Encodes the peptide sequence at SEQ ID NO. 6820
agtgccactgcgagctctccctctccccccacctccctgatctggtcgcaccagtctccaccagcagcccttcccttcgcacgcacctccgaaaccctagacccgccccgcgagtcgggagttgcttcgccgccagccgccatggacccggccccggcggtcgctgcggagctctggcgcccgccgcacctcgccgcgggcggcggccgagctgtggaggccacctccgccgtcacggagaagagcagcggcggccgcgggggaggcggcgccggtcggaggaggcagagggagaccccagcgtccgaggacgactcgtcccggatcgtctccacttccggcggcggcggcggtcaggatttgacagattcaggagcaaaacgtttcaaaacaaataaatccaatgataataatggcaacgttagaacggaggctgaaactgactcaagaagtgctgccaaggctgttagtaaaaaccctccagcaccagagccaccgaaacaagattacattcatgtcagggcaagaaggggccaagcaactgacagtcatagtcttgcagaaagggcgcggcgtgagaaaataagcgaacggatgaaagttctccaagatcttgtccctggatgcaacaaggttattgggaaagcatcagtacttgacgagataattaattacatccagtctttgcaatgccaagttgagttcttgtcaatgaagcttgaggcggttaatgcccatgcgagcaatggagttgaagcattttcaaccaaagattttgcttcacagacttatagcacagctcctgggcttacatttgatacccaaaccccaagagaatatgggcatggcacatcgacctcggaatggcttcacatgcagatcggcggtgcctatgaaagggtatcatgaacaagatgaatccagagtagcattctaataaagtgaaccatgatcaatcgaacccatggttctagataatttttttttgaaaccgtcatgttccaaacgcagttttattcatgcttggagctgtaatgcagtgggggacatgaattttgaggactacaattttcgttttcccatctgaatctcgacgaagtttctcctaaaaaaaaaaaaaaaaaaaa

SEQ ID NO: 6820 - protein, 255 aa, Panicum virgatum
  misc_feature: Ceres CLONE 1887922
  misc_feature: Great-hit functional homolog of the protein sequence given in SEQ ID NO 9405
  misc_feature (1)..(51): Pfam Name: HLH Pfam Description: Helix-loop-helix DNA-binding domain
  misc_feature: The sequence is a functional homolog of  SEQ ID NO 1929 in the  10/374,780 US patent application
  misc_feature: Useful for making plants with modulated biomass
  misc_feature: The plant is abnormally small.
  misc_feature: Useful for making plants with modulated growth and phenotype characteristics
MDPAPAVAAELWRPPHLAAGGGRAVEATSAVTEKSSGGRGGGGAGRRRQRETPASEDDSSRIVSTSGGGGGQDLTDSGAKRFKTNKSNDNNGNVRTEAETDSRSAAKAVSKNPPAPEPPKQDYIHVRARRGQATDSHSLAERARREKISERMKVLQDLVPGCNKVIGKASVLDEIINYIQSLQCQVEFLSMKLEAVNAHASNGVEAFSTKDFASQTYSTAPGLTFDTQTPREYGHGTSTSEWLHMQIGGAYERVS

SEQ ID NO: 6821 - DNA, 1775 bp, Panicum virgatum
  misc_feature: Ceres CLONE 1887929
  misc_feature: Encodes the peptide sequence at SEQ ID NO. 6822
atgatcgccgctttgcctcttgatcccttcgaattaattgcccgcatcacacggctgccgttctcctcctcgctccgatcccctctccaaatctcatcctgatctccactcactcatcatcacctagctagctctactacctagccagcagccatagctccatccggatctcgggcgcgagttcctctcggtcgtcccatgtctgccatctacatgagccagctctccactgccctccctctcatggagggagatcaccaccaggatcaccaccaccaaggccacttccaggccttcaccctcccaaaggatcccccgatcctgttcccctttgtgatcagcagcagcagcagcagcgccagcgacagcagcctgagctatggatcgccagaaggccatcacttgttcaggcagcagcagcatcaggctatgctggagccccagcatatgatcggcggatcatcgtctgcgagtgtctttgcgacgccgttcccgaccgtggagagtatccgggacgacatgatcgagccgtcctcgttcgatccatacgatatggggaggctgcagatgggtggatcacttgaggctgcaggcagctggacgccgccggccaagatgaggatcacgaggaaggcgaccgccgatcccggtgcggcgaagaagcccaggaggaaggcacaagggtacgaggacatgctgagcatgggtgggcagcctaatctgggtgttattagggtgtgctccgactgcaacaccaccaagacgcccttgtggaggagtggtccttgcggccccaagtcgctctgcaacgcgtgcggcatcaggcagcggaaggcgcggcgggcgatgatggcctctggcggcggctccgggccagtgccggccgacggcgccaaggcagccactgccacgcccagggacgccatggcagcacgagcacactcgaaggtgaagaaggagaagagagtggacgtggaacggtcgctgccgttcaagaaacggtgcaaggtggtccaggatcaaggtggcgccgccgccgccgccgcccctcctgccgccgctcacaaggccgtcccccagcccgccgccgaggttgctgatgacgccagccagagcagcagggaccttgggctcctcagctggagcaggagcccagctcgcccatcttccgctgcttcctgcagtttccgggcgtcgccggccctgcctgtgcagcaggacgagatcacggatgccgccatgttgctcatgacgctgtccttcgggcttgtccggagctggtgatgatctacctctacatgtacacaaggcacgaccagcaccgtaggccttttgcagcagctaggtgcctttgactgttagtgttcccgtcgtcgtctaccttccgcgctgtagtggtttttggcttcttgttcgttgccagtgtaacccgtgtcactgttggagtcatgtgattcggtcgtgtatgagagagatcagagagagaagagatgataggagcgacaggatcacgagggaagtaataaggcaaaatcgtgagattaccatctagctagaaatatagctaggatataattgcatgtagtagtgtgaggagttttagttttgagtaatagttttttggttttttctgtgtgctggggctataacatggtcgctggctctgctagcagctagtagcctgctacatgtatttttgttctttgttgttttggttcagtttcttgtactggggctaaaaataatagcaatatgcatggagagaggtcgagcac

SEQ ID NO: 6822 - protein, 361 aa, Panicum virgatum
  misc_feature: Ceres CLONE 1887929
  misc_feature: Great-hit functional homolog of the protein sequence given in SEQ ID NO 9296
  misc_feature (1)..(36): Pfam Name: GATA Pfam Description: GATA zinc finger
  misc_feature: Useful for making plants with modulated biomass
  misc_feature: Useful for making plants with modulated low light sensitivity
  misc_feature: The plant is abnormally small.
MSAIYMSQLSTALPLMEGDHHQDHHHQGHFQAFTLPKDPPILFPFVISSSSSSASDSSLSYGSPEGHHLFRQQQHQAMLEPQHMIGGSSSASVFATPFPTVESIRDDMIEPSSFDPYDMGRLQMGGSLEAAGSWTPPAKMRITRKATADPGAAKKPRRKAQGYEDMLSMGGQPNLGVIRVCSDCNTTKTPLWRSGPCGPKSLCNACGIRQRKARRAMMASGGGSGPVPADGAKAATATPRDAMAARAHSKVKKEKRVDVERSLPFKKRCKVVQDQGGAAAAAAPPAAAHKAVPQPAAEVADDASQSSRDLGLLSWSRSPARPSSAASCSFRASPALPVQQDEITDAAMLLMTLSFGLVRSW

SEQ ID NO: 6823 - DNA, 699 bp, Panicum virgatum
  misc_feature: Ceres CLONE 1887998
  misc_feature: Encodes the peptide sequence at SEQ ID NO. 6824
atccctaggcacaagtgcagaagccaagcccaccccacacagccggggccagccgagcgagcgagcgagcgagcggtcggcggcggaaaaaggtaaggcatcagcatgtcgtcggcggcggcaggagagggggagacggtgcgggcgtcgcacatcctcatcaagcacgagggctcccgccgcaagtcctcctggaaggaccccgacggccgcgtcatctccgccaccacccgcgccgacgccgccgcgcgcttcctcgacctccgcaaccagatcctcgccggccaagccaacttcgccgacctcgccgcgcgccactccgactgctcctccgcgcgccgcggcggagacctcggttcctttgggaggaggcagatgcagaaaccctttgaggacgctacctttgccctcaaggttggtgagctcagcgacctcgtggacactgacagtggggttcacatcatcctgcggactgcctgagtagaggcccacactgtcagctgaatgtcggctttgagcaattagtgcaaatgactttcatttagggcctgtattttttccctttcgcagcctgagtgcataaccttctggacgaagataaatcatgtatcttaacacgtttgcagcagcatatttgagcttaacctacctgcagggtcgatgcacctgtaggcctctgaaaaaaaaaaaaaaaaaaaa

SEQ ID NO: 6824 - protein, 124 aa, Panicum virgatum
  misc_feature: Ceres CLONE 1887998
  misc_feature (1)..(109): Pfam Name: Rotamase Pfam Description: PPIC-type PPIASE domain
  misc_feature (10)..(123): SWISSPROT Homolog: EC 5.2.1.8 Peptidyl-prolyl cis-trans isomerase 1
MSSAAAGEGETVRASHILIKHEGSRRKSSWKDPDGRVISATTRADAAARFLDLRNQILAGQANFADLAARHSDCSSARRGGDLGSFGRRQMQKPFEDATFALKVGELSDLVDTDSGVHIILRTA

SEQ ID NO: 6825 - DNA, 935 bp, Panicum virgatum
  misc_feature: Ceres CLONE 1888068
  misc_feature: Encodes the peptide sequence at SEQ ID NO. 6826
acttcactcctccgcttgccagttcttccccgcaaggctcctcgatctatccatcgaccactcctccaccggctgcggcacgcacgcacgcacgcacgcacgggctagcgatggcggatcgcgacgcgcgcggcggcatctacggcggcacccacgccggccagcagggcggcggcggccggccggtgggggagcaggtgaagggcatgatccacgacaaggggcccacggcgtcgcaggcgctgacggtggcgacgctgttcccgctgggcgggctgctgctggtgctgtcgggcctcgcgctggcggcctccgtggtggggctcgccgtggccaccccggtgttcctgatcttcagccccgtgctcgtcccggccgcgctgctcatcgggatggcggtgacggggttcctcacgtcgggcgcgctgggcctgggcgggctctcctcgctgacgtgcctcgccaacacggcgcggcaggcgttccagcgtaccccggactacgtggaggaggcgcgccgccggatggcggaggccgcggcgcacgcgggccacaagaccgcgcaggccggccacgccatccagagcagggcgcaggaggccgccggaggcggaggcggcgccgcggccccgcccctcgccgcggccctcgtcgcctccgccgccgccttcctcttcgccgccgtccgccactgagcccgtccgcgggcagtaccgctaccgccccgcctagatctatttatttagtaatattactagagatggatttcttccttggttgctcgtgtcgtcgtcgcattttggtcggatctgggatgagtttctaccgtgtcgtcgtgtcgggtggtgtgatccccctgtagatactctgctatctcgttcctgagtgggatggttctgtctggttgctactgataaaaaaaaaaaaaaaaaaaa

SEQ ID NO: 6826 - protein, 194 aa, Panicum virgatum
  misc_feature: Ceres CLONE 1888068
  misc_feature (1)..(118): Pfam Name: Oleosin Pfam Description: Oleosin
MADRDARGGIYGGTHAGQQGGGGRPVGEQVKGMIHDKGPTASQALTVATLFPLGGLLLVLSGLALAASVVGLAVATPVFLIFSPVLVPAALLIGMAVTGFLTSGALGLGGLSSLTCLANTARQAFQRTPDYVEEARRRMAEAAAHAGHKTAQAGHAIQSRAQEAAGGGGGAAAPPLAAALVASAAAFLFAAVRH

SEQ ID NO: 6827 - DNA, 2980 bp, Panicum virgatum
  misc_feature: Ceres CLONE 1888115
  misc_feature: Encodes the peptide sequence at SEQ ID NO. 6828
gctgaacaacaacgaccagccgtcgtcgcgctcctctcctctcctctccttccctccccatggcgacctcctacgagcgccgcctactagcggccgccgacctggtcctctccgccgacgcgcagggccaaggagcctgcctccccgaacttggcgtcacggcggacctcaagccgcaccagctcgatggcgttgcctggctcatccgccgctaccgcctcggcgtcaacgtcgtcctcggtgatgagatggggcttggcaagaccctacaagcaatttctctactgagccacctcaaaatccagcgtgttgcacccggaccattccttgtgctatgtcctctaagtgtaacagatggctggctcgcagagttcagtaaattctgtccttccttgaggctcctgcactatgttggcaataaggtgcaccgtcgtgatcttcggagaaccttgtacgatcatgtgcacaaggcttccacatcatctcattctagcgaattatcatttgatgtgctcttgacaacatatgacatagccttgatggatcaaaactttctttcacaaattccctggcactacgcaattattgatgaggctcaacgtcttaaaaatccatccagtgtactgtataatgtccttgagcaacgtttcatcatgccaaggcgtctactactaacaggcactcctatccagaacaacctttctgaactatgggctttgatgcacttttgtttgccttcaatatttggaaagctagatgagtttctttccactttcaaggaagcaggggactctttaacaggtgccgaagctaataaagcaaacagacagtttgagattattaaacacatacttaaagcatttatgctacgcaggacaaaagctttactaatcgagagtggagttctggcgctgcctccactaactgagctaactgtgatggtgccactgacacagttacaaaagaagctttacatgtcagtgttgaggaaagagctgcaaacacttctttcatttactggaggatcgtctcgccaccagtctttgcagaacattgttatacagctgaggaaagcttgcagtcacccatatctgttcagtggcattgaacctgagccttttgtggaaggggagcatttagttcaggctagtgggaagctcattgtgctggatcttattctgaagaagctccatgagttaggacatcgtgttttactatttgctcagatgacccaaacactggacattctgcaggatttcctggagatgcgcaattacacttatgagcgcctggatggttcagtacgtgctgaggagcggtttgcagcaataagaaatttcagctctcaatctactaaaggccttatgagagatgataatcagattggagcttttgttttcatgatatcaactagagcagggggtgtggggcttaatctcattggtgccgatactgttatcttttacgaacaagattggaatcctcaagctgacaagcaggctctacagcgcgctcatcgcattggacagttaaatcatgtgctgtcaataaatttggtgtcacagcgtacaattgaagaggtcataatgcgaagagccgagagaaaacttaagcttagccacgatattattggagaagatcatagaactgatgtgaagggtggagttctgggaaatgaagctagtgacatgagatcaattatctttggcttgcacctgttcgatcctgctgatacaaccacagagacaatcaatgagggcaccacttctgacacaattaatgtggagaaactggcaaagttgaaaacaatgtctgaaaaggttgtaatgatgcgtagccatgaaccttcagaaaaggatgaacgggcatttgaaatcaacccaaattttgctgatggcaatggaactgtaattagaagggcttctgattctattagtgttgatcctgggcttaatgaagctgcatacctatcctgggtcaataagttcaaagaggcttcgcgttcaattgaagatgccacatctgaacttggaaggcaaagagcagcgccaaaagaaaagttcctgaaacgtgtagttaacaagaaaaaagtagaagaaaagaggtttgccaaatgggaaactttgggttacaagacactagctgttaaggaacctgatatcacagcatgccagaatatttcagactcaggatgcgtccaacttgtgtatggagattgtaccaatccttcaaaactttgccctgcaaagcctgccatcatattcagttgcatagataattctgggacatgggggcatggaggaatgtttgatgctttgactagtctctcaacatgcattccagatgcttatcaccgtgcttctgagtttgatgacctccacatgggggatcttcacttgattgagcttgatgaagtcaactgcacccggagtttggatgcacctttatgggtggcactagctattgttcagtcttacagtcggagacgtaaagttccaagaagtgaaatctccatacctgatttggagctctgtttatcaaaagcagccttctcagctgctcagcattctgcaattatccacatgccccgaattggttaccaaagtggctcccaacgatcagaatggtataccatagaacgcctgctcaggaaatactcatctctccatggaatcgacattttcgtgtactactttcagcgttcatccaggcaacagacaggttctatctagctcatgctgacgcttctgcttgaagaaacccaagctaggtgtagggaaactagggatgtttctgtaacccactagaagaatcagggaatattagctagctgcaacttacagtatcttttatttgcccctttttaatagctttgtaacttatgaatagatgagccaaatgaattattatgttttatggtttttgcctcctttagctaagaggtatgtgtctttgcatgcaaaaaaaaaaaaaaaaaaaa

SEQ ID NO: 6828 - protein, 890 aa, Panicum virgatum
  misc_feature: Ceres CLONE 1888115
  misc_feature (1)..(90): Pfam Name: Helicase_C Pfam Description: Helicase conserved C-terminal domain
  misc_feature: The sequence is a functional homolog of  SEQ ID NO 1581 in the  10/412,699 US patent application
  misc_feature: The sequence is a functional homolog of  SEQ ID NO 1582 in the  10/412,699 US patent application
  misc_feature: Useful for making plants with modulated growth and phenotype characteristics
MATSYERRLLAAADLVLSADAQGQGACLPELGVTADLKPHQLDGVAWLIRRYRLGVNVVLGDEMGLGKTLQAISLLSHLKIQRVAPGPFLVLCPLSVTDGWLAEFSKFCPSLRLLHYVGNKVHRRDLRRTLYDHVHKASTSSHSSELSFDVLLTTYDIALMDQNFLSQIPWHYAIIDEAQRLKNPSSVLYNVLEQRFIMPRRLLLTGTPIQNNLSELWALMHFCLPSIFGKLDEFLSTFKEAGDSLTGAEANKANRQFEIIKHILKAFMLRRTKALLIESGVLALPPLTELTVMVPLTQLQKKLYMSVLRKELQTLLSFTGGSSRHQSLQNIVIQLRKACSHPYLFSGIEPEPFVEGEHLVQASGKLIVLDLILKKLHELGHRVLLFAQMTQTLDILQDFLEMRNYTYERLDGSVRAEERFAAIRNFSSQSTKGLMRDDNQIGAFVFMISTRAGGVGLNLIGADTVIFYEQDWNPQADKQALQRAHRIGQLNHVLSINLVSQRTIEEVIMRRAERKLKLSHDIIGEDHRTDVKGGVLGNEASDMRSIIFGLHLFDPADTTTETINEGTTSDTINVEKLAKLKTMSEKVVMMRSHEPSEKDERAFEINPNFADGNGTVIRRASDSISVDPGLNEAAYLSWVNKFKEASRSIEDATSELGRQRAAPKEKFLKRVVNKKKVEEKRFAKWETLGYKTLAVKEPDITACQNISDSGCVQLVYGDCTNPSKLCPAKPAIIFSCIDNSGTWGHGGMFDALTSLSTCIPDAYHRASEFDDLHMGDLHLIELDEVNCTRSLDAPLWVALAIVQSYSRRRKVPRSEISIPDLELCLSKAAFSAAQHSAIIHMPRIGYQSGSQRSEWYTIERLLRKYSSLHGIDIFVYYFQRSSRQQTGSI

SEQ ID NO: 6829 - DNA, 1685 bp, Panicum virgatum
  misc_feature: Ceres CLONE 1888123
  misc_feature: Encodes the peptide sequence at SEQ ID NO. 6830
accctcccccacccaaaccccacctcctccccgtgtcaaaacctccgagccccgaagcgatcgccagctcagcgcgccggcgacggcggcggtcgccggaggggagatggaggacgtgatggactccgcggtggggccccacttcagcgggctccgcctcgactcgcgccgcctctcgtcctcctcgctcccgtcccccacctccgccaacggcaacggcaacggcacggccgacgccgtcaaagggctcgcgtcccccagggcggacgggaccaagcagcccttcgtgataggcgtgtcgggagggacggcgtcggggaagacgacggtgtgcgacatgatcatccagcagctccacgaccaccgcgtcgtgctggtcaaccaggattcattctaccacggtttaactgaggaacagtctgagcacgtgcaagactacaactttgatcaccctgatgcatttgatacagatcaacttctggagtgcatgggaaagctaaaaagtgggcaatctgtgaatattcctatatatgattttaagaatcatcggcgatgctctgaaagttttagaaaggtcaatgcatcagatgtcatcattttggaggggatcttagtttttcatgaccaaagggttcgtgatttgatggacatgaaaatttttgttgatacagatgctgatattaggcttgctcgacgtataaggcgtgatacagatgaaagaggtagagatgttatctcggtgcttgaacagtatgggaggtttgtcaagcctgccttcgatgattttgtcctgccttccaagaaatatgctgatgtgatcataccaaaagggggagataaccatgttgcaattgatttaattgtgcaacacatccgtacaaaacttggacagcatgacttgtgcaaaatctatccaaatgtctttgtagttcacacaactttccagatacgaggaatgtgtacgctgattcgtgacaggaacatcacaacacctgactttgttttctactcagatcggctgatccgtctggtagttgagcatggtcttgggcatttgccatttacagagaagcagatagttacaccaacaggatctgtttacatgggagttgacttctgcaagaagctctgtggagtgtctattgttagaagtggtgaaagcatggaaaatgctctgcgtgcttgctgtaaggggataaaaattggtaaaattctaatacatcgggttggagacaatggacaacaactcatataccataagcttccaatggatattgctgaacgtcatgttctgcttctggatcctgtgcttggtacaggtaactcagctaatcaagctattgagcttcttataaggaaaggggttcctgaggaccggatcatttttcttaatctcatcacggcccctgaaggtgtcaattgtgtctgcaagcgcttccctcgtttgaagattgtaacctcagagattgatggtgggttgaacgatgaatatcgggtcatcccgggacttggagaatatggggaccgctacttcggcacagactaatccaggattggaactgctgtagttggcattgtgaaaagatactcaagctagagctaacatcaccgtgacagatatactagtgtttggttggttatggtatactggaagcaaacgtggaaaggtttccccggagttgctg

SEQ ID NO: 6830 - protein, 479 aa, Panicum virgatum
  misc_feature: Ceres CLONE 1888123
  misc_feature (1)..(188): Pfam Name: PRK Pfam Description: Phosphoribulokinase / Uridine kinase family
  misc_feature (284)..(479): SWISSPROT Homolog: EC 2.4.2.9 Uracil phosphoribosyltransferase
MEDVMDSAVGPHFSGLRLDSRRLSSSSLPSPTSANGNGNGTADAVKGLASPRADGTKQPFVIGVSGGTASGKTTVCDMIIQQLHDHRVVLVNQDSFYHGLTEEQSEHVQDYNFDHPDAFDTDQLLECMGKLKSGQSVNIPIYDFKNHRRCSESFRKVNASDVIILEGILVFHDQRVRDLMDMKIFVDTDADIRLARRIRRDTDERGRDVISVLEQYGRFVKPAFDDFVLPSKKYADVIIPKGGDNHVAIDLIVQHIRTKLGQHDLCKIYPNVFVVHTTFQIRGMCTLIRDRNITTPDFVFYSDRLIRLVVEHGLGHLPFTEKQIVTPTGSVYMGVDFCKKLCGVSIVRSGESMENALRACCKGIKIGKILIHRVGDNGQQLIYHKLPMDIAERHVLLLDPVLGTGNSANQAIELLIRKGVPEDRIIFLNLITAPEGVNCVCKRFPRLKIVTSEIDGGLNDEYRVIPGLGEYGDRYFGTD

SEQ ID NO: 6831 - DNA, 1848 bp, Panicum virgatum
  misc_feature: Ceres CLONE 1888124
  misc_feature: Encodes the peptide sequence at SEQ ID NO. 6832
tgttgtacatctggatgcatatcatggagctcttaggtgtgagaatcattacgcagtatatttatgagtttctaatcctttcttctttttcccagttgggctgtggttttaccccgtgaggtgcgggctccaaccaggcttcttaagttggagctagctatatatcctgaattacatgtacgacttaaaagtttaaaaggattctgctttatttatatattatgcagttactgcttatagttgtggatatgttggcgtatctcctacacattgaattctgcggtatttttgcaattaattaacatgaacatgggctggtaatggcattactgatgccccttccttttaaaatgtatcccttcccccccaggtctagttctgtaggaacaagtagcatttgaatttgagtaactgctgcttcatatgttcatgtaagcctgttcagggggaaactgcactgtaactacactggtgttgccattttctgttgttacagcgcacatgtgcagccattccatttgtttattagagttgtgttttgcttacttctacaattagctgtgaacactgtgcttccttgttgcagttgataatttttcttgacggctgcatgctattgaaatgattgttatttgagatatttcttttcttaacgaactgcaggcttctaaacctcgtgctgtagttaaactatggaaatctcaaattgaagaaccaaagcttaatttggctgacccttccattatcatttttgacaaaggaacaaaaacccgatacaagatcttacctgcctatgaaggtgacaaacagcagcttcaaaggttttataatgcatgttgtggcatggcacaggttttcaacacggctccagcaccaccagcaaatctcccaatgccaaatctagtacctgcaaactcatctgtggcacattcagaacaatctgcacccagcaaggaggatgttgaattagcgatggctatcaatgcctcaattcaatcagctattgcagagggagtgcccaatgttcaaccaaatgcatccactcccagcaccaatggctggggtattcctccaagcaattctcacaacggatggggacctccagcagctcctgcaccatcaaaattgagcagccaatcccaagcccaggctgacacaccaagcagcagcacatacaatggatgggacatgcctggaacaagctctagccaaagctcatctagatccaacaaaacccaaatcaaccctccagtcgtgattccgcaggaagcacttccggcgcttccaaccccaaccgccccaccattcgcggaagaaaccttctacagcggccctgttcagtatccatccgtagatgccactcctgttgatgttgtcatgcctgctaccaccgaaggtggcacagcagcagcatctgctagaccaggagaaaatgaggctaatgcgagcagcagtggcaacactccctctggcacctgtgttatctgtcttgatgcccctgtggaaggtgcctgcattccttgcggccacatggctggttgcatgtcctgcttgaaggatatcgagtccaagaagtgggggtgccctatctgccgcgccacgatcaaccaggttgttcgcctctatactgtttgaggagttgaaacggtgagcctggaaagtcagcaattcatggttctcgcgacaagttttattggagcatctttatataaaaaaaatatgcagctgtgatattgtgcagttcgtgctgcagtgtaaattatgacttttgtgtaatgtggtctactcgggccgttatatacagtggttgtgtatataagtgtaagacaaaaaaaaaaaaaaaaaaaa

SEQ ID NO: 6832 - protein, 263 aa, Panicum virgatum
  misc_feature: Ceres CLONE 1888124
  misc_feature (1)..(39): Pfam Name: zf-C3HC4 Pfam Description: Zinc finger, C3HC4 type (RING finger)
MAQVFNTAPAPPANLPMPNLVPANSSVAHSEQSAPSKEDVELAMAINASIQSAIAEGVPNVQPNASTPSTNGWGIPPSNSHNGWGPPAAPAPSKLSSQSQAQADTPSSSTYNGWDMPGTSSSQSSSRSNKTQINPPVVIPQEALPALPTPTAPPFAEETFYSGPVQYPSVDATPVDVVMPATTEGGTAAASARPGENEANASSSGNTPSGTCVICLDAPVEGACIPCGHMAGCMSCLKDIESKKWGCPICRATINQVVRLYTV

SEQ ID NO: 6833 - DNA, 2262 bp, Panicum virgatum
  misc_feature: Ceres CLONE 1888198
  misc_feature: Encodes the peptide sequence at SEQ ID NO. 6834
acgtccgctgtccaaacagaaaaggggcaaagaggtgctaacaattacgaggatgccactctatctcgtctccgctcccgccgccgccgccaagctcgccgccggggcacgcgcgtcccctcgccgacgccgccagctcctcctcccagcacgccacttccacagccgccgcgcctccttgtcttcgtccgcggagcgtgcggcggggcgagccatggctgctgcggaggccggcgcgtcgacggcgccggaggcgagctcgagcgccacaggagtgaagcaggcactgatttcattgtcagataaaacagacctggccaatcttggaaatggtcttcagcacttgggattttctattatttccaccggtggcacagcatcaagcttggaagcagctggagttaatgttacaaaagtggaggaaattacacattttcctgaaatgctagatgggagagtaaaaacattgcaccctagtatacatggtggtattcttgcgcgaagagaccagaagcatcatctggaagcattgaacaagcatggcattgggacatttgatgtggttgtagtgaacttgtatccattctacgataaggtcacctcaggtgcaatatcttttgaggatggtatagagaatattgatatcggtggacctacattgatccgagctgcagccaagaaccatagggatgttcttgtcgttgttgatcataaagattatcctgctctattggaatatctggatgggaagcaagatgatcaggatttccgcaggatgcttgcatggaaagctttccaacatgttgcttcttacgattcagctgtctcagagtggttatggaagcaaacaaataaaggagaaacattccctcctagctttactgtgcccctgtcgctgaagtctacacttagatatggtgaaaatcctcatcaaaaggctgcattctacagtgacaagagtctttctctagtaaatgctggcggtattgcaacagcaattcagcaccatggaaaggaaatgtcctataacaattacttggacgcagatgccgcttggaactgtgtctcggagtttgagagcccaacctgtgttgtggttaaacacacaaatccgtgtggggtagcatcccgacaggacatccttgaagcatacaagttggctgtgaaggcagaccctgtgagcgcatttggcggcatagtcgcctttaatacgacgatcgatggggatctggcaagggaaatccgcgagtttaggagtccgacggatggcgagacgcggatgttctacgagatagtcgtcgcacccggatatactgagaaggggctcgaggtcctgaaggggaaatcgaagacgctgaggatactcgaggtgcagcggagcgggaaagggatgctgtccctccggcaggtgaacggcggctggctggctcaggagtcggacgacctgaccccggaagccatcaccttcacgaagatgtcggagagggcccccgagtttagcgagctctcggacgcgaggttcgcctggctctgcgtcaagcatgtcaagagcaacgccatcgtgatcgccaagaacaattgcatgctgggcatgggcagcgggcagccgaacaggctggagagcctgaggatcgccttcaggaaggccggggaggaggccaagggagctgctctggccagcgacgccttcttcccattcgcctggaacgacgcggtggaggaggcgtgccggagcggcatcgcggtgatcgcggagcccggcggcagcatccgggaccaggacgccgtggactgctgcgacaagtacggggtggccctcctattcaccggcgtcaggcacttcaggcactgaccgtggccgccgctgaaggtggcaaacaaagctggggcagggaggattctgaccggaggcaggctgcaacaaagctgctgcagctgctcctgatcgagggcatgcctgagcagaagagatttgaattcaaatctttttacttcagttcaaaattaaaaacttgcaccagatcttccaaaagaaatgtaggaaaggatgccctgggtaaaagcgcgactctggaacaaaggggtgtccgaaggcgagaatgcgtgtacatcttgtaggaggctggatgaagcgtttcttggggaatcctatttcagttttttttaataacctacatttcagtttttctcagccactgttttcgtgtatttttttagataatggaaataagttccggcctctaaaaaaaaaaaaaaaaaaaa

SEQ ID NO: 6834 - protein, 599 aa, Panicum virgatum
  misc_feature: Ceres CLONE 1888198
  misc_feature (1)..(326): Pfam Name: AICARFT_IMPCHas Pfam Description: AICARFT/IMPCHase bienzyme
MPLYLVSAPAAAAKLAAGARASPRRRRQLLLPARHFHSRRASLSSSAERAAGRAMAAAEAGASTAPEASSSATGVKQALISLSDKTDLANLGNGLQHLGFSIISTGGTASSLEAAGVNVTKVEEITHFPEMLDGRVKTLHPSIHGGILARRDQKHHLEALNKHGIGTFDVVVVNLYPFYDKVTSGAISFEDGIENIDIGGPTLIRAAAKNHRDVLVVVDHKDYPALLEYLDGKQDDQDFRRMLAWKAFQHVASYDSAVSEWLWKQTNKGETFPPSFTVPLSLKSTLRYGENPHQKAAFYSDKSLSLVNAGGIATAIQHHGKEMSYNNYLDADAAWNCVSEFESPTCVVVKHTNPCGVASRQDILEAYKLAVKADPVSAFGGIVAFNTTIDGDLAREIREFRSPTDGETRMFYEIVVAPGYTEKGLEVLKGKSKTLRILEVQRSGKGMLSLRQVNGGWLAQESDDLTPEAITFTKMSERAPEFSELSDARFAWLCVKHVKSNAIVIAKNNCMLGMGSGQPNRLESLRIAFRKAGEEAKGAALASDAFFPFAWNDAVEEACRSGIAVIAEPGGSIRDQDAVDCCDKYGVALLFTGVRHFRH

SEQ ID NO: 6835 - DNA, 2448 bp, Panicum virgatum
  misc_feature: Ceres CLONE 1888220
  misc_feature: Encodes the peptide sequence at SEQ ID NO. 6836
gtccacctcgccctcctcctcctgctcggcggctcatgaacctgtggacggacgacaacgcctccatgatggaggccttcatggcctctgccgacctccccgcctttccctgggccggcgcctcgtcggccgccgccacgccgccgccgccgccgccgcaggcgccgccggcgatgatggcgccgggcttcaaccaggacacgctgcagcagcggctgcaggccatgatcgagggctccagggagacctggacctacgccatcttctggcagtcctccgtggacgccgccaccggcgcctcgctgctcggctggggggacggctactacaagggctgcgacgacgacaagcgcaagcagaggccgctcacgcccgccgcccaggccgagcaggagcaccgcaagcgcgtgctccgcgagctcaactcgctcatctccggcgccgccgccgcccccgacgaggccgtcgaggaggaggtcaccgacaccgagtggttcttcctcgtctccatgacgcagtccttcctcaacggctcgggcctcccggggcaggcgctcttcgccggccagcccacctggatcgcctccggcctctccgccgcgccgtgcgagcgcgcgcgccaggcctacaacttcggcctccgcaccatggtctgcgtccccgtcggcacgggggtgctcgagctcggctccaccgacgtcgtcttccagaccgccgagagcatggctaagatccgcgcactctttgggggcggaggcggagcagggggcggctcgtggccgcccgtgcagccgccggcgccgccgcagcagcccgcgcccggagcagaccaggcggagacggacccctccgtgctctggctcgccgacccggtcatggacatcaaggattccctgtcgcacccgtcggccgagatctccgtcagcaagccgccgccgccgccgccccagatccacttcgagaacgggagcacgagcacgctcacggagaaccccagcccctccgtgcacgcgccccctcccccgccggcgccggctgccgcgccaccgcagcggcagcaccagcagaaccagggccccttccgccgggagctcaacttctccgacttcgcgtccaatccctcctccatggcggcggccccgcccttcttcaagcccgagtccggcgagatcctcagcttcggcgccgacagcaacggccggaggaaccagtcgccggcgccccccgccgccacagccagcctgaccaccgcgcccgggagcctcttctcgcagcacacggcgaccctgacggccgccgcggcgaacgacgcgaagaacaacaccaccaccaacaacaacaagcgctcgatggaggccacatcccgcgccagcaacaccaaccaccacccggcggcgacggcgaacgagggcatgctgtccttctcgtcggcgccgacgatgcggcagtcgacgggcacgggcgcgccggccaagtcggagtcggaccactcggacctggacgcctcggtgcgcgaggtggaaagcagccgcgtggtggcgccgccgcccgaggcggagaagcggccgcgcaagcgcgggcggaagccggccaacggccgggaggagccgctgaaccacgtcgaggcggagcggcagcggcgcgagaagctcaaccagcgcttctacgcgttgcgcgcggtggtgcccaacgtgtccaagatggacaaggcgtcgctgctcggcgacgccatctcctacatcaacgagctccgcggcaagctgacggcgctcgagtcggacaaggactcgctgcacgcgcagatcgaggcgctcaagaaggagcgcgacgcgcggccggccccgcacgccgccgggcacgacgccgggccgcggtgccacgcggtagagatcgacgccaagatcctggggctggaggccatgatccgcgtgcagtgccacaagcgcaaccacccgtcggcgcggctcatgacggcgctgcgcgagctggacctggacgtctaccacgccagcgtctccgtcgtcaaggacctcatgatccagcaggtcgccgtcaagatggccagccgcatctactcacaggagcagctcaacgccgccctctacagccgcctcgcggagccgggcgccgccatgggcaggtaattagggatctcacctcacctggggcagccagatatcatagggacgataccgttaccgttaccgcaaccggattgtttgtcgccgtcgtcacctccatggtcacaacacaatagctgctggagagattcgcgaggaggaagacgaccatgacgacggtgttgttgttgtaaactttagaagggaggatggatgaggggtgatacttagctgctgctgctgctgcggttgttcatcttcttcttgtgtttttgctagtagcgtgttactaattagcaggattgagcaaaaaaaaaaaaaaaaaaaa

SEQ ID NO: 6836 - protein, 702 aa, Panicum virgatum
  misc_feature: Ceres CLONE 1888220
  misc_feature (1)..(50): Pfam Name: HLH Pfam Description: Helix-loop-helix DNA-binding domain
  misc_feature: The sequence is a functional homolog of  SEQ ID NO 1238 in the  10/412,699 US patent application
  misc_feature: The sequence is a functional homolog of  SEQ ID NO 943 in the  10/374,780 US patent application
  misc_feature: Useful for making plants with modulated growth and phenotype characteristics
MNLWTDDNASMMEAFMASADLPAFPWAGASSAAATPPPPPPQAPPAMMAPGFNQDTLQQRLQAMIEGSRETWTYAIFWQSSVDAATGASLLGWGDGYYKGCDDDKRKQRPLTPAAQAEQEHRKRVLRELNSLISGAAAAPDEAVEEEVTDTEWFFLVSMTQSFLNGSGLPGQALFAGQPTWIASGLSAAPCERARQAYNFGLRTMVCVPVGTGVLELGSTDVVFQTAESMAKIRALFGGGGGAGGGSWPPVQPPAPPQQPAPGADQAETDPSVLWLADPVMDIKDSLSHPSAEISVSKPPPPPPQIHFENGSTSTLTENPSPSVHAPPPPPAPAAAPPQRQHQQNQGPFRRELNFSDFASNPSSMAAAPPFFKPESGEILSFGADSNGRRNQSPAPPAATASLTTAPGSLFSQHTATLTAAAANDAKNNTTTNNNKRSMEATSRASNTNHHPAATANEGMLSFSSAPTMRQSTGTGAPAKSESDHSDLDASVREVESSRVVAPPPEAEKRPRKRGRKPANGREEPLNHVEAERQRREKLNQRFYALRAVVPNVSKMDKASLLGDAISYINELRGKLTALESDKDSLHAQIEALKKERDARPAPHAAGHDAGPRCHAVEIDAKILGLEAMIRVQCHKRNHPSARLMTALRELDLDVYHASVSVVKDLMIQQVAVKMASRIYSQEQLNAALYSRLAEPGAAMGR

SEQ ID NO: 6837 - DNA, 2690 bp, Panicum virgatum
  misc_feature: Ceres CLONE 1888267
  misc_feature: Encodes the peptide sequence at SEQ ID NO. 6838
aaaaccgagcaccgaagtgggggtgtcggggggaggcagaggcataagcgggagagcgataaatcggagagggccgttgggagcaggcggctatcgcggccgccgcctccccgatccggagccccacccccgggtcgcccccagattcgcacgacttgggggcctcgccaccagatcgggaggaaaatcgagttgcaggtgaaggggcaagttttctgcagcttaaataactagagtttgatatatggcttacatgaattctgatcaaattcttgaggttcctgacactcctgaccgaatacaacagtcaacatgccctgtatccagctctgttgttaggagggatgttacaatggcagctgctaatccaataccatgtcgcagaattagatttaaaaccagtaataattccttgcatggttcctcaatccaagataatgcttgcagtgtactgcctgcaccttcggatacagaccatattttcaaacaagctgacgtggcacggattctggcactaccagaagatcttcaggcaaatatttccttacagaaatctgacaggagtgaaatatctgttgagaacggaaagagggctgaaaaacgtggcttggatcaaagcagcagcatttccgaccacatcagttgtagtgtgactggaggaaggagccctggctgccgagttagagatggggacgttagtgaccaagatgcaaatcatcggaatgtgagctttcttggtgcaggatcaggtcttcctaccatcccagtaggcaaaccacgaaacagaacctgtactattaccaccaataggctgaagggtgtagcaggtgctgatatttgtcaagggtcaagttctgcggaggtgaaaggtgaaatggtcactaacaaggccatcgcaggaccttcaagccctccatgtggtgttcctcaaaggcatgtgggtcaaaaaaaactggtccgtaatggatgcatttctccatctaacatagccaaaagaagtgtaaaagctgatgaaaagcaggaaatgtgctatccaagcaaacatttgcaccatccacatcctcagcttgatgcatttgacagaagcaatgtgatcgatctcactgataattcaccaataatgacaaggcagagatatgcaatgaaggacaaattgacctctggatgcaatttggacacaaggacagcaaaaaagttgagaacagatagagctgggaagactttgattccacagtgtgcacatcatgccaacagcagcaattgttctggaatcggtttatcaggccgcaacaaaggaaaagaaattagcgacagcgatccaattggagaggctaatttgaggaggatttctctaactgctgctggaagttctgttgtaaataacaacagttctaatatggatgcagagcaaggttggagaacaacacgtaaccacactagtaaattacccatttcattgatgggtaagctgacttgtagttctcaacgagaatctgaatcttctgcaccatctagtcaggatcacggatctggagcaaccatagttgcttctgataggatgggaactaaaacaataatgattggtagaggaaggagaaaacatgcctcaacttcttcccatcctggtgaaagctctagtgctcatgatggacctggagcttcttttgtttcaccaccaaaagccggaagaaatcataccagtcatcgacatgatattcctgtagtaaccattgatgatatgacccctgaagcaagatctagtttgagtggatatagtaatggaacctctgttgatcctactatacaagcacaattagagtcagatgagttactggctcgccagcttcaggagcaactttacaatgaatctcctcgtttcgcatctacagaagagatggatgcaatcgtagcaatgtcacttcaacatgaggaggatacacatcagacatctagtcctgtaaggcggttcccaaacaataatagaggtgcccgggcttcccgttcaagttcttatcgaaatgctcttagggctgaattggcgacatcgaatatgatttcccgtttgcagaatagggcttcaataacttcaggattgagagctgttttaggaagatatcctggtgctgcaggaagatatcctggtgctgtgcgcattcaacctaacattgatttaaatgactatgacgcactacttgcactggatgaaaataaccaccagcacactggtgcttcagaaagccagatcaacaatttgccgcagtcagtagttcagtcgaatagcatcgaagagccatgtgctgtctgcctagacaatccctctgtgggagataccattcgccatcttccatgctttcacaagttccataaagagtgtatcgacgagtggctgagacgaaagaaactctgcccaatctgcaagtctgggatcagatgaagcgggccaccaaatctgcagctccagttttatgttggttgtggtagcgacgagaggctgcagtttcttgtaccggctgcttctgtgccaattcctgcagtgcgtcttagcctctggtgtatcgttaaagttgcgggcttaattgcatcgttttgtcgccgtaccccttgcaatttttcctgctatattgactcactgattggcataatggatgaagtcaaccaccccctttcccgaaaaaaaaaaaaaaaaaaaa

SEQ ID NO: 6838 - protein, 729 aa, Panicum virgatum
  misc_feature: Ceres CLONE 1888267
  misc_feature (1)..(41): Pfam Name: zf-C3HC4 Pfam Description: Zinc finger, C3HC4 type (RING finger)
MAYMNSDQILEVPDTPDRIQQSTCPVSSSVVRRDVTMAAANPIPCRRIRFKTSNNSLHGSSIQDNACSVLPAPSDTDHIFKQADVARILALPEDLQANISLQKSDRSEISVENGKRAEKRGLDQSSSISDHISCSVTGGRSPGCRVRDGDVSDQDANHRNVSFLGAGSGLPTIPVGKPRNRTCTITTNRLKGVAGADICQGSSSAEVKGEMVTNKAIAGPSSPPCGVPQRHVGQKKLVRNGCISPSNIAKRSVKADEKQEMCYPSKHLHHPHPQLDAFDRSNVIDLTDNSPIMTRQRYAMKDKLTSGCNLDTRTAKKLRTDRAGKTLIPQCAHHANSSNCSGIGLSGRNKGKEISDSDPIGEANLRRISLTAAGSSVVNNNSSNMDAEQGWRTTRNHTSKLPISLMGKLTCSSQRESESSAPSSQDHGSGATIVASDRMGTKTIMIGRGRRKHASTSSHPGESSSAHDGPGASFVSPPKAGRNHTSHRHDIPVVTIDDMTPEARSSLSGYSNGTSVDPTIQAQLESDELLARQLQEQLYNESPRFASTEEMDAIVAMSLQHEEDTHQTSSPVRRFPNNNRGARASRSSSYRNALRAELATSNMISRLQNRASITSGLRAVLGRYPGAAGRYPGAVRIQPNIDLNDYDALLALDENNHQHTGASESQINNLPQSVVQSNSIEEPCAVCLDNPSVGDTIRHLPCFHKFHKECIDEWLRRKKLCPICKSGIR

SEQ ID NO: 6839 - DNA, 2545 bp, Panicum virgatum
  misc_feature: Ceres CLONE 1888493
  misc_feature: Encodes the peptide sequence at SEQ ID NO. 6840
tgatccgtacatgtgcgtgagagactgatggcatttggccggggtggaaagatggacggccgccggccgtcctcgtcgtcctcatcgttctgcacgaccaccacggtcgtcgtctttgtggcgctctgcctggtcggcgcgtggatgatgacatcgtccaccgtattcccgctggagatttcgtcaaataagaagccagtggtgaagcaacagccagcgcctgttaacttcggcacgtctgaggatgctgcatctggcaatactggtgaaggttctgggaaatttgaggataccgacaacaacgacaccacagtcccagaggagctgaccaacaatgaagctcctgagaaagagaagtccaccgagaacatggcagagaagcctgaggagaagctcgaagaaaaggagccggcaccaccaaatgagaaagaggagaccaaggatatgtttgatgatgcaaatggaaaatcagaagggcggtcagatgatgtgaagaatgacaatgatggggataagaaagatgagaacacaaatgagagtggtgatgagaaacctgatggcgagaggaaggatgatcaagaagaaaagtctgaaggtgatgccactcaggaggagcaacctcaaatagaagagaaggtcgaagaaactggagaaaaggaacagagctcaaactctaatgaggtatttcctgatggggctcagtcagagcttctgaaggagtcaaatgcccagaacggttcattcaccactcaggctgcagagtcgaagaatgagaaggaagttcaagcatcatcaaaatcttcaggtgatgagaccagctatagctggaaactatgcaatagcagtgcctccacagattacattccttgccttgacaatgtgaaggctatcaagaagcttcgaagtactaaacattatgaacatcgcgagaggcattgccctgaggagcctcctacctgccttgttccactcccagaaggatataaacgcccaatcgagtggccaaagagcagggacaaggtatggtacagcaatgtcccacacaccaagcttgcagagtacaaggggcaccaaaactgggttaaagtctccggtgattacctcctgtttcctgggggtggcactcagttcaagaatggtgcactccactacattgatactattcagcaggcactgcctgatattgcatggggcaaacgaagccgcgtcattctagatgttggttgtggtgttgccagctttggaggctacatgtttgacagagatgtgcttaccatgtcttttgctccaaaagatgagcatgaagctcaagtacaatttgcactagaaaggggaattccagcaatatcagctgtaatgggcaccaagagacttccataccccagcagggtctttgatgtcatccattgcgcccgctgcagggtcccttggcacattgaaggtggcatgcttttactggaattgaaccgccttttacgccctggtggttactttgtctggtctgccactcctgtttaccaaaaactcccagaggacgtcgagatttggaatgccatgtctattctgacaaagtccatgtgctggaagatggtcaacaagactaaggataagttaaaccaagttggtatggccatatatcagaaaccaatggacaacaattgctacgagaaaagatcagaaaacagcccaccattatgcaaggaatcagatgctgcagatgctgcatggaatgtacctttggaagcatgcatgcacaaattgcctgttggcccaacagttcgaggagcaaaatggccagagtcgtggccgcaaaggcttaataagacccctttctgggttgatggttcccaggttggagtctatggaaaacctgcaaatgaagattttgaggcagacaatgctcactggaaacgggttgtaagtaaatcatacttgaatggcatgggcattgactggtccaaagtgagaaatgtcatggacatgagagcagtatatggaggttttgctgcagctctgaagaaccaaaaggtctgggttatgaatatcgtgccaattgattcaccagacacgctgcccatcatttatgagcgtggtttgtttggtatgtatcatgactggtgtgagtctttcagcacttacccaagaacatatgaccttctgcacgcagaccacctgttctcgaagctcaaaacgagatgcaaattgttggcagtttttgctgaggttgaccgtgtgttgaggccagaaggcaaactgatcgttagggacaccgcggacacaacaaacgaactggaaagcatggccaagtccctaaagtgggaggtgcgcatgacctacaccaagggtaacgaggggctgctctgcgtcgagaagtcgatgtggcggcccaaggaggttgaagcaagcatgtgaagtatgtgttgaacaaaactgtcactgggtagggcattttaggccctgtttagttcccacccgtaaacacaaaattttgcgaaaacttaaagtactaaataaagtctatttacaaaaaaaaaaaaaaaaaaaa

SEQ ID NO: 6840 - protein, 794 aa, Panicum virgatum
  misc_feature: Ceres CLONE 1888493
  misc_feature: The sequence is a functional homolog of  SEQ ID NO 198 in the  10/666,642 US patent application
  misc_feature: The sequence is a functional homolog of  SEQ ID NO 484 in the  11/435,388 US patent application
  misc_feature: The sequence is a functional homolog of  SEQ ID NO 626 in the  11/435,388 US patent application
  misc_feature: Useful for making plants with modulated growth and phenotype characteristics
MAFGRGGKMDGRRPSSSSSSFCTTTTVVVFVALCLVGAWMMTSSTVFPLEISSNKKPVVKQQPAPVNFGTSEDAASGNTGEGSGKFEDTDNNDTTVPEELTNNEAPEKEKSTENMAEKPEEKLEEKEPAPPNEKEETKDMFDDANGKSEGRSDDVKNDNDGDKKDENTNESGDEKPDGERKDDQEEKSEGDATQEEQPQIEEKVEETGEKEQSSNSNEVFPDGAQSELLKESNAQNGSFTTQAAESKNEKEVQASSKSSGDETSYSWKLCNSSASTDYIPCLDNVKAIKKLRSTKHYEHRERHCPEEPPTCLVPLPEGYKRPIEWPKSRDKVWYSNVPHTKLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSILTKSMCWKMVNKTKDKLNQVGMAIYQKPMDNNCYEKRSENSPPLCKESDAADAAWNVPLEACMHKLPVGPTVRGAKWPESWPQRLNKTPFWVDGSQVGVYGKPANEDFEADNAHWKRVVSKSYLNGMGIDWSKVRNVMDMRAVYGGFAAALKNQKVWVMNIVPIDSPDTLPIIYERGLFGMYHDWCESFSTYPRTYDLLHADHLFSKLKTRCKLLAVFAEVDRVLRPEGKLIVRDTADTTNELESMAKSLKWEVRMTYTKGNEGLLCVEKSMWRPKEVEASM

SEQ ID NO: 6841 - DNA, 2227 bp, Panicum virgatum
  misc_feature: Ceres CLONE 1888501
  misc_feature: Encodes the peptide sequence at SEQ ID NO. 6842
agcactagcagctcaagctcagctgtggtcacggtcgcgcgcgtcttctgatcgaagaagcgcggcgcctccccccggccggtcgtctcgcgtctcttctactgcctcctccctccactttcactccggcattccgcctttcccattcccgttgaaacgagccaaacagatcaaaagcagagcgagaaatacagagggaaaaaaaaaaacaaatcccgccgctcccgaggcacgtcgccggcgactgggcgagagggagacccctccggctctgctccgccgaggcgacgcccgtgcaccggccgcgcccgcggatgcgcggcgagggcccggcggtccacgctcgtagccagatctgagggaagggcgctgctgggaagcggcaggaggtggtggtgtgggattcattcagcccccggcggggatggggtggtccgtagggctgtgctggtggctcgtggcggcggcggcggcggcgggggcagcggagggggaggtcggcgcggtggcgggggcggcggcgccgaggcggcacgcgtacgcggcgatgatgtacatgggcacgccccgggactacgagttctacgtcgccacgcgcgtcatgatgcggtccctgggccggctaagcgccaccgccgaccgcgtcgtgatcgcgtccctcgacgtcccgccgcgctgggtccaggcgctgaaagatgatggtgtgaaggtggtctctgtggagaatttgaagaatccttatgagaaacaagaaaatttcaacatgcgattcaaattgactttaaacaagctgtatgcatggagcttagtttcatatgagcgagttgttatgcttgattccgacaacattttcctccagaatactgatgagttatttcagtgcggtcggttttgtgctgtcttcatcaatccatgtatcttccatacaggcctctttgtactaaagccttcaatggatgtttttaagaacatgctacacgagctagctgttggacgcgaaaacccagatggtgcagaccaaggcttccttgctagttatttcccagatttgcttgatcagccaatgttccatccgccagctaatggtaccaaacttgagggtacttatcgcctccctctgggctaccagatggatgcatcatactattatctgaagcttcgttggagtattccatgtgggccaaacagtgtgattacgtttccaagtgctccatggtttaaaccatggtattggtggtcttggccagttttacctttggggctctcttggcatgaacaacgtcgtgaaaacctagggtactcgtcggagataccagtggtattaatccaggctgtattgtacattggagtcatagcagttacccgactggcacggcctagcttgtccaagatgtgctacaacagaagaatggagaaaagcactatgttcttgctctccctgctcagagtagtggtggcatggtccatactcgcagcatacaccatacccttcttcatcatcccaagaactgtgcatccgctgcttggatggcctctgtacctgctgggttctttctcgctttcttccattgtgatcaacatcttcctcctccacccgttctctgtcctcacgacatggtttgggatcgtcggtgctctctttgtgatgtctttcccttggtatctaaatggtatcgtcagggccttggtggtgtttgcgtacgcattctgctgcgcacccttggtctgggcatctttggtcaagacaatgagctccttacaggttctggttgagagggacgcattcaggcttggagaacctaaccagaacgccgagttcacgaagctgtactgaggtgggaagtgcagatacatatgattgatcacttcagttgtggttcagtttgaacagctaatctccattgacgttggcaattctgatggccaatttagttgtacaagtaaaactgcaggatgtgggagctagagttgttgtacctttggaaccacctggaaacctctggaacccgttattgttatcttagacatacaggtgatatacaaggggggaaggaggggtagaggaactgcagaggaaatgaccgagggacaattttttgttatttgacttactgttcctctgaaaagccaacacaatttttggctttgctgtaattgatatgatcagttccataaccattaccaatcaagagaagggttcaaagttcaaaaaaaaaaaaaaaaaaaa

SEQ ID NO: 6842 - protein, 469 aa, Panicum virgatum
  misc_feature: Ceres CLONE 1888501
  misc_feature: Great-hit functional homolog of the protein sequence encoded by LOCUS At2g35710
  misc_feature (1)..(223): Pfam Name: Glyco_transf_8 Pfam Description: Glycosyl transferase family 8
  misc_feature: Useful for making plants with altered cell wall content and/or composition
MGWSVGLCWWLVAAAAAAGAAEGEVGAVAGAAAPRRHAYAAMMYMGTPRDYEFYVATRVMMRSLGRLSATADRVVIASLDVPPRWVQALKDDGVKVVSVENLKNPYEKQENFNMRFKLTLNKLYAWSLVSYERVVMLDSDNIFLQNTDELFQCGRFCAVFINPCIFHTGLFVLKPSMDVFKNMLHELAVGRENPDGADQGFLASYFPDLLDQPMFHPPANGTKLEGTYRLPLGYQMDASYYYLKLRWSIPCGPNSVITFPSAPWFKPWYWWSWPVLPLGLSWHEQRRENLGYSSEIPVVLIQAVLYIGVIAVTRLARPSLSKMCYNRRMEKSTMFLLSLLRVVVAWSILAAYTIPFFIIPRTVHPLLGWPLYLLGSFSLSSIVINIFLLHPFSVLTTWFGIVGALFVMSFPWYLNGIVRALVVFAYAFCCAPLVWASLVKTMSSLQVLVERDAFRLGEPNQNAEFTKLY

SEQ ID NO: 6843 - DNA, 1873 bp, Panicum virgatum
  misc_feature: Ceres CLONE 1888535
  misc_feature: Encodes the peptide sequence at SEQ ID NO. 6844
gttgcttcgcttttcgaccaccgaacgctagccgcagtccgacctaggcggcggcggcagcagcagcagggcgctccccggctccggtccatctatcgcgttgtcatggccgcgcaaccgacgatcccgcgccgcggcctcttcgtcggcgggggctggagggagccgtcgctcgggcgccgcctccccgtcgtcaacccggccaccgaggccaccatcggcgacatcccggcggccacggcggaggacgtggagatcgcggtcgcggcggcgcgggacgcgttctcgcgcgacggcgggaggcactggtcgcacgcccctggggccgtgcgggccaagttcctcagggcgatcgctgccaagattaaagatagaaaatctgatctggctttgctggagacacttgattctgggaagcctctggatgaaacagatgcggatatggaggatgctgctgtatgctttgagtactatgctgatctggcagagtctttagatgagaagcaacgttcaccaatctctctacctatggagaatttcaagtcccatatactcaaagaacccattggggttgttggactgatcactccctggaactatcctctgttgatggctacttggaaggtcgcaccttccttggctgctgggtgcacagctgtgttaaagccatcggagttggcttctctgacttgcttagagcttggtgcaatatgcatagaggtaggcctacctccaggtgtgttgaacataattacgggtctgggccctgaagctggcggtccattatcttcacatccccatgtggataaggttgcttttaccggaagtacagagactggtaagagaataatgactgctgctgctcaaatggttaagcctgtttcgttagaacttggaggcaaaagtcctcttattgtctttgatgacgttgacattgacaaagctgttgaatgggccatgtttgggatctttgcgaatgctggacaagtctgcagtgctacttctcgtctacttctgcatgagaaaatagcaaagcaattcttggatagattggtcgcatgggcaaagaatatcaaagtctccgacccactggaggaaggctgcaggctggggtctgttgtcagtgaagggcagtatgaaaagataaagaagttcatctcaacggcaagaagcgaaggagccacaattttatatggtggtgcccgaccacagcacctcggaagagggttctttattgaacctacaattataacagatgttagtacatcaatgcaaatttggcgagaggaagtctttggaccagtcgtctgtgtcaaagagtttaggacagagagtgaagctgtggaacttgcaaatgatactcactatggtttagctggtgcagtgatctctaatgatgaagagaggtgtgagcgcatttcgaaggcccttcattctggtattgtttggataaattgctctcaaccaacctttgtccaagctccatggggagggaataagcggagtggttttggtcgtgagctcggacaatggggccttgacaactacctgaccgtcaagcaagtcaccaagtactgctcggatgagccatggggatggtaccagcctccatcgaagctgtaaacaggttcacgccaggagaatggagcgcatcattcacggaagaggcaacatcaatcctgcgcgtggacagaacttatgtacaatacggtgctctttgaataaaaagcccttacgacaaagcggcttgtacttgtgctgttaacgaatccaggacagtgtactttatcatgggctgttcagtttgcactctgcagactagccaagatcgaagtaaacaaagatatttggtcaaaaaaaaaaaaaaaaaaaa

SEQ ID NO: 6844 - protein, 505 aa, Panicum virgatum
  misc_feature: Ceres CLONE 1888535
  misc_feature (1)..(321): Pfam Name: Aldedh Pfam Description: Aldehyde dehydrogenase family
  misc_feature (1)..(505): SWISSPROT Homolog: EC 1.2.1.8 Betaine aldehyde dehydrogenase
MAAQPTIPRRGLFVGGGWREPSLGRRLPVVNPATEATIGDIPAATAEDVEIAVAAARDAFSRDGGRHWSHAPGAVRAKFLRAIAAKIKDRKSDLALLETLDSGKPLDETDADMEDAAVCFEYYADLAESLDEKQRSPISLPMENFKSHILKEPIGVVGLITPWNYPLLMATWKVAPSLAAGCTAVLKPSELASLTCLELGAICIEVGLPPGVLNIITGLGPEAGGPLSSHPHVDKVAFTGSTETGKRIMTAAAQMVKPVSLELGGKSPLIVFDDVDIDKAVEWAMFGIFANAGQVCSATSRLLLHEKIAKQFLDRLVAWAKNIKVSDPLEEGCRLGSVVSEGQYEKIKKFISTARSEGATILYGGARPQHLGRGFFIEPTIITDVSTSMQIWREEVFGPVVCVKEFRTESEAVELANDTHYGLAGAVISNDEERCERISKALHSGIVWINCSQPTFVQAPWGGNKRSGFGRELGQWGLDNYLTVKQVTKYCSDEPWGWYQPPSKL

SEQ ID NO: 6845 - DNA, 989 bp, Panicum virgatum
  misc_feature: Ceres CLONE 1888554
  misc_feature: Encodes the peptide sequence at SEQ ID NO. 6846
ctatcctccggccgccaccgcaccacccggccccccatggccgccgcctccacctccacctccctttcccttggcttcccctctctcctccgcccaactcccagaaccctaccccagacccagtcgcaaccaccgaaccccaacaacccccctaaacccctccgcctcggcctaaccctcgcgccgccggccgcggcgcctcgccccgccgcggtgcccgacggcgtcgccatcgccgacgtcgtggagagggactggtccttcctcgagcccgcgggggcgggcgtccagcgcgcgctcgccgcgggggcgctgtcgccgtcctcgcgggtgctggccgtcacgcccacggcgtccttcgtgggcgcggtgctcgcgtcctcgccctgcgggctcctggtggccgtgcacgagtcgctgtacgtgctggcgggggtcaaggaggcgcacgacgaggtgaggtgcttccacctcgagggcgggggcgggggcaggggcggcggcgtggtggaggccgtcccggagaggttcgacggcttcgacgccgtgttcgtgtgctacttccctgggatgggggtctccgccgcggcgctgctcaagtctctggccaagaggtgctccaaaggtgcaagagttgtcatgttcttggatcaagacaggcagaattttgaacaacaccggagagagcatcctgatgtcgcaacatctgatttgcccagtaaatcctcactagagaaggctgcatctgggaacaagtatgaaataacagagtttgtggatgatcctaccttgtacctagctgttttgcaatttcaaggatgagaattttcgatattttaaagcaaatcgtgattgcttgtgatggctagttcgagtatggcttatgtagttgtatctctttggccagcttgtgtctataatgctctgttcactttgtttgagatcaaatgaatcaccattcaccagggcaaaaaaaaaaaaaaaaaaaa

SEQ ID NO: 6846 - protein, 261 aa, Panicum virgatum
  misc_feature: Ceres CLONE 1888554
  misc_feature: Great-hit functional homolog of the protein sequence encoded by LOCUS At2g41950
  misc_feature: Useful for making plants with modulated nitrogen use efficiency
MAAASTSTSLSLGFPSLLRPTPRTLPQTQSQPPNPNNPPKPLRLGLTLAPPAAAPRPAAVPDGVAIADVVERDWSFLEPAGAGVQRALAAGALSPSSRVLAVTPTASFVGAVLASSPCGLLVAVHESLYVLAGVKEAHDEVRCFHLEGGGGGRGGGVVEAVPERFDGFDAVFVCYFPGMGVSAAALLKSLAKRCSKGARVVMFLDQDRQNFEQHRREHPDVATSDLPSKSSLEKAASGNKYEITEFVDDPTLYLAVLQFQG

SEQ ID NO: 6847 - DNA, 2830 bp, Panicum virgatum
  misc_feature: Ceres CLONE 1888647
  misc_feature: Encodes the peptide sequence at SEQ ID NO. 6848
atttttacacaccatcttccctgttccccaacctcccaaaaccctacccgccctcggccctcctaaaccctcgcggcgtccctcgtttccactgctccgactcggccaccccgtccgtctccgcagcctccctcgcccttggcgtgcttggcaggggaagcggaagatgctcggggcctccaggcgatccctctgcgccgccgccgccgcccgcagccgcgcggccgctggcgcctccgccgcctcggcgccgccgacccgcccggtgagcaatggagcgcagggagctcctcagcaacagaaaaggttgctctcagtgcttgcggcgcccaaggttactggaaccagcaatgttgcatcccttaagctgatggatggtgcccttgttgggagacgctatgagtcgagtgcagctgcagttgactccacagacatgccaccagctgagaagcatgagtaccaggcggaggtcaacaggctcatggatttgattgtgcacagcttgtatagtaacaaggaagtcttccttcgagaattggtcagcaatgctagtgatgcacttgataagttgcgttatctgagtgtcactgatcctgagcttctgaaggatggtcctgaacttgacattcgcatccaaacagacaaggataatggaatagtaatgattaccgattctggaattggcatgacgaagcaagaacttgttgattctcttgggactattgcaagcagtggaactgccaagttcctgaaggcattgaaggagagtcaagaagctggcatggacagcaacttgattggccaatttggtgttggattctattctgcatttcttgttgcggataaggtggttgtgtcaacaaagagcccaaaatctgacaaacaatatgtttgggaaggggaagcagattccagttcttataccattagagaggaaaaggacccggagaagctcattcctagaggaacttgtcttactctctacctcaagcgtgacgacaagggttttgctcaccctgaaaggatccagaaacttgtaaagaactactctcagtttgtttccttcccaatttacatgtggcaagaaaagggcttcacaaaagaggttgaggttgatgaggatccagcagaaaccaaaaaagaaggcgatagtgaaacccaaacagagaaaaagaaaaagaccaagacagttgtggagaagtattgggattgggagcttacaaatgaaacacaacctatctggcttcgaaaccctaaagaggtttcaactgaggagtacaatgaatttttcaagaaaaccttcaatgagtacttggatcctttggcatcctcccacttcactacagagggtgaggtagaattcagatcaattctttttgttccggctacaaagaaggaagacataactgacaggaagaccaagaacatcaggctttatgttaagcgtgtattcatatcagatgactttgatggagaattgttcccaagatatttgagctttgtgaagggtgtcgttgactcaaatgaccttccattgaatgtctctcgtgagatccttcaagaaagtcgaattgtgcggataatgagaaagaggctagtgcggaaggcctttgatatgattcttggtatttcttgcagtgaaaacagagatgattatgaaaggttttgggagaattatggaaaaattttaaagcttggtgccatggaagacaaggaaaaccataagagaattgctcctttgttgcgattcttctcttctcagagcaatgatgaattaattagcttggatgaatatgtggagaacatgaaacctgagcagaaggacatttacttcattgctgcagacagtctgaacagtgcaaaaaatgctcctttcttagagaaactcactgagaaagagtatgaggttctacttttggttgaccctatggatgaagtggctatccagaatctgagctcctacaaggataagaaattcgtggacattagcaaggaagatttggacttaggcgataagaacgaggaaagagaaaaggagataaagcaggagttcagccaaacctgtgactggatcaagaaacgcttaggtggcaaggttgcacgtgttgacatatctaatcgtctcagttcatcaccatgtgttctcgttgcagccaagtttggctggtctgccaatatggagaggttgatgagggcacagtctatgggtgacacatcttctttggatttcatgcgatcgaggaaagtatttgagataaacccagatcacgagataattaagggcttgaacgttgcttgcagaaacaaccctgatgactctgaagctctaaaggttctggatgtcctatttgaaactgctatgatttcaagtggctttacgcctgacaactcggccgagctcagcgggaagatctacgagatgatgagctccgccattgccagcaaatggtccacacagtcgcaggtgcagcccgccagcccgtccccacagtatgatgccccggtggtcgagcccgagtccattgaagctgaggtggtcgagcctgagcccgtcgagtctggcaagcagaaataagaagaggtacctgcgtacctaggtgtcacgaacgtcggatgtcaaagccgagaatttttgagatcttgccccagcggcctgtacaacgagctttgtgattgctaatgtagtcgtgttggataggctttagaaaacaggaataagtagtgtttagaaaaccagaacagaaatttgaattttgatgggtttggccactacgtagattgtttttagaaattgcaagcctacttgtttcaaaaaaaaaaaaaaaaaaaa

SEQ ID NO: 6848 - protein, 802 aa, Panicum virgatum
  misc_feature: Ceres CLONE 1888647
  misc_feature (2)..(475): Pfam Name: HSP90 Pfam Description: Hsp90 protein
MLGASRRSLCAAAAARSRAAAGASAASAPPTRPVSNGAQGAPQQQKRLLSVLAAPKVTGTSNVASLKLMDGALVGRRYESSAAAVDSTDMPPAEKHEYQAEVNRLMDLIVHSLYSNKEVFLRELVSNASDALDKLRYLSVTDPELLKDGPELDIRIQTDKDNGIVMITDSGIGMTKQELVDSLGTIASSGTAKFLKALKESQEAGMDSNLIGQFGVGFYSAFLVADKVVVSTKSPKSDKQYVWEGEADSSSYTIREEKDPEKLIPRGTCLTLYLKRDDKGFAHPERIQKLVKNYSQFVSFPIYMWQEKGFTKEVEVDEDPAETKKEGDSETQTEKKKKTKTVVEKYWDWELTNETQPIWLRNPKEVSTEEYNEFFKKTFNEYLDPLASSHFTTEGEVEFRSILFVPATKKEDITDRKTKNIRLYVKRVFISDDFDGELFPRYLSFVKGVVDSNDLPLNVSREILQESRIVRIMRKRLVRKAFDMILGISCSENRDDYERFWENYGKILKLGAMEDKENHKRIAPLLRFFSSQSNDELISLDEYVENMKPEQKDIYFIAADSLNSAKNAPFLEKLTEKEYEVLLLVDPMDEVAIQNLSSYKDKKFVDISKEDLDLGDKNEEREKEIKQEFSQTCDWIKKRLGGKVARVDISNRLSSSPCVLVAAKFGWSANMERLMRAQSMGDTSSLDFMRSRKVFEINPDHEIIKGLNVACRNNPDDSEALKVLDVLFETAMISSGFTPDNSAELSGKIYEMMSSAIASKWSTQSQVQPASPSPQYDAPVVEPESIEAEVVEPEPVESGKQK

SEQ ID NO: 6849 - DNA, 1908 bp, Panicum virgatum
  misc_feature: Ceres CLONE 1888666
  misc_feature: Encodes the peptide sequence at SEQ ID NO. 6850
gttccggcttccgcttggcgatcgccgcgacccctttcttcccgaccgccgcgcgcgcctctccgaccacccgcctccttccccgccgcccgccggcacagtttcaatgaactaacgtcgcctctctccacccagtacccgcccgcatccccctgcccttctatcccggcttggatgcccatggagaccagcggcgcggcggccgccgccggcgaggtgggctggtacgtgctcggcccgaaccaggagagtgtgggcccctacgcgcttaccgagctgcgagaacattttgcaaacgggtatctcagcgagggaacaatgctctgggcagaagggaggactgaatggatgccactctcttccatccctgaggtacactctgctgtcacaacaaatgatcaacctgagcaagctgctccggatgccgaagatgattttgagaaatttcagaaagaggttgcggaagccgaggcagaggtagaggcattgaaaggcagtgctgaagatggtgatgagcggccagcaaccccgcctgatggagaggaggagtttactgatgatgatggcaccatttacaaatgggaccgcactctgagggcatgggttcctcaaaatgatgcatcaggtaaaaaggatgattatgctatggaagagatgacttttgcacttgaggaagaagtatttcaagcaccaggtatccctggtcctgctgctttagaagaaaacaacaccctggctgaaaacaaaaacaaagaatcagacaaagcagaaaagagaggggagaagaagcgaaaatcttctgaaaagccagctgaaaaaaaggaagcaaacaaacctccggagagttggtttgatctcaaagttaatacacatatctatgtgaatggattgcctgatgacgtcacagtggaggagatagtggaggtattttccaagtgtggaataataaaggaggatccagagactaaaaagcctcgagtgaaggtctatactgacaaggaaacaggcaggaaaaagggtgatgccttggtgacatatctcaaggagccatctgtagctttagcagttcagttgttggatgggacatcattccgacctggtggtaagactctgatgtctgtaagtccggccaaatttgagcagaaaggtgatgttttcattgcaaagaaaactgataaacaaaagaaaaggaaaaccaagaaggttgaagacaaaatgcttggatggggtgggcatgatgataagaagctgacgattcctactaccattattttgcggcacatgttcactcccgctgagttgagagctgatgacgagcttctttctgagcttgaggaagatgttaaagaggaatgtgccaagttcggtccagtggataatgtgaaggtttgtgaaaatcatccacagggtgtcatattggtgaaattcaaagaccggaaagatggcgccaattgcatagaaaagatgaatggcagatggtttggtgggcggcaaatccatgctagcgaagatgatggttccattaaccatactctgatccgtgattacgatgcagaggtgtcaaggctggatcgattcggagaagagttggaagagtccgcatagaggataactggcattgccttcttgtacgatataagatagcatggggataggaagttttgcgtttcacctcttccatattctttggcctttttatgtgcctggtggttaaccaacgaaaagaaatcatgtattcatgttagtgggtcacgtcgtttgttactggaacattagagatgcacaattttcagtgctaacatgtaacacccaaatgttgatgtgtcatgtaacactcagtagtaatcaacatgtaacattagagatgcacaattttcagtgctaacatgtaacacaggctaccaaccg

SEQ ID NO: 6850 - protein, 476 aa, Panicum virgatum
  misc_feature: Ceres CLONE 1888666
  misc_feature: Great-hit functional homolog of the protein sequence given in SEQ ID NO 9490
  misc_feature: Useful for making plants with altered terpenoid content
MPMETSGAAAAAGEVGWYVLGPNQESVGPYALTELREHFANGYLSEGTMLWAEGRTEWMPLSSIPEVHSAVTTNDQPEQAAPDAEDDFEKFQKEVAEAEAEVEALKGSAEDGDERPATPPDGEEEFTDDDGTIYKWDRTLRAWVPQNDASGKKDDYAMEEMTFALEEEVFQAPGIPGPAALEENNTLAENKNKESDKAEKRGEKKRKSSEKPAEKKEANKPPESWFDLKVNTHIYVNGLPDDVTVEEIVEVFSKCGIIKEDPETKKPRVKVYTDKETGRKKGDALVTYLKEPSVALAVQLLDGTSFRPGGKTLMSVSPAKFEQKGDVFIAKKTDKQKKRKTKKVEDKMLGWGGHDDKKLTIPTTIILRHMFTPAELRADDELLSELEEDVKEECAKFGPVDNVKVCENHPQGVILVKFKDRKDGANCIEKMNGRWFGGRQIHASEDDGSINHTLIRDYDAEVSRLDRFGEELEESA

SEQ ID NO: 6851 - DNA, 2204 bp, Panicum virgatum
  misc_feature: Ceres CLONE 1888709
  misc_feature: Encodes the peptide sequence at SEQ ID NO. 6852
atcgagcttatctctcccagcccccgcgtcgctctcttctcgggggcggcacgggaggcaccccaactctagccgccgccgccacccctccccaccctcacctcccctcgccgccgcctgagcagggcttcggaagccgtggacctgcaaggagggcggcggcggggttgtctcgctggctcggcctgcgtgccgagtggatctgagcgtgcggcgcgacggaggagtgggcgcggcgctccggcctggcttgtggcgcgcaaggggaggactagctcgaggtggaagggccggcttgcggcgcgggcgcggtggttgggaggcgccggcatggctgcgggcgccggcgtggttgcaggtgtcggcgtggaggagaagggcggagtgccggcctggtggcgttggatggggagcagcgcgcctgctcggcccgatgtcgcgcggccgtgagggcggcggcggagcggcgtggtggtgctcttcggcctcggggtgtggggcgccgcgcgagcctctggcggcggcggcaagtttggcaagcgcacggaaccaaacacggcctcagccactcatcaacatcactccaccaagctcattgaatgcctgctcccacctctttccaccaccacccaacagcagtcaatactaacgccaccactaccagtacctcctcgatcacttgacccccgttaaaaccacgcggtggtgagtgcgtgcctgcctctgacacgcccgcacactccacacccaccgcgcagcccactgccagctcctcagctcgcaaccgcagaggggaaccggccggcgttcgcgtacgcgtcgagagcgaggacgatgaagtcgagctccgccgtgcccgcggcgtcggcgtcggcggtgatgctgatgctgatggtgctctcggcggcggcggcgaccgcgaggggccaggcgctggtgcccggcgtgatgatcttcggcgactcggtggtggacgccggcaacaacaaccggctggccacgctggtgcgcgccgacttcccgccctacggccgcgacttcccggcgacgcacgcgcccacggggcgcttctgcaacggcaagctcgccacggactacaccgtggagaacctggggctgagctcgtacccgccggcgtacctgagcgaggaggcgcagagcaacaacaagagcctcctccacggcgccaacttcgcctccggcgccgccggctacctcgacgccaccgccgcgctctacggcgcgatctcgctgagccggcaggcggactacttccgggagtaccagtcgcgggtggcggcgtcggccggcgagcagcgcgccaaggcgctgacgtcggggtccatctacgtggtgagcgccggcaccagcgactacgtgcagaactactacgtgaacccggtgctgggcgccgcctacgcgcccgaccagttcgccgacgcgctcatgcagccattcacctccttcgtcgagcgcctgtacagcctgggcgcccgccggatcggcgtgacgtcgctgccgccgatggggtgcctcccggcgtccgtcaccctgttcggcggcggcaacccgggctgcgtggagcgcctcaacaacgactccctcaccttcaaccgcaagctcggcgccgccgcggacgccgtcaagcgccgccgcccggacctcaagctcgtcgtcttcgacatctaccagccgctgctcgacctcgtcaacaaccccaccagcgccgggttcttcgagtcgcggcgggcgtgctgcgggacgggaacgatcgagacgtcggtgctgtgccaccagggtgcccccgggacgtgctccaacgccacgggctacgtcttctgggacggcttccaccccacggacgccgccaaccgggtgctcgccgacgcgctgctgctccagggcctgcagctcatcgcctgatgagatgcgcggcagcctccgggcagaaaatacactccaattcccggcgccattccatcatcctaccagcaaatgtactaccttgcttttctgtcgttctgtgctgcttgcttgcttgctgtttgtttgcttgcttgtctttccatccatgatctctggtagttttgtgctgcttagaaacaactcgtgtataaaagtgtcgttctgtaaaattttgtgttcttcgccgttttcccaatttgttcgacaaacttggacttcaaaaaaaaaaaaaaaaaaaa

SEQ ID NO: 6852 - protein, 362 aa, Panicum virgatum
  misc_feature: Ceres CLONE 1888709
  misc_feature (1)..(318): Pfam Name: Lipase_GDSL Pfam Description: GDSL-like Lipase/Acylhydrolase
MKSSSAVPAASASAVMLMLMVLSAAAATARGQALVPGVMIFGDSVVDAGNNNRLATLVRADFPPYGRDFPATHAPTGRFCNGKLATDYTVENLGLSSYPPAYLSEEAQSNNKSLLHGANFASGAAGYLDATAALYGAISLSRQADYFREYQSRVAASAGEQRAKALTSGSIYVVSAGTSDYVQNYYVNPVLGAAYAPDQFADALMQPFTSFVERLYSLGARRIGVTSLPPMGCLPASVTLFGGGNPGCVERLNNDSLTFNRKLGAAADAVKRRRPDLKLVVFDIYQPLLDLVNNPTSAGFFESRRACCGTGTIETSVLCHQGAPGTCSNATGYVFWDGFHPTDAANRVLADALLLQGLQLIA

SEQ ID NO: 6853 - DNA, 1785 bp, Panicum virgatum
  misc_feature: Ceres CLONE 1888721
  misc_feature: Encodes the peptide sequence at SEQ ID NO. 6854
aagtgcttgctcccatcagtacacacacacacaccggccggccaggcagccaacacacagccctccgagatccctttcctttcctttcctccctgccttccttctccagcaagagctttctagctacaccgtcaaaaaaaaaaaggctttctagctagctagggtttacactacagtacttgtaccgagccaccgatcgatcaccgctccctgctctagagagaggtccttccttcgcaacgccgccgccagaattccggcgttcggcgttaggcgcgctcgctcgctcagctagctcatgggcggccggccatcccgtcagattcagccaaaggggccatggtgcaagctagttgagctgatctgagagggaggaagtgtggactcttggtcatgcttctcaagatgataagcggcaacctcacaaatgaagagctggcggccaggtgcaccaaggccgaggccccggccgcgggcgccggcgccgtcgtcgccaagagtcccgccgtgccgagctcgcggcactggccgccgtccacggagtcgcggatcgtgcgcgtgtcgcgggtgttcggcggcaaggaccggcacagcaaggtgaggaccgtcaaggggctgcgcgaccggcgcgtgcgcctgtccgtgccgacsgcgatccagctctacgatctccaggaccggctgggcctcagccagccgagcaagggggtcgactggctgcttgacgccgcgcagcacgagatcgacaagctgccgccgctccagttcccgccacaagcgcagggcctcgtcgcacacctgcccccctccatggtggcgccgttcgcgaacggcgcagccgaccgcgccgccgccgccgcgaacgcggcgacgggctcgtccgctgcgatggccgacggcgacaagcgccactgccacggcggcattaaaggactcatgggcttcaacaattcagtcggcctcgtcaatggcgcgatgccgctggctcacggattgtactacacgcccggcggtgaaccttgggcaaatggcaatgccgtccacgaccaggtgagccatggcacttcgcctcaaacggtggctcaccactcgccgttctcatcgctgctgtctctggctccggggcctcagctcgtcttctactcgccggaaggtggtggcttcgccatgaaagaagccgccgatcatcagttcctaggtaacctcgaccattcggaagggcagctctcactgagctcagcaagaagcttccttcaccccggcagccagggatgattaggtcactgatctctactactccaagaaggtacgtagaacaataatgcttggtgtagtagtagtcaggtacggtacatggctgaagcaggttcgttaagcttatgattgcagttttgagatggtattcgaatagggggctccagaactacgtagagctgctagcatgcatagtaattaagccttttttcagggcatgcaatgcaattcgttgcttcttttttacgcaaggaagtaactggtatggtgtgtgtgtgtgttggtttttgtaataacagtttggtaatttttgaatttattcgtacctagttttgtgttccggttaggacttttgcttcttattgagcaaatatgcttgttccatatcgatatgctgaagttcgttgtattatccttttcccacattccttatctttggggaaagtgtttcttctcttcctatttcccttttattgggactatctgttcttcagaaagttattgggattatttatagattatttaattgcc

SEQ ID NO: 6854 - protein, 293 aa, Panicum virgatum
  misc_feature: Ceres CLONE 1888721
  misc_feature: The sequence is a functional homolog of  SEQ ID NO 1406 in the  10/666,642 US patent application
  misc_feature: The sequence is a functional homolog of  SEQ ID NO 2378 in the  10/374,780 US patent application
  misc_feature: The sequence is a functional homolog of  SEQ ID NO 538 in the  10/225,066 US patent application
  misc_feature: Useful for making plants with modulated growth and phenotype characteristics
MLLKMISGNLTNEELAARCTKAEAPAAGAGAVVAKSPAVPSSRHWPPSTESRIVRVSRVFGGKDRHSKVRTVKGLRDRRVRLSVPTAIQLYDLQDRLGLSQPSKGVDWLLDAAQHEIDKLPPLQFPPQAQGLVAHLPPSMVAPFANGAADRAAAAANAATGSSAAMADGDKRHCHGGIKGLMGFNNSVGLVNGAMPLAHGLYYTPGGEPWANGNAVHDQVSHGTSPQTVAHHSPFSSLLSLAPGPQLVFYSPEGGGFAMKEAADHQFLGNLDHSEGQLSLSSARSFLHPGSQG

SEQ ID NO: 6855 - DNA, 1683 bp, Panicum virgatum
  misc_feature: Ceres CLONE 1888787
  misc_feature: Encodes the peptide sequence at SEQ ID NO. 6856
cgccgtcgtcctcactcctccctccccagctcggtcgcgttcccacctcgtcagatctcgcgcgccccgccgcgatgggctccgcgcactcgtcccactcttccgtctccaccgccggcggcgaagacgacgacgacgaggagccctccgccgcggctgccccctcctccgcgggcccgccggcgccgcggccgcccgcgccggcgccagtgcgcgtgcccccggcggcgtccgcgttgtccaaggtgctggagcaggagcccgaggtgctgccgtgcctcgccgcggactcgccgctctcgccgcagccgtctgcggcggggaccccgcgcctgctcgcgggccccggcattaaggtctgggacccgtgccacgtcctcctcccgcccccgcccgcggcgcacgcggggaggcacgccgacgccgcctcggcggtggaggtcgtggtggtcagccacggggagtgcgccgccgcgatgcgccccgacctcgtcggcggccggtggccggccgcggccctcacggcgcgcggggagcgccaggcgcgcgctctcgctgtcttcctgcgctcccgcggcgcgaggctcgccgcggcgttcgcgtccccgctcgaccgcgcccgcgccaccgcggcgctcatctgcagggaacttgatttcccagaggagcagattcaactatcagattctctgactgagatgagccaaggtcattgggagggctgcccaaagtcagaaatttatactccagaaatgatcaatctgatggagagctcccaacctgatttctcagcaccatctggtgagtccctcaggcaggtacagtttcggatgatggaattcctcaaccggaccatcctaaggctaccagaaaagatagcaatgggggacacactatcgcaacaaaatgagcccaaagggttctctcggcagagctccagcaattctgtccaagatggtcctccttgggatctgctgtacaggcttaaccgacatagcctccaaaaaaagaaatctgggaagagccgactccagtttgtcacttcaggggacaatgatcctgaggatgacttctcccctaaagatataaaccagaggcatctgcttcatgaaggaagtttagggagttctgtagccacctccattgcgattttcagccatgcaacccccattcgttgtctgattgcaggcctgctggattgcaatcctatgatgtcacagagaatatgtatagacgattcctcggttacagttcttgagcattcatcaagaacagggtggcaaataaaaaggcttaacgatactgcgcatctcagacttctctaggtgcaagatgccacgctgttcagtgagaacataactggcacgtgtatcagtgcaagaatttatcaaagacattctgcaaatcagatgctcatgccccttgctgcatgcatgtgctataccgccattagaagtgtagtctcatcactgtattgcatttgtatctattgtaatatctctattccaagaagaggggttggcctgtaatggtgttgtgctatatttgttgtaattcttttttataattatttatcaagtgtaatttccagctgaatctatccccatttttttggatgggtgattggtgcgggcatatttcaatgcattattctttttgggtcaaaaaaaaaaaaaaaaaaaa

SEQ ID NO: 6856 - protein, 416 aa, Panicum virgatum
  misc_feature: Ceres CLONE 1888787
  misc_feature (1)..(153): Pfam Name: PGAM Pfam Description: Phosphoglycerate mutase family
MGSAHSSHSSVSTAGGEDDDDEEPSAAAAPSSAGPPAPRPPAPAPVRVPPAASALSKVLEQEPEVLPCLAADSPLSPQPSAAGTPRLLAGPGIKVWDPCHVLLPPPPAAHAGRHADAASAVEVVVVSHGECAAAMRPDLVGGRWPAAALTARGERQARALAVFLRSRGARLAAAFASPLDRARATAALICRELDFPEEQIQLSDSLTEMSQGHWEGCPKSEIYTPEMINLMESSQPDFSAPSGESLRQVQFRMMEFLNRTILRLPEKIAMGDTLSQQNEPKGFSRQSSSNSVQDGPPWDLLYRLNRHSLQKKKSGKSRLQFVTSGDNDPEDDFSPKDINQRHLLHEGSLGSSVATSIAIFSHATPIRCLIAGLLDCNPMMSQRICIDDSSVTVLEHSSRTGWQIKRLNDTAHLRLL

SEQ ID NO: 6857 - DNA, 1834 bp, Panicum virgatum
  misc_feature: Ceres CLONE 1888814
  misc_feature: Encodes the peptide sequence at SEQ ID NO. 6858
gatcatccatcggggagcaagccgctcgctctccactcatagcaataacgtacagcaagcaatgggtcgtcgggaggtgctcggtggtggtgcgccgccggctaacaacgcgcaggcgttgggccgccgggtcgtcggccacctccatctcctcctcgccggcgcggcgctcatcatcgccgcggccccgcggctgtcggcggcgctcccggcccccgcgaacaggctgctggcgaacggcctcctgcgggagctggccgccctgggcgcgagcgcgccggcggtggcggtggcctgctgggcggcggcggtggcggcgtgggcgtacgccgtgtcgcgcccccggcccgtgtacctggtggagctgtccgggtacatcgccggcgaggcccacgaggcgtcccgcgccaagacgatcgcgcacttcgggcggtgcgggcggttcagcgaggcgagcatggcgttccagaagcggatgctggagcggtcggggctcggggagcggacccacttcccggcgtcgctgatcagcgtgcccgtggacatgtgcctccgcacggcgcgggaggagtcgcacgccgtcatctacggcgtggtggagggcgtgctccggcgggccggcgtcgccgcggcggaggtcggcgtgctcatcttcaactccagcctgctcagcaccacgccgtccttcacctcgctcatcgccaaccgctacggcatgaggcacgacgtcgtcgcccacaacctcagcggcatggggtgcagcgccggcatcatcgccatcgacctcgcaaagcgcctgctgcaggtgcacccggacacgtacgcgctggtggtgagcacggagaacatcaccctcaacgcctacatgggcaacaaccggccgatgctggtgaccaacacgctcttccgcgtcggcggcgccgccatcctcctctccaaccgccgcgccgaccgcgcccgggccaagtaccagctcatccacaccgtgcgcacccaccgcggcgcgcacgaccagagcttccgctgcgtgacgcaggaggaggacgacgccggctgcgtcggcgtctccctctccaaggagctcatgctcgtcgccggcgaggccctgcgcaccaacatcaccacgctggggcccctcgtcctccccatgtcggagcagctccgcttcctcgccaccgtcgtcctcaaccgcgtcttccgcgccaacgtccgcgcctacctccccgacttcaggctcgccttcgaccacttctgcatccacgccggcggccgcggcgtgctggacgagctcgagcgcagcctcaagctcagcgcctggcacatggagccgtcgcggatgacgctctgccgcttcggcaacacctccagcagctcgctctggtacgagctcgcctacagcgaggccaagggccggatccggaagggcgaccgggtgtggcagatcgccttcggctcagggttcaagtgcaacagcgccgtctggaaggcgctccggacggtggacggcggcgaggagggcaacccgtggacgccggagctcgacgtgctccccatccacgtgcccaaggtctcgcccgtcgacgagaccacctacaccttcccggacggggccacctacaaggtcgagcggggccctcaaggttaagtcgtaacaagagttactcgtatgttgaagcagcagctagctagctagctagcagcgccgtagtacgttattgccaggccttattacctatagtagggcctgatttggttactatttgccgtgatttgtaatgtataaggcttatgaagtatgaactcgcgatgaaattaaaaaaaaaaaaaaaaaaaa

SEQ ID NO: 6858 - protein, 527 aa, Panicum virgatum
  misc_feature: Ceres CLONE 1888814
  misc_feature (1)..(291): Pfam Name: FAE1_CUT1_RppA Pfam Description: FAE1/Type III polyketide synthase-like protein
  misc_feature (89)..(500): SWISSPROT Homolog: EC 2.3.1.- 3-ketoacyl-CoA synthase 1
  misc_feature (89)..(506): SWISSPROT Homolog: EC 2.3.1.- 3-ketoacyl-CoA synthase 11
MGRREVLGGGAPPANNAQALGRRVVGHLHLLLAGAALIIAAAPRLSAALPAPANRLLANGLLRELAALGASAPAVAVACWAAAVAAWAYAVSRPRPVYLVELSGYIAGEAHEASRAKTIAHFGRCGRFSEASMAFQKRMLERSGLGERTHFPASLISVPVDMCLRTAREESHAVIYGVVEGVLRRAGVAAAEVGVLIFNSSLLSTTPSFTSLIANRYGMRHDVVAHNLSGMGCSAGIIAIDLAKRLLQVHPDTYALVVSTENITLNAYMGNNRPMLVTNTLFRVGGAAILLSNRRADRARAKYQLIHTVRTHRGAHDQSFRCVTQEEDDAGCVGVSLSKELMLVAGEALRTNITTLGPLVLPMSEQLRFLATVVLNRVFRANVRAYLPDFRLAFDHFCIHAGGRGVLDELERSLKLSAWHMEPSRMTLCRFGNTSSSSLWYELAYSEAKGRIRKGDRVWQIAFGSGFKCNSAVWKALRTVDGGEEGNPWTPELDVLPIHVPKVSPVDETTYTFPDGATYKVERGPQG

SEQ ID NO: 6859 - DNA, 1929 bp, Panicum virgatum
  misc_feature: Ceres CLONE 1888836
  misc_feature: Encodes the peptide sequence at SEQ ID NO. 6860
tggaggcgcggcgcggggggtgctggctggcgcgtgatgggatctgggagcagcaaggccgccgccgcctcctcgtcgtcctcatcggcatcggaggcgggcggcgaggtgaagcggggaaatgggaccggcaaggggcggcgggcgaggagcctgctgccgctgccgagctccgcctgcttccgcggctccgcggcgccggcagaaggcggcgcttcttccgctgcccgaacgccgccggcgggcgaggctaacaagggaggggagaccacaagcctgccttcgctggttcactctgcaaagtctgacgaagatgctctcacggtgcctaaatctcgcccaggtgaagagacagtagcgccttcatcagataatgagagagaccaagatgatgatgcgctacagaatcctgctgccactagcacatctgaagctgcggccaatcaattgccaaatccttctgacaggccaaggccacgctttggtgccaacttcgggttgagtagggctgtcagcttgggatcatctgtagcttgctccattctgtcatctggcctatctgcttcagccaatccaggtgaaagccacggagaggtgaccagttcttctgatgcagttgtctcccaacaaggcggtgccctgactgctgggatcgattctactctggatatgcttagagatagtgtcacagcacaagctagagcagctcgtcaggctaggagaaatcagctagaatctgaagatgctagctttaggaactccaatagaaggattggatccgagcctttcgaaggcagtgttcgatttagccgaacgttgagtgttgggcggcttcgagacagagttctcaggaggactccgttctcagatgggctattcaccccttcacttctttatgatagggctgtgtggccgtcaggaaatggtagtgctaggcaggatttagcaacgatgcagaggactaattccgatagaagttcagaattgcgctctgatccttcagccaactacaattctagctctgagaccttgagagaggcaagtaatcgggatctactggagcgcagatcagcttttcttgaaaggaggagaaggatacgatctcaggtcagagctctccaaagattgggcagcaggtttgaaaatttatctggtcatgagaggtcctgcatactatctggtcaacatagaactggaaattgcaactgcagaacaagcggtcgaacaggtaatcctgatgaagaaactagcacgagggctagcatatcaagaattgttatgttagcagaagcactctttgaggttctggatgaaatccaccagcagtctgctgcattatcatcatcaagaccatcattttcttcaattggatctgttcctgctccaagggagatcgttgagtgtcttcctgtaaaggtttataggaagccattgaaacatcgaactgaggaggctgcacaatgctatatttgccttgttgaatacgaggagggagattgtgtccgtgtacttccatgtaatcatgaatttcatctaacatgtgtagataaatggctaaaagagattcacagggtctgtccactttgtcgtggtgatgtctgtagatccgacgtgtccaacatcggaaaagtcggctaattttttctcttaagaattcagcttcatccggagaaaaactggagctcctggcatggttctttgatccaatcccgacagaacctgcaaaaagtctcttgcaggcgttgttttcatttttttttcctcttatggtcagaacagctcaggacgctcctgtattctatggcaaattcgcatcgcagtcatcccattatgaaacagatgacatggcatgtgaattttggcattcttgtatggtggggggatgtttgttgatatttggattgtcggcaaaaaaaaaaaaaaaaaaaa

SEQ ID NO: 6860 - protein, 533 aa, Panicum virgatum
  misc_feature: Ceres CLONE 1888836
  misc_feature (1)..(42): Pfam Name: zf-C3HC4 Pfam Description: Zinc finger, C3HC4 type (RING finger)
MGSGSSKAAAASSSSSSASEAGGEVKRGNGTGKGRRARSLLPLPSSACFRGSAAPAEGGASSAARTPPAGEANKGGETTSLPSLVHSAKSDEDALTVPKSRPGEETVAPSSDNERDQDDDALQNPAATSTSEAAANQLPNPSDRPRPRFGANFGLSRAVSLGSSVACSILSSGLSASANPGESHGEVTSSSDAVVSQQGGALTAGIDSTLDMLRDSVTAQARAARQARRNQLESEDASFRNSNRRIGSEPFEGSVRFSRTLSVGRLRDRVLRRTPFSDGLFTPSLLYDRAVWPSGNGSARQDLATMQRTNSDRSSELRSDPSANYNSSSETLREASNRDLLERRSAFLERRRRIRSQVRALQRLGSRFENLSGHERSCILSGQHRTGNCNCRTSGRTGNPDEETSTRASISRIVMLAEALFEVLDEIHQQSAALSSSRPSFSSIGSVPAPREIVECLPVKVYRKPLKHRTEEAAQCYICLVEYEEGDCVRVLPCNHEFHLTCVDKWLKEIHRVCPLCRGDVCRSDVSNIGKVG

SEQ ID NO: 6861 - DNA, 2651 bp, Panicum virgatum
  misc_feature: Ceres CLONE 1888865
  misc_feature: Encodes the peptide sequence at SEQ ID NO. 6862
acctcgtccgcctcgttggctccgcaccgctgcatctctctagagacaaaggcaggccgcgtgctcccctgcgtagtccttcgagcaggtacgagcggcctcctcctccgtcttcttgattccgccatggcttctgcagcagtagaggggtggagattccggcggtttctgaatcttcttgtttctgtgctttatgagttatgagtatggttggtaatggcgtccgcttgctagtggccactatgctgaaaaattgggcgagcctttagtgttcagaactcgatgaccaacttctaggagttaggtctgcctcaaattcagatccccccactttgtttgtgtggattactgaagtggccaataatttgagcaatttgtccattttttccctcgactaacttgtgccaacaaaaaatgtttttttcttgaagaaatttgatgtctgtatttgagtcgttaaatcgtgtcccatttatattgtttctattctgatgcaaatccacgcctagtcacaatctctgaaatttcaaggcttcttgtgcacacttgctccgtttattgacatctaggactatcacactgaatcttcagtaacagtatcgttgtatgctcgcaggacaggaggcctctgattctctgagcttgtacaccatctgagcgacgccatgggagaggttgcagacatgtacacccaagacgggaccgtcgacatgaaggggaaccccgccgtgaagaagggcaccggcaactggcgcgcctgcccttacatcctcgcgaatgagtgctgcgagaggctggcgtactatggcatgagcaccaacctggtgaactacatgaagacccgcctcggccaggggaactctgtcgccgccaacaatgtcaccaactggagcggaacgtgctacatcacgccactcatcggcgcattcttggctgacgcctacatggggagatactggaccatcgcgagcttcatgatcatctacatcattggcctggcgctgctgacgatggcgtcgtcggtgaaggggctggtgccgtcgtgcgacagcagcgggacgtgccacccgacggagtcgcagtcggcggcagtgttcgtggcgctgtacctgatcgcgctgggcacgggcgggatcaagccctgcgtgtcatcctttggcgccgaccagttcgacgagaacgacgagcgggagcagaagagcaagagctccttcttcaactggttctacttctccatcaacatcggcgcgctggtggcgtcgacggtgctggtgtacgtgcagacgcacgtcggctggggctggggcttcggcatccccgccgtggtgatggccatcgccgtcgtcagcttcatcatcggcacgccgctgtaccggcaccagcgccccgggggcagcccgatcacgcgcatcgcgcaggtgctcgtcgcgtccgcgcgcaagtggagcgtggccgtgcccgccgacaaggcgcagctgcacgagacgctggacaaggagtccggcatcgagggcagccgcaagctagagcacacggaccagttcagctgcctcgacaaggcggccgtcgtgacggccaaggacggggcggcggtgagcccgtggcggctgtgcacggtgacgcaggtggaggagctcaagagcgtggtgcggctgctgcccatctgggcgaccgggatcgtgttcgcgacggtgtacgggcagatgagcaccatgttcgtgctgcagggcaacacgctggaccagcgcatgggccccaggttcagcatcccctcggcgacgttgtccatggtggacaccatcagcgtcatcatctgggtgcccatctacgaccgcgccatcgtgcccttcgtgcggtccgtgacggggcgcccgcgcgggttcacgcagctgcagcgcatgggcatcggcctcgtgatctccatcttctccatggtggcggcgggcgtgctcgacgtggtgcggctgcgcgccgtggcgcggcacggcctgtacggcgacaaggacacggtgcccatctccatcttctggcagatcccgcagtacttcatcatcgggtgcgcggaggtgttcaccttcgtggggcagctggagttcttctacgaccaggcgcccgacgccatgaggagcctgtgctcggcgctgtcgctcaccaccgtggcgctgggcaactacctgagcacggtgctggtgaccatcgtgacgcgcatcaccaccacgcacggcaggctcgggtggatcccggacaacctcaaccgcggccacctcgactacttcttctggctgctcgccgtgctcagcctcctcaacttcctcgtctacctggtcatcgccaagtggtacaagtacaagaagacggcggaatacccggacgccaaaggcggggagcacaactgatgaagcggtgcagggcagggctgcaggctgactgaacggacaaggcgaaaacgaagtgatttctctgtctgtgtggttggctctttcggtttgtttgtgagagttcgccgcgtgtttaaacgtagcagttcactgtaggtgacagggtcgaatgaattgtttagtatgtcatgtgtcagtaatacgcgcaatgcttgatcccaactatcagtatctataaaataagttcagctccaaaaaaaaaaaaaaaaaaaa

SEQ ID NO: 6862 - protein, 576 aa, Panicum virgatum
  misc_feature: Ceres CLONE 1888865
  misc_feature: Great-hit functional homolog of the protein sequence given in SEQ ID NO 9671
  misc_feature: Useful for making plants with altered carbon content
  misc_feature: Useful for making plants with altered nitrogen content
MGEVADMYTQDGTVDMKGNPAVKKGTGNWRACPYILANECCERLAYYGMSTNLVNYMKTRLGQGNSVAANNVTNWSGTCYITPLIGAFLADAYMGRYWTIASFMIIYIIGLALLTMASSVKGLVPSCDSSGTCHPTESQSAAVFVALYLIALGTGGIKPCVSSFGADQFDENDEREQKSKSSFFNWFYFSINIGALVASTVLVYVQTHVGWGWGFGIPAVVMAIAVVSFIIGTPLYRHQRPGGSPITRIAQVLVASARKWSVAVPADKAQLHETLDKESGIEGSRKLEHTDQFSCLDKAAVVTAKDGAAVSPWRLCTVTQVEELKSVVRLLPIWATGIVFATVYGQMSTMFVLQGNTLDQRMGPRFSIPSATLSMVDTISVIIWVPIYDRAIVPFVRSVTGRPRGFTQLQRMGIGLVISIFSMVAAGVLDVVRLRAVARHGLYGDKDTVPISIFWQIPQYFIIGCAEVFTFVGQLEFFYDQAPDAMRSLCSALSLTTVALGNYLSTVLVTIVTRITTTHGRLGWIPDNLNRGHLDYFFWLLAVLSLLNFLVYLVIAKWYKYKKTAEYPDAKGGEHN

SEQ ID NO: 6863 - DNA, 1963 bp, Panicum virgatum
  misc_feature: Ceres CLONE 1889016
  misc_feature: Encodes the peptide sequence at SEQ ID NO. 6864
tcctcagtccccaccccaacatttccaactttgaatccttcgattgattccagagcagagcgaaaccccctcgaggcgtccaaggttccgtttcaggagtgcgttgcggaggcaatggcgatggatccgcccctcaaaaggaagagggggagatcacctggcactcagtccgccaagagcaagatggagcagaagacggcattggtcaagcagaggcttgccttgcttgacagtgccagcagcagcagcagcagcagcagcagcagcagcagcgctgagattgacaaggatgatgactttgtgcccatggatgacgagctctctatccctatagaaattgattatggtgattcctacaatgaagatgaggttattcctttaaaagttttggcatcgaagggactggagagtgagaaaagaagtcttcctggccaaaatataagtgcaaactatggatctgcgatggacagagctgaggaggtacaggcaaagttgccagcagaacatcctagctttgtcaagcgtatgctacagtctcatgttgtccgtggtttttggctgggtctgccaacttacttttgcaacaaacatcttccaaaggaagacactggaattgtcctagaagatgaaaatggacaggaccaccagacgttgtatcttggtgcaaagcagggactcagtgctgggtggagaggttttgcaattaagcatgatattaaggttggcgatgttgtgatttttcagctcgtgggatcgacgaaatttaaggtatatataataagagcaaacaaatttacaacagctgatggagcaatcagtctgctgaatttggaagtgcacaagaaagggaagctatcaaaaaaaggatgtttcgaagatgacaaggctgagaaggctagcccagtcgacgacaaagttcctcagagtgatgagaataatgctgtagccagtgaagcaatagatggcctgaggatctcagattcagacatggactttggcgatgtcacaagcttcagcaacttcaacattgtggtcgacagcttggtcatcgactgcaagtttcatgatcatctgcgcaggagatactatgagctctgctgttcccagaagtccttccttcacaagaatctgctgaagcagctaaacctgacgcttgtcgtgggagtgatcatggagacgatcagcatcgcggagggtatccgagcctgcaaggcgcaggctccttcccgcgaggacttggtgacctggaagaagaccctggagtccttggagctgctgggcatgaacgtcgcgttcctggtgaaacgcgtcaacgatctcctcagcctcccagctgggccgagagacctctccgagtgccagaagtacaaggaactcaagtcggagagggcccatgctggggagaaactgaaagcgcttgagcttatgctgtcaaatgtgaagggcctgctacagaaaatgggcgcggagatggaggagatggagtcgagtgtgaagagaagcggtctgacactgcagcagttggccactgcaccatggtgatgttgccagttaccagaggcaaacattttgggtacatctttcagcagagtgtaaaggaagatgctttggatggagtagtgagaaaactggtgtctgcagaagatgggcgctgcatcatgcatgtctactgagggtgagtggtgagccttatgctagttaggagttagggctggcagtggcgaggccacattttgtgtgcaccttgagcaattgcatagtagtaggagctagtacatgtaggtgtgggtagcagtaacacacttcggtgtgtccagctagcggtaagtaactgggacgatactcttttggtggttaagtgactgtaatccccatgtaaccgtcgctgtaaatttctgggaccagaaatgaatcaaggagcgagctgaggatcgtttctgtgcaaaaaaaaaaaaaaaaaaaa

SEQ ID NO: 6864 - protein, 475 aa, Panicum virgatum
  misc_feature: Ceres CLONE 1889016
  misc_feature (1)..(91): Pfam Name: B3 Pfam Description: B3 DNA binding domain
MAMDPPLKRKRGRSPGTQSAKSKMEQKTALVKQRLALLDSASSSSSSSSSSSSAEIDKDDDFVPMDDELSIPIEIDYGDSYNEDEVIPLKVLASKGLESEKRSLPGQNISANYGSAMDRAEEVQAKLPAEHPSFVKRMLQSHVVRGFWLGLPTYFCNKHLPKEDTGIVLEDENGQDHQTLYLGAKQGLSAGWRGFAIKHDIKVGDVVIFQLVGSTKFKVYIIRANKFTTADGAISLLNLEVHKKGKLSKKGCFEDDKAEKASPVDDKVPQSDENNAVASEAIDGLRISDSDMDFGDVTSFSNFNIVVDSLVIDCKFHDHLRRRYYELCCSQKSFLHKNLLKQLNLTLVVGVIMETISIAEGIRACKAQAPSREDLVTWKKTLESLELLGMNVAFLVKRVNDLLSLPAGPRDLSECQKYKELKSERAHAGEKLKALELMLSNVKGLLQKMGAEMEEMESSVKRSGLTLQQLATAPW

SEQ ID NO: 6865 - DNA, 2643 bp, Panicum virgatum
  misc_feature: Ceres CLONE 1889119
  misc_feature: Encodes the peptide sequence at SEQ ID NO. 6866
gacaccacacacgactcgcacatacgtaggccggcaccgcacgcgctgcgccgccacaaagcgaaggcaggagcgagagatcaactcggcgccgctgcgcgcgcacacggccgccgctcgatcgatcaccagtacatggcgacgcaggagaaggcggcggcggggaggagggggagcccgatgctgcgggggcgcaagcgcgaggggtacacgcacgggctgcgcccgccgcagatggaggcgctccgggcgctgtgcggcgcgatcatcccgtccctgcccgtcgaggggctcctcgaccagcccggcggcggcggcgccgagcaggccggcctcgagcggttctaccgcgcatccgccgccgacggcgccatccccgacgaggtcgcggagatgaccacacgatgcgtatgggaggctatgttgttgatcagagttatcctctggatgctaagcaccaacgtgggcacattggcgctatgtggctggctttgcatctccggcaggttcccttatgtcagcaagttcgccgacatgccggtggagcggcgagagcaagtgctgaagcggtggagcaaggctcggtggctgttccccctcaaggtcgccttcgccatcatcaagatcctctcccactactcattctacacaatggtaaacgaggactccgacaacccttcctggaaagcaatcgggtacagcgtgccagacatcgacaggccacagcaaggccggacgggagacgcagcacggtcgccgtcgccgtcgccgcgcccactggacagcggcgtcgtggaggccagatccctgaccgacgcgacgctgctcgggtcactcgcgggcaaaggactggaggtgaaagcggacgcgtcgggggcgcaccacgcggtgcggtgcgacgtcgtcatcgtcggctcaggatgcgggggcggcgtggccgccgccgtgctcgccgcggcggggcacaaggtcgtcgtcgtcgagaagggggactacttcacagccggggattacagctccatcgagggcccctccatggagcgcctctacgagaagggaggcatcttctgcacgtccaacgcgtcgaccatcatgttcactggcgccacggtcggcggcggctccgcgatcaactggtcggcgagcatccgcacgcccaagtgggtcacgcaggagtgggctggcgagcacgggctccccctgttcgggaggccggagtacgcgcgcgccatggacgcggtctgcgcccggctcgcggtcaccggcgggtgcgtggaggaggggttccagaacaaggtgctccgcggcggctgcgaggcgctcgggctgcgcgccgacgccgtgccgcgcaactcgccggagggccatttctgcggcagctgccacctcggctgccccaccggcgagaagcgcggcaccgacacgacgtggctcgtcgacgcggtggcgcgcggcgccgtggtcctgacggggtgcgaggccgagcgcttcatcctcgagagtagcagcaaccccagcaagagcggccggagcaggaagtgcgtgggcgtggtggcgacgtgcctgggcgatggcatcaccaggaagctgcgcatcgaggccagggtttgcatcgcggcgtgcggcgcgctcatgacgccgcctctgctccgcagcagcgggctcaagaacaggcacatcggccgcaacctccacctccacccggtgtccatggcgtgggggtacttccccgagaacaagcaggagccgcggccgctcaccggcacgtgctacgagggcggcatcatcaccaccatgcaccgcgtcaccgcccgcaccatcgtgcaggcgccggcgctggggccggggtgcatggcgtcgctgatcccctgggagtcgggccgcgacatgaaggaccggatgcgccggtacgcgcgcaccgcgcacgccttcgcgctggtgcgcgaccgcggcgcggggaccgtcggcggcgagggccgcgtgcgctactcccccagcggcgaagacgcggacgagctccgaggcggcctgcgccgcgcgctgcgcatcctggtggcggccggcgccgccgaggtcggcacccaccgcagcgacgggctccggctgcggtgcggcggcctccgcgacgaggacctggaggcgttcctggacgaggtgaccgtcgcgagcgggcccctgctcccgggcccggacaagtgggcgctcctggcgtcggcgcaccagatgggcagctgccggatggggtccagcccccgggacggcgccgtggacggccgcggcgagagctgggaggccgaggggctgtacgtgtgcgacggcagcctgctgcccacggcggtgggcgtgaaccccatgatcaccatacagtccaccgcgtactgcgtctccaagggcatcgccgagtctctggcggcggcgcgtgtcaagaaaccgtagcctgcttgagtccgtgctggctcgtgctttgttgagactgtgtgctctgtgatctgtggatgtggcatcattcatatttgtaataacgcataataaatagataaaggaatcttaaaaaagtctattactccgtagcttgtactccgtatgtgtatccgatgcttctttattttatttttttaggacgaaaaaaaaaaaaaaaaaaaa

SEQ ID NO: 6866 - protein, 766 aa, Panicum virgatum
  misc_feature: Ceres CLONE 1889119
  misc_feature (1)..(235): Pfam Name: GMC_oxred_N Pfam Description: GMC oxidoreductase
  misc_feature (1)..(154): Pfam Name: GMC_oxred_C Pfam Description: GMC oxidoreductase
MATQEKAAAGRRGSPMLRGRKREGYTHGLRPPQMEALRALCGAIIPSLPVEGLLDQPGGGGAEQAGLERFYRASAADGAIPDEVAEMTTRCVWEAMLLIRVILWMLSTNVGTLALCGWLCISGRFPYVSKFADMPVERREQVLKRWSKARWLFPLKVAFAIIKILSHYSFYTMVNEDSDNPSWKAIGYSVPDIDRPQQGRTGDAARSPSPSPRPLDSGVVEARSLTDATLLGSLAGKGLEVKADASGAHHAVRCDVVIVGSGCGGGVAAAVLAAAGHKVVVVEKGDYFTAGDYSSIEGPSMERLYEKGGIFCTSNASTIMFTGATVGGGSAINWSASIRTPKWVTQEWAGEHGLPLFGRPEYARAMDAVCARLAVTGGCVEEGFQNKVLRGGCEALGLRADAVPRNSPEGHFCGSCHLGCPTGEKRGTDTTWLVDAVARGAVVLTGCEAERFILESSSNPSKSGRSRKCVGVVATCLGDGITRKLRIEARVCIAACGALMTPPLLRSSGLKNRHIGRNLHLHPVSMAWGYFPENKQEPRPLTGTCYEGGIITTMHRVTARTIVQAPALGPGCMASLIPWESGRDMKDRMRRYARTAHAFALVRDRGAGTVGGEGRVRYSPSGEDADELRGGLRRALRILVAAGAAEVGTHRSDGLRLRCGGLRDEDLEAFLDEVTVASGPLLPGPDKWALLASAHQMGSCRMGSSPRDGAVDGRGESWEAEGLYVCDGSLLPTAVGVNPMITIQSTAYCVSKGIAESLAAARVKKP

SEQ ID NO: 6867 - DNA, 952 bp, Panicum virgatum
  misc_feature: Ceres CLONE 1889294
  misc_feature: Encodes the peptide sequence at SEQ ID NO. 6868
atatagttcgccgcagctgtgcccgttctcggcccatgcacatggcgctagcgtcctgcaactcgctcccagccgacgccgcctgcttattcccggccatggcgtaccgccacccgtgcgacgccggcggcctagcagcatccgccttctacggcgccgctcgtagccccgcggcggctttactctcccagccccagctcgcgttcggtgctgcggctctcaccagcctggcgccgccgccgcagcccgacgccgtcttcgagcgcctgtcggaggaaggcgtctcgtcggttgtgcctggcacgacgacgttcgggaggccgccgccggagatgccggtcgagtacgccgtgccggacgcctcgggctatgctcatcatgccatgggtgcggccgccatggcgggggcagaagggtccacgaggacgacggacaggatcgcgttccgggtgaggtcgcaggaggaggtgctcgacgacggctacaaatggaggaagtacggcaagaagtctgtcaagaacagccccaatccgaggaactattaccggtgctcgacggagggctgcaacgtcaagaagagggtcgagcgagataaggacgacccgagctacgttgtgaccatgtacgagggggtgcacaaccatgtgagccccggcacgatctattacgccacccaggacgccgcctccggccgcttcttcgtcgccgggatgcatcaagcccttgattattaggcagagcgtgtgctagcgtaagatagactcacgcacactgactgtcttggtttagggtagacaagcctactactccacatggaaactaaggacctgcttggagaggaactaaagttgaatcctaaattttagcaatattagtactcacattgtcacaaatatgctaaaaggtttttagtcctggttaaagtttagtccaaaaaaaaaaaaaaaaaaaa

SEQ ID NO: 6868 - protein, 232 aa, Panicum virgatum
  misc_feature: Ceres CLONE 1889294
  misc_feature: The sequence is a functional homolog of  SEQ ID NO 136 in the  10/714,887 US patent application
  misc_feature: The sequence is a functional homolog of  SEQ ID NO 136 in the  11/435,388 US patent application
  misc_feature: The sequence is a functional homolog of  SEQ ID NO 138 in the  10/714,887 US patent application
  misc_feature: The sequence is a functional homolog of  SEQ ID NO 138 in the  11/435,388 US patent application
  misc_feature: The sequence is a functional homolog of  SEQ ID NO 140 in the  10/714,887 US patent application
  misc_feature: The sequence is a functional homolog of  SEQ ID NO 140 in the  11/435,388 US patent application
  misc_feature: The sequence is a functional homolog of  SEQ ID NO 142 in the  10/714,887 US patent application
  misc_feature: The sequence is a functional homolog of  SEQ ID NO 142 in the  11/435,388 US patent application
  misc_feature: The sequence is a functional homolog of  SEQ ID NO 154 in the  10/714,887 US patent application
  misc_feature: The sequence is a functional homolog of  SEQ ID NO 154 in the  11/435,388 US patent application
  misc_feature: The sequence is a functional homolog of  SEQ ID NO 156 in the  10/714,887 US patent application
  misc_feature: The sequence is a functional homolog of  SEQ ID NO 156 in the  11/435,388 US patent application
  misc_feature: The sequence is a functional homolog of  SEQ ID NO 158 in the  10/714,887 US patent application
  misc_feature: The sequence is a functional homolog of  SEQ ID NO 158 in the  11/435,388 US patent application
  misc_feature: The sequence is a functional homolog of  SEQ ID NO 1610 in the  10/412,699 US patent application
  misc_feature: The sequence is a functional homolog of  SEQ ID NO 208 in the  10/714,887 US patent application
  misc_feature: The sequence is a functional homolog of  SEQ ID NO 208 in the  11/435,388 US patent application
  misc_feature: The sequence is a functional homolog of  SEQ ID NO 970 in the  10/666,642 US patent application
  misc_feature: Useful for making plants with modulated growth and phenotype characteristics
MHMALASCNSLPADAACLFPAMAYRHPCDAGGLAASAFYGAARSPAAALLSQPQLAFGAAALTSLAPPPQPDAVFERLSEEGVSSVVPGTTTFGRPPPEMPVEYAVPDASGYAHHAMGAAAMAGAEGSTRTTDRIAFRVRSQEEVLDDGYKWRKYGKKSVKNSPNPRNYYRCSTEGCNVKKRVERDKDDPSYVVTMYEGVHNHVSPGTIYYATQDAASGRFFVAGMHQALDY

SEQ ID NO: 6869 - DNA, 650 bp, Panicum virgatum
  misc_feature: Ceres CLONE 1889414
  misc_feature: Encodes the peptide sequence at SEQ ID NO. 6870
ctgagcttcacaaaccacagcgagaagccttgtcagagctgtccatcgccacgacgacgaacaccgtacttggccgcgcacaccatgggcatcctgaaccacctctcccatctctgcagcttcacggagaccaaggaggccctcaagctccggaagaagcgcccgctcaacacggtgaacatcaaggtgaagatggactgcgaggggtgcgagcggcgggtgaagagcgccgtcaagtcgatgcgcggcgtgacgagcgtggcggtgaacccgaagcagggcaggtgcacggtgacggggtacgtggagccggccaacgtgctggcgcgggtgaagagcaccggaaagaacgcccagatgtggccgtacacgccctacaaggtcatcacctacccctacgtcggcggcgtctacgacaagaaggcccccgccggcttcgtccgcagcgcgccgcaggccatggccgaccccgccgcgcccgagatcaggatgatgaccatgttcagcgacgagaacgccaacgcgtgcgccgtcatgtgacccattgtgacggaatcgtcaagttaaacggcttaattaagcgtaactgttatcatttaaacgcatcaggcgtattagtttaattaagtataatctggcagcctgttttc

SEQ ID NO: 6870 - protein, 151 aa, Panicum virgatum
  misc_feature: Ceres CLONE 1889414
  misc_feature: Great-hit functional homolog of the protein sequence given in SEQ ID NO 9550
  misc_feature: Useful for biocontainment applications
  misc_feature: The plant produces a reduced number of seeds.
MGILNHLSHLCSFTETKEALKLRKKRPLNTVNIKVKMDCEGCERRVKSAVKSMRGVTSVAVNPKQGRCTVTGYVEPANVLARVKSTGKNAQMWPYTPYKVITYPYVGGVYDKKAPAGFVRSAPQAMADPAAPEIRMMTMFSDENANACAVM

SEQ ID NO: 6871 - DNA, 712 bp, Panicum virgatum
  misc_feature: Ceres CLONE 1889533
  misc_feature: Encodes the peptide sequence at SEQ ID NO. 6872
attagtagtagagaaagaagggcatcgggatggcctccggcacgcacgacaagtcgctgctgacggcgcggcggctgctggaggagacctccccggcggaggcggagcagctgcccagcctgccctcggggttctacgacgccttcgtcctcaagggaatccgcgtcgtccaggccctccagcccggcacccttctctgccacttcaccgtcccctccaggctactcaactcgggcggcttcctgcacggcggcgcaaccgcttccctcgtcgatctggttgcctccgccgccttcaccactgccggcctccgcaccaggggctcacccctcgagatgaacatctcctaccttgatgctgcttttgccgacgaagagattgatatcgaggcgaaggttctgcgtgctggcaaggcggtaggggtggccgtcgtggaactgaagaagaaatctggcaaactcattgctcaagcccgctattccaagtatctcggtgcagcatctagtaaactctgatctgactggatcaaggtggccttgcgccgtggcagcatgttgtgttctattgttgttattattctcatgatgttgcaatgccccctaagctaagcatatatggtaggtagtatggtgtggtgtgcttggcttatgtctatttgaccgaaaacagcttcatttctctctgcagcacggatggtattgttttgttgtat

SEQ ID NO: 6872 - protein, 161 aa, Panicum virgatum
  misc_feature: Ceres CLONE 1889533
  misc_feature (1)..(78): Pfam Name: 4HBT Pfam Description: Thioesterase superfamily
MASGTHDKSLLTARRLLEETSPAEAEQLPSLPSGFYDAFVLKGIRVVQALQPGTLLCHFTVPSRLLNSGGFLHGGATASLVDLVASAAFTTAGLRTRGSPLEMNISYLDAAFADEEIDIEAKVLRAGKAVGVAVVELKKKSGKLIAQARYSKYLGAASSKL

SEQ ID NO: 6873 - DNA, 805 bp, Panicum virgatum
  misc_feature: Ceres CLONE 1889574
  misc_feature: Encodes the peptide sequence at SEQ ID NO. 6874
ctccccggccgcctagctctctctccagaagctttagctataaatatttagcctagctcctccgcgccaggcagggtccggcgagctcgatctatcgatcgtcttcgttccagccacgcagcagctagctccggcgagcgatcggtgggcggccgggcaccatgcaggcggtgggcatccggcgggggctgaccatcgacccggcgggggaggaggaggcccccgcggcgcgcgtgggccgcctggtccgcgagagccccgtggtgatcttcgcgcgccgcggctgctacatggcgcacgtgatgaagcgcctgctggccgccgtgggcgcgcacgccaccgtcatcgagctggacgccggcgcggccgacgagctcgcggcggccgccgaggccggccgcggcgccgtcccggcgctcttcgtgggcggcgcgcccgtcggcgggctcgagggcctcatggacctccacctcagcggccgcctcgtgccgcgcctcagggaggtcggcgccctctgcgcctagcgtgcacctcgtcgcgtagggcgttccacttccaccatcaaggctgcgtcgtccatgtatgatgtgtacatacgcgcgacctctgcgattcggccaagcttcagggtgctggacgcaaaacacgcgcgaataagttgtagctgtagtgcttgtacaccaagggcggggggtgcttgtgagggaacagtgttacgggggggttttgtgagaaacggcaggacctaaatgtgattacttaggagtaacactactttctcttccaaaaaaaaaaaaaaaaaaaa

SEQ ID NO: 6874 - protein, 120 aa, Panicum virgatum
  misc_feature: Ceres CLONE 1889574
  misc_feature (1)..(59): Pfam Name: Glutaredoxin Pfam Description: Glutaredoxin
MQAVGIRRGLTIDPAGEEEAPAARVGRLVRESPVVIFARRGCYMAHVMKRLLAAVGAHATVIELDAGAADELAAAAEAGRGAVPALFVGGAPVGGLEGLMDLHLSGRLVPRLREVGALCA

SEQ ID NO: 6875 - DNA, 848 bp, Panicum virgatum
  misc_feature: Ceres CLONE 1889609
  misc_feature: Encodes the peptide sequence at SEQ ID NO. 6876
gaaacccgtgcgccactcgaccgctcatcatcaggaggcagcgatcgagaaactcgcagaccggccatggcaccgcaacgacgtggcgtcgtgccgatgctgccgccgcttcttctcctggtgctctctatgagctggtgttgcggcggcggcggctccgcggcgcggccagcaccttcgtcgtcgtcgccggactccgtgccgggcttcgtgaggtcgtggtgcgcggcgacggagtacccggcgctgtgcgacgcgacgctggcgccgtacgcggcggcggtcgggtccagcccggcgcgcctgtcgtgggcggcgctgacggtggcgctgggcggcgcgcgggcggcgacggccgcggtgaaggcgatggcggccgcgggccacctggcgcccttgggcgccgaggccgcgcgggactgcgtcagcatgctcgggcgcgccgaggacctgctgcggcagtccgcggatgccatggcgcggttcgggaaggagcggcagggcgggcaggccgcgagcagccgggacgtgcggttccaggtggacagcgtgcaggcgtgggcgagcgcggcgctgacggacgacgacatgtgcgtggaggggttctgggcggaggccgcgggcggcggcggcgcgagggaggccgtgcgcgggcacgtcgtcgacgtcacgcacctcacggtcaatgcgctcggcatcgttaacgccatggccaagcagatggcctaagggcaatcccaaccccaaaacactacttgcagtttctatacttgccatatcatatagatactacttatagaaattacatccccaatggatggtttctttaaaaaaaaaaaaaaaaaaaa

SEQ ID NO: 6876 - protein, 220 aa, Panicum virgatum
  misc_feature: Ceres CLONE 1889609
  misc_feature (2)..(174): Pfam Name: PMEI Pfam Description: Plant invertase/pectin methylesterase inhibitor
MAPQRRGVVPMLPPLLLLVLSMSWCCGGGGSAARPAPSSSSPDSVPGFVRSWCAATEYPALCDATLAPYAAAVGSSPARLSWAALTVALGGARAATAAVKAMAAAGHLAPLGAEAARDCVSMLGRAEDLLRQSADAMARFGKERQGGQAASSRDVRFQVDSVQAWASAALTDDDMCVEGFWAEAAGGGGAREAVRGHVVDVTHLTVNALGIVNAMAKQMA

SEQ ID NO: 6877 - DNA, 1683 bp, Panicum virgatum
  misc_feature: Ceres CLONE 1890056
  misc_feature: Encodes the peptide sequence at SEQ ID NO. 6878
tcttcctctccctctccatcagctcgcgcgcgagtagggcttccccgcaccagtcgcccctcgcgccgcacccaacttgcctccaacgcaaccagctgccacccgagctcatctccaaatcgccgcgcactcccctcccccaaatctctgcgcactcctcgatctcctccaaatctccgcgcaccttcctcttccaaaatcgacgcaccctcctgtccatcgaatcgcatccagactttctcatctatgcctctgatgccggcaccgccgggttgacgtccggctgtagcccctagcacggacgagacgagctgcagcaactccgccgctgtctcctgctgcataagtcgtccagcaccaatcgccgctttgctgcctccgcccaaatctcctgtggcctcgcctcacattatctttctccttgcggccactccgactgccgatgccgccgctttctacttctgcaagcccaccaccgaacacccaggtgagttgcgcatccactcccttttgcttacatctcactccaagatctttttttttttggttctcctcactgcatttttttgtgcttgtcttcggtttatttgtgcaagatcctgctgctgtgaacgagctcctgcctgctgctgctgtgaacgagctcctcctgatttcagtgatctgctgctgatgtgtactgtttggaggagagcaattagtttgagcaatataacgatctacaaaaaaatggaggcagcacaatagatcatattctatgccgccatatccatgtatgaggtaccatgtcaaggagttcaagaaagggtcacctcgccacgctcaagaattgttcaacaagtaccattcgaggctgcagatcatattctatgccgccatatccatgtatgaggtaccatgtcaaggagttcaagaaagggtcacctcgccacgctcaagaattgttcaacaagtaccattcgaggctgcgaaacgtgattgaacgtacttttgggtgcgcaaaaagtaagtggcaactcttgaatggcatacctcactacccgctaataaagcaatctcaacttgttatggctgcctgtgcactccacaactatgtgcatgagttggagggacgaaaacgtccagcgaggtacaggcaacgtggttttggtggcagtttgggtcaagtgcttgcaatggcgttaagcccggacgcgactacagaagaaatccgagattggattactctgggacttcctctccttgagaagaaatgaatggtttatgcaagggactgggaggacggagagtagggagttgctggatgaggaaggttgaaaatggcttttggattttgtttacgtgattgattagtaatgaagagggtggaagatggcttttggctggatgatgaatttgccttcttactgtgtgtactaattcaaattagttgtttagagaattaattaactcatgcattgggaatttatctaggagatggctgtacagaccttaaccattgggtacttagtggtaattattacttagaatggctgtggttgtaatgcaactgtttgtatgtgaagggacctttgatgggtcatgttgtttgagtctatttgaatctgaaatagaattctagttggtgccaaaaaaaaaaaaaaaaaaaaaaaaaaaaaaaaacaaaaaaaaaaaaaaaaaaaa

SEQ ID NO: 6878 - protein, 156 aa, Panicum virgatum
  misc_feature: Ceres CLONE 1890056
  misc_feature (92)..(167): Pfam Name: Transposase_11 Pfam Description: Transposase DDE domain
MSRSSRKGHLATLKNCSTSTIRGCRSYSMPPYPCMRYHVKEFKKGSPRHAQELFNKYHSRLRNVIERTFGCAKSKWQLLNGIPHYPLIKQSQLVMAACALHNYVHELEGRKRPARYRQRGFGGSLGQVLAMALSPDATTEEIRDWITLGLPLLEKK

SEQ ID NO: 6879 - DNA, 2036 bp, Panicum virgatum
  misc_feature: Ceres CLONE 1890218
  misc_feature: Encodes the peptide sequence at SEQ ID NO. 6880
ttttttcatcccataccatctccttaacaactacctttactttatgttattatgatataatataatgtgatacatgattaagccattcacaatatagtttcacttctaaatattatcttctcaagtgtcctgttatacattgtcttataaaaataaagtactttctgattataattatcatttggtctacaccagattttgttgtactacagaacagaaacaccttccaaaggttagtggcatggtgggctcatgaactttttccttttatcctcgggtatccaagaagtggcggagtagtgtgttttgacttttgagcctggatgttaataaggttcagcgctggataatggacaaatatttgatgcacaatccatccatatacgattcagaaggttcaaacgttttatgtgtttagaccaaatcactcatgacgtctccatgctgatatttggtacctgcatattatggctgttcctaagccctcagccactgtatatatattcaaaattatatatgcacgcataatgtgtacttaagctacatgcttctacaggcttaggacacattagcctttgacaatctgaataactgactattcactctgtttttatttaaatgtcctattaggcttgtcttaaattaaacatggcaagctttgatcaaacttagaaaaataataataacatttttaatgccaaatttgttttattggatctatcatgaagtataattgttgctatatttttctatagacctgtgtctcctgcctacccagtgtttctttgttttttttaagcaaagcccgctattgcttcgttgctcctgctatcatgctcattgccgacgccgcccggcgtttttgtggttctctttagcccttttggccctcttctctttcgtgggccgctcgctgggtcgtccgtgcctattcattatttcagcccgtttttgttgcagctgttgggactgtagaggaccgatgtggcgtagaagatgggactggtaggggagaagctggacatcgacttcgtcatctccaccggcgacaacatctatgacgacggcatcgccaacaccagcgacccactcttcaaggagtgcttcaccaacatctacaccgcccagagcctccagaagccttggtacatcgtccttggcaaccatgactataccggcaacgcgctggcgcagcaggaccctgccatccgcgaagtggacagccggtacctcgccattgccaaatccttcattgtcaactcagaaattgcggacttcttcctcatcgacacgtcgccgttctacctcaagtactggaatagcagcaagtacgattggagaaatgttgctcctcgcgacacctacatcgaaaccctcctcaaggacctggacaacgcgctgacgcaatccgaggcgccctggaagatcgtcgtcggccaccaccccatcagcagcggctgcgagcatgggaacaccaccgagctccagcagctgctccggcccatcctcgaggcgcgtggtgctgacatgtacgtgaacggccatgaccactgcctgcagcacatcagcagcaggaatagccctgtgcaatttatgacaagcggcggcgggtccaaggcatgggcaggcaagttcaagaccacctcggacaagatcgagttcatctacgacgggcaggggttcgtgtcgatgcagctgagcaagacggaggcgcaccttgtcttctacgacgttgccggcaacatcctgcacacctatgacagcaccaagactgaagatgatgagcactagatatacctagctggctagatcctagatggccttcaagctaggcaggcagcactgcagattggtaaatcatcagaggttgttaattaaatgtttgtctgaattgcgatgcagttcgtgtgtgtttggttgtgtctgtgataatataatgtgagatgtgtgtggtgtacagaagagagaattgtatcttctgtggaattaataagttaatcaaatgagaatttttacaaaaaaaaaaaaaaaaaaaa

SEQ ID NO: 6880 - protein, 264 aa, Panicum virgatum
  misc_feature: Ceres CLONE 1890218
  misc_feature (1)..(188): Pfam Name: Metallophos Pfam Description: Calcineurin-like phosphoesterase
MGLVGEKLDIDFVISTGDNIYDDGIANTSDPLFKECFTNIYTAQSLQKPWYIVLGNHDYTGNALAQQDPAIREVDSRYLAIAKSFIVNSEIADFFLIDTSPFYLKYWNSSKYDWRNVAPRDTYIETLLKDLDNALTQSEAPWKIVVGHHPISSGCEHGNTTELQQLLRPILEARGADMYVNGHDHCLQHISSRNSPVQFMTSGGGSKAWAGKFKTTSDKIEFIYDGQGFVSMQLSKTEAHLVFYDVAGNILHTYDSTKTEDDEH

SEQ ID NO: 6881 - DNA, 863 bp, Panicum virgatum
  misc_feature: Ceres CLONE 1890277
  misc_feature: Encodes the peptide sequence at SEQ ID NO. 6882
atcccttcgcaaaggccattcattcatacatagtagcagaacctaatacccttcagttttgctttcttgcttcacctgtgagctcagctcaccaaccatggaggatctagttagtagcccatctttcagtaggagcgtccttagctgtagcgaaggccaggctcaatcaggagagagctcttggaccgattacttcgtggatttcatgctatccgaagaggagaagaagagacaggagggtgctatttcctactgcgctgccgaagacgacggcgatggaagtagccgtggggaggagaacgaggaggattctatgatctccgacgccgcctctcgcgcccctgcgtccgcgctgttgcctgccaaatacaaggggttgaagaagctcaagaaggctttcaaggccctggatcatgatgaatccctggaagatactgcaagctccccagtgaatagcccaaaggtcagtgctgtgtcccagctggaattgagccctaaaaggagatgcaacatcagggacctcaccaaggaagcaggaataattggcgatgatcacggaagagaggggacggattgtacagatgcaggtgtggaaggagtgagatttggtgatcagagtcagacgagtatagctccatgtgcagagctcaaggacaaggggatttgcttgtttcccttgtccgtgctgctacactaccatggacgaacaaactgagagcgagctctcaatgtatgaacagcatatgaagtgttgaccctttacactctatgcatgtgtgggataaatggcgaaaaatacatttatgtagtgtggtgatactgtggatacgctcgtctttaatgagaaatatgtgaatattact

SEQ ID NO: 6882 - protein, 205 aa, Panicum virgatum
  misc_feature: Ceres CLONE 1890277
  misc_feature: Great-hit functional homolog of the protein sequence given in SEQ ID NO 9383
  misc_feature: Useful for biocontainment applications
  misc_feature: Useful for making plants with modulated biomass
  misc_feature: The plant is abnormally small.
  misc_feature: The plant produces a reduced number of seeds.
MEDLVSSPSFSRSVLSCSEGQAQSGESSWTDYFVDFMLSEEEKKRQEGAISYCAAEDDGDGSSRGEENEEDSMISDAASRAPASALLPAKYKGLKKLKKAFKALDHDESLEDTASSPVNSPKVSAVSQLELSPKRRCNIRDLTKEAGIIGDDHGREGTDCTDAGVEGVRFGDQSQTSIAPCAELKDKGICLFPLSVLLHYHGRTN

SEQ ID NO: 6883 - DNA, 1786 bp, Panicum virgatum
  misc_feature: Ceres CLONE 1890329
  misc_feature: Encodes the peptide sequence at SEQ ID NO. 6884
aggaaccggcactcattgaggaaccacacgcggagaaaggggggagaccaagaagaagcaagccatggagctcaatcaagcagacgaggtatgctattcctctggcacctaatcctccccccactgttcaagatgattcgagtctccaggcaccaaacatcctatcctaagcctgcctcgagaaattctgctaaaagacaggcatgctcctcgagaagaaaattacctgttgatgtgctgcctgcattgctgtctttgaacttggtaccaagtattcagctcggtggaaacatttctcctgcaaaaatgttttgatttgtcagcagaaaactgagtaatttagcttttgcagatgaataactaaattatctgatttttatccgaggaactaatctaacaattgatatgacaaatgacaaagccccagcctcccaaatagcagccttgttaggaatcacaaaggacctgttcactgaataaactcctgtcaacaagttctatcttattggactatgtttgagtttttgttttctttttctttatagaagttattaccggtaatttggaaacagggtatttgtctgttgagaagatccaaagatgcatagctcgccaatgtactgatatagggacactgtgttggccacatcactgtatgtccagtccctgcttagaaaacctcacgcataacttatgctatccaggttctatcttctccgcttgctccaaatgcaaaggacaatctcagcatgatgcactcaaagtttatcggctgcaagctctacatttctgaaagccgcaatcccacggctattgccgcaattgatcttgcagcgaagactgatcctcaggttgcggtgctaagcaagttcgaagatagtctctacaaccgcgtacgctacacacttgtctcctatatcattgatggcagctcaactggtgaagtgatatatagtccaatcaggaaggtattgttggcgatgatggaggctgcattttcagccataaacctcgaatcgcactccggtgctcatcctagaatgggtgtcaatgatgacctgtccttccaccccttgggtcaagccacaatggaggatgcagcttacttggctaagcaggtggcttcagacattggcaatgattttcaagtgccggtgttcctctatgcagcagcccatcccacaggcaagcctgtaggtgcaataaggcgtgagctcggctactaccggcccaatcacatgggcaaccagtggtcaggtaccatgctccctgatgttctgccaattaagcctgatgagggtccaaccaatgtttcttctgaaagaggggccacaacagttggcgcgacaccttttgttgaggcatacaatgtgccagtgctctcaaaggatgttgcaactgtgaggcggattactcgaagactaagcggacgcggtggagggcttccgactgtgcaagctcttgcgcttccccatggtgatgattgcacagagatcgcatgcttgttggatccagatcatgtcagtgcctatcaagttcagaccgtggttgagcagattgcagcagaagaagggctcgaagttgagaaggggtacttcactgacttaactaaggacaggatgcttgacaagtacttgaagataactgctgattgatatgaatgtaatagaactttgtgcgactgactaacccagatgaatcatgcatgtttataattgcaacttgcaagcatgctgctctttagtggtggctccagactgcatcagaaaaaaaaaaaaaaaaaaaa

SEQ ID NO: 6884 - protein, 301 aa, Panicum virgatum
  misc_feature: Ceres CLONE 1890329
  misc_feature (1)..(197): Pfam Name: FTCD_N Pfam Description: Formiminotransferase domain, N-terminal subdomain
MMHSKFIGCKLYISESRNPTAIAAIDLAAKTDPQVAVLSKFEDSLYNRVRYTLVSYIIDGSSTGEVIYSPIRKVLLAMMEAAFSAINLESHSGAHPRMGVNDDLSFHPLGQATMEDAAYLAKQVASDIGNDFQVPVFLYAAAHPTGKPVGAIRRELGYYRPNHMGNQWSGTMLPDVLPIKPDEGPTNVSSERGATTVGATPFVEAYNVPVLSKDVATVRRITRRLSGRGGGLPTVQALALPHGDDCTEIACLLDPDHVSAYQVQTVVEQIAAEEGLEVEKGYFTDLTKDRMLDKYLKITAD

SEQ ID NO: 6885 - DNA, 1695 bp, Panicum virgatum
  misc_feature: Ceres CLONE 1890337
  misc_feature: Encodes the peptide sequence at SEQ ID NO. 6886
tatctgactgctcgtgcacatgtcaagagatgagatgcatatgtctgtctccatggtgatggtgatcgcaccaagagagtcctggtgactgctgggtagctggtctccaatgcaattccttgtggcccatatctgcctggtggaggacggccaatatctgcctgccggccggcgacgagtcaaacaccaaaacgcagagcagcaggcagagatcaagtctacgggtggggtgcatggtggcccacccaccaacctctgaccccgacccggcgcgcctcctcccggctatctatatataagcagcagcggccggccacacggcgagaggagctagctagagaccaccggcaccaaggctagctgccttccgccaccagcccagcagccagcaagcaaaaggcaaggcaaagcatgtgggtgacgtcgatgccgcaggtgtgggacgaggagggcggcgccgacgcggtgaccccggcgccggccgcggccatgctgagctccctctcgggctggctctcccgcaccgtccagccgcagccgccggcgcccagggtgtgcggcaccgagggcggcccgcccgtgacggcgaccaggctccgcctccgcgaaggccgccacctggcctactgcgagaccggcgtgcccaaggacaaggcgcgcttcagggtcgtcttctcacacggcttcaccggatcacgcgaggacaccgtcagaccctcacaggaagtggccgaagagctgggcgtgtacatggtgggctttgatcgcgccgggtacgggcagagcgaccccaaccccaagcgctccgtgaagagcgcggcgctggacgtggaggagctcgccgacgcgctggggctcggccccaagttctacctgatcggcatgtcgctcggctgccatgccgtctggggcgccctcaagtacatccccgacaggatcgctggtgccgcgatgatggctccggtggtgaactactggtggccggggttcccggcggacctggccgcggaggtgtacgccaagcaggaggtgggcgaccagtgggcgctgcgcgtgtcgcaccacgccccgggcatcctccactggtggatggagcagagctggctgcccacgtcgacggtggttgccggcacgaccccgctccccaacaagctcgacgcggagatgcggagcaagatgatggcggacgggacgttccagcagaggaaggagcaggcgacgcagcagggcatccatgagtcctactaccgggacatgatggtcatgttcggcaagtgggagttcgacccgatgagcctgccccagccggcgtgccccgtgcacctgtggcagggcgacgaggacgggctcgtccccgtcgtgttgcagcggtacctggccagccgcctcagctgggtcaactaccatgagctccccggcaccgggcacttcctgtcgtcggtgcccggactgggcgacaccgtcctcaggacccttttcggctgatgcagatgcagcagcagcagcagtttcggaagaacacatggcaagtatggacgggtgctaattattattaaacctatactactccagtatagtagcgccgtggtgcattagtttcatttgttgtaaggccagttcgttggttgtcgctgattattacagcgacggtaatgatcatgaagatgatatatataaaaaaaaaaaaaaaaaaaa

SEQ ID NO: 6886 - protein, 357 aa, Panicum virgatum
  misc_feature: Ceres CLONE 1890337
  misc_feature (1)..(230): Pfam Name: Abhydrolase_1 Pfam Description: alpha/beta hydrolase fold
MWVTSMPQVWDEEGGADAVTPAPAAAMLSSLSGWLSRTVQPQPPAPRVCGTEGGPPVTATRLRLREGRHLAYCETGVPKDKARFRVVFSHGFTGSREDTVRPSQEVAEELGVYMVGFDRAGYGQSDPNPKRSVKSAALDVEELADALGLGPKFYLIGMSLGCHAVWGALKYIPDRIAGAAMMAPVVNYWWPGFPADLAAEVYAKQEVGDQWALRVSHHAPGILHWWMEQSWLPTSTVVAGTTPLPNKLDAEMRSKMMADGTFQQRKEQATQQGIHESYYRDMMVMFGKWEFDPMSLPQPACPVHLWQGDEDGLVPVVLQRYLASRLSWVNYHELPGTGHFLSSVPGLGDTVLRTLFG

SEQ ID NO: 6887 - DNA, 2093 bp, Panicum virgatum
  misc_feature: Ceres CLONE 1890384
  misc_feature: Encodes the peptide sequence at SEQ ID NO. 6888
gctggctggctagctactggtagagaaggcgaggaaggggagaagacgaagcgaagcgaagccgaagcaacgtcggtcggagaggagaggagaggagagagtggctagctagagagagaaacgcctctcgcgcgcgtacgtcacgtgagagcccgagagagggaggcagggagctctccgtgcgatccgaggtgctgccttcttgtacaggcgcggcttcttccggtggacgacgaccgacgacgacgaaggcggggctatagctgaggagaattgggcggcgcgcgggcagctggcgtccatggcgaggcggcgcggcgattgacgggcgacgattatgggcatccaagggaacaaggcggcgacgcacgagcacgacttcctctcgctgtacaccgccgccacagctagtaaggacgctcctctccagctccacgactccatgccacatcctccctctcaaggtggtaatttcttcctgaagacgcacaacttcctgcagcctctggagaagccgggagcgccgcctttgctgcccgccgccgcctccggcgccgaaagcaggcatcgccacccgcaggtgcccgccgccgccgccacctccaagcagcacgcgctgcccctgcccggcggcgtcggcacgttcagcatctgccccgcacccgtctcggtcgcgccgccggcgaccgccgccgtcgtcaaggcggagccgccgctcgtgctctggggccagcccgcggcggcgctccaccagccggccgcgcgagggcaccagcagcagtgggcgctccccttcgccggcgccgggcagcccaggccgcccccgccgccgcaggataggaaggggcgcggcggaagagccgcggtcatggagtccggctccagatccagcggcggcgcggggttcgacgacgacgacggcctcgccgcgcgccgcgaggtctcctcctcgctccaagagttgacagtaagggtggacaggaagggtggaagctgcagcgatggtggcacagatcagcggccaaacacaccacggtcaaaacactcagccacagagcagcgccgacgcagcaaaatcaatgataggtttcagatacttagggagctgttgccacacaatgatcaaaagagagataaagcaacatttctcttggaggttattgaatacatacggtttttgcaagagaaagtacaaaagtacgaggctacattcccagaatggaaccaagaaaatgcaaagatgcttccatggtcaaatatgtattttcgatcattctggaaaaattcgcagagtaaaggacaaatcccaggagattccctgcctgacccttcacatttcatgagaaatggatcctcacctggatctaatttcactgggaagctcgatgataatcacaacatggtgacatctgctgcatcaggggcacagaatcagactgaaaatgatcacatggctagcgtgtgctacagatcagctgaaactccggcaattattacaaataatgctttatctcagtcccaaccccaatggacagatccgtcccctgtggatgattgtgcagtgaacagtcaaatgcttaacaaccagcagttggcaatcgatgaaggaacaatcagtgtatccagtcaatattcccaagagttacttaattcgttgactcatgcccttcaaagctcaggtgtggatttgtcccaagccagcatctctgtgcagatcaacctgggcaagcgagcagtcaagagacctgctgctggtttaccctccaaggaaccaacggacccagcatctagcgacgaaatcggtcagcagctggcaatgttgggtggcggcgctgaagacctctctcatgcagcaaagcggcataaaccgggcaacagctgatgatggtccccgcctcgctcccggacccgattgatcattctttccttcccagccaaccagccaacgggaggctcttttggattggttgtacatttgtgctagctgtgaaaggctccgtgatgaacgaggcccccgctgcattctttcatttgatcgctcccgccgtcctctttagtccattgttcacttagaaaaaaaaaaaaaaaaaaaa

SEQ ID NO: 6888 - protein, 514 aa, Panicum virgatum
  misc_feature: Ceres CLONE 1890384
  misc_feature: Great-hit functional homolog of the protein sequence given in SEQ ID NO 9437
  misc_feature (1)..(51): Pfam Name: HLH Pfam Description: Helix-loop-helix DNA-binding domain
  misc_feature: Useful for making plants with altered terpenoid content
MGIQGNKAATHEHDFLSLYTAATASKDAPLQLHDSMPHPPSQGGNFFLKTHNFLQPLEKPGAPPLLPAAASGAESRHRHPQVPAAAATSKQHALPLPGGVGTFSICPAPVSVAPPATAAVVKAEPPLVLWGQPAAALHQPAARGHQQQWALPFAGAGQPRPPPPPQDRKGRGGRAAVMESGSRSSGGAGFDDDDGLAARREVSSSLQELTVRVDRKGGSCSDGGTDQRPNTPRSKHSATEQRRRSKINDRFQILRELLPHNDQKRDKATFLLEVIEYIRFLQEKVQKYEATFPEWNQENAKMLPWSNMYFRSFWKNSQSKGQIPGDSLPDPSHFMRNGSSPGSNFTGKLDDNHNMVTSAASGAQNQTENDHMASVCYRSAETPAIITNNALSQSQPQWTDPSPVDDCAVNSQMLNNQQLAIDEGTISVSSQYSQELLNSLTHALQSSGVDLSQASISVQINLGKRAVKRPAAGLPSKEPTDPASSDEIGQQLAMLGGGAEDLSHAAKRHKPGNS

SEQ ID NO: 6889 - DNA, 655 bp, Panicum virgatum
  misc_feature: Ceres CLONE 1890455
  misc_feature: Encodes the peptide sequence at SEQ ID NO. 6890
aacgaagtactcgagatagattcagagagtgcaggacagttgattccaggccaagaatcattccactttgcttgctgacagcctactacctagtaggatccgtggatccatggaggtggccggaggagatgtcggcgcgccgtccccgccgcggcgcgtggtggtggcggtggacgagagcgaggagagcatgcacgcgctctcctggtgcctctccaacgtcgtctccgccgccagggccgccgcagcgccgccccccggcgtgagggtggagacgtgcgtggagaagggcgacccgcgcgacgtgatctgcggcgcggcggagaaggccggcgccgacatggtggtgatgggcagccacggctacggcttcctgcagagggcgctgcgggggagcgtcagcagccactgcgtgcagaactgcaagtgccccgtcgtcgtcgtcaagaggggcccgccggcgagcaccaggcggcgccgcggatcgatctaggcggctctagaggccgtagccgtaagcgcacacgagcacgactcgcctcgcctcggccaaacgtgacggtgggcgcccgtgtgtacatacttcgcttttgttcggtgcctgtatctccctgagtataatgttttcagttcacacaaaatattgtaacgtgtc

SEQ ID NO: 6890 - protein, 127 aa, Panicum virgatum
  misc_feature: Ceres CLONE 1890455
  misc_feature (89)..(148): Pfam Name: Usp Pfam Description: Universal stress protein family
MEVAGGDVGAPSPPRRVVVAVDESEESMHALSWCLSNVVSAARAAAAPPPGVRVETCVEKGDPRDVICGAAEKAGADMVVMGSHGYGFLQRALRGSVSSHCVQNCKCPVVVVKRGPPASTRRRRGSI

SEQ ID NO: 6891 - DNA, 679 bp, Panicum virgatum
  misc_feature: Ceres CLONE 1890702
  misc_feature: Encodes the peptide sequence at SEQ ID NO. 6892
gtgatggcctccggctcgcacgacaagtcgttgttgacggcgcggcggctgctggaggagacctccccggcggaggcggagcagctgcccagcctgccctcgaggttctacgacgccttcgtcctcaagggaatccgcgtcgtccaggccctcccgcccggcaccctcctctgccacttcaccgtcccctccaggctactcaactcgggcggcttcctgcacggcggcgcaaccgcttccctcgtcgatctggttgcctccgccgccttcaccactgccggcctccgcaccaggggctcacccctcgagatgaacatctcctaccttgatgctgcttttgccgacgaagagattgatatcgaggcaaaggttctgcgtgctggtaaggcggtaggggtagctgtcgtggaactgaagaagaaatctggcaaaatcattgctcaagcccgctactccaagtatctcggtgcagcatctagtaaactctgatctgactggatcaaggtggccttgcgccgtggcagcatgttgtattctactactgtagttattctcatgatgatgcattgccccctgagcatatatagtatggtgtggtgtgcttggcttatgtctatgtgaccaaaaacagcttcatttctttctgcaacacggatggtactgttttgttgtgtacttc

SEQ ID NO: 6892 - protein, 161 aa, Panicum virgatum
  misc_feature: Ceres CLONE 1890702
  misc_feature (1)..(78): Pfam Name: 4HBT Pfam Description: Thioesterase superfamily
MASGSHDKSLLTARRLLEETSPAEAEQLPSLPSRFYDAFVLKGIRVVQALPPGTLLCHFTVPSRLLNSGGFLHGGATASLVDLVASAAFTTAGLRTRGSPLEMNISYLDAAFADEEIDIEAKVLRAGKAVGVAVVELKKKSGKIIAQARYSKYLGAASSKL

SEQ ID NO: 6893 - DNA, 709 bp, Panicum virgatum
  misc_feature: Ceres CLONE 1890779
  misc_feature: Encodes the peptide sequence at SEQ ID NO. 6894
atcccttttttcctcctgcaaagaggaatacgattcagctcaccccatctccaccaagaacaagatctgaagcagccaggccggagcacgagtcaactctgcagcagtcaagcaaggctctcccgctcgcacgcagccagcggtcaagccggtcagcagcagacatgagtaccatgaagttttgccgggaatgcaacaacatcctgtaccccaaggaggacagggagcagaaggtgctcctctacgcctgccggaactgcgaccaccaggaggttgcggacaacaactgcgtgtaccggaacgtggtgcaccacagcgccggcgagttcacccaggtgctccaggacgtcgccggcgaccccacgctgccccgcaccaaggacgtgcgctgcgccgtctgcggccacggcgaggccgtcttcttccaggccactgcgaggggtgaggaggggatgacgctcttcttcgtctgctgcaaccccagctgcggccaccgctggagggagtgaggagtgaggagctgataaacagagcaaaaggatccctctgctgcagtagccagaggggcatgatttttgaaatttccacccaagaaacctgcccatgttaccatgaactgattgtatctttcaagcacattaataacttcaggagggagataatcaagtgagccactgggataaatttccctgtggttctgttgcatcag

SEQ ID NO: 6894 - protein, 114 aa, Panicum virgatum
  misc_feature: Ceres CLONE 1890779
  misc_feature: Great-hit functional homolog of the protein sequence given in SEQ ID NO 9245
  misc_feature (1)..(55): Pfam Name: RNA_POL_M_15KD Pfam Description: RNA polymerases M/15 Kd subunit
  misc_feature (4)..(114): SWISSPROT Homolog: EC 2.7.7.6 DNA-directed RNA polymerase II subunit I
  misc_feature: Useful for making plants with altered Lignin content
MSTMKFCRECNNILYPKEDREQKVLLYACRNCDHQEVADNNCVYRNVVHHSAGEFTQVLQDVAGDPTLPRTKDVRCAVCGHGEAVFFQATARGEEGMTLFFVCCNPSCGHRWRE

SEQ ID NO: 6895 - DNA, 594 bp, Panicum virgatum
  misc_feature: Ceres CLONE 1890803
  misc_feature: Encodes the peptide sequence at SEQ ID NO. 6896
gtgcgcgactcgcgagccttctccgccgacctgacacctactgggcagcgcctcgccgccgcaggagacggggtcggcgcggcacgatgaggagcagcgaggccatggagctcctgggcttccctccctactcccggccgtccccttccgaggtaaaggctgcgtatagaagaatggtcatggagtctcatcccgatcgtgtcccaacgcatctgaaatctcaggccgagtcaaaattcaaggagataggcgaagcatattcttgtctgaaggatgcttttgcaggaagaagatcagggagtaggatggaagtacatgttatgcggtctggtgtcccaactggatgcggaagatcaaataaagcattggttaaagccccatttatacttataatgtttgcagcagtttcttttggtgcctttagcgcctcaagagcatatcaacggcaaaaggaactctgttcctctcagaatccctttctgccatagaggacgaccattgtgctgtgtccatattcataggcgagaagagtttcatgttatattgtacagatgtaaaacaacccaccctgaataaaagcacagtttggtgatt

SEQ ID NO: 6896 - protein, 133 aa, Panicum virgatum
  misc_feature: Ceres CLONE 1890803
  misc_feature (1)..(47): Pfam Name: DnaJ Pfam Description: DnaJ domain
MRSSEAMELLGFPPYSRPSPSEVKAAYRRMVMESHPDRVPTHLKSQAESKFKEIGEAYSCLKDAFAGRRSGSRMEVHVMRSGVPTGCGRSNKALVKAPFILIMFAAVSFGAFSASRAYQRQKELCSSQNPFLP

SEQ ID NO: 6897 - DNA, 2001 bp, Panicum virgatum
  misc_feature: Ceres CLONE 1890860
  misc_feature: Encodes the peptide sequence at SEQ ID NO. 6898
acacttgtcacgcccagcgtagcgcacgcgcaccccactcacgcaggcacgcacgcaaaacatacagcaggcgcccccgcgcacaagaaacaaacaaacaaaccaacggcgcctcctcttctccgggcgaggcggggcagaggcaggcgaaagcggaggaccgggagctgaagcggttacccaccctctccctctcccctccgactccgccgcgtcgactggcatcaaacaaaaaaaagcgatcgatgggtggtttcgtcgatcctttcatcccggcgccagcttggcctcaggacctcgtgttcaccggctcatcttggtcaggcagcgcttctgccccacttgcagattctgcagggacgtacatgggagcggcaccagatcaagacacagagttccacctccagaatggttcctctccggtgctcttgaacagcatcgcaaaagagatggtgtcgccggtggggctgcacgatcagttcttgcaagcgcagctgcaggacgacgtgacgcagggcctgaacttcgaaatggacggcgctctgatggccagcatgctgggctcggtcctgagcacgccctgtgccatatcgcttgccgacagtgccccggtggtgtgcagctccaacgacagcagtgggagcgagcagtctggcctggctcagttcatcctgggagaacagcctgtgccagtgtcggctgcatggccgtcaacattcacgcagatttcttcgttggttggggaagaaacatcagagggtttcggcttcggtgcgcttagcaacggtgatcttctgcgtgaggcctgcgctgcagatgtgaagaagtatccgcagttaggcaatgtgccatctgtaccactgcagctacataatgatgctgagttcaacactggaaagatgctctcttttgctcctggtcctaggcagcaaaatacaaactttgaggacctgcagatcagtcaaaaggaattcagcagtctgcatcacctgaacctctcctcgctggtttctgggcagctttcatcgtttaatactacaggagtggcgcataatcccaaacagtccaatgaagccagcagcggcaagaatgggctgaacgcggcacccctcatggctcgttcagaagtgccaaatggcagtgggattgctgggaataatggagctccgaagccgcgcgtcagagctcgccgaggccaggccactgatccacatagcattgcagagaggctccgaagggagaagatctctgacaggatgaaaaatttacaggagctcgttccaaactccaacaggactgacaaggcatccatgctcgatgaaattatcgactatgtcaaatttctccagttgcaagtcaaggttcttagcatgagcaggttgggcgcgacggaagccgtcgtcccgctcctgacagagtctcagactgagagctcctccgggggtctcctgtccccgagatcgggcaggcagcaggcgggcggcgggggcagcctgctcgggcagcccgagcaggaggtggtgcagctgatggagaacaacatgacgacggcgatgcagtacctgcagagcaagggcctgtgcctcatgcccatcgcgctggcgtcggcgatctcggaccagaaggggacgtcctcggcggcggtccggccggcgggcagcaccgccgcggaagagggcggcgccggcggggaggagcacggcgcgactgagatgctgcgcgggctgaacgcgttcgtcagtgcgagggagatgaggtccagagcctagggcggctgcagccctccgaggagcagcgaagccatccggagcttctgaggcctgtcatcagtctgtctgtcccgtgttctactggttctttttgcgacttgtagcctggagcgtgaaccttgcttacatgtgctgtctccttttttttcgtcatcacaagaacgtatgattaattatcctcccaaattcgaattaaaaaaaaaaaaaaaaacaaaaaaaaaaaaaaaaaaaa

SEQ ID NO: 6898 - protein, 507 aa, Panicum virgatum
  misc_feature: Ceres CLONE 1890860
  misc_feature (1)..(50): Pfam Name: HLH Pfam Description: Helix-loop-helix DNA-binding domain
MGGFVDPFIPAPAWPQDLVFTGSSWSGSASAPLADSAGTYMGAAPDQDTEFHLQNGSSPVLLNSIAKEMVSPVGLHDQFLQAQLQDDVTQGLNFEMDGALMASMLGSVLSTPCAISLADSAPVVCSSNDSSGSEQSGLAQFILGEQPVPVSAAWPSTFTQISSLVGEETSEGFGFGALSNGDLLREACAADVKKYPQLGNVPSVPLQLHNDAEFNTGKMLSFAPGPRQQNTNFEDLQISQKEFSSLHHLNLSSLVSGQLSSFNTTGVAHNPKQSNEASSGKNGLNAAPLMARSEVPNGSGIAGNNGAPKPRVRARRGQATDPHSIAERLRREKISDRMKNLQELVPNSNRTDKASMLDEIIDYVKFLQLQVKVLSMSRLGATEAVVPLLTESQTESSSGGLLSPRSGRQQAGGGGSLLGQPEQEVVQLMENNMTTAMQYLQSKGLCLMPIALASAISDQKGTSSAAVRPAGSTAAEEGGAGGEEHGATEMLRGLNAFVSAREMRSRA

SEQ ID NO: 6899 - DNA, 3091 bp, Panicum virgatum
  misc_feature: Ceres CLONE 1890866
  misc_feature: Encodes the peptide sequence at SEQ ID NO. 6900
gcagagttgcagaagcaaccccgtgcgacgagaaatctccatgcgtccaatttccctggaccgtggatgcgttgaatcatgcgtgagccgtgagccattacgtggcgtcgacaacccccactcggctgcccgccgccccatcgccgtcgaagagatccccgcctctgactttcttgtttcacgccgcatcgtcccgcacgggtggagaaactgaaacaccatcccaaccaatccggaacctgatattgtggccacctccagtttcaccagtacctaatccctggggcaataagaatcgctccttctaagttttctccgagtttaatctgatcgtgttggtcgggctcggaacttgagattgcggtttgaggagttgcgggagggagatggcgcagagcaaggaggagttcttggagcagttcggcggggactacggctacccggacgctcccaggggcatcgacgagctgcgcgccgccgatttcaagcggctggaagggatggtttacctggaccatgccggtgcgacactctactcagaggcacagatggcggatgttgccaaagaccttatgtcgaatgtctatggaaatcctcatagccagagcgattcaagcatggctacaagcgaccttgttacttctatgcggcatcaggttctaaaatacttcagtgcatctccaagggactataaatgtatttttacctccggggcaacagcagctctgaaacttgtcggtgaatgttttccatggagtagagatagctgctacatgtacacaatggaaaatcataatagtgtgcttgggataagagagtatgctctgagcaaaggagctactgtatcagcagttgatattgaagaggttgtcgatccatcaaataaccagggaagtgatagtttgtttaagatttcaaaacactcaaaccaaagaagaggcgacgatgtgcttttgcatactcatcagaatggaagcctgacagctatttcaggaagcaatttaaatctatttgcattcccttcagagtgcaatttctcaggacgcaagttcaacctcagcttggtcaagctcgtcaaggaagggaaatttattggtacatcacagcaacagggccgctggatggttttgattgatgctgcaaaaggatgtacaactgaaccaccaaacttaaccgtgtatccagctgattttgttgtctgttcattctacaagatatttggctatccaactggtcttggtgccttaattgtaaaaaatgaggctgctggtttactaaacaagacgtacttcagtggtggaacggtggctgcttcaattgctgacattgactttgttcagaaaagaaagagcattgaaaatgttcttgaggatggaacaatctcattcttgagcatatcctctcttcgatatgggtttaagataatcgatatgctaactatttcagctattgcaaggcatactgcatctcttgctacttatgtgagaaagaaaatgatggacttgaagcacagcaatgagaaaaatgtttgcataatctacggacaacaagcttctaaggtgaaagatctgaagatgggtcctacaatcacattcaatttgaaaagagaagatggcacctggtttggataccgcgaagtggagaagcttgcttccttgtcaggaattcatctgcgtacaggctgcttctgtaaccctggtgcatgtgctaagtaccttggcttgtcacactcagatctagtttctaattttgaggctgggcatgtttgctgggatgataatgacataataaatggaagaccaactggtgctgtgaggatgtcatttggctacatgtccacatatgaagatgcagaggaatttcttaagttcctgcagtcatcttttgtgtccaaagctgtaggattgaacaatggctacatggtgaatatggatactcttaatttagtagatgattggagccaacaagctatttcagatatccgcttaaaatccataactatatatcctgtgaaatcttgccaaggatttagtgtgcagagttggccactgacaactggtggtttaaaatatgatagagaatggcttctccaaggatcaggtggtgaaattttgacacagaaacaggtgccagagttgagttctatccgcacattgattgacctggaactagggaaactcttcttagagtcgccaaaacacaaggataaattgcaaatatctgttctagagaatttgactcatctaagagcagaaatagatgtttatatttatggtcaaaggtacgaggtgcaaacttacggcgacaaggtaaactcctggttcagtgatgctattggacgtccttgtacttttatgagatgctcaagctccaagtaccgttcctgcacaattaacggcaggagagatcgcctatgtagagatactcgaagcaaacttagttttgttaacgaaggacagctgctacttgtttccgaagagagcatatctgatctcaacagccggttaagttcaggtaatgtaaatggtaagcaacggatgtttgttgacgcaatgaggtttcgtccaaatatcgttgtctctgggtccgcatcatatgatgaggataactggaaaaggcttaacattggggaggcgtattttacttctatgggaggatgcaaccgttgtcaaatgatcaacctatatcagagctcagggcaggtgatcaagtcaaaagaaccactggcaactttagcatcatatagacgacaaaagggtaaaattttgtttggcatcctgctgaactatgaagacagtatggatgaagaagatgataccgttatagagagatggattaaagtagggcaagaggtatatccttctacataatgacgtgtacagagatcagcacaaaggtttctcaagcagaatggtataggctttcagaatgtatagactttcagatatactatgtatgtaataattttcatttttttttcatgcatgtaacacgtaagggcttgaagcctgtgttccgacaaaaaaaaagaagagaaaatgaatataatacaaaggaaaaatatgtatatcaaaaaaaaaaaaaaaaaaaa

SEQ ID NO: 6900 - protein, 827 aa, Panicum virgatum
  misc_feature: Ceres CLONE 1890866
  misc_feature: Great-hit functional homolog of the protein sequence given in SEQ ID NO 9189
  misc_feature (62)..(410): Pfam Name: Aminotran_5 Pfam Description: Aminotransferase class-V
  misc_feature: Useful for making plants with modulated drought sensitivity
MAQSKEEFLEQFGGDYGYPDAPRGIDELRAADFKRLEGMVYLDHAGATLYSEAQMADVAKDLMSNVYGNPHSQSDSSMATSDLVTSMRHQVLKYFSASPRDYKCIFTSGATAALKLVGECFPWSRDSCYMYTMENHNSVLGIREYALSKGATVSAVDIEEVVDPSNNQGSDSLFKISKHSNQRRGDDVLLHTHQNGSLTAISGSNLNLFAFPSECNFSGRKFNLSLVKLVKEGKFIGTSQQQGRWMVLIDAAKGCTTEPPNLTVYPADFVVCSFYKIFGYPTGLGALIVKNEAAGLLNKTYFSGGTVAASIADIDFVQKRKSIENVLEDGTISFLSISSLRYGFKIIDMLTISAIARHTASLATYVRKKMMDLKHSNEKNVCIIYGQQASKVKDLKMGPTITFNLKREDGTWFGYREVEKLASLSGIHLRTGCFCNPGACAKYLGLSHSDLVSNFEAGHVCWDDNDIINGRPTGAVRMSFGYMSTYEDAEEFLKFLQSSFVSKAVGLNNGYMVNMDTLNLVDDWSQQAISDIRLKSITIYPVKSCQGFSVQSWPLTTGGLKYDREWLLQGSGGEILTQKQVPELSSIRTLIDLELGKLFLESPKHKDKLQISVLENLTHLRAEIDVYIYGQRYEVQTYGDKVNSWFSDAIGRPCTFMRCSSSKYRSCTINGRRDRLCRDTRSKLSFVNEGQLLLVSEESISDLNSRLSSGNVNGKQRMFVDAMRFRPNIVVSGSASYDEDNWKRLNIGEAYFTSMGGCNRCQMINLYQSSGQVIKSKEPLATLASYRRQKGKILFGILLNYEDSMDEEDDTVIERWIKVGQEVYPST

SEQ ID NO: 6901 - DNA, 2194 bp, Panicum virgatum
  misc_feature: Ceres CLONE 1891131
  misc_feature: Encodes the peptide sequence at SEQ ID NO. 6902
aattcaagtcgcaatcttccccttcgggcctgcgactcttcttcggcgccccccgtccctccctctcccgcggaaagccacaaaccctagcgccgggttggcccgggaacgttgcaggctaactatgctttgatgaagcatgggttgttttgaagaagttacgcaggaaggtcctggaaccaatcagcacaatgatgagcgctccatatgcttgcatcccttttatgatctatcgcacgttcctccagccactttcatttatctcttaaaggactgctatacatacggtaccaacaaagcaacctcaaagtttaagatccttctgcagctggtaaaagtggcattgcataatgcgcctcagccagggccattcacatatgctatccagtgtatgtatattgtgccactgctggggaaaacttattctgaaggtttcagccatatgttgacatcttctttaaagcacttgaaatctgttgaatccgtacagaaagattttttggaggcaaagtaccttgctgcacaacttgttctcaatatccttgattctgttgtaccccatgagaaccgcatattggttaagcttcttgagacatttgaaattgagttgagagatatggctcatgctttgtatggttcagagttggatgatgatctagtgaaagcaaaagaacatctaagacagtatgtaaaatgctttatggaatcagaatccaatgcaatcgctgtagctctgataacacgattttctatccaatgctgtgatgagtcctttctcataaaattgattgaaagcaatcaattagatattgccgaggagtgtgctactttcatgggcaaggaaatgatatctttggtcatccaaaagtttctagatatgaaaatgctaaagagtgcgaacaagttggtgaaagaacatgaccttacagaagagttcccagatgttagctatttgtacaaagagagtttagtaaagaagttggctgagaaagggtgctgggatattgctgaagcccgggccaagaaggaaaaaaaacttgtggaatatctggtatatttggccatggaagctggttatatggagaaggttgatgagctttgccagcggtactcccttgaaggttatgtcaattctttggttccagagaaggtattttgcagatctgattacttagatctgaagaaattggatgtacaagaaattgtctgggtcgatgagatcaatgggcttcttaatgcaacaagttgtattgaagcttgtaaaattattggcatggattgtgagtggagaccaaattttgagaaaaatagcaaacctagtaaggtctcaatcatacaaattgcatcagataagatagccttcatctttgatctgattaagctgtatgaagatgacccaaaagtattggacagctgcttcaggcgaattatgtgttcatctaatatactaaaactgggtttcgacattcaatgtgatctccatcagctagctcaatcctatggtgaattggaatgtttccagtcctacgaaatgctgcttgatatgcagaagttgtttaaaggggttactggtggtctctctggattgtcaaaggaaatattaggagctggtttgaacaagacacgacgaaatagcaactgggagcaacggccactgagccaaaagcagaaagagtatgctgctcttgatgctgtggtccttgtgcacatattccatgaacacatccggaggcaaccacagtttggtgtatctgagggatgcaaagccgaatggaagtctcacgttgtttcccgagtaaacagcgcgcgtaggccattgcgtttctaggagtaggttaggcaaggtggctaagatgcagcaccttcttagataactttcagaggttaacaacaatttggttccgaaagaagtttaagctttgaagacggtacatgtagctgttattagtacttcactctgttgcccttgtatatagtacctccttgactgcttcagagtttttcctttcctgttgtgtctcattcaggctcagtacaatcattttggtgtttcgaattagtgatacggtacactgacacaatcatgtatgtattgtactgaagcctagggcgacaaagtcagacagttcttttcaccctctgaagaaatttgtttggcaggggcacacatggacaaaaaaaaaaaaaaaaaaaa

SEQ ID NO: 6902 - protein, 562 aa, Panicum virgatum
  misc_feature: Ceres CLONE 1891131
  misc_feature (1)..(179): Pfam Name: 3_5_exonuc Pfam Description: 3'-5' exonuclease
MGCFEEVTQEGPGTNQHNDERSICLHPFYDLSHVPPATFIYLLKDCYTYGTNKATSKFKILLQLVKVALHNAPQPGPFTYAIQCMYIVPLLGKTYSEGFSHMLTSSLKHLKSVESVQKDFLEAKYLAAQLVLNILDSVVPHENRILVKLLETFEIELRDMAHALYGSELDDDLVKAKEHLRQYVKCFMESESNAIAVALITRFSIQCCDESFLIKLIESNQLDIAEECATFMGKEMISLVIQKFLDMKMLKSANKLVKEHDLTEEFPDVSYLYKESLVKKLAEKGCWDIAEARAKKEKKLVEYLVYLAMEAGYMEKVDELCQRYSLEGYVNSLVPEKVFCRSDYLDLKKLDVQEIVWVDEINGLLNATSCIEACKIIGMDCEWRPNFEKNSKPSKVSIIQIASDKIAFIFDLIKLYEDDPKVLDSCFRRIMCSSNILKLGFDIQCDLHQLAQSYGELECFQSYEMLLDMQKLFKGVTGGLSGLSKEILGAGLNKTRRNSNWEQRPLSQKQKEYAALDAVVLVHIFHEHIRRQPQFGVSEGCKAEWKSHVVSRVNSARRPLRF

SEQ ID NO: 6903 - DNA, 2143 bp, Panicum virgatum
  misc_feature: Ceres CLONE 1891170
  misc_feature: Encodes the peptide sequence at SEQ ID NO. 6904
acagccccaatttgccgtcagacgtttctacccagccgccgctccctccctctcggtctcccccaattcgcgccgccgccgctccctccctctcgattccccccgcgcgctccctccctctcggttcctcgccgcctccgcagtaaccccgcccccaccgccgacgttcctccaccgccgcagttctcccgtcaccgcccctcctccaccagacgcgcctctgccgcatccaggacgacgcccttaaaacgactggtagctgctggccctgcggcgctggcggccgaaggagcctcgcgccgccgctggccgaaggagccccatccagcgtgcggcggccggcggccgcgaagtgcagactgcaggacttgtgaagtcctggcctggtgaatcctcctcgacggcagcagcacggcagcacgactacatcaatgcttgtggatctagaggccgtcatcctgcttctccacacgaagacacaatctcctgctggcacagagcgctctgctctcctcagtaatctcctttagatctaatggtggtgaggagaggggagactgcagctggatctgacgaagggtgctgccttttcgtcccatctgtgctgggattcgcctccaaccgctgccctcccttctgcctgcaggcatccctgtctcctcgaggttcagcagttgctgcatttaaatggattggattaactatgttgggaagcgtccacaggaacttctagtagccttcagaagttagtagatgaacagactatgtcaagaccttatacattgatggcactgtcttgtatacggaacttacatgttattgcaggatgtttggcctagaatggttttggagggtaatcttgtctctctagatgaaatagatgagatggtgagcccatcccttatcgatttattcccaaaaccaattcggcactcctcttatctcgccgcgccgccgctccatttccttcctccacccaaaaccttgaaaccctacccgcgggattcctgcgcgggctcgcctgcctagggtgggttcactccgcggtctccgctccggcccgcagccatggccgtggcggaagcgagtagcagcggcggcggcggcgaggaggggtacggggcgtggacccgcgagcaggagaaggcgttcgagaacgccatcgcgacgatggcggaggaggcggacggggacgcgcggtgggagaagatagcggaggccgtcgaggggaagacggcggacgaggtcaggcagcactacgagctgctcgtggaggacgtcgagggcatcgatgcgggccgcgtgcccctcccgacgtacgcggtcgacggcggcgccgaggaagggggcggcggcggcggcggcaagaaggggggcgggggaggaggggcccacggggagaaggggtcagccaagtcggccgagcaggagcgcaggaaggggatcgcctggacagaagacgagcacagattgttccttcttggtcttgaaaagtatggcaaaggtgactggcggagcatctctcggaactttgtgatctcaaggacaccgactcaagtagctagtcatgcacagaagtattttatccgtctgaactcaatgaatagagagaggcggcgatcaagtatacatgatatcactagtgtgaatggggacgcatcagctgctcaggggccaatcacaggtcaaacaaatggacaggctgcaaatcctggcaagccctctaagcaatctccacagccagcaaatacacccccaggtgtcgatgcttatggtaccacaattggacagccagttggtggcccccttgtctcagcagtggggactcctgttacgcttcctgttcaagctccacctcatatggcctatggcatgcatgccccggtcccaggagctgtagtacctggagccccagtaaacattgctctgatgccctatccaatgccacccccgtcatctcatgggtgagaaacatttcagagtgctgcatggcttctaaacaaatccataatctccctatgttgcttttagcggatgtgctaccatgttgcaataaagcaatatcaataaacttttgtgtacattccaaactgttgttacatgtagcactttgaggacattgtaaaaaaaaaaaaaaaaaaaa

SEQ ID NO: 6904 - protein, 299 aa, Panicum virgatum
  misc_feature: Ceres CLONE 1891170
  misc_feature (1)..(48): Pfam Name: Myb_DNA-binding Pfam Description: Myb-like DNA-binding domain
  misc_feature: The sequence is a functional homolog of  SEQ ID NO 36 in the  10/286,264 US patent application
  misc_feature: The sequence is a functional homolog of  SEQ ID NO 864 in the  10/412,699 US patent application
  misc_feature: Useful for making plants with modulated growth and phenotype characteristics
MAVAEASSSGGGGEEGYGAWTREQEKAFENAIATMAEEADGDARWEKIAEAVEGKTADEVRQHYELLVEDVEGIDAGRVPLPTYAVDGGAEEGGGGGGGKKGGGGGGAHGEKGSAKSAEQERRKGIAWTEDEHRLFLLGLEKYGKGDWRSISRNFVISRTPTQVASHAQKYFIRLNSMNRERRRSSIHDITSVNGDASAAQGPITGQTNGQAANPGKPSKQSPQPANTPPGVDAYGTTIGQPVGGPLVSAVGTPVTLPVQAPPHMAYGMHAPVPGAVVPGAPVNIALMPYPMPPPSSHG

SEQ ID NO: 6905 - DNA, 1688 bp, Panicum virgatum
  misc_feature: Ceres CLONE 1891177
  misc_feature: Encodes the peptide sequence at SEQ ID NO. 6906
acagtggggccacttccactccgcttccgaagttgactctctcctctcctcctccccgggctccggcggaagcaacaacaccacatctcgctggcaggttctccactggcctgctcaatctcctcttggaaacaccaggcgcgggtcgcggatcaggttggacttgtgattggtaatcagtaatcacgcgtattctttggcgatttgacttcaagacggcgaggaactcggctcccccgcgatggatctaccgagacgaggcggcgaccacacccgacgatggaggaccaataaccttgagcaacaagggataatggcctccgccaacaactgcgacgaggaggccgcgctgaaggcgttccacgaggcccgaggcggcgtccgcggcctggttgagtccggcgtcaccacagtgccgccattgttcctggcacccaccgcgccagtgtcctcgccggccaggaacttcgccatcccgtccgtcgacctctccctcccgcgctcggacgccgccgcgctcgtccgggccgccgcgcgctcgtgcggcatcttccacgtcaccaaccacggcgtcccagccggcaccgtcgactccgcgctcgccgtggtcagggccttcaacgagcagcccctcgcggcgcgctcgcgcttctacgggcccgccggaggcatcaactactacaccgtagccatcccgcggccgagggatggccgtcctgcaaccactccccgcctgtcatggtgcgacacgcttattgtcatgttcgaccagccaaaagatcctggcctcctcagcctccccgcagcatgccgggacgcgttgctggaataccatcggtcgctgtcgaggttggcgaaggagattgccggcctgctgttggaggggctcggggtcggcgccgaccggctggagcgggttgaaggggccctgatgcagtgtcactactacccgccgtgccctgagccggagcgggtgatgggcagccgtgagcacaccgacggagattttttcacggtgcttgcccaggacggggtcggcgggctacaggtgcggctcgacaacggcgagtgggtggacgtagcgccggtgcccggtgcgctgcttgtcaacatcgaggacgtgctaaaggtggtttcaaatgacgaatacaatagtgcagagcacagggtggtaagcaaatccaaacaagaggccagggtctccattgccctcttcttcaaccttgcagagtatggcgagtctggtctcttcagccctctgccggagctggtgacaggagaaaagcctgcacagtacaggagtttaagcttgggggagatgctgggtaacagagtcgaattggggcatgccaagccgtcgacacttgatcatttcaaggcaactttgagttgattgtcgagatttagcactacatcctgtcaatttgtcgagagaatatcctgacgattattagctctgttggctctagctacttgaccataacaatgcgttgttttctggggcaattttggcctgctcctatctgtagttgtaactgtgattttacactattatttcaactttgtttggcccctgcattttgaagctggaaattggatttgttgcctcttcccttgaacccacataaacagtatcaattcagctgtaaaattataagtgcattatcgaaaaaaaaaaaaaaaaaaaa

SEQ ID NO: 6906 - protein, 383 aa, Panicum virgatum
  misc_feature: Ceres CLONE 1891177
  misc_feature (1)..(108): Pfam Name: 2OG-FeII_Oxy Pfam Description: 2OG-Fe(II) oxygenase superfamily
MDLPRRGGDHTRRWRTNNLEQQGIMASANNCDEEAALKAFHEARGGVRGLVESGVTTVPPLFLAPTAPVSSPARNFAIPSVDLSLPRSDAAALVRAAARSCGIFHVTNHGVPAGTVDSALAVVRAFNEQPLAARSRFYGPAGGINYYTVAIPRPRDGRPATTPRLSWCDTLIVMFDQPKDPGLLSLPAACRDALLEYHRSLSRLAKEIAGLLLEGLGVGADRLERVEGALMQCHYYPPCPEPERVMGSREHTDGDFFTVLAQDGVGGLQVRLDNGEWVDVAPVPGALLVNIEDVLKVVSNDEYNSAEHRVVSKSKQEARVSIALFFNLAEYGESGLFSPLPELVTGEKPAQYRSLSLGEMLGNRVELGHAKPSTLDHFKATLS

SEQ ID NO: 6907 - DNA, 2032 bp, Panicum virgatum
  misc_feature: Ceres CLONE 1891276
  misc_feature: Encodes the peptide sequence at SEQ ID NO. 6908
aaaaatcaccaccaaactagtcttgtagccagtacttccattgctctcctcatctatcccttagcttcctgctcttcctctttcccctcttctcttgcagctgcgtgctctatccattagcagccggccggccagcagagatctccatcccagctagctcatcagcttgcttggcacttgcttgtgatcgattctctttctcttgtgttagttcttgccagagattaccatcagaattatatatcgagagagctgctagctgattgttgttggatctcttctcgctcgctcgctaggcggcctccaattagattaaattaagaaggccaggtattactagatcgatcgactagctagctatctaataagcagcagggcaggtggattatcatatcatatcatcgatgcttgaggtgtcgagccttcggagccctagcaaggtggatcatcagcgcgggttcgtcggcgaccatgtcgtgttcccgacgtccggcagcgtctgcgacgacttcatggtcgacgacaacctgctggactacatcgacttcagctgcgacgtgcccttcttcgacgccgacggggacatcctccccgacctcgaggtggacccgacggagctcctcgccgagttctcctccccggagacgagcccgacggaggcagacggctgtcgcgtggaggccaagccgccggacgacctacggcaagcagccgcagaggaagaagcagtgacgacatcgacgacagtagaagagaagaaagcagacgagatcatcaacaggaggatgttgctgggaaatgacgacgacaaattagcagccgcatcaggttcaggtgtgacgacgacgaggaagagcgtggatgctgaggggtcgagcgcggtgacaacggaggaggattccgccggcgccgggtcggacaccaagtcgtcgtcggcgtcggcggggggccactgcggcaagaagaaggcggcggacaagaagtcttccaacggcaagcggaaggtgaaggtggactggacgccggagttgcaccggcggttcgtgcaggcggtggagcagcttggcatcgacaaggctgtgccctcccggatcctggagatcatggggatcgactgcctcacacgccacaacatcgccagccacctccagaagtaccggtcccacaggaagcacctgatggcgcgggaggcggaggccgcgacctgggcgcagaagcgccaccacatgtacgcgccggcggcggcgggaggcccgtgggtggtgccgaccctcgggttcccgccgccgcctccgcctccgcccttgtgccggccgctgcacgtgtggggccacccgcccaccgcaggcgttgaggcagccgctcctcctccggcgatgctgcccgtgtgggcgcggcacctcgcgccgccccggccgtgggcgccgccggtggcctactggcacctgcagcagcatcagtacaacgcggccaggaagtggggtccacatcaggcggcagcagcagcagtgacgcccgccatggtgccgaggttcccggtgccgccgcacccgcacccggccaccatgtacagaccacccatggtcgtccctccgccgccgacgaccaccaccaccaagctcgccgacttgcagcttcagctcgacgcgcacccgtccaaggagagcatcgacgcggccattggagatgttttagtgaagccatggctgccgctgccgctggggctcaagcctccctccatggacagcgtcatgtcggagctgcacaagcaaggcataccaaaggtcccaccctccagcgcctgatctcatccatccatgcataggcaactactcgtcgacatgtattatattatattatattgtatagcctccagagctagagtagaagagggcgttgcgtgcgtgtgtgtaataaattaattaaataatgtaggtgtgcaagtgagtacaagaaacgggaccccgacttatatgtatatgttcatgtatatatgcaaactgattgatgacaaaaaaaaaaaaaaaaaaaa

SEQ ID NO: 6908 - protein, 466 aa, Panicum virgatum
  misc_feature: Ceres CLONE 1891276
  misc_feature (1)..(51): Pfam Name: Myb_DNA-binding Pfam Description: Myb-like DNA-binding domain
MLEVSSLRSPSKVDHQRGFVGDHVVFPTSGSVCDDFMVDDNLLDYIDFSCDVPFFDADGDILPDLEVDPTELLAEFSSPETSPTEADGCRVEAKPPDDLRQAAAEEEAVTTSTTVEEKKADEIINRRMLLGNDDDKLAAASGSGVTTTRKSVDAEGSSAVTTEEDSAGAGSDTKSSSASAGGHCGKKKAADKKSSNGKRKVKVDWTPELHRRFVQAVEQLGIDKAVPSRILEIMGIDCLTRHNIASHLQKYRSHRKHLMAREAEAATWAQKRHHMYAPAAAGGPWVVPTLGFPPPPPPPPLCRPLHVWGHPPTAGVEAAAPPPAMLPVWARHLAPPRPWAPPVAYWHLQQHQYNAARKWGPHQAAAAAVTPAMVPRFPVPPHPHPATMYRPPMVVPPPPTTTTTKLADLQLQLDAHPSKESIDAAIGDVLVKPWLPLPLGLKPPSMDSVMSELHKQGIPKVPPSSA

SEQ ID NO: 6909 - DNA, 1789 bp, Panicum virgatum
  misc_feature: Ceres CLONE 1891463
  misc_feature: Encodes the peptide sequence at SEQ ID NO. 6910
gggctccgtccgcccgcgtgccccgccgccgaggaaggcaggcttgggaggtccctagtgccgttcaaatttcgccaggccaggtccgtgcgtcgcatccacgcaaattccttggcggtggcggaaaggagcaggggcttgcaggcgaacgcggcggcgagcggggacgaaaccctagagccgagctccagcgccgcgctgctcgcggatcggtacccccccccccccctctccgttcccggcgatgaaccggcggcaggagctctgcaggaacttccagcgcggcagctgcaaatacggagcgcagtgcagattcgtgcacgcgtcctctcagcagcagcaacagcagcagcaggcgaagcccaacccgtttgggttcggctcggcgagcaggccgcagcagcagcagtcattcggttcgcagtttcagcagcagcagcagcagcaacagcagaagcccaaccctttcggattcggggtgcaaagtgggcagtcccgaaacgctcctggcccggctaagccatttcaaaataagtgggtaagggacccttcagctccaacgaagcaaccggaagcggcgcaggcaccagcagcagcccacacatcctgtacagatcctgagtcctgcagacaacagattgctgaggattttaagaatgaaactccactctggaagcttacatgttatgctcacctcagaagtggcccttgtgacatcaagggggatatcagcttcgaggagctgagagctaaagcatatgaggaaagccgacaagggcatcctctgcagtcaataatcgagggtgagaggaatctgcaaaatgcaaagttgatggagtttactaatttcctgaacaatccacgtgtatcagtatcacaaactccaagctttccaactgtggcttctttccctgaagtgaagaataactcgtcttttggggttcctcaaactaatggaccaccagtgtttagtagtttcagtcaagttggatcagcaaataactttggacctgggcccagaactgcaccaggagtcccaaccaatagtctctttggtcagtctagccaggcaagccatccagcatttgctgcacctacttttggccgttctgatatgaaatttggagtttcaggttcatttggaagtcagacatcacaactgccatctggtagtttgcaaggctcaagcatgtccagtgttggcaatttcccaaagcctcctgcaggctacccacagtctgcttcctctaaccatcacagagacattgataggcagtcacaagatttacttagtgggatcatagctcctacaagtgccataaaccaagctcctgttgaggagaataaaaatgaaaatcaggatgatagtatctggttgaaggaaaaatggtcaattggagagattccgttgggcgaaccgccacagaggcacatcagtcatgtgttttaggaattcaaggtattctgtattgcggagccgctatcaagtcagcttcattgaccgcttatatgctgtcaagatgccatccatcgtttttttttcctcatccaagcttcggatcggaattctacagcaaactggaggaggacagatgtacattaagggctgataggcagcgtaaagcctttgctgtgtctggcatcatatactctctattacagtgtttcattcccatggtcatgtgctctgtgaagtcttatctagacacctaggggctgagccgttttgtgttttcgaactgatgaaactagttctgattgctccgttcaaaaaaaaaaaaaaaaaaaa

SEQ ID NO: 6910 - protein, 401 aa, Panicum virgatum
  misc_feature: Ceres CLONE 1891463
  misc_feature (1)..(26): Pfam Name: zf-CCCH Pfam Description: Zinc finger C-x8-C-x5-C-x3-H type (and similar)
MNRRQELCRNFQRGSCKYGAQCRFVHASSQQQQQQQQAKPNPFGFGSASRPQQQQSFGSQFQQQQQQQQQKPNPFGFGVQSGQSRNAPGPAKPFQNKWVRDPSAPTKQPEAAQAPAAAHTSCTDPESCRQQIAEDFKNETPLWKLTCYAHLRSGPCDIKGDISFEELRAKAYEESRQGHPLQSIIEGERNLQNAKLMEFTNFLNNPRVSVSQTPSFPTVASFPEVKNNSSFGVPQTNGPPVFSSFSQVGSANNFGPGPRTAPGVPTNSLFGQSSQASHPAFAAPTFGRSDMKFGVSGSFGSQTSQLPSGSLQGSSMSSVGNFPKPPAGYPQSASSNHHRDIDRQSQDLLSGIIAPTSAINQAPVEENKNENQDDSIWLKEKWSIGEIPLGEPPQRHISHVF

SEQ ID NO: 6911 - DNA, 943 bp, Panicum virgatum
  misc_feature: Ceres CLONE 1891486
  misc_feature: Encodes the peptide sequence at SEQ ID NO. 6912
gtctccagctctctccagtctccacactcccccagcccaagtgccgagtgcccaacaactccaccaccgccgctccgcaccgcagatagcagcagccatggacacgaacgacacccgcgagcctgcctcgccggcctccgcgtcctcgacgtcgtcgtcgtcgtcgtctggcccgtcgtcctcccgggccccgaagaagcgggcgcgccaggacgggagccggcacccgacgtaccgcggcgtgcgcatgcggagctggggcaagtgggtgtccgagatcagggagccccgcaagaagtcgcgcatctggctgggcacgttcgccaccgcggagatggcggcgcgcgcgcacgacgtggccgcgctcgccatcaagggacgcgccgcgcacctcaacttcccggagcaggcgcacctgctcccgcgcccggccagcgcgtcccccaaggacgtgcaggccgccgccacgctagccgcggctaccgacttcccgccgccgtcctcctcccccggcgccggcggcgccaatgccaagagccccgagagcagctgctccgacggcgccagcgccgccgcctcgccgcctcacgaggcgcccccgcaggacgccgtgccggaccccgacgacgcgctgttcgacctcccggacctgctcctggacctgagatgctgcgggccgtcctcgtgggccgtcgacgacgacgtggccggcggggagccgctgctgtgggagtactgatgctgatcaatgccgcgagttcttggaagcagtcgctgccagtcatccgcacctccttccgcagtctacacgcatcgccgctatcgagtattagatcgatcggacacatgtaaatgccgccgctttcgttctctccgcttcgctttcttcttttactggtagcagcagcaacttctctctccagaaaaaaaaaaaaaaaaaaaa

SEQ ID NO: 6912 - protein, 213 aa, Panicum virgatum
  misc_feature: Ceres CLONE 1891486
  misc_feature (1)..(64): Pfam Name: AP2 Pfam Description: AP2 domain
  misc_feature: The sequence is a functional homolog of  SEQ ID NO 1234 in the  10/374,780 US patent application
  misc_feature: The sequence is a functional homolog of  SEQ ID NO 2602 in the  10/374,780 US patent application
  misc_feature: The sequence is a functional homolog of  SEQ ID NO 610 in the  11/435,388 US patent application
  misc_feature: The sequence is a functional homolog of  SEQ ID NO 628 in the  11/479,226 US patent application
  misc_feature: The sequence is a functional homolog of  SEQ ID NO 656 in the  11/435,388 US patent application
  misc_feature: The sequence is a functional homolog of  SEQ ID NO 68 in the  10/225,066 US patent application
  misc_feature: Useful for making plants with modulated growth and phenotype characteristics
MDTNDTREPASPASASSTSSSSSSGPSSSRAPKKRARQDGSRHPTYRGVRMRSWGKWVSEIREPRKKSRIWLGTFATAEMAARAHDVAALAIKGRAAHLNFPEQAHLLPRPASASPKDVQAAATLAAATDFPPPSSSPGAGGANAKSPESSCSDGASAAASPPHEAPPQDAVPDPDDALFDLPDLLLDLRCCGPSSWAVDDDVAGGEPLLWEY

SEQ ID NO: 6913 - DNA, 2515 bp, Panicum virgatum
  misc_feature: Ceres CLONE 1891627
  misc_feature: Encodes the peptide sequence at SEQ ID NO. 6914
aaccatcacgaatcgctccttccaccgttcgtcaagctcgcgaggctcccccaaaatccccagaaccctagcagagctcgagccccccccctcccccccactcgcgatggcgtcggagagcgagacgacggcggtgtccaccataacgagcgcgacggtcgacgacggtggcgcgcacgagagcaagcgggagctcggcaatggcgcggccaccacccccggcgtggggcaggaggacgacgaggagatgatagggccgggcccggcgccgacgaagcagcggcagaagcgcccgctccagttcgagcaggccttccttgacgccctcccctccgccgccatgtacgagaagagctatatgcaccgggacgtcgtcacccacgtcgccgtctctccggccgacttcttcatcactgggagcgcagatggtcacctcaagttttggaagaagaaacctgttgggattgaatttgctaaacattttcggtctcatctcagtcccatcgaaggcctagctgtgagcgttgatggattgctttgctgcacgatatccagcgatcgttctgtgaagatatatgatgttgtaaactatgacatgatgttcatgatgcgtctcccatttgttcctggggctattgagtgggttcatcgagagggggatgtcaaaccaaaacttgctgtcagtgaccgaaatacaccttttgttcacatatatgatactcattctggttcaaacgatccaatcatctccaaagagattcatgctggtcctgttaaagtaatgaaatataaccatgtgcatgatgttgtgatatctgctgatgccagaggactgttagactactggtctccatctaccctcaactttccagatcaagaagtgaggtttcgtctgaaaacagatacaaatttatttgaaattgtaaaatgcaagacaagtgtgtctgctatcgaggtgagcaatgatggcagtcaatttgctgtcacatcccctgatcgcaggatacgggtgttttggtttaaatctggaaaactaagacgtgtatatgatgagtctctagaggtggcacaagatcttcaaagaagtgatgttccattgtatcaccttgaggctattgattttgggcgccgaatggctgtggagaaggaaatagagaaaacagaaaatgttccacaacctaatgctgtctttgatgaaagctgcaactttcttatttatgctactcttttgggcataaagattgtaaatttgcacacaaataaggtttcacgcatcctggggaaggtagagaacaatgagaggtttctgagaaccactctataccaaggcgacaaaggcaacaagaaggttagaaaaattccttcagtagctgccaatgtcaatgatagcaaagaacctttatcagacccaacactgctatgctgcgctttcaagaagcatcgaatatatctctttagtcgtagggaacctgaggaacctgaagatgcaactaagggtagagatgtattcaatgaaaaaccaccaccagaagagcttttggctgtatcagatttaggaaaaacggctacaacatcattgcccgataatttggtgctgcatacttctatgggggacattcacttgagactatatccagaagagtgtccaaaaactgtggaaaacttcactacccattgccggaacggttattatgacaatcttatatttcatcgtgtaattaaaggattcatgattcagactggggatcctttgggggatggcactggtgggcaatccatctggggcagtgaattcgaagatgaatttcacaaaagcttgagacatgacaggccttttacactttctatggccaatgcgggacctaataccaatggttctcaattcttcatcaccactgtggccactccatggctagataataagcacacggtgtttggtagagttgtgaaagggatggatgttgtccagcaaattgagaaggtcaagactgacaagaatgacaaaccatatcacgatgtaaagatcttaaatgttacagttcccaagacataagcttctgctgaccagcagggttggccggttgggacattgcgcctgcacttcctttgttccttggttggccattgctgacctgctgaagacaacacgttgtacaagaagttatgcatgctttggggaagtgagcacggcctcctccactgaagactttgtcttattgggaccatgcaattttcaggatggatggtatctcattgtactcagtatggctttgagtccagaatcatggagctgagtgtttgtatctttgtaacgtggaattaatcttgcagggttaaattggggggacaatccttctggtcttagctgtttaattcatggtaattgtatgtggaagatgtgtccagctgtccaatgtataatcatattcctttaagagttgctgggacgtttttgtatggttgtgctttatacaaaattcagcgatgttttggccaaaaaaaaaaaaaaaaaaaa

SEQ ID NO: 6914 - protein, 648 aa, Panicum virgatum
  misc_feature: Ceres CLONE 1891627
  misc_feature (1)..(153): Pfam Name: Pro_isomerase Pfam Description: Cyclophilin type peptidyl- prolyl cis-trans isomerase/CLD
  misc_feature (26)..(645): SWISSPROT Homolog: EC 5.2.1.8 Peptidylprolyl isomerase domain and WD repeat-containing protein 1
  misc_feature (42)..(645): SWISSPROT Homolog: EC 5.2.1.8 Peptidylprolyl isomerase domain and WD repeat-containing protein 1
MASESETTAVSTITSATVDDGGAHESKRELGNGAATTPGVGQEDDEEMIGPGPAPTKQRQKRPLQFEQAFLDALPSAAMYEKSYMHRDVVTHVAVSPADFFITGSADGHLKFWKKKPVGIEFAKHFRSHLSPIEGLAVSVDGLLCCTISSDRSVKIYDVVNYDMMFMMRLPFVPGAIEWVHREGDVKPKLAVSDRNTPFVHIYDTHSGSNDPIISKEIHAGPVKVMKYNHVHDVVISADARGLLDYWSPSTLNFPDQEVRFRLKTDTNLFEIVKCKTSVSAIEVSNDGSQFAVTSPDRRIRVFWFKSGKLRRVYDESLEVAQDLQRSDVPLYHLEAIDFGRRMAVEKEIEKTENVPQPNAVFDESCNFLIYATLLGIKIVNLHTNKVSRILGKVENNERFLRTTLYQGDKGNKKVRKIPSVAANVNDSKEPLSDPTLLCCAFKKHRIYLFSRREPEEPEDATKGRDVFNEKPPPEELLAVSDLGKTATTSLPDNLVLHTSMGDIHLRLYPEECPKTVENFTTHCRNGYYDNLIFHRVIKGFMIQTGDPLGDGTGGQSIWGSEFEDEFHKSLRHDRPFTLSMANAGPNTNGSQFFITTVATPWLDNKHTVFGRVVKGMDVVQQIEKVKTDKNDKPYHDVKILNVTVPKT

SEQ ID NO: 6915 - DNA, 1585 bp, Panicum virgatum
  misc_feature: Ceres CLONE 1891703
  misc_feature: Encodes the peptide sequence at SEQ ID NO. 6916
aaaacctcgtaaatgccacgtctccctgctcaggtgcctaatcagaagaggttgcttcgccttgtttcccccgtccggcggcggttcctctgactggatcgatcagaatcaccggcggcggttccccggcgagggcgaggggaggaggcggcggcgggatggaggtgccgtggctgctggtggcccacgggttggtgacggcgctggtggtggtgtcgttcctgtgcgggcagtggcccatcttcgagggcaccttcgtccagagcatcaaccacttcctcaccttcggcgcttaccactacctcctacggttcgtgcaggcggtgtgcggcaacggggccagggatctcgtcctcggcgtcgagcagtactgctgcgaccggcccaacccgatcctgcaggtgttttatgttgccataattggggtcacatattttatatttgtgcagacatctttcaagtatattcctgggtattatgttagtggatggcacagatatttgagcatcgttgctgttgctgttggtgctatactcttcgtgctcactagcttttctgatcctgggaccgttactgctgagaatgtctctcaatatgtatctgcctacccatatgacaacattatctttgtggagaaagaatgctctagttgcaagattcctagaccagccagggcaaagcactgcagaatatgtgataaatgtgttgctcgatttgatcaccattgtggatggatgaataattgcattggggagaaaaatactcgctattttgtggcctttttggtttggcattttcttctatgtgtgtatggcacagtagtcctttgcttcattcttgctggtgaaataaaagagaggaaagtcatctacattctcacagcttattatggtattaagaactcattctcgggattatttccacatgttgcacagtggttgcttgctctgcataacacacggatacttctgagtgtatttttggctatactagcattgcttcttggtggtttctgcgcgtatcatgcacatctttgtttaacaaacacaacaaccaatgagtcattcaaatggcaagactacatcatgtggatgaaaaaggagaatgaagcaaaggcaaatgctgctgcactcaaggccagcatgggctcagctaacagcgatgcccacaaaactcctccaagcaaatggagggcattcttcgtaaggtccagaagaccgagtatggaaccagttgtgaaaaacaacatatatgaccgaggcatgattagaaatatgttcgaggtgattgtccctttgtcagagcggaagtcgttttcccgaaggaaatcagactgagacccactgttatagctgttgtatcaccacactgttgtatatccatgtagaatttgcaaaaacatttttttcatatcatagagggaatactttcaggataatttgcaggactgatgagttagcatcaaaatatagataagaagttttgagattccacttgtctgtaatattttgcccttcctgaaacatctgtaatctgtcagaacaatagagagcacttgttgcaacaaaaaaaaaaaaaaaaaaaa

SEQ ID NO: 6916 - protein, 392 aa, Panicum virgatum
  misc_feature: Ceres CLONE 1891703
  misc_feature (1)..(66): Pfam Name: zf-DHHC Pfam Description: DHHC zinc finger domain
MEVPWLLVAHGLVTALVVVSFLCGQWPIFEGTFVQSINHFLTFGAYHYLLRFVQAVCGNGARDLVLGVEQYCCDRPNPILQVFYVAIIGVTYFIFVQTSFKYIPGYYVSGWHRYLSIVAVAVGAILFVLTSFSDPGTVTAENVSQYVSAYPYDNIIFVEKECSSCKIPRPARAKHCRICDKCVARFDHHCGWMNNCIGEKNTRYFVAFLVWHFLLCVYGTVVLCFILAGEIKERKVIYILTAYYGIKNSFSGLFPHVAQWLLALHNTRILLSVFLAILALLLGGFCAYHAHLCLTNTTTNESFKWQDYIMWMKKENEAKANAAALKASMGSANSDAHKTPPSKWRAFFVRSRRPSMEPVVKNNIYDRGMIRNMFEVIVPLSERKSFSRRKSD

SEQ ID NO: 6917 - DNA, 897 bp, Panicum virgatum
  misc_feature: Ceres CLONE 1891715
  misc_feature: Encodes the peptide sequence at SEQ ID NO. 6918
accatccatcactcacacctaggcaggccaggagggacctatctgattgaatcacagcacacgcaggccatggccatggcgccgcagggtcaggagcagcaccacgagcacgagcagccgcatggccagcgcccggtgcccaccacccgccccgccgcgcctggccgcaccatcgccaccaaccgctggggcccctactcgggcgccggcgacttcgccagcaacatggccgtcatcctcgccgccctgctcgccgcgctggcgctcgccctcgcgctcaacgccgccgtgcgctacctgctccggcgcggccgccgagcccggcgcgctgctgctgccggcggcgcggcgggggcgcacgaggacccggagaaggcggccgtggaggcgcccccgccgccgccggccctggtgtactcggcggccgggacgaagctggcgggcgccgcggcggagtgcgccatctgcctggcggagttcgcggacggggacgccgtgcgcgtgatgccggcgtgcggccacggcttccacgcgcgctgcatcgagcgctggctcgcggggggacgccgctcgtcctgccccacgtgccgcgcgccgctggccgccaccgccgagatcggagccaccacggcccaggccgaggccgccgcgtcgccgtcatcttgagactcccatccatggcttgcttgaatttactttggtagcaacttggcgaccctgttcctgttgtaatgttcttggctggcgttgcttcttctttctttcgtttttccattttgctagtatataagtatgtaaatatttgtctcagcagatcattcagaggagagtagagcagagaaggtaattgaagtggatggatgatgatttcgtttggaaaaaaaaaaaaaaaaaaaa

SEQ ID NO: 6918 - protein, 198 aa, Panicum virgatum
  misc_feature: Ceres CLONE 1891715
  misc_feature: Great-hit functional homolog of the protein sequence given in SEQ ID NO 9306
  misc_feature (1)..(44): Pfam Name: zf-C3HC4 Pfam Description: Zinc finger, C3HC4 type (RING finger)
  misc_feature: Useful for making plants with modulated nitrogen use efficiency
  misc_feature: Useful for making plants with modulated oxidative stress sensitivity
  misc_feature: Useful for making plants with modulated nitrogen use efficiency
  misc_feature: Useful for making plants with modulated oxidative stress sensitivity
MAMAPQGQEQHHEHEQPHGQRPVPTTRPAAPGRTIATNRWGPYSGAGDFASNMAVILAALLAALALALALNAAVRYLLRRGRRARRAAAAGGAAGAHEDPEKAAVEAPPPPPALVYSAAGTKLAGAAAECAICLAEFADGDAVRVMPACGHGFHARCIERWLAGGRRSSCPTCRAPLAATAEIGATTAQAEAAASPSS

SEQ ID NO: 6919 - DNA, 1693 bp, Panicum virgatum
  misc_feature: Ceres CLONE 1891781
  misc_feature: Encodes the peptide sequence at SEQ ID NO. 6920
tctcgaattcaatgtgagcttagcggagcaggcatcacgagtagcacgagcgctcgctagtcgccggctacttgtgcccggcctttgttttctccggccacaccacaaccgcagtagaggcacagagagagagagagagagagggcccggagaagatgcatctgagcgagaacgaggggatcgagggcgtgcggttcgcggtgaccggcgggcagggcttcgtgggcgccgccctctgcctcgagctgctccgccgcggcgccagggaggtccggtccctcgacctccgcgccgcctccacctggtcccagcagctcctcgatgccggcgtccacatcatccaagcggacattagaaagaaggatgatgtggggagggctttacacggagtggactgtgttttccaccttgcttcttatggcatgtccggaaaggaaatggtgcaggctggtagagctgacgaggttaatataaacgggacctgcaatgtactcgacgcttgccatgagcatggtgtcagaaggcttgtgtatgtaagcacgtacaatgtggtatttgggggaaagcctattgtcaatggaaatgaggcgttgccttattttccaattgaagatcatgttgatgcttatgggcgtagcaaatcagttgctgaacagttggtgctgaagagtaatgggcggccagctaagcatgataaaagtactcggctttatacatgtgcaattcgccctgctgctatatatgggccaggtgaagagcgtcatcttccaagaatcctgcgccttgcaaagttggggttggcattcttcaggattgggggtccagatgtcaagacagattgggtttatatagataatctagttcttgctctgatattggcaagcatgggacttttagatgacattcctgacaggatgggaacccctgtagcagctggtcaggcatatttcatctgtgatggatcaccatgcaacacttttgaatttatcatcagccccctatttcgaagtttaggttatgcagttcctcgagtgacgctggatacctctgctgtccttgccatttcaagaatatttttatttatatctacactgttctatccatggcttgatagtaaatggatgcctcagcctcttattcttcctgctgaagtgtataaggttggtgttacacactacttttcattcttgaaagctagaaatgaacttggctatgtacctatggtgagccctcgggaaggcctggctgcaactatctcgtattggcaagagcagaagagaagggaactagatggcccgactatatttacttggttagctgttacaattgggatgcttgctatattctgtgctgcttgccttccacccgccggcccgttgaaatgggtgcttgacatccatttatttgtatttcgctcattattggtgattcggctagtctttgcggcagcagttgcagcgcattttggtgaagccgtttatgcctggttcttggcgaaaaaggttgatccaaggaatgctgcagggtggttttggcaaacctttgctctagggttcttttctctgcagtatctgctcaagagaatgagagggtaaattgtttcacatacaaattgtaatttgtaactctgtaacagtgattgccagattcatacttgttactttctttggattaaaaaaaaaaaaaaaaaaaa

SEQ ID NO: 6920 - protein, 479 aa, Panicum virgatum
  misc_feature: Ceres CLONE 1891781
  misc_feature (1)..(286): Pfam Name: 3Beta_HSD Pfam Description: 3-beta hydroxysteroid dehydrogenase/ isomerase family
MHLSENEGIEGVRFAVTGGQGFVGAALCLELLRRGAREVRSLDLRAASTWSQQLLDAGVHIIQADIRKKDDVGRALHGVDCVFHLASYGMSGKEMVQAGRADEVNINGTCNVLDACHEHGVRRLVYVSTYNVVFGGKPIVNGNEALPYFPIEDHVDAYGRSKSVAEQLVLKSNGRPAKHDKSTRLYTCAIRPAAIYGPGEERHLPRILRLAKLGLAFFRIGGPDVKTDWVYIDNLVLALILASMGLLDDIPDRMGTPVAAGQAYFICDGSPCNTFEFIISPLFRSLGYAVPRVTLDTSAVLAISRIFLFISTLFYPWLDSKWMPQPLILPAEVYKVGVTHYFSFLKARNELGYVPMVSPREGLAATISYWQEQKRRELDGPTIFTWLAVTIGMLAIFCAACLPPAGPLKWVLDIHLFVFRSLLVIRLVFAAAVAAHFGEAVYAWFLAKKVDPRNAAGWFWQTFALGFFSLQYLLKRMRG

SEQ ID NO: 6921 - DNA, 995 bp, Panicum virgatum
  misc_feature: Ceres CLONE 1891860
  misc_feature: Encodes the peptide sequence at SEQ ID NO. 6922
atatccagagctgagagcctgagagagcttcccaacccaacatccaccaacgcccccccaaaagacaacagcaagcaagcaagaggaagggacgtcgcaggctggctggctgttagttcagcagccggcgagcaacatccccggtggcagccatggcgtccattgtaacagcaatttccagggcgctcactggttggagccggcgcgcgctcgccgtgcccgcacaccgcgtgcggtcgccgagagctcgggtcgtcgtccgggccagcgcccagcgcgcgacctggctgcccggcctggacccgcctgctcacctcgacggcacgctgccgggtgacttcggcttcgatcccctggggctcggcgaggaaccggcagcattgaagtggtacgtgcaggccgagctcgtgcactgccggttcgccatggcaggtgtcgccggcatccttgtaaccgacttgctccgcgtatcagggatccgggatctgccggtgtggttcgaggcaggtgcagcgaaatttgacttcgccaacaccacgtcactcttcttcgttcagcttctcctgatgggattcgctgaaaccaagaggtacatggatttcatcaatccagggtcacaagcagaggaaggaaccttcataggtctagaggctgcactcgtgggctcacagccaggctaccctggaggtccgctgtttaatccgttaggactcgcaaaagatatagagaatgcacatgaagagaagctgaaagagattaagaatgggaggttggcaatggtagccatgcttggcttcattgtgcaagcatccgtaactcatgttggccccatcgacaaccttttgacacatctttcggacccattcaacaaaaatatcattcattcaatctcctcttcctaagaattctgtccccaatgcaaacttttgttttcactgtacagtgctatggcacaaaaagataacaatgtttcccaaaaaaaaaaaaaaaaaaaa

SEQ ID NO: 6922 - protein, 249 aa, Panicum virgatum
  misc_feature: Ceres CLONE 1891860
  misc_feature: Great-hit functional homolog of the protein sequence given in SEQ ID NO 9575
  misc_feature: Useful for making plants with modulated nitrogen use efficiency
MASIVTAISRALTGWSRRALAVPAHRVRSPRARVVVRASAQRATWLPGLDPPAHLDGTLPGDFGFDPLGLGEEPAALKWYVQAELVHCRFAMAGVAGILVTDLLRVSGIRDLPVWFEAGAAKFDFANTTSLFFVQLLLMGFAETKRYMDFINPGSQAEEGTFIGLEAALVGSQPGYPGGPLFNPLGLAKDIENAHEEKLKEIKNGRLAMVAMLGFIVQASVTHVGPIDNLLTHLSDPFNKNIIHSISSS

SEQ ID NO: 6923 - DNA, 1577 bp, Panicum virgatum
  misc_feature: Ceres CLONE 1891923
  misc_feature: Encodes the peptide sequence at SEQ ID NO. 6924
ctctcctcccccactcctcgcctccccctctcgtccacgcttcgtccccctccttcccgttcggacacttggtcgtcgtctcgtccctcccagcagatccgcaagcgccggggctccagagggagagagaggaggggggagacggacgggtgggagtgctgcggggggtggaggagatggccgcggcggcgaaggaggcggggccgagcggctgcagcggcagggcggtgctggtcacgggcggggcgggctacatcggcagccacgccgtgctgcagctcctcaccgcgggattccgcgtcgtcgtcgtcgacagcctcgccaactcctccgagatcgcgctgcgccgggtgcgcgcgctcgcgggggaacacgccaaaaacctgctcgccttccacaaggctgatatccgtgacaaagatggactggaaaaggttttcgcttcagcaagatttgatgctgttattcattttgctggactgaaagctgttggagaaagtgtgcaaaagccattgctctattatgatcataatgttgttggtacaataaatcttctggaaattatggcagctcatggatgtaagaagttagtgttctcatcgtcagcagcagtttatggatcaccgaagaactcaccgtgcacagaagattttcctctcattccacataacccatatggcagaacaaagcttatggctgaggagatatgccgtgatatctaccattcagatcctgaatggagtatcattttgcttaggtatttcaatccagtcggggctcaccccagtggatatgttggtgaagacccttgtggaactcctagcaaccttatgcccttcgttcagcaaattgctgttggtaggaggccatcgctaacaatatttggaaataactacgcaacaaaggatgggacaggggttcgtgattatatacatgtggttgaccttgctgaaggacatcttttcgcattacggaagcttttcgacagctcatctaacataggttgtgaagcatacaacctcggaactggaaagggaacatcagttttggagatagtcaatgcatttgagaaggcttctggaaagaaaatccctttggtcatgggtcaacgccgccctggtgatgctgagattctcttttcgtcacctgcaaaagcggagagagaactccactggaaagcgaaatatggcatcgcagagatgtgcagagacctgtggaactgggctagcaaacacccttacggatatgcagcatccgagtccccgaagctgaatggcagttcacgctgagcaacaccgattgttccatgtggactattacttgtacatgcaacgtagtgcccaccaggataaaatgtagatctgtccggtcagtcatacagagaaaggttctataggcttaggaaagaatgctatcttgttccctccctagcataagtgctcctataaatggatccttccatatgcgtatagtttgtcaaacttgttctaggagcattgctgtagtcaattagctaattcaattcttctacttctaattgatatactagatttcagtaaaaaaaaaaaaaaaaaaaa

SEQ ID NO: 6924 - protein, 370 aa, Panicum virgatum
  misc_feature: Ceres CLONE 1891923
  misc_feature (1)..(265): Pfam Name: Epimerase Pfam Description: NAD dependent epimerase/dehydratase family
  misc_feature (14)..(358): SWISSPROT Homolog: EC 5.1.3.2 UDP-glucose 4-epimerase
  misc_feature (14)..(361): SWISSPROT Homolog: EC 5.1.3.2 UDP-glucose 4-epimerase GEPI48
MAAAAKEAGPSGCSGRAVLVTGGAGYIGSHAVLQLLTAGFRVVVVDSLANSSEIALRRVRALAGEHAKNLLAFHKADIRDKDGLEKVFASARFDAVIHFAGLKAVGESVQKPLLYYDHNVVGTINLLEIMAAHGCKKLVFSSSAAVYGSPKNSPCTEDFPLIPHNPYGRTKLMAEEICRDIYHSDPEWSIILLRYFNPVGAHPSGYVGEDPCGTPSNLMPFVQQIAVGRRPSLTIFGNNYATKDGTGVRDYIHVVDLAEGHLFALRKLFDSSSNIGCEAYNLGTGKGTSVLEIVNAFEKASGKKIPLVMGQRRPGDAEILFSSPAKAERELHWKAKYGIAEMCRDLWNWASKHPYGYAASESPKLNGSSR

SEQ ID NO: 6925 - DNA, 792 bp, Panicum virgatum
  misc_feature: Ceres CLONE 1891934
  misc_feature: Encodes the peptide sequence at SEQ ID NO. 6926
aaggagcgccgcaacagcagccgcaagagaggaggaggaggagggatccgatggccgagatcgacaccgacgtgatcgaggtgaccttcggggacgacgtgatcgccaccaccgtcacgtcctccggcgaggccgtggaggcctggctcgccgaggcccgcgccgcgccgggcagccccgtcgtcgggctcgacgtcgagtggcgccccagcaggcgcgccgacgagaaccccgtggccacgctgcagctctgcgtcggccgccgctgcctcatcttccagctcctccacgccgaccgcgtcccccgcgcgctggcggagttcctcggcgaccgcggcgtccgcttcgtcggcgtcggcgtggcggcggacgccgagcggcttagcgacgaccacgagctggtggtggccaacgcggtggacctgcggggcctcgcggcggaggggatgggccgcccggacctccgccaggcggggctgcgcgccgtcgtggccgccgtcatgggcgtcgacctcgtgaagccgcggagggtcaccatgagccgctgggacgcgtcctgcctcagctacgagcagatcaggtacgcctgcatcgacgccttcgtctccttcgaggtcggccgcaagctgctggacggggaggcggcggcggccgatccagtggctccagccgccgaggcggcggcagatccagcggttgccgccgtcgcaggtgcggtggccgccgtgcgactgcagtaaagctgcattgcttaattctagcctgattccacaaaaaaaaaaaaaaaaaaaa

SEQ ID NO: 6926 - protein, 229 aa, Panicum virgatum
  misc_feature: Ceres CLONE 1891934
  misc_feature (2)..(177): Pfam Name: 3_5_exonuc Pfam Description: 3'-5' exonuclease
MAEIDTDVIEVTFGDDVIATTVTSSGEAVEAWLAEARAAPGSPVVGLDVEWRPSRRADENPVATLQLCVGRRCLIFQLLHADRVPRALAEFLGDRGVRFVGVGVAADAERLSDDHELVVANAVDLRGLAAEGMGRPDLRQAGLRAVVAAVMGVDLVKPRRVTMSRWDASCLSYEQIRYACIDAFVSFEVGRKLLDGEAAAADPVAPAAEAAADPAVAAVAGAVAAVRLQ

SEQ ID NO: 6927 - DNA, 827 bp, Panicum virgatum
  misc_feature: Ceres CLONE 1891954
  misc_feature: Encodes the peptide sequence at SEQ ID NO. 6928
agctgcctgctcctccccaaaaatctcgccccgtcagcagctccacgcacagcacggcgaaaaaggcccggtaagacggcgggcaagcgagcgatggctgccaagaccgtctccttcctggtgctcgcgctcctgctcctcgccgtcgcgacgttccccgtggaggtggcggccggcggcggcggcaacggcaaaggcaaagggaacggctacggtaacgggaacgggaacgggaacgggaacggcggcggcaacctgaagccgtgggagtgctcgcccaagtgcgggacgcggtgctccaacacgcagtacaagaaggcctgcctcaccttctgcaacaagtgctgcgccaagtgcctctgcgtgccccccgggttctacggcaacaagggcgcctgcccctgctacaacaactggaagaccaaggagggagggcccaagtgcccctagatcggatcagatcagatcggatcccggtcgccattgctcgtgctcctcctccggtggccgctgctgtcaagatccacaggcttacttaccgatgatccaggcagtgttcgtgctctgttctccccctagctgctaggtgtgttagtgatgcggccgtttgctgaatctgccatgctattccgagcagatctggatgccgcaccatgtgcttgtgctagtgcaactgttggtgaggcattaggaaagaacaaatcaggggggaaataggatattcctatgtaagggtggcacggcatggggcatccctcctccctttgcacagctacctctctatttagtaggacttgattaaaattcaaaaaaaaaaaaaaaaaaaa

SEQ ID NO: 6928 - protein, 118 aa, Panicum virgatum
  misc_feature: Ceres CLONE 1891954
  misc_feature (1)..(109): Pfam Name: GASA Pfam Description: Gibberellin regulated protein
MAAKTVSFLVLALLLLAVATFPVEVAAGGGGNGKGKGNGYGNGNGNGNGNGGGNLKPWECSPKCGTRCSNTQYKKACLTFCNKCCAKCLCVPPGFYGNKGACPCYNNWKTKEGGPKCP

SEQ ID NO: 6929 - DNA, 649 bp, Panicum virgatum
  misc_feature: Ceres CLONE 1892099
  misc_feature: Encodes the peptide sequence at SEQ ID NO. 6930
gcacctcgccggcgccggcgccatggccacctccgcgcccgccgacgcctcgtctccgcccgcgccgcagccgcagacggagcccgcgcggaaggcggtccgcgtggtggtcaagggccgcgtcacgggggtcgggttccgcgactggaccgcctccacggccgagtccctcggtctcgccggctgggtccgcaaccgccgcgacggcagcgtggaggcgctcctctccggcgaccccgccaagatcgaggacatgataacccaccgcctccccgtcgggccccccgccgccaccgtcaccgccgtcgtcccctcccccgccgagcccgtcgatccgtccgccgggttcgagatcaagttcaccgtgtgatccgccgcccgcccgtcctgcggccggatcgctgtgtactcagtactcctactaaggatcggaggcggcacctagtactccgtttatctgctctgcaactgcgaagtctcagcttggggagtccatgtcaaattgtgtgtacaaaacttcaagcttgtttccaatttctaggtggcttccagtacttgaataatgaagtactattgagttctaataaactgtcagctgtggcatgattgaagataagaattgtttctggaaaaaaaaaaaaaaaaaaaa

SEQ ID NO: 6930 - protein, 115 aa, Panicum virgatum
  misc_feature: Ceres CLONE 1892099
  misc_feature (1)..(67): Pfam Name: Acylphosphatase Pfam Description: Acylphosphatase
MATSAPADASSPPAPQPQTEPARKAVRVVVKGRVTGVGFRDWTASTAESLGLAGWVRNRRDGSVEALLSGDPAKIEDMITHRLPVGPPAATVTAVVPSPAEPVDPSAGFEIKFTV

SEQ ID NO: 6931 - DNA, 902 bp, Panicum virgatum
  misc_feature: Ceres CLONE 1892133
  misc_feature: Encodes the peptide sequence at SEQ ID NO. 6932
gttcagcacttcagctgtctcactccctgctcactctgctccaccatgaggcaagaagggaaccctttggacctgaacaacttgccggaggagtacggcaagcaagcggtggagagctccacgaccaccgccacatcaagcgcccatgcagttcggatcaagaagaagagtggcggagggaaggatgatgctgccaaggtgtatgagtgccggttttgttccctcaagttctgcaagtctcaagcgcttggcggccacatgaaccggcatcggcaagagagggagaatgaaaccctcaaccgtgcccggcaactcgtcttcggcaacgagagcctcgccgccgccggcgcgcagatgagtttcagggatgtcaatttgggaggcgctgccccatcgaccatgctaggaggaggcttccggggaatcgccaccggcggcagcggcatcggcgacccgtgcgtccagttccggccggttcatccgcggccgccgtaccattacctctacacggcggcggcgccaccatccacactgcacccgatgagctacccggcgacttacccgggtcctccgcgccagcctgcggtcggcgactacgtcatcggccacgcaatctccgccggcgacgcactgatgcagccgccacaccgcggcagcttctcctgcttcggaggcccactcgccgcgccgccggcagcaacggcggcgctcgccgttgcagcgaacgtgcaggccgacaaagttaactgcaactgcagcttcggctgcggcggcggccacagcagaaataataatgtgaacgcctcctcttgagcagacgcgaccgtacgcaatggtttattttttagaattgggaatatatattaaacatatttcagcttcaaaaaaaaaaaaaaaaaaaa

SEQ ID NO: 6932 - protein, 255 aa, Panicum virgatum
  misc_feature: Ceres CLONE 1892133
  misc_feature: Great-hit functional homolog of the protein sequence encoded by LOCUS At1g68480
  misc_feature: Useful for making plants with altered lignin content
MRQEGNPLDLNNLPEEYGKQAVESSTTTATSSAHAVRIKKKSGGGKDDAAKVYECRFCSLKFCKSQALGGHMNRHRQERENETLNRARQLVFGNESLAAAGAQMSFRDVNLGGAAPSTMLGGGFRGIATGGSGIGDPCVQFRPVHPRPPYHYLYTAAAPPSTLHPMSYPATYPGPPRQPAVGDYVIGHAISAGDALMQPPHRGSFSCFGGPLAAPPAATAALAVAANVQADKVNCNCSFGCGGGHSRNNNVNASS

SEQ ID NO: 6933 - DNA, 1067 bp, Panicum virgatum
  misc_feature: Ceres CLONE 1892282
  misc_feature: Encodes the peptide sequence at SEQ ID NO. 6934
aatgctagcaacccttcatcctttgagccgttgatagaaaagagagagaattaatggcggagccaaacccagagccgagtgatcttattatgcaaacaaggaaaaaaatagtaccaaagttcactgaaatcttccccgtggaggacgtgaactacccttacggcgccttcatcgccgcggtccggaaacaagtgaccaaatactgcaccgaccgtaccggcgtcctccagcctgtgctgccgccggagaagaaggtccccgagctctggttctacaccgagctcaaaaccaagaccagctccatcacgctcgccatacgcatggacaacctctacctcgtcggcttcaggaccccagccggggtgtggtgggagttcggcaaggaaggcggcacccacctcctcgacgacaaccctaggtggctcggcttcggcgacaagtacaaggacctcatcggcgataacggtctggagaccgtcgccatgggccgtcaggaaatgaccggagccgtcaactacctggcgaagaagacgatgacactggaggaggaagagcagctgctgcaggccgctgcggctgacccacaagccgacgcgaagaacagtctggtgaagctggtcattatggtgtgcgaggggctgcggttctggactgtgtcccgcaaggttgacgaggggttcaacaacaagcaagaggtaaagttaactgcgatgcaggggaagcaggtgcagaaatgggacaggatctcgaaggcaatcttcttccagtgggccaaggatccggacgctgagatagacgaaatgaaggaacttggcatcaaaaataaaaacgaggcagcgaagatcgttgcgcttgttaagtatcaaacgcaatgatgaatatgagaaggacgaggtctgtgatgatgacttgttgctgctctactttgcatgcaaataaatacaccccgcgtgcgtacgtggtgttccttgtatccctctactgagaaatatatctaaataaaattctgcaggctccatgcctgcagatcgactgcgtcgattattgaaaaaaaaaaaaaaaaaaaa

SEQ ID NO: 6934 - protein, 273 aa, Panicum virgatum
  misc_feature: Ceres CLONE 1892282
  misc_feature (1)..(272): SWISSPROT Homolog: EC 3.2.2.22 Ribosome-inactivating protein 9
  misc_feature (1)..(272): SWISSPROT Homolog: EC 3.2.2.22 Ribosome-inactivating protein precursor
MAEPNPEPSDLIMQTRKKIVPKFTEIFPVEDVNYPYGAFIAAVRKQVTKYCTDRTGVLQPVLPPEKKVPELWFYTELKTKTSSITLAIRMDNLYLVGFRTPAGVWWEFGKEGGTHLLDDNPRWLGFGDKYKDLIGDNGLETVAMGRQEMTGAVNYLAKKTMTLEEEEQLLQAAAADPQADAKNSLVKLVIMVCEGLRFWTVSRKVDEGFNNKQEVKLTAMQGKQVQKWDRISKAIFFQWAKDPDAEIDEMKELGIKNKNEAAKIVALVKYQTQ

SEQ ID NO: 6935 - DNA, 1988 bp, Panicum virgatum
  misc_feature: Ceres CLONE 1892534
  misc_feature: Encodes the peptide sequence at SEQ ID NO. 6936
aaaaagccaactcccactccactagcacaaaacttcaaccagctgccacctgcttgcctgcctgcccacagaaattgtaaattccccattcaaaaaggaggcttctccgcttcacacgcaggctttgctctgcccgaaatctctcgctcccatcaatggcgtcgtcgaccgcctgagcagctcggtccccagctccgtcggcggcggcgcgacactccgcaccgggctcgcgactcttcgccgcacggaggaggaagggaggccgcggagatggtggggggaggcggcggcggcggcggcggggcgctgcggcgggtgggcaagtacgaggtcggccggaccatcggggagggcaccttcgccaaggtcaagttcgcgcagaacaccgagaccggggagagcgtcgccatgaaggtgctcgaccgctcctccatcctcaagcacaggatggccgaacagattaagagggagatatctataatgaagcttgtcaggcatcccaatgttgttaggctacacgaggttctggcaagccggaagaagatatttataatcctggagttcatcactggcggcgaactatttgataaaattattcgtcatgggagacttaatgaagcagatgcacgcagacacttccagcagcttattgatggtgtcgatttttgtcacaacaaaggagtctaccatcgagatctgaagcccgaaaatctcctccttgattcccagggcaatcttaaaatttcagactttggactgagtgcatggcctgcccagggatcttccctcctacgtacgacatgtggaacaccgaattatgttgccccagaggttctcagtcataaaggatataatggagcacttgctgatacatggtcatgtggagttattttatatgtactgttagcaggttatcttccattcgatgaagtagacttgactaccctttatggaaagattgagagtgcagaatattcattcccaccctggtttacaggtggtgcaaagtcactgattcgtagaattcttgatccaaatccagatacacgaatcaggatagaagagatcagaaatgatgaatggtttcagaagaattacgaacctatcaaagaaatagaaagtgaagaagtcaaccttgatgatgttaatgcagcatttgataatcctgaggaggaggatgaggatgctttcgatgatgaagcaggtcctctgacacttaatgcatttgacctaatcattctttcacgaggattgaatcttgcagccctctttgatcgcagacaggactatgacaagcttcggaatagattcttatcgcgcaaacctgctaaggtcatcttgtcaagtatggaggttgttgcacaatcaatgggatttaagacgcacatccgtaattacaagatgagggtggaaggtctaaatgcaaacaagactagtcatctctcaatcatggttgaggttttcgaagttgctccatcaatcttcatggtagaactacaaagagcagccggagatacttcagagtataacatgtttgtaaataactactgcagcaaattagatgatatcatctggaaatatccaactgaaaagggcaagtcaaggatatcccggttatcaaagtgctaatttgtcctcaacctccatcatatgtctcatgcatagtctagtgctttgttgtaccatgtatcaacttgatgagtggatgtatctgtggggtgtatcaaacttgatctctaatattctagttttaggagttgatcttccaatagtatgccaccattgtatattgagagtacccttgtacagagaggccacatcctgtatgggtttcgtacctcagtttgtctgtacacaatttccagcgatgtgttcgattctgtagatttagtcgaaaacattgcttggttgtaaacattgctctaatgtatcatgcgtttctatcgaatgtcagattcctatttattcaaaaaaaaaaaaaaaaaaaa

SEQ ID NO: 6936 - protein, 452 aa, Panicum virgatum
  misc_feature: Ceres CLONE 1892534
  misc_feature (13)..(448): SWISSPROT Homolog: EC 2.7.11.1 CBL-interacting serine/threonine-protein kinase 24
  misc_feature (14)..(436): SWISSPROT Homolog: EC 2.7.11.1 CIPK-like protein 1
MVGGGGGGGGGALRRVGKYEVGRTIGEGTFAKVKFAQNTETGESVAMKVLDRSSILKHRMAEQIKREISIMKLVRHPNVVRLHEVLASRKKIFIILEFITGGELFDKIIRHGRLNEADARRHFQQLIDGVDFCHNKGVYHRDLKPENLLLDSQGNLKISDFGLSAWPAQGSSLLRTTCGTPNYVAPEVLSHKGYNGALADTWSCGVILYVLLAGYLPFDEVDLTTLYGKIESAEYSFPPWFTGGAKSLIRRILDPNPDTRIRIEEIRNDEWFQKNYEPIKEIESEEVNLDDVNAAFDNPEEEDEDAFDDEAGPLTLNAFDLIILSRGLNLAALFDRRQDYDKLRNRFLSRKPAKVILSSMEVVAQSMGFKTHIRNYKMRVEGLNANKTSHLSIMVEVFEVAPSIFMVELQRAAGDTSEYNMFVNNYCSKLDDIIWKYPTEKGKSRISRLSKC

SEQ ID NO: 6937 - DNA, 2067 bp, Panicum virgatum
  misc_feature: Ceres CLONE 1892662
  misc_feature: Encodes the peptide sequence at SEQ ID NO. 6938
aaaggctctctctccacgagctctgttcacagctgctcctgttgccgtgctccctcaccacgagctctctcttccttgctgctccctcttctcggcgaactctttatcccgtgctcttcctccctcgatgtggcgcaagttcttctccattcatggaagcgagccgggacgacttggaggcgtgtgctacagcccacgagcgcggcctagcgcgcgtcatcgtcacaggtgcgggacgccacgtcagcggagcagggcccgtgcccgtcatcagcatggctgtgcatggggcgcgccggaagacggcgtgcattgcgcggcgcggctgtttgaggaaacatacgtgaagctgtgaaggcgtcgggccaccggcgcactcgcgaggattcggagctcacggctgcggcgaaaatttggctccagatgctcactccgttcgtcagccagctccagcctaacagtatttttctctcgcaccactccagccaccagctccagccagcccaacagtatttttctctcacactatttcaactacagcctccagctccagcctatttcttgcgaggcagatgctgctgattttttttattgcagatgctggcatgctgatcttgggcgtgcggggaaactgagtttggttagagcatctcatgccccgaagaggcacaaatttcgagttgaaaatttttgggaacgcgtgcgtcttcctccatggctcaggcacgcgtgcgtcttcctcccgccggcccaacgccggccaccgcccacttctcgagctccaaccccagacccgcccacctgaccttctcctcgaagcgcgcccccgcctctcgctacgccgccgccgccgccgccaatgagccgccggcccccatcgtcgtcgtgggctcggccaacgccgacatctacgtcgaggtcgaccgcctcccgctcgccggcgagaccgtggcggcccgcgcggggcgcagccttccgggcgggaagggcgccaaccaggcggcctgcggcgggcggctcgcgctgggccccacctacctggtggcgcgcgtgggggacgacgcaaacgggcggctcctcgagggcgcgctggccgacgccggcggcgtccgcaccgaccgcgttgcgcgcgcgcccgacgcgccctcggggcacgccgtcgtcatgctcatgcccgacgggcagaactccatcatcatcgtcggcggagctaacatgcagggctgggccgctgggatcggcgcggaggacctggaattgatccaaaaggctggggtgctgctgctgcagagggagatacccgattgggtcaacacgcaggctgcccaggctgcaaaaagtgcaggcgtgcctgttatcatggacgctggtggaatggatgctcctgtacctcaagatctactcagtctagtggatatttttagtccaaatgaaacagaactagcacggttgactgggatgcctactgagacatttgagcagatcagccaggctgcaggagaatgccataaaatgggtgtgaaagaagtactagttaaacttggatcgcagggatctgctttgtttgttgagggagagaagccagtcagacagccgattattcctgccacagaagttattgataccacgggggctggtgacactttcacctcagcttttgctgtagctctggttgaggggaagtctaaggaggagtgcatgagatttgctgccgctgctgcctccttgtgtgttcgagtgaagggtgctatacccagcatgcctgacagaaagtcagtgatgaagcttctggaatctgcgcaagtcgagtagctgcagaatgcatcgattgttcaaagtcggtctcatccatcggcaataatggccttctccagtacgcggaattcgtggaatcgtgggatccatggagcgtcgccgcaccttcacgtgcgtgctcccccaaataatgcgagtgcatctccaaatggaaacgcatttcccggtgccgcccggagtagcaaacctcctccaaaaaaaataaaaataagaagcgacgtcatgtgcgcctacggccacacgaccgtttcc

SEQ ID NO: 6938 - protein, 365 aa, Panicum virgatum
  misc_feature: Ceres CLONE 1892662
  misc_feature (3)..(301): Pfam Name: PfkB Pfam Description: pfkB family carbohydrate kinase
MAQARVRLPPAGPTPATAHFSSSNPRPAHLTFSSKRAPASRYAAAAAANEPPAPIVVVGSANADIYVEVDRLPLAGETVAARAGRSLPGGKGANQAACGGRLALGPTYLVARVGDDANGRLLEGALADAGGVRTDRVARAPDAPSGHAVVMLMPDGQNSIIIVGGANMQGWAAGIGAEDLELIQKAGVLLLQREIPDWVNTQAAQAAKSAGVPVIMDAGGMDAPVPQDLLSLVDIFSPNETELARLTGMPTETFEQISQAAGECHKMGVKEVLVKLGSQGSALFVEGEKPVRQPIIPATEVIDTTGAGDTFTSAFAVALVEGKSKEECMRFAAAAASLCVRVKGAIPSMPDRKSVMKLLESAQVE

SEQ ID NO: 6939 - DNA, 2942 bp, Panicum virgatum
  misc_feature: Ceres CLONE 1892720
  misc_feature: Encodes the peptide sequence at SEQ ID NO. 6940
aaaaaaaaaacccaacgcctcggctccaagccagccagccaaccaacccgccccgggcagcaaagcacaggcgcacgagctcccacagctccccagctccacgcctcctccctcgcgctcccgccatcctctcctccgccgcgcgccttcccgcccgccgagcctttggggtggttccggagtcgcggccgcgcgcgcgagagcgagaccctcccctgctgccgagcgtaaatctgccgagctcggcatggggtgaccagatcggggcgcggctcggtgctctacggctgaattccgctcgaggaggggggtttgccttgcctagaagaggccgcggggatggcgaacgccggcgtggccgtcggctcagggggtgttagccatgctttgttcagggaactctggcatgcttgtgctgggctgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaggtggtaaatgtagaactcagagctgaaactgattccgatgaagtttatgctcaaattatgctgcaaccagaagcagatcaaagtgagcccaccagcccagctcctgagctaccagagccagaaaggtgcaatgtccattccttctgcaagactttgactgcttcagacacgagcacccatggtggtttctctgtcctcaggagacatgctgaagaatgtttgccccaattggatatgactcagaacccaccgtggcaagaactggtggctaaagatctccatggaaatgaatggcatttccgtcacatctttcgaggtcaaccaaggaggcatctacttacaacaggttggagtgtttttgttagctcaaaaagattggttgccggtgatgcatttatctttttgagaggtgagaatggagagctacgagtcggggtaagaaggctcatgaggcaagtaaataacatgccatcatcagttatctcaagccacagcatgcatcttggagtcctcgcaactgcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtgatgaatctcctgaaagaagatttagtggaacaattattggtctgggaagcatgccagctaactcaacatctccgtgggctgactctgattggagatctttgaaggtccaatgggatgagccttctgctgttgtccgtccagatagagtttcaccatgggaactagaaccccttgatgcaactaacacacaaccgcctcagcctcctttacggagtaagcgtgcacggcctcctgcttcaccttctattgctccagaacttcctccagcttttggtttttggaaatccccacctgagcctacccatgctttctcattttcgggactgcagcgaacccaggaactataccattcaaatcccaattcgatcttttcatcatcgttgaatgtgggatttaattcaaagaacgagcattctactccaaccaacaatcatttgtattggccaattcgagacactagaacggaatcctactctgctagcattaacaaacttccacctgaaaggaagcaagaattcactattgctggctgcagattgtttggtattgagttaagtaatgcagtatcaccagtggttgctgttgctagtgctggtcaagaccaaccacctgttgtgtcagtagatgttgagcctgatcagctgtcacagccatcccaagccaacaaaacggatgccccagcagcaagcagtgagcgctctcctcatgagactgagagccggcaagtcaggagctgcaccaaggtaatcatgcaaggaatggcggttggcagggcagtggacttgacgaggctagaagggtatgatgatcttctccacaagttggaggagatgtttgatatccagggggagctttctgctagcctcaagaaatggaaggttatttacacggatgatgaggatgatatgatgctggttggggatgatccgtggcctgaattttgcggcatggtgaaaaggatatacatttactcctatgaggaggccaagtctttgactcccaaggtgaagctgccggtcattggtgacaccactaaactgaacctagacaaattgtcaccagaatctgacatgccgcagagtgactcaaacaacatcgctctggttgccgccgataaggactgatggatgctaacttggtgctttaccttttcttccctttttggatgtttgggaggcaatgcccatgctccttgagactgctaagagttatctgtttgttgcgctgtgggcctcaaggacgttgccccacaatctgcctgactgccttggtttgcaatggctgatgtaggaccagtggtggtcctctgccagcaaggacgactggaacgtaatggcaagcaggctgcgtgcgcgccgttccctgtggcaccaacctgtgttttgtttgccgtgtttggtaggaggcatggcgaattgccggctgcttggttttggagactgccactgactgctgccgtctcgttggtcgacgtcggccggcaggccgcgcccctcacctccagtaaataggacttcatgtacaactagtttggtagtagcagtagtggtttatgtatatcagcgtcatgttccttgctacctatataagcatcatcatctgtagctgctgctcccaccttgcattgtattctacccccggcttggtaccgaatgatctggtgcaaaaaagtctcagcttgctgttccaaaaaaaaaaaaaaaaaaaa

SEQ ID NO: 6940 - protein, 672 aa, Panicum virgatum
  misc_feature: Ceres CLONE 1892720
  misc_feature (1)..(106): Pfam Name: B3 Pfam Description: B3 DNA binding domain
  misc_feature (1)..(212): Pfam Name: AUX_IAA Pfam Description: AUX/IAA family
  misc_feature: The sequence is a functional homolog of  SEQ ID NO 298 in the  10/412,699 US patent application
  misc_feature: Useful for making plants with modulated growth and phenotype characteristics
MANAGVAVGSGGVSHALFRELWHACAGLLVTVPRQGELVYYFPQGHMEQLEASTDQQLDQHLPLFNLPSKILCKVVNVELRAETDSDEVYAQIMLQPEADQSEPTSPAPELPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQVNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWADSDWRSLKVQWDEPSAVVRPDRVSPWELEPLDATNTQPPQPPLRSKRARPPASPSIAPELPPAFGFWKSPPEPTHAFSFSGLQRTQELYHSNPNSIFSSSLNVGFNSKNEHSTPTNNHLYWPIRDTRTESYSASINKLPPERKQEFTIAGCRLFGIELSNAVSPVVAVASAGQDQPPVVSVDVEPDQLSQPSQANKTDAPAASSERSPHETESRQVRSCTKVIMQGMAVGRAVDLTRLEGYDDLLHKLEEMFDIQGELSASLKKWKVIYTDDEDDMMLVGDDPWPEFCGMVKRIYIYSYEEAKSLTPKVKLPVIGDTTKLNLDKLSPESDMPQSDSNNIALVAADKD

SEQ ID NO: 6941 - DNA, 2280 bp, Panicum virgatum
  misc_feature: Ceres CLONE 1892726
  misc_feature: Encodes the peptide sequence at SEQ ID NO. 6942
acacacgcatccggctccgccgcccgctcccagctcacgccaaaggcgacgacgtcgtgttccgttccgcgccgcccgacccgcttcgagcttcgatcggctaggtagctcggtcggtcggtcgcttccggtcgccatggaggctgcgccggcggcggtcatggagcgggagcgcttgacggccgagatggccttccgcgacccggacgggggcgagccggcgcccagcatcgtgatcaagatccgccgccggctcccggacttcgcgcggaacatcaagctcaagtacgtcaagctcgggatccgccacggcggcagccccacgtcggtgctgccgatgctctgcgtgcccgcgctcgccgccgccgcctactccttcgtccgcctcgacgtcatctactactccatcgacctgctcacctgcgtcgcctggctcggcaccgcggcgctgctgctcaccgtctactacttcaagcggccccgcccggtgtacctcgtcgagttcgcgtgctacaagcccgaggaccagcacaagatctccaaggcggggttcctcgagatgaccgagagcaccggctgcttcaacgaggcggccctcgacttccagaccaagatcaccaaccgctccgcgctcggcgacgagacgtacctgcccccgggcgtccaggcgcgcccgcccaggctcaacatggcggaggcgcggatggaggccgaggccgtcatgttcgggtgcctggacgcgctgttcgggtccaccgggatcgacccgcgccgcgacgtgcgcatcctcatcgtcaactgcagcctcttcaacccgacgccgtcgctggcgtcgatgatcatcaaccactacaagatgcgggggggcgtcaagtcgttcaacctcggcggcatgggctgcagcgccggcctgatcgccatcgacctcgccaaggacatgctccaggcgaaccccaactcgtacgccgtcgtgctcagcaccgagaacatcaccctcaactggtacttcggcaacgatcgctcgatgctcctctccaactgcatcttccgcatgggcggcgcggcggcgctgctgtccaacaagcgcgctgacgccgggcgcgccaagtaccggctgctccacacggtgcgcacccacaagggcgccgccgacgagtgcttcaactgcgtgtaccagcgcgaggacgaggtcggtaaggtcggtgtctccctggcgcgggagctcatggcggtggccggcgacgcgctcaagaccaacatcaccacgctggggcccctggtgctgcccctgtccgagcagctcaagttcctcaagtccctgatgatgcgccgcgtgttccgcgtcaagggcgtgcgcccctacatccccgacttccggcgcgcgttcgagcacttctgcgtgcacgccggcggccgcgcggtgctggaggaggtgcagcgcagcctgagcctgcgggacacggacatggagcccagcaagtgcgccctccaccgcttcggcaacaccagcagcagctcgctgtggtacgagctggcgtacgcggaggccaagggccgggtgcgccgcggccaccgcgtgtggcagatcggcttcggctccgggttcaagtgcaacagcgccgtgtggcgcgcgctccgcgacgtgccggcgctgccgtccccaggcggcggcgccgccggggaccggaggagctgctgcaacccctgggcggaggacgtggacaagtaccctcccaaggcgtacgtctgatggcccacgtcacgtggtttgatcaccatgcatcacacaacaattgtatgattattccattcgattttaatttcctcacatcactcacgacgacagaacgaattgaacaagggtgcgcgagggaaactaaagaacacagcatatatgtttttctttctcaattttctctgtaattttctttttcgttctttcttccagcagtgtagtaggttgccgtgcgtagacagtgctggcttttggaattcagagattcattttatgtcgtgtaagatgaatgaattccaagagcgagcactgctattttttctcagccttttgttgtctggtcctttgtcttccttggctttctagacgccggggaagagttgacggacggacacacttgtgcagtttcacatgactagaggttcatcatcaatcaagtgtgaattactaaatcatcaacagctgtatagtacacgttctgttgccaagtccaagttttaaatcacatgtgttttgtgaggcttcaaaaaaaaaaaaaaaaaaaa

SEQ ID NO: 6942 - protein, 537 aa, Panicum virgatum
  misc_feature: Ceres CLONE 1892726
  misc_feature (1)..(291): Pfam Name: FAE1_CUT1_RppA Pfam Description: FAE1/Type III polyketide synthase-like protein
  misc_feature (1)..(534): SWISSPROT Homolog: EC 2.3.1.- 3-ketoacyl-CoA synthase 1
  misc_feature (38)..(532): SWISSPROT Homolog: EC 2.3.1.- 3-ketoacyl-CoA synthase 11
MEAAPAAVMERERLTAEMAFRDPDGGEPAPSIVIKIRRRLPDFARNIKLKYVKLGIRHGGSPTSVLPMLCVPALAAAAYSFVRLDVIYYSIDLLTCVAWLGTAALLLTVYYFKRPRPVYLVEFACYKPEDQHKISKAGFLEMTESTGCFNEAALDFQTKITNRSALGDETYLPPGVQARPPRLNMAEARMEAEAVMFGCLDALFGSTGIDPRRDVRILIVNCSLFNPTPSLASMIINHYKMRGGVKSFNLGGMGCSAGLIAIDLAKDMLQANPNSYAVVLSTENITLNWYFGNDRSMLLSNCIFRMGGAAALLSNKRADAGRAKYRLLHTVRTHKGAADECFNCVYQREDEVGKVGVSLARELMAVAGDALKTNITTLGPLVLPLSEQLKFLKSLMMRRVFRVKGVRPYIPDFRRAFEHFCVHAGGRAVLEEVQRSLSLRDTDMEPSKCALHRFGNTSSSSLWYELAYAEAKGRVRRGHRVWQIGFGSGFKCNSAVWRALRDVPALPSPGGGAAGDRRSCCNPWAEDVDKYPPKAYV

SEQ ID NO: 6943 - DNA, 1931 bp, Panicum virgatum
  misc_feature: Ceres CLONE 1892803
  misc_feature: Encodes the peptide sequence at SEQ ID NO. 6944
gcagtactcttgcgcaaaagccaatcacacatcgacaaaagcatccaacaagacttcgtcgggccactcgcctggtccgccagtcatgtcgccgggcagcggtgcggccggcgtcggcgctgagacagcgccgcacttcgtgctggtgccgatgatggccgcgggccatgccggcccgatgctcgacatggcgcgggccctggcgtgccggggcgcgctcgtcacgttcgtcaccacgcccctcaacctgccccgcctcggccgcggccccggcgacgacgcgctcccgatccgcttcctcccgctccgcttcccctgcgccgaggccggcctccccgagggctgcgagagcctcgacgcgctcccgggcgccggcctcctcggccgcttcaacgacgcctgcgccatgctccgcgcgcctctcgttgcgcgcctccgggacgacgccgccgcccctccggcaagctgcctcgtcgccgacgcctgccacccgtgggccggcgccgcggcccgggagctcggcgtgctgcggctcgcgttcgacgggttctgcgccttctcctccttgtgcatgcgccagatgaacgtccacaggatcttcgacggcgtcgacgacgacaggcgccccgtgcgcgtcccgggtttccccatcgacgtcgagatatcgcgggcgcggtcgccggggaacttctcgggccccggcatgaaggagttcggcgaggagatcatggccgagagcgcgagggccgacggcctggtggtcaacagctttgcggagctcgagccccggttcgtcgacgcctacgaggcggccatcggcaagaaggtgtggaccgttgggcctctgttcctgaacaccatgccggcggcggcggcgactgccgagggcgcggccgccgcccggtgcgcgagttggctcgagtccaggaagccccgttccgtggtgttcgtgagcttcggcagcctggtgcgctcgtcggtggcgcagctcgccgagatcgcgctcgggctggaggcgagcggccggccgttcatctgggcggtgaagcccggcaagctcgccgagttcgagcggtggctgtccggcgacggcttcgagtcccgcgtcggggagacgatggggctcgtgatcaggggctgggcgccgcagagggcgatcctgtcgcacccggcagcgggcgccttcgtgacgcactgcggctggaactccgtgctggagtgcgtcgcggcggggctgccgatggcgacgtggccacacttcgccgagcagttcatgaacgagaggctggtcgtggacgtgctgcgggtcggggtgcccgtgggcgtcaaggacgcggcgccgtggggcgttgaggcggcggccgtggacgtggtggcgacgagggaggacgtggcgagcgccgtggcggcggtgatggacggcggggaggagagcgccgcgcggcggacgagggccgccgagctcggcaggaaggcgcgggaggccgtggcgactggcggctcgtcggaccggaacgtggcgcttctcatggaacacgccgggcggaagaaaaccacagcttgagaacaacagcaagccgccgagcgggcaagcgagagagaaggcatgatggttgtgagacgttgactagttttaaaggccagggcaagtgtaatcagccagcatatttgaagacgaaatggccactgagttctctctagcctcgccgtttacaggtgacacttgaatctgtttagagcaagtacaacagtgcagacagctgctgtctttttatcataaacagatagttgaacagacagtttgtacaatgacctgtctgtttgactgtctgcagggtgattaatttatcctttaacacacaaactcatagtgatctaatacataattgatctttatagctattttgttgcaaaaaaaaaaaaaaaaaaaa

SEQ ID NO: 6944 - protein, 492 aa, Panicum virgatum
  misc_feature: Ceres CLONE 1892803
  misc_feature (1)..(113): Pfam Name: UDPGT Pfam Description: UDP-glucoronosyl and UDP-glucosyl transferase
MSPGSGAAGVGAETAPHFVLVPMMAAGHAGPMLDMARALACRGALVTFVTTPLNLPRLGRGPGDDALPIRFLPLRFPCAEAGLPEGCESLDALPGAGLLGRFNDACAMLRAPLVARLRDDAAAPPASCLVADACHPWAGAAARELGVLRLAFDGFCAFSSLCMRQMNVHRIFDGVDDDRRPVRVPGFPIDVEISRARSPGNFSGPGMKEFGEEIMAESARADGLVVNSFAELEPRFVDAYEAAIGKKVWTVGPLFLNTMPAAAATAEGAAAARCASWLESRKPRSVVFVSFGSLVRSSVAQLAEIALGLEASGRPFIWAVKPGKLAEFERWLSGDGFESRVGETMGLVIRGWAPQRAILSHPAAGAFVTHCGWNSVLECVAAGLPMATWPHFAEQFMNERLVVDVLRVGVPVGVKDAAPWGVEAAAVDVVATREDVASAVAAVMDGGEESAARRTRAAELGRKAREAVATGGSSDRNVALLMEHAGRKKTTA

SEQ ID NO: 6945 - DNA, 2398 bp, Panicum virgatum
  misc_feature: Ceres CLONE 1892922
  misc_feature: Encodes the peptide sequence at SEQ ID NO. 6946
aggcgggcgggcagccagatcaagtcgcggagcagtcaagcaaggcacgtcgacgctgcccggccgcgccccgcgccgcgcgccgcgagatctgaaggcgcggcaccgagggaaatcgagcagctcgcgcgcgcgcgcgagcggcagttagcggcgcgtctcggatctcggcgcggcgcctcccgccccggccagtgcggcgagagcagcgggggcacggggggggctcggggccgccccccgcgcgatccgatgaggcgacggccgttcctggaccagaggcggccgtcgttcaagcgccggtggcagcagcggccgtggtgggtgcgcctcgcgctctccctcctcttcgccctcgcctgcgtcctcctcctcaccgtcctcctcggctcccccgaccccggcgcctcgccgtccacctccaccgcctcctccggatccgaggccacctcctcccctctcctccgtcagagatcttacctggaaggcatcacggatgcgctcaacatgactgacgaaatgctgagcgctcgctcgttctccaggcagctcatggaccagatttatctagccaaatcttatgtcgttgtcgcgaaggaggccaataacttgcagtttgcagcggagcttagtgcccaggtgcggcgggcgcagagcatcctcgtgcacgctgcagcccacgggggcacggtgctggagcaggaagcagagaaggcgatcagggatatgtctgtgctgctcttccaggcgcagcagctgcggtatgacagcggcatcacaatcatgaagttgaagggacagattcagtctctagaggagaagtcgaaagctgaggcagagaagagcacaaagtacgggcagattgctgctgaggagcttccaaaggggctctactgccttggtgtccggttaaccatggaatggttcaagaattctgagcttcagaggaagttttctgataggagcccagtagtgcagaacgacctaagggataacagcctctatcatttttgtgttttctcagacaacatccttgctgtttcagttgttgtcaattctacagctacaaactcaaagcaccctgaaaagattgtctttcacttagttaccgatgagttgaactatgctccaatgagggcatggtttgccatgagtgactacagaggggtcactgtggagatacaaaaggtggaggactttacttggctaaatgcatcatatgttcctgttcttaaacagctgcagaacactgctactcagaagttctacttctctggcagtggtaaccgcggaacaccgattaaattcaggaacccaaagtacctgtcaatgcttaaccacttgaggttttacattccagaaatatatcctgaattgcagaaggtggtatttcttgatgatgatattgttgttcagaaggacttatccgaactgtttactatcaacctcaatggtaatgtgatgggtgctgtagaaacttgcatggagacattccacaggtttcataagtatcttaaccattcccatcctctaatccgtgctcattttgaccctgatgcttgtggctgggcatttggtatgaatgtgctcgatcttgtcgaatggaggaacaagaatgtgacaggtatatatcattattggcaggagcgcaatgctgatcataccctatggaagcttgggtctttaccgcctgggcttcttgctttctatggtttggttgaagcactggatcccaaatggcatgtcttgggacttggctacactactgtggatcctgctactatcaaggaaggggcagtgctgcattacaatggaaatatgaagccatggctcaaaattggaatggagaagtacaagagcttttgggataactatgtggactattcacaccctttgattcagcagtgcttcatgtgttgattactgtgtatcaacattagaaatttttgtaagcaccctagtagaaatgttccaagtgcatgctgcaactgccacacgtaaacattgtacttagaccagttggcttcgctttcaagttataatcttaatctctgacgaaacatcagtggctgtttatagcatctgtagttgatgaagtacaacaatcacatataccttcagtcacaggtaaacagcacaagagctaagattgcaatgcagtaggctactaggctgccacttgaaccacatccactactattgtaactgcaaccgtcaatgtaatttttttttttttatttttagggtgagacagaagcacagaatggaaatgatgtagaattgattcaaaattctatgaagtgttacaagtttcgagttacctatccataattactggatgttaagacagcaaagcttttcctgtttatttatacatcttgagaagtaaagttgccag

SEQ ID NO: 6946 - protein, 555 aa, Panicum virgatum
  misc_feature: Ceres CLONE 1892922
  misc_feature: Great-hit functional homolog of the protein sequence encoded by LOCUS At2g20810
  misc_feature (1)..(318): Pfam Name: Glyco_transf_8 Pfam Description: Glycosyl transferase family 8
  misc_feature: Useful for making plants with altered cell wall content and/or composition
MRRRPFLDQRRPSFKRRWQQRPWWVRLALSLLFALACVLLLTVLLGSPDPGASPSTSTASSGSEATSSPLLRQRSYLEGITDALNMTDEMLSARSFSRQLMDQIYLAKSYVVVAKEANNLQFAAELSAQVRRAQSILVHAAAHGGTVLEQEAEKAIRDMSVLLFQAQQLRYDSGITIMKLKGQIQSLEEKSKAEAEKSTKYGQIAAEELPKGLYCLGVRLTMEWFKNSELQRKFSDRSPVVQNDLRDNSLYHFCVFSDNILAVSVVVNSTATNSKHPEKIVFHLVTDELNYAPMRAWFAMSDYRGVTVEIQKVEDFTWLNASYVPVLKQLQNTATQKFYFSGSGNRGTPIKFRNPKYLSMLNHLRFYIPEIYPELQKVVFLDDDIVVQKDLSELFTINLNGNVMGAVETCMETFHRFHKYLNHSHPLIRAHFDPDACGWAFGMNVLDLVEWRNKNVTGIYHYWQERNADHTLWKLGSLPPGLLAFYGLVEALDPKWHVLGLGYTTVDPATIKEGAVLHYNGNMKPWLKIGMEKYKSFWDNYVDYSHPLIQQCFMC

SEQ ID NO: 6947 - DNA, 2752 bp, Panicum virgatum
  misc_feature: Ceres CLONE 1893058
  misc_feature: Encodes the peptide sequence at SEQ ID NO. 6948
gtggaccgaacaaacctttccccaaaatttcccctccccccgcaccgaaccaactctcgatccgatcccgatccctgcagggcgccgcctcggctcccccatccggctccggatctgctcgtcgctcggcgggagctctcgattggtaccagctttcccccctctcttcgattccgtagggtcccgaggttagggtttgcgagggtcggtttcgggctccgatccgctcgattgaggccggattttgcacgggaacgtcggatccgtgcgtgatctgtaggtttcaggtgggattgtcgcaatttcgagagtcaattttgcgtgatttttctggtgggcggatgcgacctagggtttcgttcggtcctgaggtgtttgatcctattctcgaactcgatagggtttcagaccgcgaaattcgagcctattgctccacttaattgttgcatgaacaaaaacgttgttacgttgctaaatcattagggataacatttcttttgtgtccttcatttcggcagttaaacatgcgaattacatttggtctgttgacctccatataaggtgttcgtggggcctgtacatagctgaaatcatttattgttacccctgaatcggtgttttcctttcagtcttgtgtgcagtgactgtctgctactaagtaaactataattgtaattaatttcgttctgtatcctctcaggacaagcatgctgcatcaggaaaacagtgaggcttttgttaggcaccactctgaacagcttgcatgtggcagcataaggggagcagataccagtcgtccaaatttccttcctgagaaatgccagattgcagtttgtcagagagatgaaatggttggctcattcgatgaagacttggtgcatggtgttcatctagtaaatgcttctgttcagtcaccgttggtggcaagtggtgtcaaagaagcgcctacagtggaccataacaagagacatgcatccagtgacatgacggacatggttgaatgcaaacggcagaagcaggaagatcaaattacacctaaggagggcaactatacaagtgctgatgtggatgttcatcagtatcccacatacacaacacatgaaagaagctttggctcgccgatatatgagagtgaggaaagtgaagatgagggtgtagattcacctgtgcatttttcacttgctcatacgtatattgaagatgatctatggcctggcggctttcatcaatctgtgggaccttgccccacaaggaaacttgttcctcttggaccaaatcatcaggctgaattacctgagtataggccatttggtggaaaagcggaagatgacgagagtaacaagtggatcagaaacagtgtcatgccaatgcctggtactgttgcattgtctttgatgctgaaacctgttcactgcaaggcaggctgtgattgtgttgatgaagactcaatcaattgtgtgaggaagcatgtgagggaagcaagagaaaagctgaaggtttccgttggtgcagacaccttcagggagttgggtttctatgatatgggagaggaggttgcctcaagatggactgaagaggaggaacatctgttccaggaagtggtctcgtcaaatcctgcttctctgcgcagaaatttctgggatgaactccctcttgccttcccatccaagtccagcaaagaactagttagttactacttcaatgtcttcatgttgaggaagagggctgagcagaacaggtttgatccaatgaacattgacagtgacgatgatgaatggcaagcaggtggtgatggtgagttcacagtcacaggaagagctgacgaatacttgacaactgagtcccttactgatcaagatgatgtcgcatgcaatcgagttcctccagagggggatttctatgaagattctgaggatgaggatgatggtgccagtggagacaggcatgatggcgtgcagaggggcctcatgccagaggatcttgctgtcatgtcgtttatggatcataatcaacagaagttcaagctagatccagatgcacaagatgactcatgcacatcatttgaggctcatcaggctggcgttgaaggtgggacgcctactgatattgctgaagaccaccactacaggagtgatggttttgctggtgatgcagaacatgggttcttcggagaccattgcgacacaaaaggttgggagtttggtttcactacagggtgggataagcatgattttctgtcaacaaacaatgtcattgaagaggtgtttggaaaggattctagcgaagatggaagtgacactgccagtggccaggaccttatctgagccagagatgaaggcttcatttcaactgtgaaagctttagcagttccccccttgcctctcggaatctgtacagcagtagttcaccattttgatttaatgcctcacttgttctttataggaatctctcatcccctgtccctggaacatcacctgcttgagaaacctgattttggtctcatgattaatgtaaatccgtaggtgatatttgtcatcggtcgatgatctgctgtagcctgtagcatgtacgtattgttgttgtccatctctgtgttctggcctgagcattttttttccatatgctagcgagggtcatgtaataaaagctgttattgctccttgagccgtgagggtgggataaaagcatttttttccgtctcatagtgatttgccacgttgatggttcggtgcaaaaaaaaaaaaaaaaaaaa

SEQ ID NO: 6948 - protein, 538 aa, Panicum virgatum
  misc_feature: Ceres CLONE 1893058
  misc_feature (1)..(51): Pfam Name: Myb_DNA-binding Pfam Description: Myb-like DNA-binding domain
MLHQENSEAFVRHHSEQLACGSIRGADTSRPNFLPEKCQIAVCQRDEMVGSFDEDLVHGVHLVNASVQSPLVASGVKEAPTVDHNKRHASSDMTDMVECKRQKQEDQITPKEGNYTSADVDVHQYPTYTTHERSFGSPIYESEESEDEGVDSPVHFSLAHTYIEDDLWPGGFHQSVGPCPTRKLVPLGPNHQAELPEYRPFGGKAEDDESNKWIRNSVMPMPGTVALSLMLKPVHCKAGCDCVDEDSINCVRKHVREAREKLKVSVGADTFRELGFYDMGEEVASRWTEEEEHLFQEVVSSNPASLRRNFWDELPLAFPSKSSKELVSYYFNVFMLRKRAEQNRFDPMNIDSDDDEWQAGGDGEFTVTGRADEYLTTESLTDQDDVACNRVPPEGDFYEDSEDEDDGASGDRHDGVQRGLMPEDLAVMSFMDHNQQKFKLDPDAQDDSCTSFEAHQAGVEGGTPTDIAEDHHYRSDGFAGDAEHGFFGDHCDTKGWEFGFTTGWDKHDFLSTNNVIEEVFGKDSSEDGSDTASGQDLI

SEQ ID NO: 6949 - DNA, 1902 bp, Panicum virgatum
  misc_feature: Ceres CLONE 1893231
  misc_feature: Encodes the peptide sequence at SEQ ID NO. 6950
aaaagggcccaaaagcccagcgagcccagccaccatgttcgtcttgcggatccagtccgtcgacttcctcaccgcccccgcctccccggccgccgtcgccgccgacgaggtcggcaccagcggcggcgccacctccaacccactctccccgacctccagccaccctcccgcctccaccatcacgtcctccatacctccactggagctccccggcgcgacctccgcggcgtccgcccgaagccctaggatccaccacacccgcggcgtcatccacctctaccactcgtcgtcgtccacctccaacacctcctcctcctacgcctcggccgtcgccgccacctcgtcctcctcctccgggccggccgccccgcagcccgcctccgactcgcttctcccgccatggcgcggcacgcagctcctggtgctcgccgtcccgacgcgcgtttcgccggacgactttgtccgcttctgcggcccctacctcgagcgcgcgtcagacatccgtttcgtcagggatgatggagtggaggaccggtacagtgtcctagtggagtttgaggatcagaagagcgctgatgggttctacctggacctcaatggctggaggttctcatcctcggagggagaggtttgccatgttctgtttatagcagctgtgcagtatacaccctcctcggaggttgccacaactccaccggttggatccaccgaacttcccatatgccctgtttgcatagaaagattggatcaagacatcagtgggattttggcaactacgtgtgatcactccttccagtgttcatgtgtttcagtgtgggtcaattcatcttgtccggtatgtcagttttgtcagaagcagtctgaagattctacttgctctgtttgccaaacctccagaaacctctggatatgtgtgatttgcggttttgttggatgcggaaggtatcaagaaggccatgcaaaacagcactggaaagacactcagcactgttattcactagatttggaaacacagcgtgtttgggattatgttggtgacagttttgtccatcgattgaatcactcaaaaagtgatgcaaagcatgctaagttcaagtcaaaatgtaaatactctggggatgactgtgtgaactgctcgtgcgatgatgactccgacatgggtggagctatgttcagcagcaaagctgaaacaattgtggatgagtacaatcggctcctggcaagtcaacttgaaactcaaagagagtattatgagggccttttatctgaggctaaaagaaacaaggaacgtgtcatttctgaagctgttgacaaagctgtaaatgataagcttcaagagctccaagataagcttgagaacctaatggtggagaaaaagaaagttacagatatgaatgaaaaactcactaggagccaagacatgtggcgtcagacattaagagatattgaggaaagggaaagaacacagttgaagttgaaggatgaaacaattcgtgatctggaagaacagataaaggatttcaagttttccattaagttgcagaagtcaatagagaagaacgatggtgtcaagggtggtacgctggtgccacttcctacggtttcagattctggaggcaagggtaaaaggtcatcaagaacaagcaagaggaggaattagtaccctcctgcagttatcgtacatagtggtgctttggttgttgactacttagcagcttatagtcctgactggaggcttgcgtgtgtagtaaggtcctgctctgatggagtgcggatcaaatgtgatgtcaacgtcatatatccttgaggaggaaaaaagtgtgaatacagactcccaaacattttttaattttgaatacagtatgcagctcatttgtaaaacaaaaaaaaaaaaaaaaaaaa

SEQ ID NO: 6950 - protein, 541 aa, Panicum virgatum
  misc_feature: Ceres CLONE 1893231
  misc_feature (1)..(40): Pfam Name: zf-C3HC4 Pfam Description: Zinc finger, C3HC4 type (RING finger)
  misc_feature (281)..(317): SWISSPROT Homolog: EC 3.1.2.15 Ubiquitin carboxyl-terminal hydrolase 3
MFVLRIQSVDFLTAPASPAAVAADEVGTSGGATSNPLSPTSSHPPASTITSSIPPLELPGATSAASARSPRIHHTRGVIHLYHSSSSTSNTSSSYASAVAATSSSSSGPAAPQPASDSLLPPWRGTQLLVLAVPTRVSPDDFVRFCGPYLERASDIRFVRDDGVEDRYSVLVEFEDQKSADGFYLDLNGWRFSSSEGEVCHVLFIAAVQYTPSSEVATTPPVGSTELPICPVCIERLDQDISGILATTCDHSFQCSCVSVWVNSSCPVCQFCQKQSEDSTCSVCQTSRNLWICVICGFVGCGRYQEGHAKQHWKDTQHCYSLDLETQRVWDYVGDSFVHRLNHSKSDAKHAKFKSKCKYSGDDCVNCSCDDDSDMGGAMFSSKAETIVDEYNRLLASQLETQREYYEGLLSEAKRNKERVISEAVDKAVNDKLQELQDKLENLMVEKKKVTDMNEKLTRSQDMWRQTLRDIEERERTQLKLKDETIRDLEEQIKDFKFSIKLQKSIEKNDGVKGGTLVPLPTVSDSGGKGKRSSRTSKRRN

SEQ ID NO: 6951 - DNA, 2013 bp, Panicum virgatum
  misc_feature: Ceres CLONE 1893302
  misc_feature: Encodes the peptide sequence at SEQ ID NO. 6952
atccatctaccggtataaacccgctcggctcgacgccgcaagcttccctccctccatatccctcccagcaggagctagctccccaagtcgacaagtccccctcccccacctaacgttacgccggccggtcagcctccagtccacggcgcgcccgcgagctcgacgtctcgacgcttccacttgccgagggccgggggccgcagagcctcaagttcaccgcgcgcgcgagagagcgttttcgaacctcggctcttccagccgccgagagccgcgggcccggccggcggcagctaactccggcgtcgacgcccgttggtactacggcggcgggcgggcgcaaccggaggggcgcgacggcgggtggcggtggaatgctgatggggaagtacgagatggggcggaggctcggggagggccacttcggcaaggtgaagctggcgcggcacgccgagacgggccgcgccttcgccatcaagatcctcgaccgccagcgcatcctcgccatgaagatcgacgagcagataaagagggagatcgccacgctgaagctgctcaagcaccccaacgtcgtccggctgtacgaggtttcagcaagcaaaacaaaaatatacatggtccttgagtatgtaaatggaggagaactatttgataaaatcgcattgaagggtaagctgacagagaaggaagggagaaaactattccagcagctaatggatgccataggctattgccacgagaagggggtctaccatagggacctgaagcctgagaatgtccttgttgatgcaaaaggaaacataaaggtttctgatttcggactaagtgcacttccgcaaaatcaacggaaagatggtttgttgcatactacatgtggcagccctaactacatagcccctgaggtccttctgaacaaaggttatgatggctcgatgtcggacatatggtcctgtggtgtgattctgtacgtaatgcttacagggaatcttccatttgatgaccaaaacatggttgtcctttaccagaagattctgaaggggaatgctcacattccaaaatggctctcacaaggtgcccaagatatactgcggaaaattctggatcctaaccctattacccgcatagacttggatggaataagggcacacaattggttcaagcaaggttatgctcctgctgtgccatttaatgatgatgaagatatcagtatgtctgaaggcagcctaaatatgactgagcataatggcattcaaggcaacatagcaatcaaccaaatcaatgctttccagctcattgggatgtcctcctgccttgatttatccggattttttgagaaagaggatgcttcggaaaggaaaatcagatttgcatcaaatcattccccggcttatttatttgagaagattgagagcattgtcagaaaaatggggttgcaagtacataagagcaatggcaagctaaaagtgagccaagattgcaagggaccagcaaattccagagggctagaatcattattagtttctgcagaggtgtttgagataaatgaatctctttatgttgtcgagctaaagaagtcatctggagactgctccctgtacagaaagttgtgtgagacgctttcagaggacttgggaatatgcaaaagccagcaactcctaaagcaagattctatcaaacaagaaatagttagatataatagtagcttctaacaaagagccccttactaactaggctgtagacagaaactaacgcaaacaatatactgaattttaaacagtatattgtccatgcacctattacaaatgtgctctcttacgccttttttcatgaatctagccttaagaggcttagattacgtcaaattggcaactgacatgtatggaactcctcctaagcaataatatgatgtaaacaagtaaactatacatatatgagtttcagagttacctggtctctgtttatcttacatattgataaatgaatgtaagattctttgaaaaaaaaaaaaaaaaaaaa

SEQ ID NO: 6952 - protein, 444 aa, Panicum virgatum
  misc_feature: Ceres CLONE 1893302
  misc_feature (1)..(426): SWISSPROT Homolog: EC 2.7.11.1 CBL-interacting serine/threonine-protein kinase 1
MLMGKYEMGRRLGEGHFGKVKLARHAETGRAFAIKILDRQRILAMKIDEQIKREIATLKLLKHPNVVRLYEVSASKTKIYMVLEYVNGGELFDKIALKGKLTEKEGRKLFQQLMDAIGYCHEKGVYHRDLKPENVLVDAKGNIKVSDFGLSALPQNQRKDGLLHTTCGSPNYIAPEVLLNKGYDGSMSDIWSCGVILYVMLTGNLPFDDQNMVVLYQKILKGNAHIPKWLSQGAQDILRKILDPNPITRIDLDGIRAHNWFKQGYAPAVPFNDDEDISMSEGSLNMTEHNGIQGNIAINQINAFQLIGMSSCLDLSGFFEKEDASERKIRFASNHSPAYLFEKIESIVRKMGLQVHKSNGKLKVSQDCKGPANSRGLESLLVSAEVFEINESLYVVELKKSSGDCSLYRKLCETLSEDLGICKSQQLLKQDSIKQEIVRYNSSF

SEQ ID NO: 6953 - DNA, 2420 bp, Panicum virgatum
  misc_feature: Ceres CLONE 1893452
  misc_feature: Encodes the peptide sequence at SEQ ID NO. 6954
aaccccttcctccgctttcccttcgcgcgcacgcctcctccgcgatttcgtcgagcaccccccgcgccgcgccgcgccatgccgccgcccgccggcgcgtcccgctccggcgccggctccgaagaacccgagtccccggcggcgcgccgcctccgccgcctctccctgcacctcctccacctcgagccctcccccgccccggccgatcaggcggcgggcccggcgctggcccccgcggcgtgcgcgaggcgggtgcggcgcgtcgagggcggcgcggacgtggcggcggcgctggcggcgtacctgcggggccggcaccgcgcggcgcagctgcggctgttcgacttcctccgcgcgcgcccggacctgcagacgcccgtggagctcgccacggccgcgcaccgggagctctgcttccgccagctgcgcgcgctggtgcgggacgccggggtgcgcccgctcacgctcatggccaccgaccccgccgagtacttcgccgtcatggaggccgccggcggcgccgacatctccctcggcgtcaagctgggcgtccagtacagcctctggggaggttctgtcataaatttaggaaccaaaaagcacagagataagttctttgatggaattgacaatttggattacccaggctgttttgcaatgacagaactgcatcatggatcgaatgtccaagccctacagactactgctacatttgatactgttactgatgagttcatcattaacacccccaatgatggggctattaagtggtggattggcaatgctgcagttcatggaaaatttgctactgtctttgcaaggttaattttgccccttcaaggaaaaggaggagaacctgctgatatgggcattcacgcattcattgtccccatacgggaccttgaaactcatgctgttcttcctggaatcgagatcaatgactgtgggcacaagataggcctgaatggtgtagacaatggtgcactgagattccgctcagttaggatacccagagataatcttctgaaccggtttggtgatgtctcacgagacggaaaatacacaagcagtctccccacaattaacaaaagatttgcagcaacccttggggagcttgttggtggacgagtcggtattgcatactgttctgttggtgtgctcaaagttgcagtaacaattgccgtgaggtatgctcttctgcgccaccaatttggtccacctaagcagcccgaaatcagtgtgttggactatcagtctcaccagcacaaattaatgcccatgttagcatcttcatatgcgtttcactttgccacagtccaattggtggataagtattcagaaatgaagaaatccaacgatgaggatcttattgctgacgtgcatgttctttcatctggattgaaagcttatataacttcatatacagcgaagtctataagcatatgcagagaagcatgtggtggccatggttatgctgctgtaaatcgttttggagcactgcgcaatgaccatgatatattccaaacatttgagggggacaacacagttcttctgcagcaggttgctggagatctcttgaagcaatatcaggagaaatttaagggaggtacactctcagttacctggaattacttgagagactccatgggtacctacctatcccagcctaatcctgtcactgcccgatgggaaggggaagatcatctgcgggatcctaatttccagctggatgccttcagatatcggacatctcggttgctgcatagtgttgctgctcgacttcagaaacacagcaagacgcttggcggttttggcgcatggaacagatgtttgaatcatctcctcacacttgcagagtcacacattgagtctgtgatccttgcaaacttcattgaatcagtaaaaagttgccctgatgaaaaaacacgggaggtcctaaagcttgtgtgtgacctttacgcgctcgataggatctggaaagacattggaacataccggaatgtagactatgttgccccaaacaaagcaaaggctattcacaagttgacagactaccttagctaccaagtgaggctcgtggcaaaagaactcgtcgacgcatttgatcttccagatctcatcattcgtgccccaattggcatgcaatcagaggcttatgcacagtatactcaatatgttggcttctaaacggtataaatattaacatagctgggataagttcatatatgcaccaagttgcaatgaagtgtatagatgggaaaataagtttatccgtgctcatataaataactgtaaagccgggccttctgtgaataaactatcagattgctttttcggcacaattgttttcatggacagtattgtcactcaggaagaaaaatcagtctaaaacatgaatggtacagccttgatgtctgctc

SEQ ID NO: 6954 - protein, 702 aa, Panicum virgatum
  misc_feature: Ceres CLONE 1893452
  misc_feature (1)..(159): Pfam Name: ACOX Pfam Description: Acyl-CoA oxidase
  misc_feature (1)..(60): Pfam Name: Acyl-CoA_dh_M Pfam Description: Acyl-CoA dehydrogenase, middle domain
  misc_feature (1)..(165): Pfam Name: Acyl-CoA_dh_1 Pfam Description: Acyl-CoA dehydrogenase, C-terminal domain
  misc_feature (1)..(702): SWISSPROT Homolog: EC 1.3.3.6 Acyl-coenzyme A oxidase, peroxisomal precursor
  misc_feature (21)..(702): SWISSPROT Homolog: EC 1.3.3.6 Acyl-coenzyme A oxidase 2, peroxisomal precursor
MPPPAGASRSGAGSEEPESPAARRLRRLSLHLLHLEPSPAPADQAAGPALAPAACARRVRRVEGGADVAAALAAYLRGRHRAAQLRLFDFLRARPDLQTPVELATAAHRELCFRQLRALVRDAGVRPLTLMATDPAEYFAVMEAAGGADISLGVKLGVQYSLWGGSVINLGTKKHRDKFFDGIDNLDYPGCFAMTELHHGSNVQALQTTATFDTVTDEFIINTPNDGAIKWWIGNAAVHGKFATVFARLILPLQGKGGEPADMGIHAFIVPIRDLETHAVLPGIEINDCGHKIGLNGVDNGALRFRSVRIPRDNLLNRFGDVSRDGKYTSSLPTINKRFAATLGELVGGRVGIAYCSVGVLKVAVTIAVRYALLRHQFGPPKQPEISVLDYQSHQHKLMPMLASSYAFHFATVQLVDKYSEMKKSNDEDLIADVHVLSSGLKAYITSYTAKSISICREACGGHGYAAVNRFGALRNDHDIFQTFEGDNTVLLQQVAGDLLKQYQEKFKGGTLSVTWNYLRDSMGTYLSQPNPVTARWEGEDHLRDPNFQLDAFRYRTSRLLHSVAARLQKHSKTLGGFGAWNRCLNHLLTLAESHIESVILANFIESVKSCPDEKTREVLKLVCDLYALDRIWKDIGTYRNVDYVAPNKAKAIHKLTDYLSYQVRLVAKELVDAFDLPDLIIRAPIGMQSEAYAQYTQYVGF

SEQ ID NO: 6955 - DNA, 1979 bp, Panicum virgatum
  misc_feature: Ceres CLONE 1893468
  misc_feature: Encodes the peptide sequence at SEQ ID NO. 6956
aagagggaaagggtaggtgaaagaactgaaggcgagcgcagagcccggcagcccgcccacatgctttgcccctgccaatggtaactggtaagtggtagcccacctggatctcggatcctcgccgcctctcatctgcgtctgtttcttctgctcttccggacttcgatcggacggagcgttcctggctccgtccctccgttggtacccggtgaggatcaggaagacttcatcggtaagataggtaaggaagtgcccgcctttccgcagccgtgtcgagctttcaggtcatgtccggcggcgcagatttttgcttaccattcctagcaactcgatcgagaattcgttctgaacgtggatcgcattcctcggtagagaatttagaaatgggtccctcgggctcaggccagatttctcttgaaactgtgggtggtgcggccactggccgccacccgttcgatggaatgtctcattcactgttccatctgttctcggtcagtctcaagtgtttccttttttcttctcttttttggtcaccaagcagcgatggcgccgccgatctccacaagacagcctctgcggattgctttgacgccaaacagtggtaagcttttaaacgtttttttcctgatgcatcagcgatatggctatgagcccatgagctttcgaaacccaattaggtggtaagctaagctaaactttgaataatcaccgtatccatagttcttctctatctggtccctgcttgatttaggtgcaagctctgcagcgtaaaatgcgtcttgactatcttcttgcatgtttcagttcatgcgaatacccttgtgtaaagtttggagcttaatttttttctcaagtactatttgttttggccataacaaatgttttgtttttcactaatcaggacggtggatggaaattgtaagctgtatagttttaatattcttggttttccttgtcttatatatgatgaagggattgttagatgaactcaaggttacaataagcttcctatattttgacaatgagaacccaattaatttttgatgtgcttctttcacatttggtatttttcagtcattgccacgtctgaattttgtgatgatacaagctcttttagttcttatactcagtaccttttgcagggcacctgagatcatctgcagttagaataacctgttttgctaagcaaactattactcccaaacctttatcatctagtttggacgaggccaaaagaaatgagcctgtagtcaaaatgtgtggcattacatctgcaagggatgccgcaatagctgcaaaggctggcgctaaacttattgggatgattctttggcccaattccaaacgctcggtcccattatctgaggccaaggagatatcccgagtagccaaatgttacggggctgaaccagttggcgtgtttgtagatgatgatgaagagaccatcttgagagcgtccgattcatgtgaccttgaacttatccagctccatggagatagctcccgagaactacttcctgtgctttggaagaataatcgaattatatatgtgcttaatgttgaagaggatggtaaacttatcaatgctcctccaagtgaagaatatgttgtcgattggtttttggtggacagtgcaaagggtggcagtggcaaagggttcaactgggagaaattccaaatgccatctgtcaatagcaagaatggctggctattagcaggaggccttcacgaggacaatgtatgccaagctgcttctgctctaaatccagatggcctggatgttagcagtggcatatgttatcctgacggtttacggaaggaccctgagagaatacattccttcatgagcagagtaaaaaggttgagtccccagtaaactgaaactgcagtttctgctctttctatcatagttttcttggtccagtatctcgaacttgaataaatagcattccttgataatgaaaataaatggagtccac

SEQ ID NO: 6956 - protein, 206 aa, Panicum virgatum
  misc_feature: Ceres CLONE 1893468
  misc_feature (3)..(199): Pfam Name: PRAI Pfam Description: N-(5'phosphoribosyl)anthranilate (PRA) isomerase
MCGITSARDAAIAAKAGAKLIGMILWPNSKRSVPLSEAKEISRVAKCYGAEPVGVFVDDDEETILRASDSCDLELIQLHGDSSRELLPVLWKNNRIIYVLNVEEDGKLINAPPSEEYVVDWFLVDSAKGGSGKGFNWEKFQMPSVNSKNGWLLAGGLHEDNVCQAASALNPDGLDVSSGICYPDGLRKDPERIHSFMSRVKRLSPQ

SEQ ID NO: 6957 - DNA, 2040 bp, Panicum virgatum
  misc_feature: Ceres CLONE 1893648
  misc_feature: Encodes the peptide sequence at SEQ ID NO. 6958
atcgcccgctctctccacttccggtcactggtaacgcgcccactcgctccctcgcatcacactctccacctcctccgccctccataactccccccgcgcgcatgggcgatccccgggcccgcccgtccgccgcggccgccggcgagctgcggccgccggagccgccgctggacccgctcgagttcctctcccggtcctggagcgcgtccgggggcgcgttcacgccgccgccgcccacgccgcccccggccgcgctcgtcagccccatcgccgaggacgccgcgtgcgagctcgaggactgcggggccgccgccgcggccgggagctccttctccttcgcgtccgcggccacgtcgcagctcatcatggaacggatcctcgcgcaatcccaggaagtggcgccactcgcctccggccggctctcgcacagcagcggccccctcaacggcggcggctccctctccgacagcccgccggtctcgccggagatcgatgacgcaaagtactgtagagcagtgagcacgccgaagcctcaggcgtaccggcccggcaacaagacggtgggcaggtggctcaaggatcggaaggagaagaagaaagaggagacgcgggcgcacaacgcgcaggtccacgccgccgtctcggtcgcggcagtggcagctgcggtggcggccgtagctgctgcgaccgctgcggcgtcagggtccggcaaggacgaccgcgccgctcgcaccgacatggctgtcgcctcggcggctacgctcgtagccgcgcagtgcgttgaggccgctgaggccatgggtgccgagcgcgagcacctggaggccgttgttgggtccgccgtgaacgtccggacgccaggggacatcgtcacggtcacagctgccgctgccactgcgttgagaggcgcggcgacgctgaaggcgagggctctgaaggaggtgtggaacatcgcggcggtgatcccggtggagaagggcgcggtgggcggcggcggagggcaccaccagaggcacggcgcgccgaagcagcagcaccgcaagctggagagcaacggcagcagcatcagcgacgacgtctcgctggaggaggagaacaacttcctgggcatctgcagccaggagctgctcgctcgcggcaccgagctgctcaaacgcacccggaaaggcgccctgcactggaaggctgtgtcggtgtacatcaaccggatgggcctggtgatgctgaagatgaagagccggcatgtcgccgggacgatcaccaagaagaagaaaagtgtggtgatcgacgtgtgccgcgacgtgccggcgtggcccgggcggcacctgctggaggacggcgagcaccggcggtacttcggcctgcgcacggcggagcaccgggtgatcgagttcgagtgcaccagccagcgcgagcacgagatgtggaccaagggcgtggcgcggctcctcagcctcgccggcgaccggaagcgcctcgcgtgacagacgccgacccaacctacccccggtcgccgtcgccgtcgccgtcgccgccaacctgccgacgccccccgcccgcggtggcctgggcccctcgtcaccaccgccccgtttgttgtttgctaggctgttagatgctgcgagaccggcggaggcagcagcgcgacatgggcgcacagattttgtgtagctaggtttgggggatcctgttgctgttagggcacaagattgggcgagtcaatcgatggcggtgtggttttctggggaatgcgacgccggtgcatgggatgccaaccctcagcgagtcagtggcgagattaagggcagcagcgcttgcagatgtctctgcctgactgcctgtgctcttccctcttgctctgtctttctttttttttttgtcttcgttctctggtttggggtgtggccatactggaactgtagcaggcaaaaagataagtgctttgttctggtagtattagtagtagtaactctgtagttaccgtagtaatcaccgggtaaactaagcacatgttcattccaaaaaaaaaaaaaaaaaaaa

SEQ ID NO: 6958 - protein, 460 aa, Panicum virgatum
  misc_feature: Ceres CLONE 1893648
  misc_feature: The sequence is a functional homolog of  SEQ ID NO 224 in the  10/225,066 US patent application
  misc_feature: The sequence is a functional homolog of  SEQ ID NO 2372 in the  10/374,780 US patent application
  misc_feature: The sequence is a functional homolog of  SEQ ID NO 430 in the  10/666,642 US patent application
  misc_feature: The sequence is a functional homolog of  SEQ ID NO 929 in the  11/479,226 US patent application
  misc_feature: Useful for making plants with modulated growth and phenotype characteristics
MGDPRARPSAAAAGELRPPEPPLDPLEFLSRSWSASGGAFTPPPPTPPPAALVSPIAEDAACELEDCGAAAAAGSSFSFASAATSQLIMERILAQSQEVAPLASGRLSHSSGPLNGGGSLSDSPPVSPEIDDAKYCRAVSTPKPQAYRPGNKTVGRWLKDRKEKKKEETRAHNAQVHAAVSVAAVAAAVAAVAAATAAASGSGKDDRAARTDMAVASAATLVAAQCVEAAEAMGAEREHLEAVVGSAVNVRTPGDIVTVTAAAATALRGAATLKARALKEVWNIAAVIPVEKGAVGGGGGHHQRHGAPKQQHRKLESNGSSISDDVSLEEENNFLGICSQELLARGTELLKRTRKGALHWKAVSVYINRMGLVMLKMKSRHVAGTITKKKKSVVIDVCRDVPAWPGRHLLEDGEHRRYFGLRTAEHRVIEFECTSQREHEMWTKGVARLLSLAGDRKRLA

SEQ ID NO: 6959 - DNA, 1711 bp, Panicum virgatum
  misc_feature: Ceres CLONE 1893657
  misc_feature: Encodes the peptide sequence at SEQ ID NO. 6960
gtccgtgctctgcagcagctgttcctcggaggctcaaagcacgcctcacactggcagcatcttgtgatctgtctctcccctctcccctcacatttcccaacacctggagtaccgaggtaggagcacaagcagaggcacctacctctcttgctggctgcttccaacatctgggcacaattatctggattctagaccagaaactctcatgtagatcccctgctccagtctgctgctagaacttggcaatctcaggaggactgtctgagatagaagttgctgagatttgcccagggttggggctcaatcctcttccccttcagcagttcagcccgccagtgttggttgcctcttgttagttgttactgtgtttctgtcttccatggcggcggtggcgtcgtcttctcctccagcaacaattgttgggccgcagccgacgtgggtgccctatgagccaacccgagactgctcccagggcctctgcagcatgtactgcccgcagtggtgctacttcatcttcccgcccccgccgccggccttcgacctcggtggccccggcagcgacgactcctccggccccaccttctcgcccctcgtcatcgccatcatcggcgtgctcgccagcgccttcctcctcgtcagctactacaccatcatctccaagtactgcggcaccttgagctccctgtggaacaggctgttcggctccggcaggggccgtggccatggcgccgacggtggcggtggtggtggcggcggcggcggctcgcggagtcaggagccgtggagcgccgtgccgtcggacgggctggacgagacgctgatcaacaagatcacggtgtgcaagtacaagcgcggcgacgggttcgtggacagcaccgactgctccgtctgcctcggcgagttccgggacgacgagagcctccggctgctccccaagtgcagccacgccttccacctgccgtgcatcgacacgtggctcaagtcgcactccaactgcccgctctgccgctgcaacatcgcgttcgtcgccgtcggcgtggtgtcgccaccgccggagccggaacgccgcggcgcgcgggaggaccgggcagacagcctcgagctggtcctgaccatagacgactactcggagcaggcgcgcgacgagccccaggatcagaatgcggcgagcggcaacggcagcggccaggaggcgccgaaagattgtccagggagatcggaggaggccagcggcattgtcgagatcaaggaggacggcgcgccgccagtgagggcgtcgtcgtcgctgtcggacacgcaccgcgagggccgcatgtccatcgccgacgtactgcaggccagcctggaggacgaactgatgatggcccgggagagcggcctcctggcaggctcctcggggacggggtcgtcaagacggctccacggggaacacagcaacaaggacggcggcggcggccgcagcggccgcgcattgccggatgcagccaaaagactgccgtcggtgggaaggtcgtgcttcagtagcaggagcggcaggggaaaggattcggttcttccgatgtgaggccattgattctgggtggttcttcttctgactaggatacatgacatcgatactctttttgtgtgtgtgcgtgtgcttccggtgaagataagtgccaattgctcgtgtactcttttttagttcccaaaatgaaaattttttgatgtc

SEQ ID NO: 6960 - protein, 394 aa, Panicum virgatum
  misc_feature: Ceres CLONE 1893657
  misc_feature (1)..(42): Pfam Name: zf-C3HC4 Pfam Description: Zinc finger, C3HC4 type (RING finger)
MAAVASSSPPATIVGPQPTWVPYEPTRDCSQGLCSMYCPQWCYFIFPPPPPAFDLGGPGSDDSSGPTFSPLVIAIIGVLASAFLLVSYYTIISKYCGTLSSLWNRLFGSGRGRGHGADGGGGGGGGGGSRSQEPWSAVPSDGLDETLINKITVCKYKRGDGFVDSTDCSVCLGEFRDDESLRLLPKCSHAFHLPCIDTWLKSHSNCPLCRCNIAFVAVGVVSPPPEPERRGAREDRADSLELVLTIDDYSEQARDEPQDQNAASGNGSGQEAPKDCPGRSEEASGIVEIKEDGAPPVRASSSLSDTHREGRMSIADVLQASLEDELMMARESGLLAGSSGTGSSRRLHGEHSNKDGGGGRSGRALPDAAKRLPSVGRSCFSSRSGRGKDSVLPM

SEQ ID NO: 6961 - DNA, 1758 bp, Panicum virgatum
  misc_feature: Ceres CLONE 1893767
  misc_feature: Encodes the peptide sequence at SEQ ID NO. 6962
ctcactctagctgtgccccacacctcgtctctcccaccggccccgttcactcagatctcagccaatcggccatggcggcggcacctaccccagcgccggcgccgcacgtgctactcgtccccttcccagcgcagggccacgccctgccgctcctcgacttcgtcgccctcctcgccgcacgcggcctccgtctctccgtcgtcaccaccccagcaaacctccaactcctctcccctctcctcgccgcgcaccccgcctccgtcagcgccgtcaccttccggttcccctcccacccggccctgcccccgggcctcgagaacaccaagggctgcggcccggggcagttccccaccttcatccacgctttcgccaagctgcgcgagcccatcctcgcgtgggccagggcgcagcccaatcccgtcgtcgccgtcgtggccgacttcttctgcggatggactcagccgctggcccgcgagattggcgccgcggggatcgtgttctcgccgtccggcgccctcggcaccgccgtcatgcactcgatcttccgccgcctggttaggcggcctgcggacagcgacgacgggttcaccgtcgcgttcccggcgattccaggcgagccgtcgttccagtggagagagctcttgatgatgtacgcgaactacatggccggcaagctggaggagcaggtcggcgcgtcggtgaggcagaacttcctctggaacctgcaggagagctggggattcgtgtcgaacacgttcaaggcgctcgaggggagatacctggaccagccgctcgaggacctggccttcaggcgcgtctgggcggtgggccccgtggctccggagacggacgccgccggcgcccgcggcggggaggcagctgtcgcggccgccgatctcatggcgtggctggacgcgttcccggaaggctcggtcgtgtacgtgtgcttcgggagccaggcggtgctgaccccggccgtggcggcggcactggccgaggccctggagcgcagcgccgtgccgttcgtgtgggtcgtgaacgccgggaacagcagcgtggtcccggacgggttcgaggcgcgcgtcgcggggcgcgggctggtggtgcgcgggtgggcgccgcaggtggcggcgctgcggcacgcggcggtggggtggttcatgacgcactgcggctggaactcgacgctggaggcggtggccgcgggggtgcccatgctggcgtggcccatgacgggcgaccagttcttcgacgcgcggctgctcgtggacgaggcccgcgtcgcggtgcgcgcgtgcgcgggcggcgtcggcatcgtccccgacgcgggcgagctcgcctccgtgctggccgacgcgaccggggagaaggggcgcgacatgagggcgcgcgccaaggagctcgcggcggaggccgcgcgcgcggtgaaggaaggcgggagctcctacgctgatctggacgggttggtgcaggagattcggaagcttggttgagctgaattcaggcggtttgacataggttcagctgcaagcctgcaactatcttcagatactggtagcatatcggttgagaataacagaaggtaagaaagatcgagtgcttttagggagcattggcaaaagcacaaattcgctgtggtctgcagaacaattcgaggcttcagtaactaccatttgccattcttgcagacaaatgattgtcttcaatttcgcactgaatagtttggctgtatgctcgcaaaaaaaaaaaaaaaaaaaa

SEQ ID NO: 6962 - protein, 473 aa, Panicum virgatum
  misc_feature: Ceres CLONE 1893767
  misc_feature (1)..(112): Pfam Name: UDPGT Pfam Description: UDP-glucoronosyl and UDP-glucosyl transferase
MAAAPTPAPAPHVLLVPFPAQGHALPLLDFVALLAARGLRLSVVTTPANLQLLSPLLAAHPASVSAVTFRFPSHPALPPGLENTKGCGPGQFPTFIHAFAKLREPILAWARAQPNPVVAVVADFFCGWTQPLAREIGAAGIVFSPSGALGTAVMHSIFRRLVRRPADSDDGFTVAFPAIPGEPSFQWRELLMMYANYMAGKLEEQVGASVRQNFLWNLQESWGFVSNTFKALEGRYLDQPLEDLAFRRVWAVGPVAPETDAAGARGGEAAVAAADLMAWLDAFPEGSVVYVCFGSQAVLTPAVAAALAEALERSAVPFVWVVNAGNSSVVPDGFEARVAGRGLVVRGWAPQVAALRHAAVGWFMTHCGWNSTLEAVAAGVPMLAWPMTGDQFFDARLLVDEARVAVRACAGGVGIVPDAGELASVLADATGEKGRDMRARAKELAAEAARAVKEGGSSYADLDGLVQEIRKLG

SEQ ID NO: 6963 - DNA, 2489 bp, Panicum virgatum
  misc_feature: Ceres CLONE 1893772
  misc_feature: Encodes the peptide sequence at SEQ ID NO. 6964
agagggccttggcctcgccggctcgcccccgttcttatctcccactcgtgccgcctcccccccaccaccccccctaccctatccttctcctctccctcttgccgcgctcctctcctacctcccctcttgcctctcccaggtcatggcaaaactggagcagcaggggaaatagcagcagcaagtgggagatagactgggagctaggtgaatactacaggtagcagtacagggaaggaaagtctatctgccttgtgactgcgagtgagtttgccgccgtgtctgttgaggtcacgatgatgggaggtgggctgatgatggatcagggcatggtgttccctggcgtccacaatttcgtggatctcctgcagcagaacggcgacaagaacctcggctttgggtcgctgatgccgcaaacgtcgtccggcgaccagtgcgtgatgggcgagggcgaccttgtcgatccgccgccggagagcttcccggatgccggggaggacgacagcgatgacgacgtcgaggacatcgaggagctggagcgccgcatgtggcgcgaccgcatgaagctgaagcggctcagggagctgcagcagacccgcggcaaggaccaggcggctgccggcggcggtgggggcgatgggtcctccaagccgaggcagtcgcaggagcaggcgcggcgcaagaagatgtcccgcgcgcaggacggcatcctcaagtacatgctcaagatgatggaggtgtgccgcgcgcaggggttcgtgtacgggatcatcccggagaagggcaagccggtgagcggcgcctccgacaacctccgtgcctggtggaaggagaaggttcggttcgaccggaacggcccggccgccatcgccaagtaccaggccgacaacgccgtccccggcgccgagaacgagctcgcctcaggcgccgccagcccgcactccctgcaggagctgcaggacaccacgctcggctcgctgctctcggcgctgatgcagcactgcgaccccccgcagcggcgctacccgctggagaagggcgtgccgccgccgtggtggcccaccggcgacgaggagtggtggccggagctcggcatccccaaggaccaggtcccgcccccctacaagaagccccacgatctcaagaaggcctggaaggtgagcgtgctcaccgctgtcatcaagcacatgtcgccagacatcgagaagatccgccgcctcgtccgccagtccaagtgcctccaggacaagatgaccgccaaggagatctccacctggctggcggtcgtcaagcaggaagaggagctctacctgaagctgcagcccggcgcccgcccgccggcgtctgccggcggcatcgccagcgccatctcgttcaacgccagctcaagcgagtacgacgtcgacatcgctgacgagtgcaagggcgacgaggccggcgaccagaagtcggccgtcgccgacccaaccgccttcaaccttggcgcggctatgctgagcgacaagttcctcatgccgccgccgatgaaggaggagaccgctgaggttgagttcatccagaagaggaacgcgcccgccgccgcggagccagagctgatgctgaacaaccgcgtgtacacctgcaacaacgttcagtgcccgcacagcgactacagctacggattcctcgaccggaacgcccgcaacagccaccagtacacctgcaagtacaacgatcctctcccgcagagctctgagaacaagccgccgccgccgccgccgcctccacagtcacaagccttccagggatccttcagccaacctaaccaggcgctgaacaatctggatttcagcctgcccatggacggccagaggtccatcgcagagctgatgaacatgtacgacaacaacttcatggcgaacaagagcatgagcagcgacagtgtcagcatcatggagaggcctaatgcgctgcccccgaggatgcagatggatgatggtttctttggacagggcaacggcgtgttcgatgatgtcaatagcatgatgcagcaaccacagcaggcgccagtgcagcagcagcagcagcaaccggcacagcagcagttcttcatccgcgacgacgctccctatgggagccaaatgggcgacatcaccggcacatcggagttcaggtttggttctggtttcaacatgtctagcaacgtcgactatccaggcacggcgcagcagaagaacgatggccccaattggtactactgaagaataaagttgtagggcttaaaaacctctctataagctttggatttctccatggtgctccttggcttccatggatgaagcgtctcctaagttgtcgagtctataggtctttgtcatataggttttgcagtagctgcaagaaggctggaacttggaactggtttatacttgtatgtccgtccagccataaacctcttatgaaaacttaatgttatttctagtttaatttgttaaaaaaaaaaaaaaaaaaaa

SEQ ID NO: 6964 - protein, 647 aa, Panicum virgatum
  misc_feature: Ceres CLONE 1893772
  misc_feature: The sequence is a functional homolog of  SEQ ID NO 1358 in the  11/479,226 US patent application
  misc_feature: Useful for making plants with modulated growth and phenotype characteristics
MMGGGLMMDQGMVFPGVHNFVDLLQQNGDKNLGFGSLMPQTSSGDQCVMGEGDLVDPPPESFPDAGEDDSDDDVEDIEELERRMWRDRMKLKRLRELQQTRGKDQAAAGGGGGDGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQVPPPYKKPHDLKKAWKVSVLTAVIKHMSPDIEKIRRLVRQSKCLQDKMTAKEISTWLAVVKQEEELYLKLQPGARPPASAGGIASAISFNASSSEYDVDIADECKGDEAGDQKSAVADPTAFNLGAAMLSDKFLMPPPMKEETAEVEFIQKRNAPAAAEPELMLNNRVYTCNNVQCPHSDYSYGFLDRNARNSHQYTCKYNDPLPQSSENKPPPPPPPPQSQAFQGSFSQPNQALNNLDFSLPMDGQRSIAELMNMYDNNFMANKSMSSDSVSIMERPNALPPRMQMDDGFFGQGNGVFDDVNSMMQQPQQAPVQQQQQQPAQQQFFIRDDAPYGSQMGDITGTSEFRFGSGFNMSSNVDYPGTAQQKNDGPNWYY

SEQ ID NO: 6965 - DNA, 1764 bp, Panicum virgatum
  misc_feature: Ceres CLONE 1893814
  misc_feature: Encodes the peptide sequence at SEQ ID NO. 6966
aaagtcccagctctcaccaagcggtgccgggcgagcttgctctcctcctatctgcgtgcgcgctccgccgccgtcccacccgcgccgcccgttcgacgagatggcgcagtgggacgctctggtggacgccgcgctcgcgaggctggaggccaggagcctgctccgtgccacgcgccccatcgcgctcgcgccgccgcccgtgtcccccgagaccttcgccggcccggggccgtgggaccgcgccgccgtcgagatccggctcgaccacggcaccctccaccaatggctcgctgaaggtggtgagacggttgagcaggaagagaagctggacgcgaatctgattcttttctccgggaatgactacatgggcctcagctcgcatcccgcagtccgtgaggctgcagtgaaggcagcacaagagtatggcatgggcccaagaggttccgcgttgatatgtggctatacaacttatcacaaattggtggaggaatcattggcagaactcaagaaaaaagaggattgtcttctatgccccactggattttcggccaatatggctgtgatgacagccctggggagtatcagctctcttttggctgttgggagaaagcctgcagaggatgagagaattgtgatcttctcagatgcgctgaaccatgcttcaatcattgatggtattcgccttttggagcgacagcaagaagcattagtgtttgtctacaagcactgcaacacgtcccatcttgaatttctgctatctagttgctctatggagaagaaagttgttgtcacagatagcctgttcagcatggatggtgattttgctccattccctgaacttgtcaagttacgcagaaagtatgggtttttgttggtcatcgatgatgctcatgggacacttgtttgtggtgagaatggtggtggtgcagctgagctgtttgattgtgaaaatgacatcgacatcagtgttggcaccttaagtaaagctgctggctgccaaggtggttttatagcatgcagcactagatggaagagtttgattcaatcacgaggtcgctcattcatattttcgactgctttgccagtgccagtagttgcttctgtgcatgctgccctttatgtctcaaggaaggaggtatggcgaagatcagtagtctggaggcatgtgcaatattttgcctctttgactaaagttgacataactagtcccataatatccattgtagttggaagtgaacaagcagcacttagggctggcaggcatttgctaagatctggatttcatgttacaccaatccgaccgcccacagtgccacccaactcctgcaggttgcgaattactcttagtgcttctcattcctcagatgatatcaaaaggctggttgatgcactcacaccctggcttcctgacaaacatgctgagcagagttacgctgcagtgtcaaagctgtaagcaataatccatctgagttcaggttccaggtccggatttaggaagtggtagtagctgaggtgatgctggatcctacaggaagagttcgtttagactagtgttgcttgacaaggttatttgtatgcattcatcatcgtttgtaccacggacaaacctctgcagaatctctgtagtctcatcctgatagatatatcctgatagaaatggggaaaggcatctccacatgtatttgtggccacatggcctatctcggccattcgttcctctcacatgatattcatataatataaatgaggttggttttgccgcac

SEQ ID NO: 6966 - protein, 450 aa, Panicum virgatum
  misc_feature: Ceres CLONE 1893814
  misc_feature (3)..(347): Pfam Name: Aminotran_1_2 Pfam Description: Aminotransferase class I and II
MAQWDALVDAALARLEARSLLRATRPIALAPPPVSPETFAGPGPWDRAAVEIRLDHGTLHQWLAEGGETVEQEEKLDANLILFSGNDYMGLSSHPAVREAAVKAAQEYGMGPRGSALICGYTTYHKLVEESLAELKKKEDCLLCPTGFSANMAVMTALGSISSLLAVGRKPAEDERIVIFSDALNHASIIDGIRLLERQQEALVFVYKHCNTSHLEFLLSSCSMEKKVVVTDSLFSMDGDFAPFPELVKLRRKYGFLLVIDDAHGTLVCGENGGGAAELFDCENDIDISVGTLSKAAGCQGGFIACSTRWKSLIQSRGRSFIFSTALPVPVVASVHAALYVSRKEVWRRSVVWRHVQYFASLTKVDITSPIISIVVGSEQAALRAGRHLLRSGFHVTPIRPPTVPPNSCRLRITLSASHSSDDIKRLVDALTPWLPDKHAEQSYAAVSKL

SEQ ID NO: 6967 - DNA, 2971 bp, Panicum virgatum
  misc_feature: Ceres CLONE 1893869
  misc_feature: Encodes the peptide sequence at SEQ ID NO. 6968
atcccactccccgcgcactaccgccgctttcaccgccctcggcggcatcgccacgcgcggtgccatcactccactcactctcaccgagctcgctcaccagtcaccaatggaggctcctcgctgcccgttccccatcctcctcctgctcgcgctgctggcgctgtcggcgccggcgctgccgcgcgccgacggcgcggaggaggcgaggaagacgtacatcttccgcgtggaccaccgcgccaagccgtccgtgttccccacccacgcgcactggtacgcctccgcggccttcgcctcgtcccctcaggccgccccgctccagccgctccacgtctacggcaccgtcttccacggcttctccgcgtccgtgccgccgtcccgcgccgcggagctgcggcgccacccggccgtgctcgccgccttcgaggaccgggcgcggccgctgcacaccacccggtcgccgcagttcatgggcctccgcgcgcggctcgggctctggtccctcgccgactacggctccgacgtcatcgtcggggtgctcgacacgggcgtctggcccgagcgccggagcctgtcggaccggaacctgccgcccatccccgcgcggtggcgcggcggctgcgacgccgggcccgggttcccggcgtcgtcctgcaacaggaagctcgtcggcgcgcgcttcttctcgcagggccacgccgcgcactacggcgcatcggccgtggcgtccaacgggtccgtggagttcatgtccccgcgcgacgccgacgggcacgggacgcacacggccaccaccgccgcgggcagcgtcgcgtacgaggccagcatggaggggtacgcgtccggggtcgccaagggcgtcgcgcccaaggccagggtggccgcgtacaaggtgtgctggaagggggcaggctgcatggactccgacatcctcgccggcttcgaccgcgccgtggccgacggcgtcgacgtcatctccgtttcgatcggcggcggcagcggcgtgacggcgccgttctacctcgaccccatcgcgatcggcgcgtacggcgccgtctcccggggagtcttcgtggccacctctgctggaaacgaggggccaacttccatgtccgtgaccaacgtcgccccgtggctcgccaccgtgggcgccggcaccatcgaccgcaatttccccgctgaaatcgtgctcggcgacggcagacgcttgtcaggtgtgtcgctgtactccggcaagtctctgaccaatgcatcgttgccgttgtactacccggggaggacaggcgggctgtccgcttcgctgtgcatggagaactccatcgacccgtcactggtcaaaggcaagatcgtcgtgtgcgaccgcggcagcagcccgcgcgtggccaagggaatggttgtcaaggaagctggtggcgcggcgatggttctgaccaacggagaggccaacggcgaaggcctggttggagacgcccatgtcctccctgcttgcgcggtgagggagaaggagggcgacacgctgaaagcctacgctgcaaacgcctccaacccgacggcaacaattagcttcgagggcacggtggtcggcgtcaagccggcgccagtggtggcctcgttctcggcgcgtggacccaacgggctcgtcccggaaatcctcaagccggacttcatcgccccgggcgtcaacatcctcgcggcgtggacgggcgccacggggccgaccggcctggaagccgatacccgccgcacggagttcaacatactgtcggggacgtccatggcgtgcccgcacgcgagcggcgccgcggcgctcctccggtccgcgcaccccgggtggtcgccggcggcgatacggtccgcgctgatgacgacggccgtcgggaccgacaaccgcggcgggcccgtgggcgacgaggcggagcccgggcgcgccgcgacgccgttcgactacggcgcggggcacatcacgctgggcaaggcactggaccccggcctggtgtacgacgccggggaggaggactacgtcgcgttcatgtgcagcatcgggtacgagccgaacgagatcgaggtggtgacgcacaagcccgtgtcgtgccccgcggcggcggcgggctccgacctcaactacccgtccatctccgtggtgctccgcggcggcaaccagtcccggacggtgacccgcacggcgacgaacgtcggcgcgccggcgtccgcgacgtacacggcgcgcgtgcagatggcggcgggcagcggcgtgtccgtgtccgtgaagcccgagaggctcgtgttctcgccgggcgccaggaagcagagcttcgcggtgaccgtggccgcggcgccgtccgccccgcccgccgcggcgcccgtgcacgggtacctcgcctggtcggacggcggcggcgggaacgaggtgcggagccccatcgtggtgacgtggctgcagcccatgtgacctacaggtggggccgccgccacggctcgtgatgtgggcccccgggctgccgataaggtggaaggcagcaggcaggagtcaaggcgcagtgggccagtaacggtaaagtcgtgcggtcggggactgggccattaaagtgggccggcgaacggaactttaattgggtgggccccaggacgcccgctctggcgctctgctgcagaaattgattaaccgcggggtaagcatgctgttagcctgcgacacagtaaaagcatgggggtatagtgagagacagtggtgtgccaaagctatcgagtcagggtgattgtttttccctgcctgttcgtttccggaggctgcagtacgtgcctgcactggaggacagcggcaacggaaagtaagggagaaacatgacaaagctaagaaatacttgtgccgttagcttgggtatttctatgtggattatctgcactgtactagtagtaattttactgtcggagtagtcgcgttctctctcgccaaaaaaaaaaaaaaaaaaaa

SEQ ID NO: 6968 - protein, 780 aa, Panicum virgatum
  misc_feature: Ceres CLONE 1893869
  misc_feature (10)..(490): Pfam Name: Peptidase_S8 Pfam Description: Subtilase family
  misc_feature (12)..(494): Pfam Name: Peptidase_S8 Pfam Description: Subtilase family
  misc_feature (1)..(472): Pfam Name: Peptidase_S8 Pfam Description: Subtilase family
  misc_feature (10)..(489): Pfam Name: Peptidase_S8 Pfam Description: Subtilase family
  misc_feature (1)..(499): Pfam Name: Peptidase_S8 Pfam Description: Subtilase family
  misc_feature (13)..(482): Pfam Name: Peptidase_S8 Pfam Description: Subtilase family
  misc_feature (11)..(491): Pfam Name: Peptidase_S8 Pfam Description: Subtilase family
  misc_feature (16)..(491): Pfam Name: Peptidase_S8 Pfam Description: Subtilase family
  misc_feature (10)..(494): Pfam Name: Peptidase_S8 Pfam Description: Subtilase family
  misc_feature (13)..(485): Pfam Name: Peptidase_S8 Pfam Description: Subtilase family
MEAPRCPFPILLLLALLALSAPALPRADGAEEARKTYIFRVDHRAKPSVFPTHAHWYASAAFASSPQAAPLQPLHVYGTVFHGFSASVPPSRAAELRRHPAVLAAFEDRARPLHTTRSPQFMGLRARLGLWSLADYGSDVIVGVLDTGVWPERRSLSDRNLPPIPARWRGGCDAGPGFPASSCNRKLVGARFFSQGHAAHYGASAVASNGSVEFMSPRDADGHGTHTATTAAGSVAYEASMEGYASGVAKGVAPKARVAAYKVCWKGAGCMDSDILAGFDRAVADGVDVISVSIGGGSGVTAPFYLDPIAIGAYGAVSRGVFVATSAGNEGPTSMSVTNVAPWLATVGAGTIDRNFPAEIVLGDGRRLSGVSLYSGKSLTNASLPLYYPGRTGGLSASLCMENSIDPSLVKGKIVVCDRGSSPRVAKGMVVKEAGGAAMVLTNGEANGEGLVGDAHVLPACAVREKEGDTLKAYAANASNPTATISFEGTVVGVKPAPVVASFSARGPNGLVPEILKPDFIAPGVNILAAWTGATGPTGLEADTRRTEFNILSGTSMACPHASGAAALLRSAHPGWSPAAIRSALMTTAVGTDNRGGPVGDEAEPGRAATPFDYGAGHITLGKALDPGLVYDAGEEDYVAFMCSIGYEPNEIEVVTHKPVSCPAAAAGSDLNYPSISVVLRGGNQSRTVTRTATNVGAPASATYTARVQMAAGSGVSVSVKPERLVFSPGARKQSFAVTVAAAPSAPPAAAPVHGYLAWSDGGGGNEVRSPIVVTWLQPM

SEQ ID NO: 6969 - DNA, 3135 bp, Panicum virgatum
  misc_feature: Ceres CLONE 1893872
  misc_feature: Encodes the peptide sequence at SEQ ID NO. 6970
gtgtcacgtatctcctcggttgctgattccccgctcgtttgtcgccattgccgcacctcgtgccctgtgaaggcatggcgagctcggggccaacgtctgggaagaaatctctaaatacagtgactttgcttttcaaattaccatattacacacaatgggggcagagccttctgatcaccggctcggaatcggcactgggttcgtggaatgtcaagcaaggactgtctctgagtccagttcatcaggataatgagctaatctggtgtggaaaagtgtctgttgctgctgccttcacctgtgagtacaaatactatgtagtggatgacaacaagaacgttttgagatgggaggctggggagaataggaaactagtcctgccaagtggcgttcaagaaggagacataattgaaatccgtgactggtggcaggatgcttctgaagcccttttccttagaagcgcattcaagaatgttgttttcaatgctacagaaggtgttaaaaaggaatcccagtcggcatccctcaataaaagtttggatcctgaagatatcgttgtccagttcgtaattagctgtcctcgactcgaatctggctctactgttgtcgtcactggaagtaatcctcagttaggaagatggcaagctcaagatggtctcaagctgagctatgttggagattccttgtggaaagcaatctgtgttttgcggaagtctgagttccctgtaaaatacaaatactgtcaaatcagtcaagcaggaaactcttcattggagctaggtccaaacagagaggttgatatcgatttatcatcaccaaagcaatccagatatgtcgtgttatctgatggtgccctccgggatgaaccatggaggggtgcaggtgttgctgtacctgtgttttcaataagatcagatgaggaccttggtgttggagaatttctagatcttaaacttcttgttgactgggcagtcaattcaggtttccatcttgttcagctccttccaatcaacgatacttcaattaacgggatgtggtgggattcttatccatacagctcactctctgtatttgcgttgcaccccttgtacctgagagtacaagcactttcagatgcgattccagcagatgtcaaggaagagattcagcaggcaaagaagcaattggataaaaaggatgttgactatgaggcaacattgtcctcaaaattatcgattgctaggaaaatattcaatttagaaaaggacaaagtgctaaactccagttctttcaagcagtttttatctgaaaatgaggaatggttgaaaccatatgcggcattttgctttttgcgggactttttcgagacatctgatcacagccaatggggtcggttttctcagttttccaaggaaaagcttgagaagcttatttctgaaggtactttgcaccatgacgttatccgttttcattactatgttcagtaccatctatatatgcaattatcagatgcagctgcatatgcaagaaagaaaaaggttatcctgaaaggtgatttgcctattggcgttgacaggaatagtgtggatacttgggtatacccaactttatttcgcatgaatactgctaccggagcacctcctgattattttgacaagaatggtcaaaattggggttttccaacatataactgggaggagatgtcaaaggataattatgggtggtggcgagctcgtctgacacagatggcaaagtacttcacagcataccggatagaccacattttgggtttctttagaatatgggagcttccagatcatgctgcaacaggtttattagggaaatttagaccttcaattcctcttagtcaggaggagtttctaagtgaaggactatgggatttcaatagaatgagtcggccatacattcgtcaagaaattctggaggagaagtttggatccttttggacagtcattgcggccaactttctaaatgagtatcagaaacagtgttatgagtttaaagaagattgcaacacagagaaaaagattattgcaaagattaaaacaagtcctgaaaaatcactgtggctagagaaagaagacagtatccgccgtggtctttttgatttattacagaatgttattcttatcagggatccagaggaccccacaaaattttatccccgtttcaacctggaagatacttcaagttttagggaccttgatgaacacagcaaaaatgttctcagaagattgtattatgactattattttgctcgccaagaaaatctctggcgtcaaaatgcactgaagactctgcctgtcctgttgaactcgtcagatatgttggcatgtggagaagaccttggtcttatccctgcctgtgttcaccctgttatgcaagaacttgggttgattggactgcgtatccaaagaatgcctagtgaaccaaacacggaattcggtattccttctcaatacagctatatgacggtttgtgctccctcatgtcatgattgctctacattacgtgcttggtgggaagaagacgaaggaagaagaagtcgtttctacaagactgtagttggcagtgatgaagagcccccatctcgctgcaccccagaagtagttcacttcattgttcatcagcattttgatgctccatcaatgtgggcaatctttccacttcaggaccttctcgcactgaaagacaagtacacctcaagaccagcaccagaggaaacaatcaatgaccccactaacccaaggcactattggagattccgtgtccatgtgacgttggagtccctgctggatgacaaggacatccaggcaaccatcaagggccttgtcacaagtagcgggagatccttccctggaaagaaggtggaaggtgccgacgaaagcggagagaagctatctaaggtgcagttgaatggtaaagcttaggaaaggatcgcaatagcagaatgcgaccacgattacaagtaaataaaataaggggacacattgcgttaccatgttggttggtttgtccgcttatgttgtttaagctagaaatgtcccgtgaaattctttcgacacatgaaataaggtgtgacctgtcaagtcagaaagtgaaataattcattccattcaaaaaaaaaaaaaaaaaaaa

SEQ ID NO: 6970 - protein, 950 aa, Panicum virgatum
  misc_feature: Ceres CLONE 1893872
  misc_feature (1)..(651): Pfam Name: Glyco_hydro_77 Pfam Description: 4-alpha-glucanotransferase
  misc_feature (1)..(651): Pfam Name: Glyco_hydro_77 Pfam Description: 4-alpha-glucanotransferase
  misc_feature (1)..(651): Pfam Name: Glyco_hydro_77 Pfam Description: 4-alpha-glucanotransferase
  misc_feature (235)..(699): Pfam Name: Glyco_hydro_77 Pfam Description: 4-alpha-glucanotransferase
MASSGPTSGKKSLNTVTLLFKLPYYTQWGQSLLITGSESALGSWNVKQGLSLSPVHQDNELIWCGKVSVAAAFTCEYKYYVVDDNKNVLRWEAGENRKLVLPSGVQEGDIIEIRDWWQDASEALFLRSAFKNVVFNATEGVKKESQSASLNKSLDPEDIVVQFVISCPRLESGSTVVVTGSNPQLGRWQAQDGLKLSYVGDSLWKAICVLRKSEFPVKYKYCQISQAGNSSLELGPNREVDIDLSSPKQSRYVVLSDGALRDEPWRGAGVAVPVFSIRSDEDLGVGEFLDLKLLVDWAVNSGFHLVQLLPINDTSINGMWWDSYPYSSLSVFALHPLYLRVQALSDAIPADVKEEIQQAKKQLDKKDVDYEATLSSKLSIARKIFNLEKDKVLNSSSFKQFLSENEEWLKPYAAFCFLRDFFETSDHSQWGRFSQFSKEKLEKLISEGTLHHDVIRFHYYVQYHLYMQLSDAAAYARKKKVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLLGKFRPSIPLSQEEFLSEGLWDFNRMSRPYIRQEILEEKFGSFWTVIAANFLNEYQKQCYEFKEDCNTEKKIIAKIKTSPEKSLWLEKEDSIRRGLFDLLQNVILIRDPEDPTKFYPRFNLEDTSSFRDLDEHSKNVLRRLYYDYYFARQENLWRQNALKTLPVLLNSSDMLACGEDLGLIPACVHPVMQELGLIGLRIQRMPSEPNTEFGIPSQYSYMTVCAPSCHDCSTLRAWWEEDEGRRSRFYKTVVGSDEEPPSRCTPEVVHFIVHQHFDAPSMWAIFPLQDLLALKDKYTSRPAPEETINDPTNPRHYWRFRVHVTLESLLDDKDIQATIKGLVTSSGRSFPGKKVEGADESGEKLSKVQLNGKA

SEQ ID NO: 6971 - DNA, 1959 bp, Panicum virgatum
  misc_feature: Ceres CLONE 1893877
  misc_feature: Encodes the peptide sequence at SEQ ID NO. 6972
accgccgccgctgcagccccccgcacccgctccgcctccacgcttatgcgctcgcatccccctctcgccgcccacctccgccgcctcctcctctcgccctccacccaactaacccatcgcgccgccatggcctccaccgccgccgtcgcgcgggcaggtgctgtggcgccggcggagtacgaggaggtgctggggcgcctctcctcgctcatcacgcagaaggtgcgcgcgcacagcggcaaccgaggcaaccagtgggacctcatggcacactacgtcaagattctggagctggaggagcccatcgcgcggatgaaggtcatccacgtcgcagggaccaagggcaagggttcgacatgcacgttcaccgagtcaatcctgcgatcgtgtggcttccacactgggctgttcacctcaccacatttgatggatgtcagggagcgattccggctagatggagttgatatttctgaagagaaatttttgaagtacttttggtggtgctggaataagttgaaggagaagactgatgatgatattcccatgccagcctatttcaggttcctggcgttgctcgcattcaagatattttctgctgagcaggtagatgttgctgtcctcgaggttggccttggagggaagtttgatgcaactaatgtggttgaagcacctgtagtttgtggggtatcttcgcttggatatgatcatatggaaattcttgggaatacgcttggagaaatcgctggggagaaggctgggattttcaagaaaggagttccagcctatactgctccacaacaagaagaggcaatggttgctctcaaacaaagagcttcggagttgggtatacctctccaagttgctgatcctctggtgccatatcacttaaaaggtcaacttcttggactgaatggtgaacaccaatacataaatgctggccttgcagttgctttggctagtacatggcttgagaagcagggacataaggacaggataccactcaatcgtactgatcccctaccagatcattttattagaggactatcaaatgcttgtttgcaaggccgagcacagattgttccagattcacgagtgaattcaggagcggccagaaattcttctttggttttctatttggatggggctcacagtcctgaaagtatggaaatatgtgccaagtggttttcccatgtcacaaatgatgatagaagaataccatcttccacagagcagtctcagagttctaagtctctaaagatccttctgttcaattgcatgtctgtgagagatcctatgagactgcttccgcatctccttgacgcctcaactcaaaaaggagtccactttgatctggccctatttgtgccaaaccagtcacaatacaacaagcttggttctaatacatcagcacctgctgagcctgaacaaatcgatttgtcatggcagttgtcactccaaacagtgtgggagaagttacttcaggataaaggaataggtagtccaaattccagtgacactagtaaagtttttgcatctcttccactcgcgatcgagtggctaaggaagaatgcccaagaaaacggatctacttcttttcaggtcttggttactggctccctacatcttgttggtgatgtcttgaggcttattaagaagtgatctatttagaaatgatatacagcttgaagttcaaagtggaagcaatctatgatgtgtcccagggctaacatgattagtgagggcagaaatttcaacggctttggttatgatgctaaccaagctgtgaggttcttgacttttacattcagtgttttctggctacggtttgtatcctacactcaggaaaattggtgtgcccactgttgtatctcagaatgtaaactcatgaataaggtgattttgatcaggccatcattgaactactcggtctagcaataattgtgttttggtctttctcag

SEQ ID NO: 6972 - protein, 537 aa, Panicum virgatum
  misc_feature: Ceres CLONE 1893877
  misc_feature (1)..(211): Pfam Name: Mur_ligase_M Pfam Description: Mur ligase middle domain
MRSHPPLAAHLRRLLLSPSTQLTHRAAMASTAAVARAGAVAPAEYEEVLGRLSSLITQKVRAHSGNRGNQWDLMAHYVKILELEEPIARMKVIHVAGTKGKGSTCTFTESILRSCGFHTGLFTSPHLMDVRERFRLDGVDISEEKFLKYFWWCWNKLKEKTDDDIPMPAYFRFLALLAFKIFSAEQVDVAVLEVGLGGKFDATNVVEAPVVCGVSSLGYDHMEILGNTLGEIAGEKAGIFKKGVPAYTAPQQEEAMVALKQRASELGIPLQVADPLVPYHLKGQLLGLNGEHQYINAGLAVALASTWLEKQGHKDRIPLNRTDPLPDHFIRGLSNACLQGRAQIVPDSRVNSGAARNSSLVFYLDGAHSPESMEICAKWFSHVTNDDRRIPSSTEQSQSSKSLKILLFNCMSVRDPMRLLPHLLDASTQKGVHFDLALFVPNQSQYNKLGSNTSAPAEPEQIDLSWQLSLQTVWEKLLQDKGIGSPNSSDTSKVFASLPLAIEWLRKNAQENGSTSFQVLVTGSLHLVGDVLRLIKK

SEQ ID NO: 6973 - DNA, 747 bp, Panicum virgatum
  misc_feature: Ceres CLONE 1894016
  misc_feature: Encodes the peptide sequence at SEQ ID NO. 6974
attcccacgccaaaccgaaaaccacagaccatggctcatcatctccgtgtcatctccctcaccggcttcaccatcgtcctctccctcgccctcctcttcccctccctgcaagctcaaggatccagcaacttgggcgaggagaaacgacagtcatgggaggagtactacgtccccgtgcggagcgtggtgtaccggtcgcggtcggtggcgctgccggcggcggcggcgacgacgtcgacggaggcggtggggtacgagccgttcgaggtgtgcgaggggtgccggtgctgctcgacgtccaacacgagcagctgcgtggacacgagctgctgctactccatcgactgcaacctcccggggaagcccttcggtacctgcgctttcacgccccaaacctgcggatgcggcggcaccagcaactgcaaccagccctcctgatgatccttgctttcctgatgatttccccattcatcactaatcttctcgtctcacacaacacaagtgtgctactgatgaagtgctgatcagttcaatccaaattgtaacggtttggtttgacgatgatgcaactgcaaacgtagtatgctttgattattcatttcgtgtttttctttcggtgactctgaaatctcaatttgtgtctgagattgggctttggggtttcctaaaaaacttcttttgtgttctgagtaatctgaaaaataatatagaggatcaattcagggccaaaaaaaaaaaaaaaaaaaa

SEQ ID NO: 6974 - protein, 135 aa, Panicum virgatum
  misc_feature: Ceres CLONE 1894016
  misc_feature: Great-hit functional homolog of the protein sequence given in SEQ ID NO 9322
  misc_feature: Useful for biocontainment applications
MAHHLRVISLTGFTIVLSLALLFPSLQAQGSSNLGEEKRQSWEEYYVPVRSVVYRSRSVALPAAAATTSTEAVGYEPFEVCEGCRCCSTSNTSSCVDTSCCYSIDCNLPGKPFGTCAFTPQTCGCGGTSNCNQPS

SEQ ID NO: 6975 - DNA, 681 bp, Panicum virgatum
  misc_feature: Ceres CLONE 1894121
  misc_feature: Encodes the peptide sequence at SEQ ID NO. 6976
cctcctctgcagctgcccaattccaacacagccttctctgactgcgcccctgttcatcttcttcctcttctcgcgcgctcggccgcctgcttcacagcttcagcaactgcgagatggaggcgcaggacgacggcaaatggcgccagatcccggcgttcggcgactggaacctgtgggacgacatgcccgtcgcccaatacttccaggcaggacccttcttcttcacagcgccggttgacaaagacgacgaggacctattcaaggtgccccagttccctgccaagccctacagctacaagaagtgtgtcgtgcgagtgaagggggagaaaaccaatgctgtgccggcgaggaagaagggagccaggaggcagtatatgaacgagcagcagaagtggaagccgaagggggcagtggacgaggacctgtacaagatctccccacagcttctctgcaaggtgaagaagaagaagctgctgaggaatttactggggggttgcctgggcttgagctgcatcgcctgagagtagtggcaaagcttaataagtctatgaggaatttggttgcttctttagagagctgtatagtatctatgctaatatggaattaaggaaaacttactactgctttgcactcgcttgaatgtaacacctgcattcgatctaaaaaaaaaaaaaaaaaaaa

SEQ ID NO: 6976 - protein, 135 aa, Panicum virgatum
  misc_feature: Ceres CLONE 1894121
  misc_feature: Great-hit functional homolog of the protein sequence given in SEQ ID NO 9283
  misc_feature: Useful for making plants with modulated drought sensitivity
MEAQDDGKWRQIPAFGDWNLWDDMPVAQYFQAGPFFFTAPVDKDDEDLFKVPQFPAKPYSYKKCVVRVKGEKTNAVPARKKGARRQYMNEQQKWKPKGAVDEDLYKISPQLLCKVKKKKLLRNLLGGCLGLSCIA

SEQ ID NO: 6977 - DNA, 787 bp, Panicum virgatum
  misc_feature: Ceres CLONE 1894253
  misc_feature: Encodes the peptide sequence at SEQ ID NO. 6978
aagcatacccttccaaaaaaaaccaaagtattcgagggccagtcttttctgatccttcgcctgaaaagaacagccgccgcaaacgacgcacagtgaggtgaggggaggcgagcggggatggcgcggagcgtgtcgtacgtgtcggcggcgaagctggtgtctatggcgcgcggcaatccccgcgttgccatcatcgacgtcagggacgatgagaggagccaccaggcgcacatcgcggggtcgcaccactacgccagcggcagcttcgcggcgcggatgccggagctggtgcgggccgttagtggcaaggacaccctcgtcttccactgcgccctcagccaggtgcgaggtccaacatgtgctcggatgttctcagactatctatcggagaccaaggaggattcagggataaagaacatcatggtactggaacgcgggtttaacggatgggaggtttcagggcagcctgtctgccgctgcaccgacgcttcttgcaaagggacgtgcctttgaccacacgagttccaatctctcaggccttcaacgatcggcatggctgtctctgtttctgctgtcgcttacatcgcctcattgaaattgtaaaacacgacacagctcgttgggttagctggcaatgccaatttgtgggaacttcgttgcataactaccaccgtgctgtcagatacgacgcaatacaatacaaaagactccacggtactgattcatttcagattggctgcatagtggaaactgtttttgtttctgccaaaaaaaaaaaaaaaaaaaa

SEQ ID NO: 6978 - protein, 131 aa, Panicum virgatum
  misc_feature: Ceres CLONE 1894253
  misc_feature (1)..(130): SWISSPROT Homolog: EC 3.1.3.48 Dual specificity phosphatase Cdc25
MARSVSYVSAAKLVSMARGNPRVAIIDVRDDERSHQAHIAGSHHYASGSFAARMPELVRAVSGKDTLVFHCALSQVRGPTCARMFSDYLSETKEDSGIKNIMVLERGFNGWEVSGQPVCRCTDASCKGTCL

SEQ ID NO: 6979 - DNA, 893 bp, Panicum virgatum
  misc_feature: Ceres CLONE 1894366
  misc_feature: Encodes the peptide sequence at SEQ ID NO. 6980
acaccacaccacactgccgagacgcaggcactgcagcagtgcactactactactcgtatcgtactagcaagctactgttactggtagcagcaggtacgtacggtaaccatggcgaagaagaaaaccgccgtggtcgccacgcttctggctctgaacctcctcttcttcgccttcgccaacggctgcggctgcaggtgcggcgcctgccctagtccaggcggaggaagcagtgggggtggtggtggatctggcggcgggggaggagggagcagtgggggtggtggtggatctggcggcgggggaggagggagcggcggcggcggcggcacaggcggcggcacaggaagcggtcggtgccccatcgacgtcctgaagctgggcgtgtgcgccaacgtgctgagcgggctgatcaacgtgaccctggggacgccgccgcggacgccgtgctgcacgctgatccaggggctcgcggacctggaggcggcggtgtgcctctgcacggcgctgcgtgccaacgtgctgggcatcaccctcaacctgcccatcaacctcagcctcctcgtcaactactgcggcaggcgcgtcccctcgggcttccagtgcgcctagcgccctagcctacctggctagctcatggatggatccgatcttgcctgcagatcgacaagcctagctagctagcacctgatactactcgatcctaatacatacgtaccactaccatgctatgcatgcacatgtgtgtgtgtgtgttcaataattcaacaagctatgtatctatctcatcatcatctatagctactgtaatttgtgagtaagaatgtgtgtgtgtgtgttcttttactgtataatccattcatccatatcacatagtatgcatgtatgcagtgttt

SEQ ID NO: 6980 - protein, 166 aa, Panicum virgatum
  misc_feature: Ceres CLONE 1894366
  misc_feature (1)..(82): Pfam Name: Tryp_alpha_amyl Pfam Description: Protease inhibitor/seed storage/LTP family
  misc_feature (1)..(83): Pfam Name: Tryp_alpha_amyl Pfam Description: Protease inhibitor/seed storage/LTP family
  misc_feature (31)..(81): SWISSPROT Homolog: EC 5.99.1.2 DNA topoisomerase 3-alpha
MAKKKTAVVATLLALNLLFFAFANGCGCRCGACPSPGGGSSGGGGGSGGGGGGSSGGGGGSGGGGGGSGGGGGTGGGTGSGRCPIDVLKLGVCANVLSGLINVTLGTPPRTPCCTLIQGLADLEAAVCLCTALRANVLGITLNLPINLSLLVNYCGRRVPSGFQCA

SEQ ID NO: 6981 - DNA, 1044 bp, Panicum virgatum
  misc_feature: Ceres CLONE 1894648
  misc_feature: Encodes the peptide sequence at SEQ ID NO. 6982
agcgctgggactcgttgcttgccgtcgtcgccttcggcgtctacctcgtcggcgaggccgcgtacaaccgcctccacggctccaccgcccagcgagcttcctccgttgttttgcaggtcttgatgcacactgcagctgaactcgatacatgatagtatatctctacacaccacacctgaaaacaaaagaccgaacagtgcaagacttattcttgatcagggcgcagacacttccttggatcggcgacgacgatgtcgaagggagctgcggcattcgcgctcgtgtccctcgccgtgatggcggcggtggcggacggcgcgctgctcccgtggttcggcgacggcaggcgcgggcgcgacgaggcggcggcagcggcatcggccgtgtcgccgctgtccgacctgagcctcctggcggacccgttccggatcctggagcacgtgcccttcggcttcgaccgcgacgacgtggcaatggtgtccatggcgcgcgtggactggcgcgagacccccgacgcgcacgagatcgtcatcgacgtgccggggatgcgcaaggaggacctcaagatcgaggtcgaggacaaccgggtgctgcgggtgagcggcgagcggcggcgcgcggaggagcacaggggcgaccactggcaccgcgaggagcgctcctacggcaggttctggcgccagttccgcctccccgagaacgccgacctcgactccgtcgccgccaccctcgacaacggcgtgctcgccgtgcggttcaggaagctggcgcccgagcagatcaagggcccgcgcgtcgtcggcatcgccggcggggacagcggcgccaagaacagcatcggcgcgggcgccggggaggagcatcaggccaagaaggtcgagctgtgaggagggtgactctgcttacgcgcgctcgttgactcggatatctacgtgtatctgtatacagagaagtgtgccatgtgtctactgccatgtaaatttgcgaggtaactcgggaataaaaagtttctgatcttcctttcaaaaaaaaaaaaaaaaaaaa

SEQ ID NO: 6982 - protein, 211 aa, Panicum virgatum
  misc_feature: Ceres CLONE 1894648
  misc_feature (1)..(109): Pfam Name: HSP20 Pfam Description: Hsp20/alpha crystallin family
MSKGAAAFALVSLAVMAAVADGALLPWFGDGRRGRDEAAAAASAVSPLSDLSLLADPFRILEHVPFGFDRDDVAMVSMARVDWRETPDAHEIVIDVPGMRKEDLKIEVEDNRVLRVSGERRRAEEHRGDHWHREERSYGRFWRQFRLPENADLDSVAATLDNGVLAVRFRKLAPEQIKGPRVVGIAGGDSGAKNSIGAGAGEEHQAKKVEL

SEQ ID NO: 6983 - DNA, 941 bp, Panicum virgatum
  misc_feature: Ceres CLONE 1894660
  misc_feature: Encodes the peptide sequence at SEQ ID NO. 6984
atcagaagccgccgccgcacgggcacgccgcagggccagaggcatgggggacgccgccacgaaccaccctgttctcgcgccgggtgatgtcgggcaatcgagcttcggcgccaactcgtccgccgccgcgaccggcggcgggttcgtggccctcgacgtcggtgcgctgtcgtccctcgccggcgacgccggcccgccgggcacgcccacggcgcccccgcggacacccaaggtggtgaggtcgctgtcgcggaagggcgacaggaagccggccgacgccaacggcaccgccggtggcggtggcgagcggccgcagctgttcgtgcacgtggcggccggcgacctcggggacgcgcccggcagcgcgcggctggtcgtgcacacgccgctggccggcacgcccgggagcaagtcccggcggttcggccggcggccggcgccgtggctggatccccggagggtggtcttcctcttcgccacgctgtccagcgtggggacgctgatcctgctctacttcacgctgtccatgagcaggccggactccagcggcagtggcggcggcggcggcgccagcgacgctcggtgatacgccagctgtcgaaagcgaaggtgtttttttgccttgttctgagaattttcaaacaacaaagatgacttacaaagattgagaggggtaccgtaatccgggcaaaaaagaaagaaagctgtgctgctgcgggagtctgcaaggtcagtcacactgatggatagagagtgaacggctgtgaagaaagtagcccgagtttgatggagaagttttgtgatggtgctcgttcttgttccttctcctcttttttttctttccctttttttttctgattgctcaaatgaggatacatgccgctttacagcgataacacgtaatactgtatttttcatttcaaaaaaaaaaaaaaaaaaaa

SEQ ID NO: 6984 - protein, 180 aa, Panicum virgatum
  misc_feature: Ceres CLONE 1894660
  misc_feature: Great-hit functional homolog of the protein sequence given in SEQ ID NO 9242
  misc_feature: Useful for making plants with modulated biomass
  misc_feature: The plant is abnormally small.
  misc_feature: There is no branching.
MGDAATNHPVLAPGDVGQSSFGANSSAAATGGGFVALDVGALSSLAGDAGPPGTPTAPPRTPKVVRSLSRKGDRKPADANGTAGGGGERPQLFVHVAAGDLGDAPGSARLVVHTPLAGTPGSKSRRFGRRPAPWLDPRRVVFLFATLSSVGTLILLYFTLSMSRPDSSGSGGGGGASDAR

SEQ ID NO: 6985 - DNA, 1223 bp, Panicum virgatum
  misc_feature: Ceres CLONE 1895533
  misc_feature: Encodes the peptide sequence at SEQ ID NO. 6986
aaacgtccaaaccaaaccaaaccccgcccgcgaatctctccccgccgagcccgaccagccgcgaatccgcccgcgggaggggaagggcgcgagcgcggcgagggcatggagatcctgcaggggcagaggctggagaccacggtggccgtcgcggtcgccgtcgtcgccatggccgccggcgccgcctacctcttcctccgcagcaggaagcccaggggttgcttggaccccgaaaacttcagggagtttaaacttgtagagaagaggcaactcagtcataatgtcgccaagttaaagtttgtgctcccaacacctacttctgtattgggtcttccaatcggacaacatataagctgcaggggacaggatgctgctggcgaggaagtaatcaagccttatactcccactacactggactctgatcttggacactttgagcttattattaagatgtacccccaaggaagaatgtctcatcattttcgtgagatgaaagttggcgactatatgtctgtaaagggacctaagggtcgtttcaagtaccaacctggacaagtgagagcatttggaatgattgctggaggatcaggcattaccccaatgttccaagttacaagggcaattcttgagaacccacaagacaatacaaaagttcacctaatctatgcgaatgtaacatatgatgatattcttcttaaggaagaactggacagtatggccaaaaactatcccgatcgtttcaagatctactatgtcctgaatcagcctcctgaaatctgggatggcggtgttgggttcgtgtcgaaggaaatgatccaagctcattgcccagcacccgctgccgacattcaggtgttgagatgcgggcctccccccatgaacaaagccatggccgcgcacctggacgagcttggctacacgaaggagatgcagttccagttctaatcaagccccgcatctgccgaaggatactaaaaataatagcgacgggacatgttttcgctctccgttgagtcgagtcacatagctccagcagacgtattcacaaagcaatgcgtcgtatctctcgatgacagcacgagtgcctaatctgtatcggtgttgcgacattgaattgaaccattggcatttgtgccattgctgctccaccctccagtccagacatcgagagacatccactgccttgcatcattatatgtctccaaaaaaaaaaaaaaaaaaaa

SEQ ID NO: 6986 - protein, 279 aa, Panicum virgatum
  misc_feature: Ceres CLONE 1895533
  misc_feature (1)..(110): Pfam Name: NAD_binding_1 Pfam Description: Oxidoreductase NAD-binding domain
  misc_feature (1)..(100): Pfam Name: FAD_binding_6 Pfam Description: Oxidoreductase FAD-binding domain
MEILQGQRLETTVAVAVAVVAMAAGAAYLFLRSRKPRGCLDPENFREFKLVEKRQLSHNVAKLKFVLPTPTSVLGLPIGQHISCRGQDAAGEEVIKPYTPTTLDSDLGHFELIIKMYPQGRMSHHFREMKVGDYMSVKGPKGRFKYQPGQVRAFGMIAGGSGITPMFQVTRAILENPQDNTKVHLIYANVTYDDILLKEELDSMAKNYPDRFKIYYVLNQPPEIWDGGVGFVSKEMIQAHCPAPAADIQVLRCGPPPMNKAMAAHLDELGYTKEMQFQF

SEQ ID NO: 6987 - DNA, 1593 bp, Panicum virgatum
  misc_feature: Ceres CLONE 1895608
  misc_feature: Encodes the peptide sequence at SEQ ID NO. 6988
gctcctccactggcgagatggggcgaggctcgggcgccgctcccgtctcgccgggcctcgcgcttgaggccgcggtgctggcgctgctcgcggccgcggcggcgctgccttccccggcggccggggtcaacgtgacggccgtgctctcggcgttccccaacttcgccgacttcgcgcgcctgctggcgtccacccccgtggccggggagctggcagggaggtcgtcgctgacgctgctggccgtgccgaatgccaacctgccgcagtcgccctcggcgttcgcggccggcgccggcgccgacatcgccgacgtgctgcggtaccacgtcctgcttgagtacctctccccgtccgacctcgctcgcctcccggcgtccgggaagctcgtgacgacgctgttccagaccacgggccgcgctccctccgacctcggcgccgtcaacctcaccgcggggacaaactccaccgtcgtggtccgctcgccggcgccgtccccggggtcgaacgccaccgtcctcggcgccgtgaccgcggtgccgtacaacctcagcgtgctcgcggtgggtggcctcatcgtcccctccggattcgacctcgcggcctccgagagccgtccggccccgccggtgaacatcacccgggtcctcaccgacgcgcggggattcaacgtggcggcctccatgctgcaggcttccggtgtggcgagcgagtttgaggccgacgagcacggcgctggcatcacagtcttcgtgcccaccgacgacgcctttgccggcctccccgctaccgaccgcctccagtccctccccgcagagcgcaaggccgttgtgctccgcttccacgtcctgcactcctactacccgctcggctccctcgagtccatcgtgaaccccgtccagccgacgctcgcgactgagtacaccgaggctggccgcttcaccctaaacataacccgtgtcaatggctccatcgccattgacaccggcgtcgtgcaggcatccatcaccagaacagtgttcgaccaaaaccctgtgtcagtcttcgccgtctccaaggttctactgcccaaggaaatgttcagccggggggattctgacagcactaccatggcaccaccttcagccgcaatggcacccggcaatgaggggaatgaacagacaccaccgacaaggctttcatccccgcctgacctgcacggcgaggatagtgagtcgtcagctgctttgacgacagcaaagggggcttcttggtggtgtataggattgatgtatctacagctgcatctgttactctctctggtatgagatccaggtgtgcttgttgcttgcttcattgtgctcagtttttcattgtgctcagtttttgttccttagtgtctagaatgtctacaccggaaaatggatgggttggggagagaattccgtagctgcaaagtagcaaacagattagttgcttcacttgattattcccttttcttttccttttgtcgtgtggcaaaagggaaataatatcatgtgtagaaatctatgcagtcattctgttccacaatgaaatagtattttctattgagcgtcaaaaaaaaaaaaaaaaaaa

SEQ ID NO: 6988 - protein, 428 aa, Panicum virgatum
  misc_feature: Ceres CLONE 1895608
  misc_feature: Great-hit functional homolog of the protein sequence encoded by LOCUS At3g46550
  misc_feature: Useful for making plants with altered cell wall content and/or composition
MGRGSGAAPVSPGLALEAAVLALLAAAAALPSPAAGVNVTAVLSAFPNFADFARLLASTPVAGELAGRSSLTLLAVPNANLPQSPSAFAAGAGADIADVLRYHVLLEYLSPSDLARLPASGKLVTTLFQTTGRAPSDLGAVNLTAGTNSTVVVRSPAPSPGSNATVLGAVTAVPYNLSVLAVGGLIVPSGFDLAASESRPAPPVNITRVLTDARGFNVAASMLQASGVASEFEADEHGAGITVFVPTDDAFAGLPATDRLQSLPAERKAVVLRFHVLHSYYPLGSLESIVNPVQPTLATEYTEAGRFTLNITRVNGSIAIDTGVVQASITRTVFDQNPVSVFAVSKVLLPKEMFSRGDSDSTTMAPPSAAMAPGNEGNEQTPPTRLSSPPDLHGEDSESSAALTTAKGASWWCIGLMYLQLHLLLSLV

SEQ ID NO: 6989 - DNA, 1474 bp, Panicum virgatum
  misc_feature: Ceres CLONE 1895658
  misc_feature: Encodes the peptide sequence at SEQ ID NO. 6990
gcaggccgcagcagcatcgtaagggacaaaaaccagagctccatggtcctggtgctggtggtggtgtcaagagaaggtcggcctggcggtctcttggcgtcgtctggtctgatccatggcggccttcgcggcgcactactcgccggcgggcacggccatcctgctccgaagcgggagcgggaggcgggccttccccacccgcgtgtcgtgctcggtggcggcggcggcgcacaataagacggtggtgatcggggtggcggccgactccgggtgcgggaagagcacgttcatgcggcggctgacgagcgtgctcggcggcgtgccggacgagccgccgaacccggactccaacacgctcgtcggcgacaccgccacggtgctctgcctggacgactaccgctcgctggaccgcgcggcgcggaaggcgcggggcttgacggcgctggacccgcgggccaacgacttggacctcatgtacgagcaggtgagggccctcaagggcggccgcgccgtcgacaagcccgtctacaaccacgtcaccggcctcctcggcccgcccgagcgcgtcgcgccgcccaggatcctcctcgtcgcggggctgcacccgatgtacgatgagcgcgtcagagatctgctggacttgagcatctacctggacatcagctacgaagtcaagcttgcatggaaaattcggagagacatggcagagagtgggcacagcctagagagcatcaaggccagcatcgcggccaggaagcccgacttcgacgcctacattgacccgcagaagcagtacgcggacgccgtgatcgaggtcctgccgacgcagctgataccgggcgacgacgacggcaaggtgccgcgcgtgcggctcatcatgaaggaaggcgtgaggcacttcgccccggtgtacctcttcgacgaagggtccaccatcagctgggtcccctgcggccggaagctctcctgctcctaccccggcatcaagttcgcctacggcttcggcacctacttcggccacgaggtgtcggtgctggagatggacgggcgtttcgacaagctggacgagctcatctacgtggagacccacctcagcaacctgtccgccaagttctacggggaggtgacgcagcagatgctcacgcacgccgacttgccgggcagcaacaacggcacggggctcttccagaccatcgttgggctcaagatcagggaactctgcgagcacatcgtcgccatgacggccgacgacgcagtcgaggtctgatgtctgatgaagccggtgttgatcggaggagggcgaccacatattctggttgctgttcttgtaaccgtagtgccggatagattatcatgttgcattgcggttcaataaattggtatgtttgtaattgtataggagatgttgcagggacagttcagtgagcagtaagttgcatgcatgtccacgagatgttggcgcccttcatctatc

SEQ ID NO: 6990 - protein, 383 aa, Panicum virgatum
  misc_feature: Ceres CLONE 1895658
  misc_feature (1)..(200): Pfam Name: PRK Pfam Description: Phosphoribulokinase / Uridine kinase family
  misc_feature (18)..(374): SWISSPROT Homolog: EC 2.7.1.19 Phosphoribulokinase, chloroplast precursor
  misc_feature (22)..(377): SWISSPROT Homolog: EC 2.7.1.19 Phosphoribulokinase, chloroplast precursor
MAAFAAHYSPAGTAILLRSGSGRRAFPTRVSCSVAAAAHNKTVVIGVAADSGCGKSTFMRRLTSVLGGVPDEPPNPDSNTLVGDTATVLCLDDYRSLDRAARKARGLTALDPRANDLDLMYEQVRALKGGRAVDKPVYNHVTGLLGPPERVAPPRILLVAGLHPMYDERVRDLLDLSIYLDISYEVKLAWKIRRDMAESGHSLESIKASIAARKPDFDAYIDPQKQYADAVIEVLPTQLIPGDDDGKVPRVRLIMKEGVRHFAPVYLFDEGSTISWVPCGRKLSCSYPGIKFAYGFGTYFGHEVSVLEMDGRFDKLDELIYVETHLSNLSAKFYGEVTQQMLTHADLPGSNNGTGLFQTIVGLKIRELCEHIVAMTADDAVEV

SEQ ID NO: 6991 - DNA, 1695 bp, Panicum virgatum
  misc_feature: Ceres CLONE 1895690
  misc_feature: Encodes the peptide sequence at SEQ ID NO. 6992
aagcagcgcgttccatcctgaggtctcaaccctgctgcagtttaatttgcgttgtctgccttgttagcctctgccctctgctgcaattgtgaagtccctgtagaagcctactcttcgaggaagtttagtgtggacgtgtctcaaaactaagtatacttcaattagaagaaagatctattcagtcaagctttgcaaatcatcgtcatagttttggatggcatccatggttacttaatgagtttatggcatcctgtttgtcgagctgatgtgggttgtatcacaatggaactgtaatattttctccaaaagttccctcatcttcggagaaaggttcaagggaattataagtgttgttctgaagcttgatgacgtgttcgtgagggttaagtgagagtgaaattttcgtctggcatgcagatgtcaacagatcctaaccactatggggtatttccacattcattctgcaaccaacatgtggtttcatttcagacgagttcaattaccagtgggtcaggaggagccatgccagtttgtctggacacttccagcacaatgaatggcaatatggcgatgttgaacactacatcttccacaattgtatccactggttcaccaaacatgattcctgattcttctggccagagcctcaagtatagtgcaccaatggctgtggagtggtcctatgctgaactgcaaatgttgaatgatggcctcatcaagtatgcaaatgaaccgggaatcatgaagtacataaagatagcagccacgttaccagacaaaacagtaagagatgtagccatgagatgccaatggatggcagcgagaaaagaagctacaagacgacggaagcctgaagaacactatcctggaaaaaagataaaagatagaaaggacaaaatggctgagccgtcatcatgggttaccaatcctccagttcagactgacatgagagcttctgcctttatgcctcgtaacaccagacacaataacggatttctatctggagattctcaaattgatcgtgaaatgttaaatatattggaagaaaatgctcgacttctcaatgaaatagaagtaaatattttgacatcgcaggctcaaaacaacattgatcttttccatcgcacaagaaggaacatcaacagtctactacaaagcatgagccaaattcccggaataatgagcaagatgcccccattgcctgtttcagtggatgaaaggctagctagttacgtactccctcgatttcctatgacacaagttcttggcagcattcatttgaaagaagaaccgagagtatggtaggccattgcagacagggcagcggcttaattttgagcaatagtttggtcaaaatatatgaagagccatgtgcttgggtacctacatggagaagcacagatcgaagaaaggtcgtgcttttctgaaagctatgaagcaagatccgctgatccgcaccatatggccttcaaaaacgctgtccagcttgccttctcaggaagctctatattagtgattgagaatttgagatagggagagttttaccgtaaactgcagttttcctcaccctggttgcacatattgatttttttttgggttttctcctggtgatcgatgttaacagaggtgtagcatagatactaaacttatatatgaataattatctggaaaagcttagcctttttgtcagttatt

SEQ ID NO: 6992 - protein, 297 aa, Panicum virgatum
  misc_feature: Ceres CLONE 1895690
  misc_feature (1)..(50): Pfam Name: Myb_DNA-binding Pfam Description: Myb-like DNA-binding domain
MQMSTDPNHYGVFPHSFCNQHVVSFQTSSITSGSGGAMPVCLDTSSTMNGNMAMLNTTSSTIVSTGSPNMIPDSSGQSLKYSAPMAVEWSYAELQMLNDGLIKYANEPGIMKYIKIAATLPDKTVRDVAMRCQWMAARKEATRRRKPEEHYPGKKIKDRKDKMAEPSSWVTNPPVQTDMRASAFMPRNTRHNNGFLSGDSQIDREMLNILEENARLLNEIEVNILTSQAQNNIDLFHRTRRNINSLLQSMSQIPGIMSKMPPLPVSVDERLASYVLPRFPMTQVLGSIHLKEEPRVW

SEQ ID NO: 6993 - DNA, 1401 bp, Panicum virgatum
  misc_feature: Ceres CLONE 1895744
  misc_feature: Encodes the peptide sequence at SEQ ID NO. 6994
atggtcagagtggaatgcagctacaaaacggtattcctctgcagcttgccgtcttcagtctttgctgactgcccgcaagaggacctccattccccgtcgtagaagaagcacgagagtggaagcagcatccatggcgggagaggaggctgggaggagaggtattccctccctgctgaacccgtcttcgtcatccagcgaaggggagcgcgaacacatcgcctctgacgtcacacagctcatcggatggacgcctctgatcgagctcaagcgaatcacaggcaaggacggggtagaagcccggatcgtcggcaaggtcgaggcgtaccagcccctctgctccgtcaaggaccgcagcgctttgagaatgatagaagatgcagaggagaggggattgatttcacctggggtcacaacactggtcgagccaacaagtggcaacttggggttaggaattgtcctcattgctcttcacaaaggctataggttcgttgcagttatgccgggtcaatattcacttgataagcagatcctgttgagatacatgggtgctgagttatacttgactgatccagcccttggatttccgggcataaatgagaaggttgaacagctcaaaaaagaattgcccaatgtacatgttcttgatcaattctcgaacaaagcaaatcctgaagcacacattaggtggactggacctgagatttggaaggacactgctggcaaggtggacatatttgtagctggttctggctcaggaggtacggtatctggtgttggaaagtatctgaagatgcaaaacccaggtatcaggatcatctgtgttgagcctacagagagtccagttgtttcaggtggagaacctggcaaacataaaatccagggcatagggccaggatttatacctgaagtactggacacctcggttattgatgaggctgtcacggtgaccactgaggaggcgatggtgaatgcaaggaggctggccaaggaagagggcctccttgtgggcatatcttctggagctaacttggcagcttgcttgaaggtcgcgtcgagggaagaaaacaagggaaagatgattgtcaccgtgtttcccagcgggggcgagagatacatgaactccgacctatttgcagatgtgagagaggagtgcattgcaatgacattctgatctcatcacttattcagaagagagctgtcttccaaagttccacgtagcggctgacaaccacccaatcggcatctggtatatgtactagtagctcatatatggtgataccacaatgaattgtgtaattttgcaatggaatttatattcaagaaatttgtatgaactaactggagaaccaattggccaagtaacgtgtcccaggtttatttcaaaaaaaaaaaaaaaaaaaa

SEQ ID NO: 6994 - protein, 346 aa, Panicum virgatum
  misc_feature: Ceres CLONE 1895744
  misc_feature: Great-hit functional homolog of the protein sequence given in SEQ ID NO 9420
  misc_feature (15)..(341): SWISSPROT Homolog: EC 2.5.1.47 Cysteine synthase, chloroplast/chromoplast precursor
  misc_feature: Useful for making plants with modulated cold sensitivity
MAGEEAGRRGIPSLLNPSSSSSEGEREHIASDVTQLIGWTPLIELKRITGKDGVEARIVGKVEAYQPLCSVKDRSALRMIEDAEERGLISPGVTTLVEPTSGNLGLGIVLIALHKGYRFVAVMPGQYSLDKQILLRYMGAELYLTDPALGFPGINEKVEQLKKELPNVHVLDQFSNKANPEAHIRWTGPEIWKDTAGKVDIFVAGSGSGGTVSGVGKYLKMQNPGIRIICVEPTESPVVSGGEPGKHKIQGIGPGFIPEVLDTSVIDEAVTVTTEEAMVNARRLAKEEGLLVGISSGANLAACLKVASREENKGKMIVTVFPSGGERYMNSDLFADVREECIAMTF

SEQ ID NO: 6995 - DNA, 1546 bp, Panicum virgatum
  misc_feature: Ceres CLONE 1895831
  misc_feature: Encodes the peptide sequence at SEQ ID NO. 6996
atccatccggcacctgcaatccccccccgcaggccgcagcagggcaagacggagggaagcccagccgtccccctccccactccgccaccacacgctccgctcccccatggcgctcgcgctgcgctgccccgccgccacctcctctaggagtcccttcctgccctcctcctccccggtaccgccggcgaggttcgcgaggaggccgccagccacctgcaggtgccactactaccacggcgacggcgtcggattccgcaagaactacgaccacatccccaagcagttccgcgaggagaacctcaaggatgggctgatggataactacaagaatgttcctcagttcctttatggattaagtcctgctcagatggaaatgtttatgaacgatgataatccttataatcggcaatcccaaaaagttaccgaggaaagtgtttctgctgctaggagttacgatgaatttggtatgtacaccttgtcaggcatgcatgagggccctgcaagttacagcttgggcatgggcatggggggcagcatgagcatgggcatgggcagaggtgggagaggatatagaagaatgagaagctctgctccagatctgccatcgttgctactggactctcgaattatatttcttggaatgcctattgttccggcagtaactgagcttattgctgcgcaatttctgtggctagattatgatgaccgcacaaaacccatttatctgtatataaactccactggaactatggatgaaaataatgatcttgttgcatctgaaactgatgcttatgcaattgctgattttatcaatcgaagcaaatccaaggtttacacaatcaatcttagcatggcatatggtcaggctgcaatgcttctgtcccttggtttcaagggcaaaagaggagtgcttccaaattcaatcactaaattgcacctgcctaaggtccacaaatctggtggagccgccattgatatgtggattaaggcaaaagagttggatacaaacacagattattaccttgatctattgtcaaaaggagttggtaaaccaaaggaagagctcgctgaattccttaagggcccaaggtacttccatgcgcaagaggccatcgattatggacttgctgatacgatcttgcactcattggatggttctttcaagccaaaggatctgactgcacagctggccaaagcacaggagatgcggcaatcgggtaagcgtgcagcagctggagctgggagatggtcgactccaactgcacccaggtagattagaaagttttatcaggatggtatgctccatcctgatgatcatgcggttctgcaatacaaagaagccagcgtcttgtaaaatgtgcaatgcaaaaaatcatctctatggagcttggaactgatgctggatagtgaaatgttttgaactgtagtgtaagttgtgatgtgtatcatcatgtatgtgtaattttggttacaatcagcccgcagctattgtatccatatatatttcattcaccagtggaaatgatagcttatctgaattttagcc

SEQ ID NO: 6996 - protein, 388 aa, Panicum virgatum
  misc_feature: Ceres CLONE 1895831
  misc_feature (1)..(189): Pfam Name: CLP_protease Pfam Description: Clp protease
MALALRCPAATSSRSPFLPSSSPVPPARFARRPPATCRCHYYHGDGVGFRKNYDHIPKQFREENLKDGLMDNYKNVPQFLYGLSPAQMEMFMNDDNPYNRQSQKVTEESVSAARSYDEFGMYTLSGMHEGPASYSLGMGMGGSMSMGMGRGGRGYRRMRSSAPDLPSLLLDSRIIFLGMPIVPAVTELIAAQFLWLDYDDRTKPIYLYINSTGTMDENNDLVASETDAYAIADFINRSKSKVYTINLSMAYGQAAMLLSLGFKGKRGVLPNSITKLHLPKVHKSGGAAIDMWIKAKELDTNTDYYLDLLSKGVGKPKEELAEFLKGPRYFHAQEAIDYGLADTILHSLDGSFKPKDLTAQLAKAQEMRQSGKRAAAGAGRWSTPTAPR

SEQ ID NO: 6997 - DNA, 2002 bp, Panicum virgatum
  misc_feature: Ceres CLONE 1895888
  misc_feature: Encodes the peptide sequence at SEQ ID NO. 6998
atgggggaaagaaagggtggaaagccaccgcagcaaaaccaaaccctctcggcttctccccgctccccttccccttcccctcctcatccgcggcggcacgctggactaagggactcgctaccgaggagtacgcatttgtctaggttttggggtcttccgcgggggagctgaattagttggagccttcgtgatggcgggcgcgaaggcggatgtagacgcggaaacgggggacggcggcggcgccgcaggtggcgccggcggcgggggaggcggctccttcagcgagcacaggctggtcgacaagctcaacaagctcaacagctcagcggcgagtattcagacactttcacaatggtgcatttttcaccgcaagagggccaaaagggttgtagacacatgggagaagcagtttaatagtgcaacaaaggataagaaagtatcattcctgtatctatcgaatgatatcctgcttccttccactcctcgctcctccgttgcttcctccttccctccacagtcggctccactcatcggccctgcagctctcggtattgaccgattggtggaggtagctgctggcctgctgctgcttcttgctcctgccggtgcgttcagaccagtggctctgattacgagccgtaggaaggacaaggagcaagcctgacagggaggtggcgatggagaggtacgaggtgatcaaggacataggatcgggcaacttcggggtggccaagctggtccgggacgtcaggaccaaggagctcttcgctgtcaagttcatcgagaggggaatgaagattgatgagaatgtccaaagggagatcatgaaccatagatcactgaggcatccgaatattgttaaattcaaggaggttgtgctaactcccacacatttggccatagttatggaatatgctgctggtggcgagctattcgaaaggatctgcaatgcagggagatttagtgaggatgaggcaaggttcttcttccaacaattgatttcaggagttagctattgtcactccatgcaaatatgtcacagagatttgaaactagaaaatactttgctggatggtagtatagcacctcggctaaagatatgcgattttggttattccaagtcttctgtgttgcactctcagcccaaatcaactgttggcacacctgcttacattgctcccgaggtgcttgctaaaagggtatatgatggaaaggttgccgatgtttggtcatgtggagtaactctgtatgtgatgcttgtcggggcttatcccttcgaggaccctgacgaaccaaagaatttccgcaagactcttactcggattctcagcatacaatatgccatacctgattttgtccgagtttcaatggaatgcaggcatcttctgtcccggatttttgttgcaaaccctgagcaacggataagcatcccggagatcaagaaccacccgtggttcctgaagaatctgccaatcgagatgaccgacgagtaccagatcagcgtgctaatgaccgatatgaacgtcccctcgcaaagcttggaggagatcatggccatcatacaggaggcccgcaagcctggcgacggtatgaagctcaccgggcagatccccggactggggagcatggagctggacgacattgacgttgacgatatcgacatggaggacagcggtgacttcgtctgtgccttgtgacagaacaagtggttggttcaggccgtccgacgccgaagctgcagtgaactcccactctcttctggtctttttgtgttgtgctgttgatccaagttgtttgtttaagcgtgttctgcgctcccattttgttgttgtgatttcacttgttttctgtaatggaggtagtgatgttgtggataaataatagactttttaaggctggattcttagagttcggatcctccgccctgtatgaaggggtcgtctcatgaattcgcaatggcttgtttctttccgttgacctttaaaaaaaaaaaaaaaaaaaa

SEQ ID NO: 6998 - protein, 339 aa, Panicum virgatum
  misc_feature: Ceres CLONE 1895888
  misc_feature (1)..(339): SWISSPROT Homolog: EC 2.7.11.1 Serine/threonine-protein kinase SAPK1
  misc_feature (1)..(339): SWISSPROT Homolog: EC 2.7.11.1 Serine/threonine-protein kinase SAPK2
MERYEVIKDIGSGNFGVAKLVRDVRTKELFAVKFIERGMKIDENVQREIMNHRSLRHPNIVKFKEVVLTPTHLAIVMEYAAGGELFERICNAGRFSEDEARFFFQQLISGVSYCHSMQICHRDLKLENTLLDGSIAPRLKICDFGYSKSSVLHSQPKSTVGTPAYIAPEVLAKRVYDGKVADVWSCGVTLYVMLVGAYPFEDPDEPKNFRKTLTRILSIQYAIPDFVRVSMECRHLLSRIFVANPEQRISIPEIKNHPWFLKNLPIEMTDEYQISVLMTDMNVPSQSLEEIMAIIQEARKPGDGMKLTGQIPGLGSMELDDIDVDDIDMEDSGDFVCAL

SEQ ID NO: 6999 - DNA, 1533 bp, Panicum virgatum
  misc_feature: Ceres CLONE 1895978
  misc_feature: Encodes the peptide sequence at SEQ ID NO. 7000
agcacccatggattcatccatggggcggagctccgtgagtcttctggttgggctcctggtgctgcggttcaacaggtgcttggcggtggacggcggaggcggggcgtttccgctggtggtgagcacctggccgttccgggaggcggtcagggcggcgtgggatgtggtctcggccggtgacggagggggttcggccgtggacgctgtcgtcgccggctgctccgcctgcgaggtgctccgctgcgatgggacagttggtcctggtggaagtccagatgagaatggtgaaactacgctagatgctcttatcatgaatggggcaacaatggaaattggagctgtggctgccatgagatatgttaaggatgaaattaaggcagcaaagttggtaatggagcacagcttgcatactctgcttgttggcgagaaggcaacagactttgcaatttcaatgggccttccaggaccaattaatctaagttctccagagtcacttgagaaatgggcaaactggagacagaatcactgccaacccaacttctggaaaaatgttgctcctgccggtagctgtggcccatatcgtcctatcaatttagcacgagcttcggactctgtaaagcatgaggtagaacagaatcaaggaggtgtttgccaggaatggttccaaagtgatagtttactggagccaataaactcccatttgaagtttattgatcaccacaaccatgacactatctctatggcagtgattgacaagatgggtcatatagctgttgggacatcaaccaatggtgctacatttaaaattccaggaagggtcggtgatggaccaataccaggatcttcttcatatggtgatgatgaggtcggagcttgtggagcatctggcgatggtgatattatgatgcgcttccttccatgttatcaagtggtcgagagcatgagacgaggaatggaacctcgggacgccgccatggatgctatatcaagaattgccagcaaattcccaaatttcgttggtgctgtatttgcagtcaacgagaaaggagtgcatgctggggcatgccatggttggacattccagtactcggtaaggaattccagcatgcatgacgtggaggtcattacagtatatccttagcggtggcggttcctggaaatcaaaagctcgcttcgtcggcattcagagtatttcactcgtggtgatggacattattttcttcattgatgctcactgatgatgtagcaatgttctgtgttgattgttccgatagtattgttaagccgattgttctgaaactgggaccttattatatgtagcgcattgaccctagttgtgttttaaagtcattgaaaggaggcctccaaacccctcttccattggatctgccctgtttcagagtttgattatagaaaagttagaattgcatatagtcaacttcatcacccagaccggctatcatgtattcatgtttaatgtaatagttgggccgtgtttagttccaaaaatcagaaaaaaaaaaaaaaaaaaaa

SEQ ID NO: 7000 - protein, 377 aa, Panicum virgatum
  misc_feature: Ceres CLONE 1895978
  misc_feature (3)..(359): Pfam Name: Asparaginase_2 Pfam Description: Asparaginase
MDSSMGRSSVSLLVGLLVLRFNRCLAVDGGGGAFPLVVSTWPFREAVRAAWDVVSAGDGGGSAVDAVVAGCSACEVLRCDGTVGPGGSPDENGETTLDALIMNGATMEIGAVAAMRYVKDEIKAAKLVMEHSLHTLLVGEKATDFAISMGLPGPINLSSPESLEKWANWRQNHCQPNFWKNVAPAGSCGPYRPINLARASDSVKHEVEQNQGGVCQEWFQSDSLLEPINSHLKFIDHHNHDTISMAVIDKMGHIAVGTSTNGATFKIPGRVGDGPIPGSSSYGDDEVGACGASGDGDIMMRFLPCYQVVESMRRGMEPRDAAMDAISRIASKFPNFVGAVFAVNEKGVHAGACHGWTFQYSVRNSSMHDVEVITVYP

SEQ ID NO: 7001 - DNA, 1869 bp, Panicum virgatum
  misc_feature: Ceres CLONE 1896029
  misc_feature: Encodes the peptide sequence at SEQ ID NO. 7002
aaatccccggcgcctccctctcctgccgacccactgcaaagccaaagcacgcgcacgccgcccgttgtctcgcgctgctctccacactgccacctgcctctctctcttggtcttgccaaaggccgccgccgcgtggggtgccgctcctcttcgtgttcttgtgcccgtcgcccaccgcagcttgggagaaaccctcgtcccgccgccgccgccgctgttcttggtgaggaggaactgaacagatgggagggtccgggaagtgggtcaagtcgctgatagggctcaagaagccggagaaggaagactgcaaggacaagctgcaagtcccgtccgtccatggaggattgcgaggcaagggccgaaagtggaagctgtggcggagctcctccggcgaccacggctccctgtggcgcggctcgagaggcggcagccaacgctcggcggcgtctgaggcctccgacgacgcctcctcggttgccgcccccaccgacccgttcaccgccgccgtctccacggtcgcccgcgccccggcgagggacttcatggccgtccggcaagagtgggccgccatccgcatccagactgcgttccggggattcttggctcggcgggcgctacgggcgctcaaggggctggtgcggctgcaggcgatcgtccgcgggcggcaggtgcggaagcaggcagcggtgacgctgcgatgcatgcaggcgctggtgcgggtgcaggcgcgcatccgggcgcgccgcgtgcgcatgtccaccgagggccaggccgtgcagaagctgctcgaggcgcgccgcacccagatggacatcctcagggaggccgaggaaggatggtgtgacagtcagggaacactggaagaagtgagggtgaagctgcagaagcggcaggagggcgcgatcaagcgtgagagagctatcgcctacgcgtattcgcagcaggttgagggtgctgcaaaatgcaatccttcaaagcttacttgtaatggccggttgaaccactccggtatgttgctcaagcaccagaattttgacaagagcaatggcaactggagctggctggagaggtggatggctgcacggccatgggagaatcgattgatggaggagcacaaccagaccaattccagctcaccagatctccggtcaaccaagaactgcgaggattcattcggagttcttggggatttctctgaaccgaattcagtgaaggtgcgcaagaacaatgtcagcaagcgggtctgcgcgaagccaccaggagcatcgcaatcacaggcccaccatcagcgcttcaaagcccagtctatctcatctctgagcactgaattgcacaacgatgagagctccgcatcatcatcttcttgttttgcgtcaactccgatatcattctcaacatttgtcacttctgagaaaactgaggacaatgtcaggacaaggcccaactacatgagcatgacagagtcgatcaaggcgaagcagaaggtgtgcagtgccgagagatcgacggctctgaagcaatcggaggataggaaaggcatgaccaccgagttgaaggctattcaggtgtagtagtgttcatgtaactccatgcagagatgaagccaactcctacatctcactagggtgttcgtcaggtgacttgtcacattcttaagtggctcgttgctgcattgttgagttgtccgtgtgttgcttgtctgattgttcaatgtgttcgattgccccatcttggagcagtcattgtcactttgtcagtggtagagtctctgtaagatagctctttgagtagaaaacagtgtgttgtttccagagtgttgattcctggtgaaaagaagggataatttaccaaaaaaaaaaaaaaaaaaaa

SEQ ID NO: 7002 - protein, 442 aa, Panicum virgatum
  misc_feature: Ceres CLONE 1896029
  misc_feature: Great-hit functional homolog of the protein sequence encoded by LOCUS At2g26180
  misc_feature: Useful for making plants with modulated salt sensitivity
MGGSGKWVKSLIGLKKPEKEDCKDKLQVPSVHGGLRGKGRKWKLWRSSSGDHGSLWRGSRGGSQRSAASEASDDASSVAAPTDPFTAAVSTVARAPARDFMAVRQEWAAIRIQTAFRGFLARRALRALKGLVRLQAIVRGRQVRKQAAVTLRCMQALVRVQARIRARRVRMSTEGQAVQKLLEARRTQMDILREAEEGWCDSQGTLEEVRVKLQKRQEGAIKRERAIAYAYSQQVEGAAKCNPSKLTCNGRLNHSGMLLKHQNFDKSNGNWSWLERWMAARPWENRLMEEHNQTNSSSPDLRSTKNCEDSFGVLGDFSEPNSVKVRKNNVSKRVCAKPPGASQSQAHHQRFKAQSISSLSTELHNDESSASSSSCFASTPISFSTFVTSEKTEDNVRTRPNYMSMTESIKAKQKVCSAERSTALKQSEDRKGMTTELKAIQV

SEQ ID NO: 7003 - DNA, 1947 bp, Panicum virgatum
  misc_feature: Ceres CLONE 1896123
  misc_feature: Encodes the peptide sequence at SEQ ID NO. 7004
acacacatatgatctgtgctgtctcctccctcagctctcctctcctctcctctcctcctcccccctctggcctccctgtgctcgcctaagctaactcaaacggcgagagcccttccgcgaagcccaggccgctgctctgattgctgagtgattggtcaatcactccgccgcctactcgactccatccgctaccgcctacactgctctgcagatcctctcttagcttgcttctctcgtcgtcttcgcctcgctggtcgtcgttcatctccgagcttattgaccgagctgctggccggccggctggcggcggcggctcagcgccgttgctgacggtgtgtttacaagggcggctgttgggacttggaagccgcgtgcgtggagggtgcgctcgtcggcgaagcgaagccgcgcgtgttgttgtcccccaccgtttgccatcgatcagcagcagtcgtggttgatagagaagtgcacagttatagcgtcgtcccagaatccctgcgtcagtcgtttaagctcccttggatcgatcgagaccggcggcggcgatggacgctaccttcggctgggccggcgccgaccaccatgtcgatgactacttctcgcgccagcaggttggatgcggccggttcgagatggacgaggccttcctcggcgcctgctttggacagctccagtgcgacggggtcctcgccgccgccggcggtggcgacaccgtagcgtgccaggtgagctcgaattgcggcgtcttcgaaggcgccgcgggtatggactgtgaccccctcgcgttcttgggcgcggggacgggggacgcgttcgacggcggcctcctcgacgcggcgctcgcgttcaccagggagctcggcgacggcggggccgtgtcgaacggcgccatgctctccagctacagcggcaccaccgggggcaacatctcctccggggagtcaaacaactacagcagcggcggccacgacgccgaggtggtatcgccgacgtccatcatgtcgcccaccaccacggcgccgcggccgttcacccacgcgtcgtcccaccagcaggcgctccacgccaagcggaaggtggccgacgagtacccggcgaccggcaacgcgacaaccgcgcccgcgccagcggcgctcccgcgccccggcgtcgcgaagcggcgtgcggcgacgagcatcagcttcggccagggcgcccagcacagcgcgcgcgaccccgccggcggcggcgggtacgagccggacatggaggcgatggcgcaggtgaaggagatgatctaccgcgcggccgccatgcggcccgtcaacctcggccccgaggtcgccgcggcggcgtccgcggagaagccccggcgcaagaacgtgcgcatctcgagcgacccgcagacggtggcggcgcggctgcggcgggagcgcgtgagcgagcgcctccgcgtgctgcagaagctggtccccggcggcagcaagatggacacggcgtccatgctggacgaggcggcgagctacctcaagttcctcaagtcccaggtccaggcgctggaaaccctaggcaccagcagcacgagcacgagcacgagcacgagcggcgtgccaagcaggtcacagcactacaactatttcggcagcagcagctgcaacccgggcttccttggattgccgagaaggagcagtaacatctctccagctgggtatgtaaatcctaacggatcgacgacgaatactggcagcaaattgttgtagccagtaactgttcgtgtatatatgactgtgcctgctgagtggattatacacgtaacaagcatgatgcatgttgctgtttcatcgaactgtttatctagccgtaagttcttgttgttagttgtgtagattacgacgtactcatagtgatcattatgagtatttagtaatagatatactttatgcgcaaaaaaaaaaaaaaaaaaaa

SEQ ID NO: 7004 - protein, 397 aa, Panicum virgatum
  misc_feature: Ceres CLONE 1896123
  misc_feature (1)..(48): Pfam Name: HLH Pfam Description: Helix-loop-helix DNA-binding domain
  misc_feature: The sequence is a functional homolog of  SEQ ID NO 1937 in the  10/374,780 US patent application
  misc_feature: The sequence is a functional homolog of  SEQ ID NO 1938 in the  10/374,780 US patent application
  misc_feature: Useful for making plants with modulated growth and phenotype characteristics
MDATFGWAGADHHVDDYFSRQQVGCGRFEMDEAFLGACFGQLQCDGVLAAAGGGDTVACQVSSNCGVFEGAAGMDCDPLAFLGAGTGDAFDGGLLDAALAFTRELGDGGAVSNGAMLSSYSGTTGGNISSGESNNYSSGGHDAEVVSPTSIMSPTTTAPRPFTHASSHQQALHAKRKVADEYPATGNATTAPAPAALPRPGVAKRRAATSISFGQGAQHSARDPAGGGGYEPDMEAMAQVKEMIYRAAAMRPVNLGPEVAAAASAEKPRRKNVRISSDPQTVAARLRRERVSERLRVLQKLVPGGSKMDTASMLDEAASYLKFLKSQVQALETLGTSSTSTSTSTSGVPSRSQHYNYFGSSSCNPGFLGLPRRSSNISPAGYVNPNGSTTNTGSKLL

SEQ ID NO: 7005 - DNA, 2028 bp, Panicum virgatum
  misc_feature: Ceres CLONE 1896132
  misc_feature: Encodes the peptide sequence at SEQ ID NO. 7006
atgcccttcatcagaccggccagtcggcagcccagcaacagcaacgcagcgactatgggaagagcggcggcgatggcggtagctctgctggtggcggtggtcgcttcggcggccacgttgccgggcacggcgagagcgtccccggcggaagggatccagccgctgtccaagatcgccgtacacaaggcaaccgtcgaaatgcagccgtcggcgtacgtgcaggcgaccccgtcgctgctcggcgagcagggagaagacacggaatgggtgacggtgaagtacggatggacatacccgtccgacgacgactggatcggcgtcttctctccatctgaattcaactcgtcggctacgtgtcctaacccgtggccagcagaagaaccctatctctgcacagcacccatcaagtatcaatacgccaactactcggcaaactacatctactggggcaagggcagcatccggctgcagctcatcaaccagcgctccgacttctccttcgccctcttcaccggcggcctccacaacccgaagctgatcgcggtgtcggagccgatctcgttcaagaaccccaaggcgcccgtgttcccgcgcctcgcgctgggcaggtcccacgacgagatgacggtgacgtggaccagcggctacgacatcagcgaggcgtacccgttcgtcgagtggggcgcctcggtcggcggcggcgccgcccggcagaccgcgcgcgcccccgccgggacgctcaccttcagccgcggcagcatgtgcggcgagccggcgcgcaccgtcgggtggcgggaccccggcttcatccacaccgccttcctcagggacctctggcccaacaaggagtaccactaccggatcgggcacgagctcccggacgggtccgtggtgtggggcaagccctactcgttccgcgcgccgccgtcgccggggcagcagtcgctgcagcgcgtcatcgtcttcggcgacatgggcaaggcggagagggacgggtcgaacgagtacgcggcgtaccagccggggtcgctcaacacgacggacaggctgatcgaggagctggacggctacgacgccgtgttccacatcggcgacatgccctacgccaacggctacatctcgcagtgggaccagttcacggcgcaggtggcgcccatcaccgcccggaggccctacatggtggccagcggaaaccacgagcgggactggcccgacacggcggcgttctgggacgtcgaggactcgggcggcgagtgcggcgtgccggccgagacctactactactaccccgccgagaacagggccagcttctggtacaaggtggactacggcatgttccggttctgcgtcgccgactcggagcacgactggcgggcgggcacgccgcagtacgagttcatcgagcactgcctctccacggtggaccggaagcaccagccgtggctcatcttcgcgacgcaccgcgtgctgggctactcctccaacgcatggtacgccggcgaaggctccttcgaggagcccgagggccgcgagaacctgcagaaactgtggcagaagtaccgcgtcgacatcgcctactttggccacgtccataactacgagaggacctgcccaatgtaccagagccagtgcatgaccagcgagaagagccactactccgggacgatgaacggcaccatcttcgtggtggccggcggcggcggttgccacttgtcggactacacgacggcgatccccaagtggagcatctaccgcgaccatgacttcgggttcaccaagctcacggcgttcaaccactcgacgctgctgttcgagtacaagaagagcagcgacggcaaggtgtacgactccttcaccatccacagggactaccgcgacgtgctcagatgcgtgcacgacagctgtttccccactacgctcgccacctaattaatcaagccttgttgttaagacaccaacggtggttttggctttgatcgaaataaaatgagccaaccacttattagtagaataataataaaatgagcc

SEQ ID NO: 7006 - protein, 624 aa, Panicum virgatum
  misc_feature: Ceres CLONE 1896132
  misc_feature (1)..(217): Pfam Name: Metallophos Pfam Description: Calcineurin-like phosphoesterase
MGRAAAMAVALLVAVVASAATLPGTARASPAEGIQPLSKIAVHKATVEMQPSAYVQATPSLLGEQGEDTEWVTVKYGWTYPSDDDWIGVFSPSEFNSSATCPNPWPAEEPYLCTAPIKYQYANYSANYIYWGKGSIRLQLINQRSDFSFALFTGGLHNPKLIAVSEPISFKNPKAPVFPRLALGRSHDEMTVTWTSGYDISEAYPFVEWGASVGGGAARQTARAPAGTLTFSRGSMCGEPARTVGWRDPGFIHTAFLRDLWPNKEYHYRIGHELPDGSVVWGKPYSFRAPPSPGQQSLQRVIVFGDMGKAERDGSNEYAAYQPGSLNTTDRLIEELDGYDAVFHIGDMPYANGYISQWDQFTAQVAPITARRPYMVASGNHERDWPDTAAFWDVEDSGGECGVPAETYYYYPAENRASFWYKVDYGMFRFCVADSEHDWRAGTPQYEFIEHCLSTVDRKHQPWLIFATHRVLGYSSNAWYAGEGSFEEPEGRENLQKLWQKYRVDIAYFGHVHNYERTCPMYQSQCMTSEKSHYSGTMNGTIFVVAGGGGCHLSDYTTAIPKWSIYRDHDFGFTKLTAFNHSTLLFEYKKSSDGKVYDSFTIHRDYRDVLRCVHDSCFPTTLAT

SEQ ID NO: 7007 - DNA, 1596 bp, Panicum virgatum
  misc_feature: Ceres CLONE 1896325
  misc_feature: Encodes the peptide sequence at SEQ ID NO. 7008
actcatcgtccgggagccccccttccaccacagccagcaaggccgcggttgcgctcgccccgctcccctcccgcacgaccagatggccgccgccccgtcctcctctgccgccgccgccgcctgcttcctctcttccccgtgccccctgcctagccgccagcgccatttccccaggcacctcgcgtgcgccgcggcctccaagcacgcgcccgccgcttcctcctcccgctcgctcgccctcccctcccccgcgccgtggccgtggccgcggcggctagccgagctggtccccgccgaagtggcaggccggctgctgtcgtcggccgcgggctccttcatcgtcgcgctcgcctccgcggcgctgatcctcggcgacgccggcgcggcctccgcgttcgtggtcgccacgccgcggaagctgcaggcggacgagctcgccaccgtgcgcctcttccaggagaacacgccctccgtcgtctacatcaccaacctcgccgtgaggcaggacgcgttcacgctcgacgtgctcgaggtgccgcaggggtccgggtcggggtttgtctgggataagagcggccacatcgtcaccaatttccatgtcatccgtggtgcgtcggacctcagggtcacacttgctgatcagtcagtgtatgaagcgcaagttgttggatttgatcaggacaaggacgttgctgttttgcgtatcaaagcgccaatggataaactaaggccgataccagttggtgtgtcagcagacctactggttggtcagaaagtatacgccattggaaatccatttggccttgaccacactcttacaacaggtgttatcagtggactgcgtagagaaattagttcagctgccacaggacgtcctatacaagatgtgatacagactgatgctgctatcaaccctggtaacagtggtggtccactccttgatagttcaggaaacttgataggtgtaaacactgctatatactcaccctcaggagcatcatctggtgttggtttttccattccagttgatacagttgggggcattgtggatcaacttataaaatttggtaaggtgacaagacctattttgggaataaaatttgcccctgatcaatctgtagagcagcttggattaagtggagtgcttgtcttggatgctcctccaaatggaccagctggcaaagcaggtcttcaatcaaccaaacgagatgcctacggtcggcttgtcctgggggatataattacctctgtgaatggtacgaaggtaacgaatggaagcgacttgtaccggatattggatcagtgtaaagttggggaaacggtgaccgtggaagtcttgcgtggtgaccacaaagagaagatccctgtggtccttgaaccaaagcctgatgaatcataggagaaaccaggttcatctgtatcatatgctcagctgcttacttaggtgcagagatgcaaattacaagaccttagcatttcgcctaccatgggattcattgtacataattcatacttgtaaatcaaactatctctggtctggtcgaaaaggtcatccatgttggcgtcaatgctatagtgtgtcatgcttgttttttc

SEQ ID NO: 7008 - protein, 438 aa, Panicum virgatum
  misc_feature: Ceres CLONE 1896325
  misc_feature (1)..(169): Pfam Name: Trypsin Pfam Description: Trypsin
MAAAPSSSAAAAACFLSSPCPLPSRQRHFPRHLACAAASKHAPAASSSRSLALPSPAPWPWPRRLAELVPAEVAGRLLSSAAGSFIVALASAALILGDAGAASAFVVATPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLRIKAPMDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIKFGKVTRPILGIKFAPDQSVEQLGLSGVLVLDAPPNGPAGKAGLQSTKRDAYGRLVLGDIITSVNGTKVTNGSDLYRILDQCKVGETVTVEVLRGDHKEKIPVVLEPKPDES

SEQ ID NO: 7009 - DNA, 1522 bp, Panicum virgatum
  misc_feature: Ceres CLONE 1896328
  misc_feature: Encodes the peptide sequence at SEQ ID NO. 7010
accaccgcagcagcacagacgcggccccgcgccagaaaacccagaagagggatccacggcgggcccgcgcgcgcgcagcaagctgctccgacgacgatgatggccctgcaggtcgccggctgcgccctgccgcccctcctcgcgcggcggcggtgccggcgccgggcgctccgctcgccccgcgcggtggcgtcggacgccgcgccggcggcggcgagggaggaggacggcaaggtcgcgctgggcgggtccggcgtcgcggtgaccaagctcggcatcggggcctggtcctggggcgacaccacctactggaacgagttccagtgggacgataggaaactaaaggcagcaaaaggagcatttgatgcgagcatcgattgtggaataactttttttgatactgctgaagtatacggagctgggatatcaggagccataaattcagaaagtttactaggaagattcattaaggaaaggcaacgaaaggaacaagttgaagtggccatcgcaacaaagtttgcagctcttccatggaggtttggccgtggaagtgtcatctgtgcactgaaggcctcattggatcgccttggcgtctcttcagttgagctctaccaacttcattggccagggacatggggcaatgaaggttacctggatggccttggagatgctgttgagcaaggtcttgtgaaagctgttggagtctcaaactatagcgaaaaacgcctccgagatgctcatgcacggcttaagaagagggggattccactcgcttcaaatcaagtaaattacagtctgatatacaggaacccggaggaaaatggggtgaaggcagcttgcgatgagctcggcattactttgattgcgtattccccgatcgcccaaggtgctctgacagggaaatacactccggacaatcccccgaaagggcctcgaggacggatatacactccagagttcctgacaaagctccaaccgcttattaaccggatcaaggagattggaggaaactacgagagaaccccaacccaggtggtgctcaactggctggtgtgccagggcaacgtggtgccgatcccaggggcgaagaacgcggagcaggcgcgggagttcgcaggcgcgctggggtggagcctgacgggcgacgaggtggaggagctgcgctccatggcgcgccaggtcaagcccgtcatcggcttcccggtggagaagctgtgacgacccgctgggccggtcccgctgcctgcagctagctgggatttttgcatcggatggacgtggtcaccgcgaaagacaaaagggttacctcgtgacagcaaccacgtagtacagtatagtatagatagattgacaagtatgccatgtcgagttgaaaccaaatgaaacgaaaatacacattggaagaacagcagattactgcagtagctctagcgttgactgttgacctcagctctcttctagtattttgtgcatgctgaatccaagctgctaatggtttgaggtaaaaaaaaaaaaaaaaaaa

SEQ ID NO: 7010 - protein, 373 aa, Panicum virgatum
  misc_feature: Ceres CLONE 1896328
  misc_feature (1)..(314): Pfam Name: Aldo_ket_red Pfam Description: Aldo/keto reductase family
  misc_feature (1)..(311): Pfam Name: Aldo_ket_red Pfam Description: Aldo/keto reductase family
  misc_feature (1)..(315): Pfam Name: Aldo_ket_red Pfam Description: Aldo/keto reductase family
MMALQVAGCALPPLLARRRCRRRALRSPRAVASDAAPAAAREEDGKVALGGSGVAVTKLGIGAWSWGDTTYWNEFQWDDRKLKAAKGAFDASIDCGITFFDTAEVYGAGISGAINSESLLGRFIKERQRKEQVEVAIATKFAALPWRFGRGSVICALKASLDRLGVSSVELYQLHWPGTWGNEGYLDGLGDAVEQGLVKAVGVSNYSEKRLRDAHARLKKRGIPLASNQVNYSLIYRNPEENGVKAACDELGITLIAYSPIAQGALTGKYTPDNPPKGPRGRIYTPEFLTKLQPLINRIKEIGGNYERTPTQVVLNWLVCQGNVVPIPGAKNAEQAREFAGALGWSLTGDEVEELRSMARQVKPVIGFPVEKL

SEQ ID NO: 7011 - DNA, 1859 bp, Panicum virgatum
  misc_feature: Ceres CLONE 1896410
  misc_feature: Encodes the peptide sequence at SEQ ID NO. 7012
acacaaaagagaatgcaggaaaagttggttgtggatcagatcatttatttggttagtaataatgaatgaaggagctagtatagtagtgcccaacagtgcagagaggagtcctataaattgggcgccgctcctgccgctacatccaatccactccctcttttctctcttgtgacctcacgggtcactagaggccactgcgcgcggttaccagcgccgagctgcagcagcaatggcgtcgccgatgctcaatgcatctccactcctccagttggtatgcgtcctcctggtggccgcgtcgtcgacggtggccgggcgccaccactactccccagcagcatccaggagcgagcagagcacgtacctgtcgcccaactgccgggcgcacacggcgtcgctggcggacttcggcgccgtgggcgacggcacgacgtccaacacggcggcattccgttcggcggtggaccacctgtcgcagtactccggcgagggcggcgccatgctgtacgtgccggcggagaagtggctgacggggcccttcaacctgacgagccacttcacgctcttcctgcacagcgacgccgtcatcctgggatcgcaggatatcggcgagtggccggtgatcgaccccctcccttcgtacgggcgaggccgggacaaggccggcggtcggtacgcgagcctgatcggcgggtcgaacctgacggacgtggtggtcaccggcgacaatggcacgatcgacgggcagggcgcggtgtggtggtccaagttccgcagcaacaagctcaagtacacgcggggttacctgatcgaggtgctgtggtcggacacggtggtggtggccaacgtgacgctgctcaactcgccggcgtggaacatccacccggtgtacagccgcaacatcgtggtgcagggcgtcacgatcctggcgccgacgcggtcccccaacacggacggcatcaacccggactcgtgcgcccacgtccgcatccaggactgctacgtcgtctccggcgacgactgcgtggccatcaagagcggctgggacgagtacggcatccgggtcggcatgcccagcgagcacatcgtcgtccgccgcctcacctgcgtgtcgcccaccagcgccgtcatcgcgctcggcagcgagatgtcgggcggcatccgggacgtgcgcgccgaggacatcgccgccgtcgactccgagtcgggcgtgcggatcaagaccgccgtggggcggggcgcctacgtgcgcgacgtgttcgtgcggcggatgacgctccagaccatgaagtgggtgttctggatgacgggcaactacaagtcccacccggacgacggcttcgacccgagcgcggtgcccgtggtggagggcatcagctaccaggacgtggtggcgacgggggtgtacaaggcggcggcgcgcctcgagggcatccagggcgcgcccttccggggcatctgcctcgccaacgtcacggccgagctcgacaaatcgaagaagtacccctggacctgcaccgacgtcgagggcgtgtcggccaacgtcaccccgccgccgtgcgaggcgctgcagcagagcggcggcggcgacgtcgccggcggctgccccttcccgacggacacgctgcccatcgaccagctcaccctgcagcactgcgcctacgacgtcccaagcagcagcaactagctgctgctgctactactactagtctgatctgaaaacaattacttactgtaataaggaaacaggaaaggaccgtgccgtgcgtgtgctagttgaatttccctcctcatacagtcatgctctctgtacaaatcaaaagattaaggaggctgctgccctgaccggccctgcaagttgt

SEQ ID NO: 7012 - protein, 484 aa, Panicum virgatum
  misc_feature: Ceres CLONE 1896410
  misc_feature: Great-hit functional homolog of the protein sequence encoded by LOCUS At3g61490
  misc_feature (1)..(130): Pfam Name: Glyco_hydro_28 Pfam Description: Glycosyl hydrolases family 28
  misc_feature: Useful for making plants with altered cell wall content and/or composition
MASPMLNASPLLQLVCVLLVAASSTVAGRHHYSPAASRSEQSTYLSPNCRAHTASLADFGAVGDGTTSNTAAFRSAVDHLSQYSGEGGAMLYVPAEKWLTGPFNLTSHFTLFLHSDAVILGSQDIGEWPVIDPLPSYGRGRDKAGGRYASLIGGSNLTDVVVTGDNGTIDGQGAVWWSKFRSNKLKYTRGYLIEVLWSDTVVVANVTLLNSPAWNIHPVYSRNIVVQGVTILAPTRSPNTDGINPDSCAHVRIQDCYVVSGDDCVAIKSGWDEYGIRVGMPSEHIVVRRLTCVSPTSAVIALGSEMSGGIRDVRAEDIAAVDSESGVRIKTAVGRGAYVRDVFVRRMTLQTMKWVFWMTGNYKSHPDDGFDPSAVPVVEGISYQDVVATGVYKAAARLEGIQGAPFRGICLANVTAELDKSKKYPWTCTDVEGVSANVTPPPCEALQQSGGGDVAGGCPFPTDTLPIDQLTLQHCAYDVPSSSN

SEQ ID NO: 7013 - DNA, 2043 bp, Panicum virgatum
  misc_feature: Ceres CLONE 1896682
  misc_feature: Encodes the peptide sequence at SEQ ID NO. 7014
acgacccgtgtgtgtgctgtctgctgggtgtgtggcctcggctgctcgctagctgctgctagcttcctcctctcgctagctgctgcttgcttgctcctccatagcccgcagcttgaagccttgagcagaggaggaggtcgagctcgctcgttcggtcgcggcgatggggaagcctcgcctcgctccgcttgccacggcggggttcgtcgtcgtgctgtggatgctgctgcattgcggcagcgagctcgtcgcggcggtgcctcctgatggctggtacgactactccgcctattctgactgcagagggcagccggagccggcgctgtacaacggcggcatcctcaagttcggcaacagcgacgacccggacggctaccgcacgacggagaccggcgtcttctccccggcgttcgtggtctacaacctcaacaagaccaccatgtacaccttctcatgctgggtgaagctggaaggcgcctccaacgctctgatcactgcgaggctggcgccggacaacaccggcgcgaggtgcatcggcacggttctcgccaggagcgactgctgggccttcgtcaagggcggcttcgtcctcgactggccaacgcagaccgccgtcatcttcttccagaacgctgacaagacgcccatgaagatcaccgtcgccagcgggtcgctgcagccgttcacgacggaccagtgggcgatgcaccagcaggacaccatccggaagaggaggaagcgcgtggcgaccatccacgtggccgacccgcagggcgcccgcgtggtgggcgcgtccgtttccgtgcagcagaccgccaaggacttcccgatcgggtcggccatcgcgtccaccatcctgggcaaccaggcgtaccagaagtggttcgtggaccgcttcaacgcggcggtgttcgaggacgagctcaagtggtactcgacggagcccacgtcggggctcctccgcttcgacgtgccggaccagatgctggcgttcgtgcgctcccaccgtgtgatggtgcgcggccacaacatcttctgggagaaccaggacgcgacgccgcggtgggtcaagaacctgacctcgccggacgacctccgcgccgccgtgaacgcgcgcatccagggcctcatgacccgctaccgcggcgagttcgcgcactgggacgtcaacaacgagatgctccactacaacttctacgagcagcggctggggcccaacgcgtccatggagttcttcagcgtggcgcaggacgccgacccgctggcgacgctcttcatgaacgagtacaacgtgatcgagacctgcgacgaccccttctccaccgtggacacgtacgcggccaagctcagggagctccgcgccgggggcgccatcctggaggggatcgggctggagggccacttctccaggcccaacatcccgctgatgcgcgccatcctggacaagctcgccacgctggggctccccatctggttcaccgagatcgacatcagcagcaagttcgacgcgcagacgcaggcggcgtacctggagcaggtgctgcgggaggcgtacgcgcacccggcggtgagcggggtgatgctgtggacggcgatgcaccccagcgggtgctaccagatgtgcctcaccgactggggcctcaacaacctgcccacgggggacgtcgccgaccgcctgctcaacgagtggcggacgctgcaggccggcggccagacggacgcgcacggcgcctacagcttcagcggattcctcggggagtacatcctcacggtcacctacaacaacaggacgacgcagtccaccttctcgctctcgccgggcgatgagaccaggcacatcaacgtccagatgtaactgcctaccaggcaccagccctcgtgctgttctgggagcgtctctcctgactccgtcgtcccatacgggtagtgtgatgtatgcaacggcttactactagctaatgtaagctaatgtagtgtttgtataagtgattgctgtggaagaaatttcacatggttcccatccaaaaaaaaaaaaaaaaaaaa

SEQ ID NO: 7014 - protein, 563 aa, Panicum virgatum
  misc_feature: Ceres CLONE 1896682
  misc_feature (1)..(129): Pfam Name: Glyco_hydro_10 Pfam Description: Glycosyl hydrolase family 10
MGKPRLAPLATAGFVVVLWMLLHCGSELVAAVPPDGWYDYSAYSDCRGQPEPALYNGGILKFGNSDDPDGYRTTETGVFSPAFVVYNLNKTTMYTFSCWVKLEGASNALITARLAPDNTGARCIGTVLARSDCWAFVKGGFVLDWPTQTAVIFFQNADKTPMKITVASGSLQPFTTDQWAMHQQDTIRKRRKRVATIHVADPQGARVVGASVSVQQTAKDFPIGSAIASTILGNQAYQKWFVDRFNAAVFEDELKWYSTEPTSGLLRFDVPDQMLAFVRSHRVMVRGHNIFWENQDATPRWVKNLTSPDDLRAAVNARIQGLMTRYRGEFAHWDVNNEMLHYNFYEQRLGPNASMEFFSVAQDADPLATLFMNEYNVIETCDDPFSTVDTYAAKLRELRAGGAILEGIGLEGHFSRPNIPLMRAILDKLATLGLPIWFTEIDISSKFDAQTQAAYLEQVLREAYAHPAVSGVMLWTAMHPSGCYQMCLTDWGLNNLPTGDVADRLLNEWRTLQAGGQTDAHGAYSFSGFLGEYILTVTYNNRTTQSTFSLSPGDETRHINVQM

SEQ ID NO: 7015 - DNA, 2431 bp, Panicum virgatum
  misc_feature: Ceres CLONE 1896695
  misc_feature: Encodes the peptide sequence at SEQ ID NO. 7016
atggcccggcccagctttcacacggcccgcgaagaagccgttcccaaaccctaaccccagagcggcggacaagggcaaccatggcgtccgtcgccgcgccgaccgcctcgctggcgggaaagcgccccacctccggcgcccgggagggcgaccagatggtcatcacgccgctgggcgccggcagcgaggtcggccgctcctgcgtccacatgaccttcaagggccgcaccgtcctcttcgactgcggcatccacccggcctactccggcatggcggcgctgccctacttcgacgagatcgatccctccaccatagacgtcctcctcatcacccactttcacttggaccatgccgcctcgctgccctatttcctcgagaagactacgttcaagggcagggtgtttatgacccatgccacaaaggctatttacaagctgctgcttacggattatgtcaaagtcagcaaagtttccgtggaggatatgctgtataatgagaatgacattgctcgctctatggagaaaattgaggttatcgatttccaccagacattggaagttaatggcatacgtttctggtgctacactgctggccatgtacttggtgccgccatgttcatggtggatatcgctggtgtgcgcattctttacactggtgactactcccgtgaagaagaccgccacctacgagctgctgagctcccacagttctccccagatatttgcattattgagtcgacttatggcatacaacaacatcagcccaggattgtacgcgagaagcgctttactgaggtcatccacaatactgtttcacatgggggtcgtgttcttatcccagcatttgctcttggcagagcacaagagctgttgcttatccttgatgagtattggtccaagcacccagagctccataagattccaatctattatgcctcccctcttgcaaagaggtgcatggctgtctaccagacatacataaactccatgaatgaaaggatacggaaccagtttgcacagtccaatccctttgttttcaagcatatcgagtccttgaatagcattgagaatttccatgacgtaggtccttcagtggtgatggctagtccaggtggtcttcagagcggtctctctaggcagctttttgataagtggtgcacagataagaagaatgcttgtgttattccaggatatgttgtggaggggacccttgcaaagaccattatcaacgagccaagagaagtgacgctagctaatgggctcactgctcctcttcatatgcaggttcactatatatctttctcagctcatgctgatttccctcagacaagcaactttttggatgaacttcggccacccaacattattcttgtgcatggagaagcaaatgaaatgtcaaggcttaaacagaaacttatttctcagtttgatgggacaaacaccaaaattgtttctcccaagaactgccaatcagtggagatgtatttcacttgtgagaaaatggccaagactattggcaggctggcagagagcgtaccagaaggtggagagtcatcgggtggcttacttgtgaaaaaagggttcacatatcagattatggctcctgaagatctccgagtgttcacacagttatctacagctaacatcactcaacgcattgcggtcccttactctggttcttttgaagtcataaagtacaggctgaagcaaatatatgagagcgtggagtcagcaactgaagaatctgatgttcccacacttattgtgcatgaacgagtgacagttcgccaagagtcagaaagctatgttacgctgcaatggtcatcggatcccattagcgacatggtgtctgattctgtggtggctgtggtcttgaacataggccgtgagggtccaaaagttgttccggttgaagaagcagcgaagaccaaggaagatacagaaagggtagcactaaaggtagtgtattctcttatggtgtcgctttttggtgatgttaaagttggagaggaagggaaatttgtcatatccgtcgatggagatgtggcacacttggatgggaggagtggtgatgttgaatgtgaaaatgctacactgaaagaacggatcaagactgctttccgtcgcatacagggtgctgtgagaccaatcccacttttagcctcttgatctggaggtgccaagatcatgctttagacttattatccaacatttcctagctcaacattcgacttcatttagagagcagaactttttttttttgagtcaaatgtcttgtaccacagttgttgaaaacacgaaatgattagtgtgctctgagcctatgtactccctctgaaacatgagttacaacattgtactaatttctactaacagctactcttactatgttaaccttctttctttgagaataaaaaaaaaaaaaaaaaaaa

SEQ ID NO: 7016 - protein, 695 aa, Panicum virgatum
  misc_feature: Ceres CLONE 1896695
  misc_feature (1)..(189): Pfam Name: Lactamase_B Pfam Description: Metallo-beta-lactamase superfamily
MASVAAPTASLAGKRPTSGAREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYKLLLTDYVKVSKVSVEDMLYNENDIARSMEKIEVIDFHQTLEVNGIRFWCYTAGHVLGAAMFMVDIAGVRILYTGDYSREEDRHLRAAELPQFSPDICIIESTYGIQQHQPRIVREKRFTEVIHNTVSHGGRVLIPAFALGRAQELLLILDEYWSKHPELHKIPIYYASPLAKRCMAVYQTYINSMNERIRNQFAQSNPFVFKHIESLNSIENFHDVGPSVVMASPGGLQSGLSRQLFDKWCTDKKNACVIPGYVVEGTLAKTIINEPREVTLANGLTAPLHMQVHYISFSAHADFPQTSNFLDELRPPNIILVHGEANEMSRLKQKLISQFDGTNTKIVSPKNCQSVEMYFTCEKMAKTIGRLAESVPEGGESSGGLLVKKGFTYQIMAPEDLRVFTQLSTANITQRIAVPYSGSFEVIKYRLKQIYESVESATEESDVPTLIVHERVTVRQESESYVTLQWSSDPISDMVSDSVVAVVLNIGREGPKVVPVEEAAKTKEDTERVALKVVYSLMVSLFGDVKVGEEGKFVISVDGDVAHLDGRSGDVECENATLKERIKTAFRRIQGAVRPIPLLAS

SEQ ID NO: 7017 - DNA, 1550 bp, Panicum virgatum
  misc_feature: Ceres CLONE 1896830
  misc_feature: Encodes the peptide sequence at SEQ ID NO. 7018
atagcgcttcctagttgcgtgttctagtgtgctacgcatgctgctaaagatttcaagaaagtccctacaatcatgagcggatttggttagagcgggcaaagacaagagaaatgatgtgttgaggcagctaacttccaagcatcggtcacactcaccatttccatctttcctcttcttcgccggcgccagccccagcatcgccgaacctcccgcacgccggccggagaattcatccagacgtggcattgagcgaatccttttcctggcatggcgaggttcggatggagagtcggttccaaggtgcagagatggggtcggagcttcttccggggcttctcttctgcttcgattccgtctcagctggagcacacactattatcgacttggtttgaacgtctacgagaacttaactaaaatagggaagaatgtaggattcattggactcgggaatatgggatcccatatggcaaggaacctgattacggctggatataaagtgactgttcatgatataaatgaaaattcgatgaagaaattctcagacgatggaatccccacaaagcagtctccacttgaagtttcagagtcgagtgatgtcgtgattaccatgcttccttcctcttcccatgttttagaggtatacaatggaactaatggcttgcttggtggtggtagccaccttggaccttggttatacatagactcatctacagttgatccgcaaacatcaagaaagatatcgacggccatatcaagatgccatttaaaggaaaataaaggctacgttgaaaacccattgattctggatgctccggtttctggaggtgttcctgctgcagaagctgcgaagctaactttcatggtaggaggtctagaggaagcatatttagcagccaagcccctacttctctcaatggggaaaagggcaatctactgcggtggggctggaaatggctcggctgcaaagatctgtaacaacatggcaatggcgatcagcatgcttggggtctcagaagcctttgctcttggtcagaatcttgggatcaaagcaagcactcttacagacattttcaattgctcgagtgctcgctgctggagtagcgacacatataacccagttcccggagttatggagggcgtgccatcatcgaggaactatgacggtggtttcacctccaaactaatggctaaagatttggatttggccatggcctctgcatctggagtcggcttcaaatgtcccatgggctctgaggcacttgaaatttaccgaaagctctgcggggattgctgcgaactcaaggacttctcatgtgtattccgccattactatgctggcaaggatgaagagtgacctgctagttactctagcaaacttgccgcttgttcaaatgaataaaacaaaaataaagtttctggaatggttccagtgtaaatctgtagagttgtactgagatatggtggctttgtaaactgtttgttggtttgcttctcggcaatggcaatagactgttcgagacatctttaactaaaaaaaaaaaaaaaaaaaa

SEQ ID NO: 7018 - protein, 300 aa, Panicum virgatum
  misc_feature: Ceres CLONE 1896830
  misc_feature (12)..(176): Pfam Name: NAD_binding_2 Pfam Description: NAD binding domain of 6- phosphogluconate dehydrogenase
MGSHMARNLITAGYKVTVHDINENSMKKFSDDGIPTKQSPLEVSESSDVVITMLPSSSHVLEVYNGTNGLLGGGSHLGPWLYIDSSTVDPQTSRKISTAISRCHLKENKGYVENPLILDAPVSGGVPAAEAAKLTFMVGGLEEAYLAAKPLLLSMGKRAIYCGGAGNGSAAKICNNMAMAISMLGVSEAFALGQNLGIKASTLTDIFNCSSARCWSSDTYNPVPGVMEGVPSSRNYDGGFTSKLMAKDLDLAMASASGVGFKCPMGSEALEIYRKLCGDCCELKDFSCVFRHYYAGKDEE

SEQ ID NO: 7019 - DNA, 1953 bp, Panicum virgatum
  misc_feature: Ceres CLONE 1896863
  misc_feature: Encodes the peptide sequence at SEQ ID NO. 7020
actgaaagagaacttaataccgagcactgcgccgcggtggccatggcagcgttgcttcgcaaaggttcccctccctccccgcatgggcacggccgcgtcgacgacgagcagagtgccccggccacgagggcgctgcgcttccggtaacttccgccgttataaattgcgccgggcgctcactcccacatgttaaactgccgcacccgcacgtctccccagtcaaacacagatcagctcagctcagctagcgaactcctcttctacacagtccccgacgcacgccctgatccctctgcttcgcttcctttctccctcctcccgctcgatcggattcaccgttcaccgtccgcgctctccagtctccacccgccgcggtcaacccgatagcgccgtggtcaggaggtgggattgattacaagtggggagcgcggggtgggtgatgtacggctcgccggtgcccaaggacctcaacctgccagcagcccagcagccgcagccgaccacgaccaggacgccgccgcagatgagctccccgggcctgctgcggtacaggtcggcgccgagcacgctgctcggcgaggtgatgtgcggggatcacgacttccccggggcggctgccggcgcggcagggcacggcccggagcacgccgccgcggacaacgtcctcgcccggtttcttgccgggcaccacgcggagatccccgactgcaagcctccccgcccggccgcggccgcccacttcatggaggacgccgcgtccgtggccgcctcgcagcagcagcagctcatgtacccgtcgcagcagcagatggccgctatggaggggctctaccgcaacgtcagctccggcggcgcggagcaggctgttgccgccggcgccagcggcggcgccgtgctccgtcagagcagctcccccgctggtttcctgaaccatctgagcatggacaacgggtacggaagcatgctccgggcgggcatggccgtcggcgggttcaggaacggcgtcgtcggcgacgcgcggctcaaggggcagctgagcttcccgtcccgacaggggtcggtgatgtcgcagatctccgaggtgggcagcgaggagctcgacggcggcggcagccccgaggcggccggcagcaacggcgcggcgcgcgggtacggcggcatcccggggtacccgatgggcggcggctcgtccggcgcctgggcggacgagcagtcgccgacgtcgtccggcgcgaagcgcccccgcgactccggctcggcgccgcagaacgggcagcagcagcagccgctggcgtcgcagctcagcctgcccggcggcggcggcggcggcaacggcgtcgggaagcagccctcggcggagatggcggcgatcgacaagttcctgcagttccaggacgccgtcccctgcaagatccgcgccaagcgcgggtgcgccacccacccccgcagcatcgccgagcgggtgaggaggacgaagatcagcgagcggatacggaagctgcaggagctcgtgcccaacatggaaaagcaaaccaacactgccgacatgttggatctggccgtggactacatcaaggatcttcagaagaaggtcaaggtgctgaacgacggccgcgccagctgcacctgctccgccggcaagctgctgcagaaccagttcggcagctgaaacagccgccacctctcacggctggatgcggcgcgccacggccgcaaggcctggccggaggagaagcctctgcaccggccgcatcctctggtcctagtcctaccggtgtacttgccagcgtacatgaggaggtgaaaccgtaaaagaaaaagatacttgtagagatgggctgatctactcaaaatcaaagatatttacttgaggggcaggagactacaaactaaaaatggaaaaaataccatactttggtctgattcttggttgaataacaagcctctctgtgc

SEQ ID NO: 7020 - protein, 409 aa, Panicum virgatum
  misc_feature: Ceres CLONE 1896863
  misc_feature (1)..(49): Pfam Name: HLH Pfam Description: Helix-loop-helix DNA-binding domain
  misc_feature: The sequence is a functional homolog of  SEQ ID NO 1258 in the  10/412,699 US patent application
  misc_feature: The sequence is a functional homolog of  SEQ ID NO 172 in the  10/714,887 US patent application
  misc_feature: The sequence is a functional homolog of  SEQ ID NO 172 in the  11/435,388 US patent application
  misc_feature: Useful for making plants with modulated growth and phenotype characteristics
MYGSPVPKDLNLPAAQQPQPTTTRTPPQMSSPGLLRYRSAPSTLLGEVMCGDHDFPGAAAGAAGHGPEHAAADNVLARFLAGHHAEIPDCKPPRPAAAAHFMEDAASVAASQQQQLMYPSQQQMAAMEGLYRNVSSGGAEQAVAAGASGGAVLRQSSSPAGFLNHLSMDNGYGSMLRAGMAVGGFRNGVVGDARLKGQLSFPSRQGSVMSQISEVGSEELDGGGSPEAAGSNGAARGYGGIPGYPMGGGSSGAWADEQSPTSSGAKRPRDSGSAPQNGQQQQPLASQLSLPGGGGGGNGVGKQPSAEMAAIDKFLQFQDAVPCKIRAKRGCATHPRSIAERVRRTKISERIRKLQELVPNMEKQTNTADMLDLAVDYIKDLQKKVKVLNDGRASCTCSAGKLLQNQFGS

SEQ ID NO: 7021 - DNA, 2040 bp, Panicum virgatum
  misc_feature: Ceres CLONE 1896936
  misc_feature: Encodes the peptide sequence at SEQ ID NO. 7022
cccgtccgacgtggcgccctcgcccatgctcttcttctcccgtcccctgcggccctgcctctacccctgcccggttgcccctccttcttcctccccacgctcgccccgccccgtcctcatcagcgacaagagctcgcgccgggccgaggctgccgcgatatttgcggcgggtcgagccgagccttccagttccagtggtggcaaccggagatgctctgtttggaggaacatcagatggaaaccgacgagggcaccgtcgatcaccgtaaggatcccctcgataccggcgacatggatttatccggcgaggagcgcgtgcccaaggcacggaagccgtacacgatcaccaagcagcgggagaagtggacggaggacgagcaccggcgcttcctcgaggccctgcagctgcacggccgcgcctggcgccgcatccaagagcgcatcggcaccaagaccgccgtgcaaatccggagccacgcgcagaagttcttcaccaaggtcgtcagggaatcgtcggggagcaacgccgccgcgggcgcagcgccggcgatccagatcccgccgccgcggcccaagaggaagccggcccacccgtacccgcgcaaggtggacggcgcggccaagaagcacgtgccggcgctttggcagctggagaagccgcccctgcggacgcactccctgcgcgaccaggacgacgggtcgccgacgtcggtgctgaccaccgcgcggacggtgttacgagcggaggagttgggcagcgtgttcgcgaacagctcgagcgggagcaggtcgccggcccagtcagccgccggttcagaggagcatggcaacggcggggactcgccggcctcgtccgtcggcggagaggacggcggcgtgtcgccaagcgcagtaacagctgagttggcgacgagaacagcaaatgccaaggtgttcggcgatgcaaaagaagtgtctggcgtaggaacagatgctccggtctttaaattgttcggaaagaaagttgtggtgaaggattcctatgggcacccgcaaagcggcatagacctgaaaataggtgcttcacctgcgatcgttgcagcaggaggcagctcgtggaatccatggccgggcaccgtgcagcagctcatgtgcttcgttccgcagcccgacggtttcgccgcgcagtccgtggtgccgtggctcgcctacaacggcggcctgccgtgcgcgctgttctacccgcaggcggcgccttcggcccagcaccagcagcagctccaccaccaccagacttcagagcctctcgatcacaaacgcacgcggagggaagggtcgctgacgggctcgaacacggcctccagcgccgtgccggcggcgtcggcggcggcgcagaactcggacgccgcggagtcccacggccccgggcaagaaaacaccggcgagagcgacgcggtgccgccggctgccgcagcggttcccgtcccgcgcctggcgaggtgcgcgagctcggcttccttcagccggagagggttcgtgccgtacaagcggtgcgcggcggagagcgaggcgccgcggcccgtggcggccggggaggaggccgacggcgagctcacgaggctgtgcttgtagcgacagtcggcaaaaggaagcaacgatacgtgacagtccgcgaacggaagtcacgatactatttttgggtgtttgctaggtttgctccggtttcttttgctgctggacatgtgcatatgactatgggctgatgccagatagccttgaagcagctgggagaccaaccacgggagttttcaagaaatggacgagcagccctggtcggtactcgcctcctcggtatatacgtgtataggtaaaacttgtataatattccgctttttgttcgctgtgtggtcgtgtaattttgctccagcttgggaggttctgggtcagtagctgactgtggaacctgggatagactactcccttgtagtctgatcacatgtaatccctccgtctcaaaataaatgcatttctaagattggacaaaaaaaaaaaaaaaaaaaa

SEQ ID NO: 7022 - protein, 466 aa, Panicum virgatum
  misc_feature: Ceres CLONE 1896936
  misc_feature (1)..(46): Pfam Name: Myb_DNA-binding Pfam Description: Myb-like DNA-binding domain
MLCLEEHQMETDEGTVDHRKDPLDTGDMDLSGEERVPKARKPYTITKQREKWTEDEHRRFLEALQLHGRAWRRIQERIGTKTAVQIRSHAQKFFTKVVRESSGSNAAAGAAPAIQIPPPRPKRKPAHPYPRKVDGAAKKHVPALWQLEKPPLRTHSLRDQDDGSPTSVLTTARTVLRAEELGSVFANSSSGSRSPAQSAAGSEEHGNGGDSPASSVGGEDGGVSPSAVTAELATRTANAKVFGDAKEVSGVGTDAPVFKLFGKKVVVKDSYGHPQSGIDLKIGASPAIVAAGGSSWNPWPGTVQQLMCFVPQPDGFAAQSVVPWLAYNGGLPCALFYPQAAPSAQHQQQLHHHQTSEPLDHKRTRREGSLTGSNTASSAVPAASAAAQNSDAAESHGPGQENTGESDAVPPAAAAVPVPRLARCASSASFSRRGFVPYKRCAAESEAPRPVAAGEEADGELTRLCL

SEQ ID NO: 7023 - DNA, 2351 bp, Panicum virgatum
  misc_feature: Ceres CLONE 1896944
  misc_feature: Encodes the peptide sequence at SEQ ID NO. 7024
aaacccctaaaccctagccgcaccagggcctctcccctccttccccggcggcggcggcggcggcgagtggcacaccagtatcggacgcggagaagcgcatatactctcaggtttggcggagatgcctctggggcagcgcgcaggggacaagagcgattcccgctactgcggggtggaggtgctcgacttccccgccggcgagggcctccccgccgtcctcaatcactccctcgcctcctccttcgacttcatcctcgccccgctggtcgaccccaactaccggcccgcgcccggcgccgtgctgcccgtgtcggcgtcggacctcgtcctcggcccggcccagtggagcaaccacgtcgtcgggaagatcagcgagtggatcgatttggacgcggaggacgagcagctccggttggactccgagctcacgctgaagcaggagatcgcttgggcatctcacctctcgctgcaggcatgcgttcttcctgcccccagaagatcttgtggcaattatgctagagttgtgaatcaaattttgcaaggcctgaccaacatgcatttgtggcttaggctacctttggagaagtcggagccaatggatgatgaccttgataaagtaaagaataacaaccatatgaatgaaatggtagactcatgggaattgtggaattcattcaaactgctatgtgatcatagtagccaactatgtgtggcacttgatatttcgagcacactgccatcaataaactcattaggccggtggtttggggagcctgtaagggcagctattctacaaaccaatgcttttctaacaaatggaagagggtatccttgtttgtcaaagcggcatcagaagctgctaactggattttttaaccattatattcaggtaatactctctgggagatcaaatcacaatgttcccccagtatctgaaggagtgctcttaggtgatgagaaccacactgaagatgcccctgttcgacatgcattaagtccatacctggactacactgcatacctataccggaggatggatccacttcctgagcaggaatgctttgagatcaattacagggattttttgcagtcccctctccagcctctaatggataatttggaagctcagacttatgagacatttgagaaggatgttgtgaagtacactcagtatcaaagagcagttgctaaggctttggttgatagggtcccagatgatgcggtctccacaactaggacggtgctgatggttgttggagcaggccgaggacctctagtacgagtatcattgcaggctgctgaacaaactggtcgcaagttaaaagtatatgctgtggaaaaaaatcctaatgctgtcattactcttcatagtttgatcaaattggaggggtgggaaagcttggttactgtaatttctagcgacatgaggtgctgggatgcccctgaaaaagcagatattttggtcagtgaattgcttgggtcctttggtgacaatgagttatctcctgagtgtctggatggtgctcagcgattcttgaagcctgatgggatttctattccttcttcatacactagttttatccaaccaataacagcatcaaagttgcacaatgatatcaaagcacacaaagatattgcacattttgaaactgcatatgttgtcaaactacaccgcatagcgacactgacacctccacaacaggtatttactttcacccatccaaatttctcaccaaacgcgagcaatcaaaggtataccaagttgcaatttgaaatgccaccagatatggggtcatgccttgtgcacggatttgctggatattttgactctgttctatataaggatgttcatcttggaattgagccaaacactgctacaccaaacatgtttagctggttcccgatcttcttcccgttgagaaagcccatctacgtacccgaccgatctcctatagaagtgcacttctggcggtgctgtgcccccacaaaggtgtggtacgagtgggctgtgacgacaccgactccgtcacccatccataacagcagtggccggtcatattgggttggtctataagtcaccaagatcattgttgtcttatattttgtaacagagaaaaaaaaattaggtattagtaatatctggagtttcgctggtgcctggaggatccttggagtttcaagcaatggacatcatcttggatgcagggcttttgggagccctggaacattggaacttgtatctcaaaggggtcgtttggcctccaacgttgtgcgctcgattttgatagcattaggcttttgacttgcaaattttgacaatatttcttgttgaaaaaaaaaaaaaaaaaaaa

SEQ ID NO: 7024 - protein, 650 aa, Panicum virgatum
  misc_feature: Ceres CLONE 1896944
  misc_feature (1)..(456): Pfam Name: PRMT5 Pfam Description: PRMT5 arginine-N-methyltransferase
  misc_feature (4)..(451): Pfam Name: PRMT5 Pfam Description: PRMT5 arginine-N-methyltransferase
  misc_feature (2)..(457): Pfam Name: PRMT5 Pfam Description: PRMT5 arginine-N-methyltransferase
  misc_feature (274)..(650): SWISSPROT Homolog: EC 2.1.1.125 Protein arginine N-methyltransferase 5
MPLGQRAGDKSDSRYCGVEVLDFPAGEGLPAVLNHSLASSFDFILAPLVDPNYRPAPGAVLPVSASDLVLGPAQWSNHVVGKISEWIDLDAEDEQLRLDSELTLKQEIAWASHLSLQACVLPAPRRSCGNYARVVNQILQGLTNMHLWLRLPLEKSEPMDDDLDKVKNNNHMNEMVDSWELWNSFKLLCDHSSQLCVALDISSTLPSINSLGRWFGEPVRAAILQTNAFLTNGRGYPCLSKRHQKLLTGFFNHYIQVILSGRSNHNVPPVSEGVLLGDENHTEDAPVRHALSPYLDYTAYLYRRMDPLPEQECFEINYRDFLQSPLQPLMDNLEAQTYETFEKDVVKYTQYQRAVAKALVDRVPDDAVSTTRTVLMVVGAGRGPLVRVSLQAAEQTGRKLKVYAVEKNPNAVITLHSLIKLEGWESLVTVISSDMRCWDAPEKADILVSELLGSFGDNELSPECLDGAQRFLKPDGISIPSSYTSFIQPITASKLHNDIKAHKDIAHFETAYVVKLHRIATLTPPQQVFTFTHPNFSPNASNQRYTKLQFEMPPDMGSCLVHGFAGYFDSVLYKDVHLGIEPNTATPNMFSWFPIFFPLRKPIYVPDRSPIEVHFWRCCAPTKVWYEWAVTTPTPSPIHNSSGRSYWVGL

SEQ ID NO: 7025 - DNA, 1644 bp, Panicum virgatum
  misc_feature: Ceres CLONE 1897174
  misc_feature: Encodes the peptide sequence at SEQ ID NO. 7026
aaaacgggaggacaaaaaaaaaaaagagcatactcaccaaactcgagctctctcccccagcggctctgctgaatgaagatggtttcgttatgccatcctgttcgaatcagaacatgcgggaaatttgcgacgaggaatgcagcagccaaggtcttgtgctccatggagacgccaccgtcccagagcacaatcaaggttgttatcatcggggccacaaaggaaattgggaggacggcgattgttgcagtcagtaaagccaggggcatggagcttgcaggggcaatcgattcccagggcattggagaggacgcgggacaggtgctcaccgttcattcaatgtgctatttcccctgcactgcacttgtctctcacgttcaatctccaagctgctgcttctcttctttatctcggaccctttgtgaatgctggcacattgccctccagattagtggcatggaggagccgttggaaattccggtgctcaatgatctcacaatggttctgggctccatagcacaatcgagagcaactggcgtggttgttgatttcagtgaaccttcaactgtttatgacaatgtcaagcaggcagcagcatttggtttaagcagcattgtctatgttccaaagattgagttagatacagtaactgaactgtcagcattttgcgagaaggcaagcatgggttgcttggttgcaccaacattatcgattggctcagtgctccttcaacaagctatacaggcctcatttcactacagcaatgctgaaattgtggaatcaaaacctaacccatcggacttgccatcgcaagatgcaatacagattgcaaataacatatcagatcttggccagatatacaacaggaaagatatggataccagtaatccagcaaggggccaagtacttggagaagatggagtgcgtgtacacagtatggttcttccaggtcttgtttccagcacatcaatcaatttctcaggcccaggagagatttacaccttacggcatgatgtcacaaatgttcaatgcctaatgccaggattaatcctggcaataagaaaggtggtacggttgaagaacttgatttatggtctagagaagttcctttagtgcacatccatctcggtataacttctggctgttcctgattatcaaatgggcaggaacatatctatttccgggcatgaggtaaacaaagtaccacaaccacaagcaaggtagatcaaatcttacaaggcaaccagatagagctttggaattaaagactgcacagaagactactcaaattttgaatgcacactacctaggaaacacaattttgtcaaaaggcatgggggagaatttattcaagaaaaatcacaaaacggtcacatggataaccactggtagcagtaccaagccaatgaatggagtgttcagactgacatcaagattcaattccatcagcacagcaaggagtttctagttgtaattcagagatactgtaattccgcttgtatgtggcaaatcagtggccaattcagcgctaactttctctagtcatggtgacaatttaatgcagaagactgagctgaaacaatttgcatcagcctaatgcaaatctcttgtccaatttaatgcattcaaaaaaaaaaaaaaaaaaaa

SEQ ID NO: 7026 - protein, 345 aa, Panicum virgatum
  misc_feature: Ceres CLONE 1897174
  misc_feature (1)..(133): Pfam Name: DapB_C Pfam Description: Dihydrodipicolinate reductase, C-terminus
MKMVSLCHPVRIRTCGKFATRNAAAKVLCSMETPPSQSTIKVVIIGATKEIGRTAIVAVSKARGMELAGAIDSQGIGEDAGQVLTVHSMCYFPCTALVSHVQSPSCCFSSLSRTLCECWHIALQISGMEEPLEIPVLNDLTMVLGSIAQSRATGVVVDFSEPSTVYDNVKQAAAFGLSSIVYVPKIELDTVTELSAFCEKASMGCLVAPTLSIGSVLLQQAIQASFHYSNAEIVESKPNPSDLPSQDAIQIANNISDLGQIYNRKDMDTSNPARGQVLGEDGVRVHSMVLPGLVSSTSINFSGPGEIYTLRHDVTNVQCLMPGLILAIRKVVRLKNLIYGLEKFL

SEQ ID NO: 7027 - DNA, 1566 bp, Panicum virgatum
  misc_feature: Ceres CLONE 1897184
  misc_feature: Encodes the peptide sequence at SEQ ID NO. 7028
aaaacgggctcacagcgcaagcactcgcgcttgcgtccgcctggtccgggaaagcttggctgagtgctcgtcgcccttcctctggccgacggaagagcggacgcccccccccccccccctccctgctctcgtctcgcctgaaccctaggtggcgacgagctagcggcgcgtcggcgccggcgggcctggcgcgagagctgcatccggcgtccctcgtccatctctcctagtctctcagattttcaacctctcggctccctagtccctagacggattggcgggcggcggcacctccgtgcctcgactgtgtgccctatttcgaggtggagtggaggtgggaggaccgagtcatgggggcctctgcccaggaatcgggtttgtggaagcaaatcgacgacgcggaggactatctactcagcggattgtttgagcaggcagtatcggcggctttatctgtgtccgatcaaatacgcacagtttctttggaggctgaatgtgaccgtgacgaactcttagatattcttgaatcagctggaatggtccttgtccaggcacttaaagaactcaggaggacgtctgagatgtttgttcagcttaattcaatgtttggttcggtggcatcggtacctgccaaagttttccttactggagctaccatgcaaatggcagcaggatctggatcagagcttagagcaatatttgatgtgtaccttgctaaatggagatatacagatgatgaagtttatgttttgaatggaggacaagaaatctctttaaatggttttgttgttacacctgttatgtcaaccaagcagtatcttgaagtggcagaattgtatacagtaacattcctttgcattgtctcccaagatagtgaaactgctatctcatgggcggaaaaagcagagctgtctgagcaaggccgtcaggacctactaaaaaagctttatgcactgcgatcagctgcaaataagaagccatccacagttgaaggggtaaaacaaacagccgaaagaaacatttccacttctacaaatgactcggcaccattgctacatgaggatgctccaaccacagctcctgtgcacaacagcctcaaaaaggtccaactaaagtccactcaatcttctacccaacatttcacaaatcaatttgatcccttgttttggtggtttcattcggttcgcttgaggtttggtaaaatacatattgttctaccaagcggaaagttaatgcttctattctcactgctgttctcgacaatctatgtgctccggaggaaaactgctggcttgaagaggactgtgttccagcatgcatcatctctgcgacgggcattctttgatgcattgcaacttgcattctctgtccagatgaaccctctggctgctgttcaacaagtaccacaagcccctcgaggaagctggtgataatgtagttatttacgtcatgatgcatgcaattcaattgaaatttgactgatgtcatcctgattcagtgtcagtgacacaaatgtaaagacaactgtgcttaaatgagcatggtaatgatcaactttttgttggc

SEQ ID NO: 7028 - protein, 359 aa, Panicum virgatum
  misc_feature: Ceres CLONE 1897184
  misc_feature: Great-hit functional homolog of the protein sequence given in SEQ ID NO 9288
  misc_feature: Useful for making plants with altered protein content
MGASAQESGLWKQIDDAEDYLLSGLFEQAVSAALSVSDQIRTVSLEAECDRDELLDILESAGMVLVQALKELRRTSEMFVQLNSMFGSVASVPAKVFLTGATMQMAAGSGSELRAIFDVYLAKWRYTDDEVYVLNGGQEISLNGFVVTPVMSTKQYLEVAELYTVTFLCIVSQDSETAISWAEKAELSEQGRQDLLKKLYALRSAANKKPSTVEGVKQTAERNISTSTNDSAPLLHEDAPTTAPVHNSLKKVQLKSTQSSTQHFTNQFDPLFWWFHSVRLRFGKIHIVLPSGKLMLLFSLLFSTIYVLRRKTAGLKRTVFQHASSLRRAFFDALQLAFSVQMNPLAAVQQVPQAPRGSW

SEQ ID NO: 7029 - DNA, 2307 bp, Panicum virgatum
  misc_feature: Ceres CLONE 1897216
  misc_feature: Encodes the peptide sequence at SEQ ID NO. 7030
gtctcgcctccacgcgcaaacccccgaccaaacgccagcgccccccgcgaccaaaaggcgagggggccatctccatgttatgctcgccgccttctccccctcttccccgcgccgccccactccactgactgcgcgccggcgcccgatcggccgccatgggaggccgagcctcccgccaccgcgcccaatcgcacgaccagggccccaacacatcgcagcatcaccaccagcagcagcataaccgcccgaagcccaagcagccccggccgccgcaggcgccgcagccccaggctccccatcccgctcggcagcggcagcatcagcagcagcagcagcagcagcagcagcatcagcagcagcagcagcagcagccggatgccgccgcggcggccgcggccgccgggctgggccgggtgctagggcgccccatggaggacgtccgcgtggcctacaccttcgggcgcgagcttggccggggccagttcggggtcacctacctcgccacccacaaggcctcgggccgccgctacgcctgcaagtccatcgcggcgcggaagctcgcgcatcgggacgacgtcgaggacgtgcgccgcgaggtgcagatcatgcaccacctcacgggccaccgcaacatcgtcgagctccggggcgcctacgaggaccgccactcggtcaacctcgtcatggagctctgcgagggcggggagctcttcgaccggatcatcaccaggggccactactccgagcgcgccgccgccgcgctctgcagggagatcgtctccgttgtgcacagctgccactccatgggggtcatgcacagggacctcaagccggagaacttcctcttcctcaacaagagggaggactcgccgctcaaggccactgactttggcctatccgtgttcttcaagcccggtgagcagttcaaggatcttgtggggagtgcatattatgttgccccagaggtgcttaaaaggcgatatggagctgaggcagacatatggagtgccggagtaatcctttacatcctactatctggtgttcctcctttctgggctgagaacgaagatggcatatttgacgctgtttttcgaggccatattgatttcgcatctgatccctggccttcaatatccaatagtgccaaagatttggtcaagaaaatgctacgacaagacccaaaggagcggcttactgctgctgaaattttgaaccatccatggattagagaggatggagaagcaccagacaaaccacttgatattacagtaattggtagaatgaagcagttcagggcaatgaacaaacttaagaaggttgccttgaaggttgttgcagagaacctgtcagaagaagagattgtgggactaaaagaaatgtttaaatcccttgatactgataacagtgggacaataaccctggaggaattaagaactggtttaccaaagctgggcaccaaaatttctgaatcagaaataaggcagctgatggaggcggctgatgttgatggaaatggtaccattgattatgttgaattcatatcagcaacaatgcacatgaatagactagagaaggaggatcacatatataaggcattcgagtattttgataaggaccacagcgggcacataactgttgatgagttggaagaagctctgaagaagtatgatatgggtgatgaagcaacaattaaagaaattattgctgaagtggatacagatcatgatgggagaattgactaccaggagtttgttgccatgatgaagaataacagccctgagattgttccaaatcgacggcgcatgttttaatggtctcctacatttattgtgaaaactctcagaaattttccacggtctttgtaactgttgaggagagcaaatacctactccaagtggaattttgtcaggcatctatgctgacattccatacttggacggggtggcactcccctcgtgtgcccttcagtatggatggttggtggttcttttctggtgcctccttgttctaccatctcattttacaattttgccatgtatctatccataatggggtgtgccttctggtcaaagtttcctgcccctgtaacttctatgtaaggaaagggcttgtaaaacagttttaaatgatcatatcaggcaaaagtaatgaagtgtcatccaatcttctgttttttgccacttgatacttatgtttggacctagcctgtagacagtcccaaaatgatcatgtcaggcagattacattttgtaatgaacatagcttgacttcatactttcggtttcgtaaaaaaaaaaaaaaaaaaaa

SEQ ID NO: 7030 - protein, 551 aa, Panicum virgatum
  misc_feature: Ceres CLONE 1897216
  misc_feature (1)..(537): SWISSPROT Homolog: EC 2.7.11.1 Calcium-dependent protein kinase, isoform 2
  misc_feature (44)..(551): SWISSPROT Homolog: EC 2.7.11.1 Calcium-dependent protein kinase
MGGRASRHRAQSHDQGPNTSQHHHQQQHNRPKPKQPRPPQAPQPQAPHPARQRQHQQQQQQQQQHQQQQQQQPDAAAAAAAAGLGRVLGRPMEDVRVAYTFGRELGRGQFGVTYLATHKASGRRYACKSIAARKLAHRDDVEDVRREVQIMHHLTGHRNIVELRGAYEDRHSVNLVMELCEGGELFDRIITRGHYSERAAAALCREIVSVVHSCHSMGVMHRDLKPENFLFLNKREDSPLKATDFGLSVFFKPGEQFKDLVGSAYYVAPEVLKRRYGAEADIWSAGVILYILLSGVPPFWAENEDGIFDAVFRGHIDFASDPWPSISNSAKDLVKKMLRQDPKERLTAAEILNHPWIREDGEAPDKPLDITVIGRMKQFRAMNKLKKVALKVVAENLSEEEIVGLKEMFKSLDTDNSGTITLEELRTGLPKLGTKISESEIRQLMEAADVDGNGTIDYVEFISATMHMNRLEKEDHIYKAFEYFDKDHSGHITVDELEEALKKYDMGDEATIKEIIAEVDTDHDGRIDYQEFVAMMKNNSPEIVPNRRRMF

SEQ ID NO: 7031 - DNA, 2155 bp, Panicum virgatum
  misc_feature: Ceres CLONE 1897240
  misc_feature: Encodes the peptide sequence at SEQ ID NO. 7032
acctctgcatcatcaaaaccaccatcatcctctttccctgcttcgaatcctccgcccgtcgccaaaacccacgctccccccaccctcgcctcctccgccaccgcttccctcacctcgcatcctcttaaacgtctcggccccaccgcctctcaccaccgcgcggtgctgccatgtactccacggccatgtccctctccgcggcttcggcttcggctgcggcggtcgccagcggcgccgccgcttccaggcccaacgcgatccggccgtccgccgggatccgcttctgcggcctccggcgcgaggccctcgggctccgctcggtccgctcctcgccgcaggtggtggccgccaggcggagcgtggcggctgcggcgacgacggggaatggcgcggccgggagcggcgacttcgactacgacctcgtgatcatcggagccggcgtcggcggccacggcgccgccctccacgccgtcgagaagggtttgaaaacagcgataattgagggagatgtcgtgggtgggacttgtgtgaacagaggttgtgttccatcaaaggctctccttgctgtaagtggtaggatgcgcgaacttcaagatgaacatcacatgaagtcactgggcctgcaggtctcctcatcaggatatgacagacaggctgttgctgaccatgcaaataatcttgcctctaaaatacgcagcaacttgactaattcaatgaaagctcttggcgtggatatactgactggtattggcacaattgtggggaagcaaaaagtgagatatggaaaagctggttttccagataataaaattactgctagaaacatcataattgccaccggatctgttccttttgtccccaagggcattgaaatagatggtaaaaccgtattcactagtgatcatgcactaaaacttgagtcagtccccgactggatagctattgttggaagtggttacattggacttgaattcagtgatgtatacacggctctgggaagtgaggttacttttgttgaagctcttgatcaattaatgcctgggtttgatcctgagattgggaaattagcgcagaggattcttattaatcctcgtaaaattgactatcacactggtgtttttgcaagcaagattactccagcaaaggatggtaaacctgttctaattgagttgattgatgctaagacgaaagaacacaaggagacacttgaggtggatgccgcacttatagctactggaagggcacccttcaccaaaggacttggcttggaaaatatcaatgttgttacacaacatggttttgttcctgttgatgaacggatgcaagttatggatgcagatggcaatgcggttcctaatttgtattgcattggagatgccaatggtaagcttatgcttgctcatgcagccagtgcacaaggaatctcagttgtggagcaaatcagtgggcgagacaacatcctaaatcacctaagcattccagctgcctgtttcactcatcctgagatcagcatggttgggttgacagagccacaagctagggagcaggctgacaaggaaggatttgaaataagtgttgtaaagaccagttttaaggctaacacaaaggctctggcggagaatgaaggagatggacttgctaagatgatttatcgtcctgacaccggagaaattcttggagttcacattttggggttgcatgctgcagacctcatccatgaggcatcaaatgccattgcccttggaactcgtgtgcaagacatcaagtttgccgttcatgcacacccaaccttgtcggaggttctggatgagctcttcaaggctgccaaggttaatgatggtgtttcgcattctgtaaatgagccagttgcggcgtagggagaaacaagagtggaaaagaaaccatctgcaacagcccaactccagttatatatccttagtaactccagctatatatccttagtgctagatgtatcttctacccacataaaactgatttttgtagccattcactgggcattttcgttagggaatagtacagacactacctatttattgagggaaagggagatccagttgtcctccctatgtatgagagaactccaaattttgcagccctttgtatagagtaaatatgtgatgcctttactttgtgg

SEQ ID NO: 7032 - protein, 568 aa, Panicum virgatum
  misc_feature: Ceres CLONE 1897240
  misc_feature (1)..(325): Pfam Name: Pyr_redox_2 Pfam Description: Pyridine nucleotide-disulphide oxidoreductase
  misc_feature (1)..(320): Pfam Name: Pyr_redox_2 Pfam Description: Pyridine nucleotide-disulphide oxidoreductase
  misc_feature (1)..(322): Pfam Name: Pyr_redox_2 Pfam Description: Pyridine nucleotide-disulphide oxidoreductase
  misc_feature (1)..(325): Pfam Name: Pyr_redox_2 Pfam Description: Pyridine nucleotide-disulphide oxidoreductase
  misc_feature (1)..(322): Pfam Name: Pyr_redox_2 Pfam Description: Pyridine nucleotide-disulphide oxidoreductase
  misc_feature (1)..(321): Pfam Name: Pyr_redox_2 Pfam Description: Pyridine nucleotide-disulphide oxidoreductase
  misc_feature (1)..(114): Pfam Name: Pyr_redox_dim Pfam Description: Pyridine nucleotide-disulphide oxidoreductase, dimerisation domain
  misc_feature (77)..(552): SWISSPROT Homolog: EC 1.8.1.4 Dihydrolipoyl dehydrogenase
MYSTAMSLSAASASAAAVASGAAASRPNAIRPSAGIRFCGLRREALGLRSVRSSPQVVAARRSVAAAATTGNGAAGSGDFDYDLVIIGAGVGGHGAALHAVEKGLKTAIIEGDVVGGTCVNRGCVPSKALLAVSGRMRELQDEHHMKSLGLQVSSSGYDRQAVADHANNLASKIRSNLTNSMKALGVDILTGIGTIVGKQKVRYGKAGFPDNKITARNIIIATGSVPFVPKGIEIDGKTVFTSDHALKLESVPDWIAIVGSGYIGLEFSDVYTALGSEVTFVEALDQLMPGFDPEIGKLAQRILINPRKIDYHTGVFASKITPAKDGKPVLIELIDAKTKEHKETLEVDAALIATGRAPFTKGLGLENINVVTQHGFVPVDERMQVMDADGNAVPNLYCIGDANGKLMLAHAASAQGISVVEQISGRDNILNHLSIPAACFTHPEISMVGLTEPQAREQADKEGFEISVVKTSFKANTKALAENEGDGLAKMIYRPDTGEILGVHILGLHAADLIHEASNAIALGTRVQDIKFAVHAHPTLSEVLDELFKAAKVNDGVSHSVNEPVAA

SEQ ID NO: 7033 - DNA, 1696 bp, Panicum virgatum
  misc_feature: Ceres CLONE 1897314
  misc_feature: Encodes the peptide sequence at SEQ ID NO. 7034
actcccgtgtgcctcctcgcagacgacgacagcgcccacgcctccaccccctcgtcaccggcggcgatgccagccgcctctagaagcccccaggcagaccactgtttgttggttcctcaattcttcacctagcacttcggttggcagtttcagttgtcaagtttaaatccctgatgacctgctacatatgcccatccttgactgcagagctcggtgagcgcgcgggcgtgtgcctggagcggatgtattgtgacgcacgggaggcagcaatgatgtggagagcgaggggaagaatgtggaaggccatcagagatgttgccaagtgaaatgacatggcatctgcaaacaagttggacgccaagattgcttgctggagattgaacatgcgctggagttgcttgcttgctggagatcgcccatttctggaacctggagttgcttgcttgctggagatcgcgcgtgcagacttttctttttcatggagaacaaagtttggtgcacagatattcgttggccaatctgaaacaatccttttctgtacataaatcaatcagttgtatgagggccacaagaacatggagtacaaacgggattagtttgctttcgatcataaaaactcatatatttacaaaacaaccaaaggagagcacccgcgcatgtttagcttcgccgggcgcgcctccaccgcatcgagcatcgtcgccagcctcgccacccccgcgccgccgtccaagcccatcagccccgccttcgcctccgcccgccgccccaggctcatcatgagcgcgcccgtcttcgccgcccccagcgccgtcgcgagcatggacgccgtggagcgcttgaagagcgggttcgagcagttcaagacccaggtctacgacaagaagccggagctgttcgagccgctcaaggccggccaatgccccaggtacatggtgttcgcctgcgccgactcccgctgctgcccgtcggtgaccctgggcctgcagcccggcgaggccttcaccatccgcaacatcgccgccatggtcccgccctacgacaagaacaagtacgccggcatcggggccgccatcgagtacgccgtctgcgccctcaaggtggaggtcctcaccgtcattggccacagccgctgcggtggcatcagggcgctcctctccctccaggacggcgcagccgacaccttccacttcgtcgaggactgggtcaggatcggctaccaggccaagaagaaggtgcagaaagagcaccccactgttccgttcgacgatcagtgctccatcttggagaaggaggctgtgaacgtgtccctctacaacctcttgacctacccctgggtcaaggaaggtgtggccaacgggaccctcaagttggtcggtgcccgctacgacttcgtgaacggtgtgttcgacacatgggagaaatgagccataaacttctactacgtcatatacatacatacatacctatatgcacctgatcgatgtgaatccgtggagtacttactgcctatttcgaccgccactacaagccggatcgtcatcctatatgcgaatgtaataagcaatagcattttctactgctttactttcaaatgtggagcttatatgtaatatatggtgcgcaatttgaccgcttttgtggtcaaaagacatcagctgtataagcctttttcataatattatctcaatttacc

SEQ ID NO: 7034 - protein, 256 aa, Panicum virgatum; identical to SEQ ID NO: 326
  misc_feature: Ceres CLONE 1897314
  misc_feature (1)..(171): Pfam Name: Pro_CA Pfam Description: Carbonic anhydrase
  misc_feature (5)..(256): SWISSPROT Homolog: EC 4.2.1.1 Carbonic anhydrase, chloroplast precursor

SEQ ID NO: 7035 - DNA, 1845 bp, Panicum virgatum
  misc_feature: Ceres CLONE 1897384
  misc_feature: Encodes the peptide sequence at SEQ ID NO. 7036
atctctcagcaagtcagcgcctcagctcttcttcccccgccgcaacaataaacaggagagggggcaaaaaaacccaaacccctcttcgtctccctcccgtacggcggcgcggcaaattccgtcgaacataacatggccgcccttgcctccgccgcccgctcgaggcgccgtctcctcccctacctccaccgcctcctccactccggcccctccgcagccgccgccgccccgtccccctccaacagccgcttcctccgccacgcctcgccggtgccccgcacccccgaccactccccctacctccgcttccccgaggcgcgtgtctccacgctcccctcgggcctccgcgtcgtcacgcaggcgtacccggccgccacccggatggcctccgtcggcgtctgggtcgacgcgggcagccgcttcgagctcccggggacaaacggcaccgcgcacttcctcgagcacatggccttcaagggaaccgggcgccggcctaacgcggaggtgctcgaggtggagatcgaggacatgggcgctcgcctcaacgcctacacctcccgcgaacagaccacattcttcgccgacgtgcaggcgcgccacgtgccagtcgcgctcgacatcctcagcgatatcctgcagcacccgcgcttcccggagagggccatgaagcgcgagcgcggcgtcatcctccgtgagatggaggaggtacaaggtatgatggaagaggtgatatttgatctcttgcatgcagcagcattcaaaggccatgcgctaggggacacaatattaggtccagaagagaatattaaatcaatctcaaagaaagatttggagcagtatatctcaactcattatacctgtcctagaatggttgtatctgccgctggaagtgtcagtcacgatgaggttgttgatcaagtgaaagaattatttacagaattctccaccgatccaactactgccgatcagcttgttgacgcgaacccagctatttttactggatcggaggttcgtgtgcaaaatgtgacgatgcctctagtacacgttgcaattgctctcaagggtgcatcatggactgaccctagctccattccccttatggtgatccaaagcatattgggatcctggaacaggagcgttggggttgggaactgctcagggtcttctttagctcgtggtgtcagcaatggtaatttagctgagagcctgatggcgttcaacactaattatcgggacacaggaatatttggcatttatgctattgcactgcctgataccctgcatgacttgtcacggttaataatggcggagcttagaagacttacattccaagtgtcagaagaggaggttgctcgtgcccgtaatcagctgaaatcatctctattacttcatattgacggatccacggcagttgctgagaataatggtcgccagatgctaacttatgggcgagtaatgccattcctagaactttttgcacgcattgatgctgttgactgcgctacagtaatggaaaccgccaaggagtacataattgataaggatattgctctggctgctatgggaccgatctcggatttgccagagcataggtggtttcggtcagaaacatgttctgatgatgaatttactcgaaggatattctttgggaacgcacagaataattgaagctgcggctctgtgatactgttgttgtaactctaggtcattccaagaaattaccaatagtaggatcaggcatttcagttatatactagatattattttctgcttcgtacccgtgctacacttcgttgatgctgaatgtgcaaatagctttcttggcaaaaaaaaaaaaaaaaaaaa

SEQ ID NO: 7036 - protein, 511 aa, Panicum virgatum
  misc_feature: Ceres CLONE 1897384
  misc_feature (1)..(140): Pfam Name: Peptidase_M16 Pfam Description: Insulinase (Peptidase family M16)
  misc_feature (1)..(187): Pfam Name: Peptidase_M16_C Pfam Description: Peptidase M16 inactive domain
MAALASAARSRRRLLPYLHRLLHSGPSAAAAAPSPSNSRFLRHASPVPRTPDHSPYLRFPEARVSTLPSGLRVVTQAYPAATRMASVGVWVDAGSRFELPGTNGTAHFLEHMAFKGTGRRPNAEVLEVEIEDMGARLNAYTSREQTTFFADVQARHVPVALDILSDILQHPRFPERAMKRERGVILREMEEVQGMMEEVIFDLLHAAAFKGHALGDTILGPEENIKSISKKDLEQYISTHYTCPRMVVSAAGSVSHDEVVDQVKELFTEFSTDPTTADQLVDANPAIFTGSEVRVQNVTMPLVHVAIALKGASWTDPSSIPLMVIQSILGSWNRSVGVGNCSGSSLARGVSNGNLAESLMAFNTNYRDTGIFGIYAIALPDTLHDLSRLIMAELRRLTFQVSEEEVARARNQLKSSLLLHIDGSTAVAENNGRQMLTYGRVMPFLELFARIDAVDCATVMETAKEYIIDKDIALAAMGPISDLPEHRWFRSETCSDDEFTRRIFFGNAQNN

SEQ ID NO: 7037 - DNA, 2208 bp, Panicum virgatum
  misc_feature: Ceres CLONE 1897394
  misc_feature: Encodes the peptide sequence at SEQ ID NO. 7038
aacctccccacgccgtcgcctcgtctctctccaccgccgctctcccctcccctctctcccactcttccagaaccccctcgcgcgcgccgccgccgccgccgcgagatccgctccgcgcgcgatgtggcgcagctgcgtctcgcggggcctctccagggccagggcctccgcctccaggctcctctccacggcgccgtcgtcctacacggtggtggaccacacgtacgacgcggtggtggtgggggctggcggcgcggggctccgggcggcgatcggcctctccgagcacggcttcaacacggcgtgcatcaccaagctcttccccacgcgctcgcacactgttgccgcgcagggaggcataaatgctgcacttggaaacatgactgaagatgattggaggtggcatatgtatgacactgttaagggaagcgattggcttggtgaccaggattctattcaatatatgtgcagagaagcaccaaaagctgttgtagagcttgagaactatggattgccattttcaagaaccgaagagggaaagatataccaacgcgcctttggaggacagagcttagattttggaaaaggaggacaagcctaccgttgtgcctgtgctgctgacagaacaggacatgctatgctacacacactttatggtcaagcaatgaagcacaatactcagttttttgtggaatattttgcattagaccttatcatggacaacgaaggtaactgtcagggagtcattgccttaaacatggaggatggcacccttcaccgtttccatgcttctaatacaattctagccacaggaggttatggcagggcctatttctcagcaacctcagcacacacctgtactggagatggcaatgctatggtcgcacgtgctggcttacctcttcaagatcttgagtttgtgcagttccatcctacgggcatttatggtgctggatgcctgattactgaaggttcccgtggtgaaggtggtatccttagaaacagtgagggtgaacggttcatggaacgatatgctccttccgcaaaagatcttgcttctcgtgatgttgtttcaagatcgatgacaatggaaattagagaaggccgtggtgttgggccattgaaggaccacatttatttgcatctgaaccatctgccccctgaggttctgaaggaaaggcttcctggtatttctgaaactgctgccatttttgctggtgttgatgtcaccaaggagccaattccagtcttgcctaccgtgcactacaatatgggtggtatcccaacaaactaccatggggaggtagtggatatcaagggtgataatccagatgctgttgttcctggtctgttggctgctggtgaagctgcatgtgcatctgtccatggtgcaaatcgtctaggcgcaaattcacttcttgacatagttgtttttggcagagcttgtgcaaacagggttgccgatatttctaagccaggtcagaagcagaaacctcttgaaaaagatgctggagaaaagaccatagcctggttggacaaactgaggaatgccaatgggtcattgccaacttccaagatccgtctcaacatgcagcgtgttatgcaaaataatgctgctgtattccgtacacaagaaactcttgaagaaggttgtaagctgattagcaaaacatgggagagttttcatgatgtgaagctcagtgatcggagtctcatttggaactctgacttgatagagaccattgagctggaaaatctgttgataaatgcatgcataactatgcattcagcggaggctcggaaggaaagcagaggagctcatgctcgtgaagatttcacgacaagagacgatgagaagtggatgaagcactcactggggtactgggagaacgagaaggttcgcttggggtacaggccggtgcacatgaacacattggacgacgaagtcgagtcattcccaccaaaagcgcgtgtgtattgattgattcaggcctggacacctcaggaattctctgtaaggtgttaataaagcaggagatgggcattcctggctgagaacgtgaccagtattccgtccttttttcttttcactctgtatcgtgtaatttgataggaataaagaagaagaaacacatgctaatgcctgaccgacgtttgtgtaaatgaaattttgcatggttggtaatagaaaaaaaaaaaaaaaaaaaa

SEQ ID NO: 7038 - protein, 619 aa, Panicum virgatum
  misc_feature: Ceres CLONE 1897394
  misc_feature (1)..(619): SWISSPROT Homolog: EC 1.3.5.1 Succinate dehydrogenase [ubiquinone] flavoprotein subunit 1, mitochondrial precursor
  misc_feature (1)..(619): SWISSPROT Homolog: EC 1.3.5.1 Succinate dehydrogenase [ubiquinone] flavoprotein subunit, mitochondrial precursor
MWRSCVSRGLSRARASASRLLSTAPSSYTVVDHTYDAVVVGAGGAGLRAAIGLSEHGFNTACITKLFPTRSHTVAAQGGINAALGNMTEDDWRWHMYDTVKGSDWLGDQDSIQYMCREAPKAVVELENYGLPFSRTEEGKIYQRAFGGQSLDFGKGGQAYRCACAADRTGHAMLHTLYGQAMKHNTQFFVEYFALDLIMDNEGNCQGVIALNMEDGTLHRFHASNTILATGGYGRAYFSATSAHTCTGDGNAMVARAGLPLQDLEFVQFHPTGIYGAGCLITEGSRGEGGILRNSEGERFMERYAPSAKDLASRDVVSRSMTMEIREGRGVGPLKDHIYLHLNHLPPEVLKERLPGISETAAIFAGVDVTKEPIPVLPTVHYNMGGIPTNYHGEVVDIKGDNPDAVVPGLLAAGEAACASVHGANRLGANSLLDIVVFGRACANRVADISKPGQKQKPLEKDAGEKTIAWLDKLRNANGSLPTSKIRLNMQRVMQNNAAVFRTQETLEEGCKLISKTWESFHDVKLSDRSLIWNSDLIETIELENLLINACITMHSAEARKESRGAHAREDFTTRDDEKWMKHSLGYWENEKVRLGYRPVHMNTLDDEVESFPPKARVY

SEQ ID NO: 7039 - DNA, 1713 bp, Panicum virgatum
  misc_feature: Ceres CLONE 1897426
  misc_feature: Encodes the peptide sequence at SEQ ID NO. 7040
tgcagtgcaggttgatcgcgcggacatggctgaggcggcggcggcggacatggcgcacgtgctggtgttcccgatcccggcgcagggccacctcaacagcttcctccacttctccacggggctcctccgcgccggcctccacgtcaccttcctccacaccgtccacaacctccgccgcctgggcgccgccgcgcgcgaggccgcggccgcctcgccgcgcctccgcttcctgtccatccccgacggcctccccgacgacgacccccgcgacgtgggcggcatcccgcagctcctggagggcctgcgcacgacggccagcaccgcgtaccgcgacctgctcgcctcgctgcgccgcgcggggggcaccgccgacgacgggttcccgccggtgacgtgcgtcgtcgccgacggcgtcatgccgttcgcctgggctatagccgaggagctcggcgtccccgcgatcgcgtaccgcacggtgagcgcgtgctccgtcctggcgtacctgtccgtgcccaagctgatcgagctcggcgagctcccgttccccgagggcggcaacctcgacgagcccatccgcggcgtcccggggatggagggcttcctgcggcggcgagacctcccggtccagtgccgctccctcaccgacacgtatcaagaccccctgctggagacggtggtcgcggccaccgtgcagagccgcaaggcaagggctctcatgctcaacacgacggcgtcccttgagcgggcatccctcgcacacctcgcgcgggagatgcgcgacgtgttcgccgtcgggccactccacgccatgtccccggcgccggcggccgccacgagcctgtggcgccacgacgacgggtgcttggcgtggctcgacggccaggcggagcggtccgtggtgtacatcagcctggggagcctcacggtgatctcccacgagcagttcaccgagttcctgcacgggctcgtcgccgccggctacccgttcctgtgggtgctccggccggacatgctcggggcgagtcagggcgcggcgctcaaggaggccgtcgccgcggccggggagggcaggtcgtgcgtcgtgccgtgggtgccgcagcgggacgtgctccggcaccgcgccgtggggtgcttcctgacgcacgccgggtggaactcgacggtcgagggcgtcgttgagggcgtgccgatggtgtgctggcccttcttcgcggaccagcaggtgaacagccggttcgtgggcgccgtgtggaggaacgggctggacatgaaggacgtgtgcgagagggacgtggtggaggggacggtgagagtggccatggagtcctccgaggtcaggaggacggcgcgctccctggcggagcaggtggagcgtgacgtcggcgacggcggctcgtcggcgctggagttcaagcggctcgtcagcttcatcagggagctcagcagcacgtcagcagcagagcccgatctatcttcagaataaagaattagtatatgcatggccatagacggacatctctcgcgcagggtactgtggaacagtgcggtgattcttgttaagattggattgctgcttaagattaagaattggactagccccaaacctcccaagaaggattagagactcgatcagtatgaggttattcttcagtcgccgataaacagtttgtttgttttttttatcaaattgataagcagtatttgttggatgat

SEQ ID NO: 7040 - protein, 485 aa, Panicum virgatum
  misc_feature: Ceres CLONE 1897426
  misc_feature (1)..(132): Pfam Name: UDPGT Pfam Description: UDP-glucoronosyl and UDP-glucosyl transferase
MAEAAAADMAHVLVFPIPAQGHLNSFLHFSTGLLRAGLHVTFLHTVHNLRRLGAAAREAAAASPRLRFLSIPDGLPDDDPRDVGGIPQLLEGLRTTASTAYRDLLASLRRAGGTADDGFPPVTCVVADGVMPFAWAIAEELGVPAIAYRTVSACSVLAYLSVPKLIELGELPFPEGGNLDEPIRGVPGMEGFLRRRDLPVQCRSLTDTYQDPLLETVVAATVQSRKARALMLNTTASLERASLAHLAREMRDVFAVGPLHAMSPAPAAATSLWRHDDGCLAWLDGQAERSVVYISLGSLTVISHEQFTEFLHGLVAAGYPFLWVLRPDMLGASQGAALKEAVAAAGEGRSCVVPWVPQRDVLRHRAVGCFLTHAGWNSTVEGVVEGVPMVCWPFFADQQVNSRFVGAVWRNGLDMKDVCERDVVEGTVRVAMESSEVRRTARSLAEQVERDVGDGGSSALEFKRLVSFIRELSSTSAAEPDLSSE

SEQ ID NO: 7041 - DNA, 1524 bp, Panicum virgatum
  misc_feature: Ceres CLONE 1897428
  misc_feature: Encodes the peptide sequence at SEQ ID NO. 7042
agtcgagtccacacacgggatgaccaaagcccaaaccctccgcctcaccccgggccgtcggcagcatcgccgccgtgaccttgccggtgctccggtagcagcgcacgatgctccgccgtgtgcctccctccctacgccgcgccctcctctcctccacctacacacgctacgtcggggcacaaatcccgaaccccagccattctccttcccagaccctcctcccccaatggcggcgtcacgccgctgtttcctcctcctcggccccgccacagccgccgcctcctccatctccgcctcggggtccgtcgcggtcgggcggaggcggtcccactgtctcgtcgctgaaccccgccgaggtcgccaagttcgctgccatcgcagagacatggtgggatgcaaacggtccattcaaacctttgcatttgatgaatccaacccgactgtcttttatccgctccactctttgtagacatttcaggagggatccatattcatctaagccacttgaaggcctcaaagttattgatgttggatgtggaggtggcattctgtcagagcctcttgctcggatgggagctacagttactgcaattgatgctgttgacaagaatataaagatcgcaagtattcacgcggcatctgatccggaaactgcttccattgagtattactgcacaacagctgaggcattggtaaaagagaaaaggctgtttgatgctgtaatttctcttgaggtgattgagcatgtcgctaatcctttggagttttgcgaatctctctcagctttgacagctcctaatggtgccactgtagtttccacaatcaaccgttcaatgagagcatataccactgcaatagttgctgctgagtacatcctcagatggcttcctagaggcacacatgagtggtccaaactggttacccctgaggagctttccctaatgctgcaaaaagcttctgtctccgttgaagagatggcagggttcgtttataatccgctgagtggagagtggtctctgtcagatgatatcagtgtgaactatattgcttttggtgtcaagaagagtgaaacaccatcgacaaattgcacataggcaagattattgtggttggagaaaaagaattggcaaaatcttgtctgttgaatcttagtgctaagggtacaaccatgttgtgtggaagccccattgagaagttgtcttgtcaagctgacgagaggcagctgctaacaagtcgagctatctctgctttcgttttgattaattgtgtaataacaatgtaatgcacggctgcttcagacagttttagcaattttgtggcaaatacaaggatggtgctttatctatatctctcgcagctatgttagctagcgttgtaaggaggaagagggagaggttagcaacattcgctctgttgttgcagtggactcgctgcaattctgaaatgtatcaggtgtattagcttcctatatattgagctgtctgctggaagtacatttttaactaaaaaaaaaaaaaaaaaaaa

SEQ ID NO: 7042 - protein, 328 aa, Panicum virgatum
  misc_feature: Ceres CLONE 1897428
  misc_feature (1)..(98): Pfam Name: Methyltransf_11 Pfam Description: Methyltransferase domain
  misc_feature (9)..(321): SWISSPROT Homolog: EC 2.1.1.114 Hexaprenyldihydroxybenzoate methyltransferase, mitochondrial precursor
MLRRVPPSLRRALLSSTYTRYVGAQIPNPSHSPSQTLLPQWRRHAAVSSSSAPPQPPPPPSPPRGPSRSGGGGPTVSSLNPAEVAKFAAIAETWWDANGPFKPLHLMNPTRLSFIRSTLCRHFRRDPYSSKPLEGLKVIDVGCGGGILSEPLARMGATVTAIDAVDKNIKIASIHAASDPETASIEYYCTTAEALVKEKRLFDAVISLEVIEHVANPLEFCESLSALTAPNGATVVSTINRSMRAYTTAIVAAEYILRWLPRGTHEWSKLVTPEELSLMLQKASVSVEEMAGFVYNPLSGEWSLSDDISVNYIAFGVKKSETPSTNCT

SEQ ID NO: 7043 - DNA, 1808 bp, Panicum virgatum
  misc_feature: Ceres CLONE 1897537
  misc_feature: Encodes the peptide sequence at SEQ ID NO. 7044
aaaagccaccaccacctctcacttcgccgccgccgccgcagccgtctgtctcggtttcctttcgcccccacctcagcccccaaacccccgccgccgcgaaaatcctagccatggacgccgcggggctcgaaaccctcatcctggacctctacgccatcgaggccgtcaagctgggctccttcgtgctcaagtccggcatcacctcgcccatctacctcgacctccgcgcgctcgtctcccacccgcgcctcctctccgccatcgcctcgctcctgcacgccctccccgccacgcgcccctacgacctcgtctgcggcgtcccctacaccgcgctccccatcgccgccgtcctctccgtcgaccgcgacatccccatgctcatgcgccgcaaggaggtcaaggcgcacggcaccgccaagtccatcgagggatcgtaccgcgccggcgacaccgtcctcatcatcgaggacctcgtcaccagcggcgcatccgtgctcgagaccgccgccccgctccgcgccgaggggcttgtggtcgcggatgccgtcgttgtcgtcgaccgcgagcagggcggcagggagaatctcgccgccaacgggatcacgctgcactcgctcatgacgctcacggaggtgctcgccgtgctgctcaagcacgggaaggtgacccaggagaaggcggaggaggtgaggcagttcctcgacgcaaacaggaaggtggcggtgcccggggtgcctgctgaacccagggtgtttcggaagccatttgaggagagggcgaaatctgccaccaaccctgtggcgaggaggctcttcgaggtgatggtggccaagcagagcaacctgtgcatagctgcagatgttgggacagcaaaggagctccttgagctggccgagcagattggttcccagatttgcatgttgaaaacccatgtggatatattatctgattttacaccagattttggctccaagcttcgctcgattgctgagaagtacaactttttgatcttcgaagaccgtaagtttgctgacatcggaaatacagtcaccatgcaatatgaaggaggaatattccgcatattggactgggctgatattgttaatgcgcatatagtacctggacctgggattgtagatggcttgaagctgaagggtttgcctaaaggaagagggttacttctgcttgctgaaatgagctctgctggcaaccttgctcagggagattacactgctgcagctgtaaagattgctgagcagcatcctgactttgtgatcgggtttatatcagtaaatcctgcatcttggtcagtagcaccttcaaacccagcacttatccatgcgacccctggagttcagctggtcgctggaggagatgctcttgggcaacaatacaacactcctcaagctgtcataaacgtcagaggcagtgacatcattatagtcggacgcgggattatcaaagcgggcgatcctgctaagatggcattggagtatcgcctccaggggtggcaatcctaccgcaccagcttgttgtgagcctgtttaaacacccgagtataagggtgcaatccaactgatgtgtaagaagagcacggtcccgtcgtcgctgcgctccatgcccagtaaatggacacacattgtctgctagtgctagttgctacaataataatttccgtaatgttggttccgttcttgttgcttgggtttggtgttgtgatgcctttgctgggtcagacagtaccagaatgtgcactctagctgtgaaactcctgatcaatttcacgccaaaaaaaaaaaaaaaaaaaa

SEQ ID NO: 7044 - protein, 475 aa, Panicum virgatum
  misc_feature: Ceres CLONE 1897537
  misc_feature (1)..(220): Pfam Name: OMPdecase Pfam Description: Orotidine 5'-phosphate decarboxylase / HUMPS family
  misc_feature (4)..(470): SWISSPROT Homolog: UMP synthase Uridine 5'-monophosphate synthase
MDAAGLETLILDLYAIEAVKLGSFVLKSGITSPIYLDLRALVSHPRLLSAIASLLHALPATRPYDLVCGVPYTALPIAAVLSVDRDIPMLMRRKEVKAHGTAKSIEGSYRAGDTVLIIEDLVTSGASVLETAAPLRAEGLVVADAVVVVDREQGGRENLAANGITLHSLMTLTEVLAVLLKHGKVTQEKAEEVRQFLDANRKVAVPGVPAEPRVFRKPFEERAKSATNPVARRLFEVMVAKQSNLCIAADVGTAKELLELAEQIGSQICMLKTHVDILSDFTPDFGSKLRSIAEKYNFLIFEDRKFADIGNTVTMQYEGGIFRILDWADIVNAHIVPGPGIVDGLKLKGLPKGRGLLLLAEMSSAGNLAQGDYTAAAVKIAEQHPDFVIGFISVNPASWSVAPSNPALIHATPGVQLVAGGDALGQQYNTPQAVINVRGSDIIIVGRGIIKAGDPAKMALEYRLQGWQSYRTSLL

SEQ ID NO: 7045 - DNA, 1811 bp, Panicum virgatum
  misc_feature: Ceres CLONE 1897543
  misc_feature: Encodes the peptide sequence at SEQ ID NO. 7046
aactgcgtaagcataaacatccgtcgccccaccccgtgcgcccccctttcttctagcctgcgctgccccccgttcctttctcctccagcaagtaaaccccccccgtctccaccgcgccgccgccatgccgaccgttagcgtgaaatggcagaaggaggtctttccaggcatagagattgacactagccagccgccaattgttttcaagagtcagctttacacactaacgggtgtaccacctgagcgccaaaaaattatggtgaagggtggaatattgaaggatgatgcagattggtctactttgggagtgaaagatggtcaaaaattgatgatgataggaacagctgatgaaattgtgaaagctccagagaaaggtccagtgtttgttgaggatctaccagaagaagagcaagtggtcgcactggggcacagtgctggtctttataaccttgggaatacatgctacatgaattccacattgcaatgtctgcattctgttccagagctgaagtcagcgctactaagctattcagatactggaagaggtaatggcattgaccaagcctctcataatttgactcttgcaactcgtaatatctttggtgagcttgatcaaagtgttcgtcctgtggcacctctacaattcttgcagacattgcgtaaaaaatatccacaatttgcccagcagcacaataatgtctacatgcaacaggatgcagaagaatgctggacacagctggtgtatacactttctcaaactcttacatcagatgcaagtgaatctgcggctctttcgatgaagcaactgtttgggatcgatctcgtgagcagggtccattgtgcagaaagtggtgaggaaagcacggagacggaatcagtttattccctgaagtgtcatatatctcaagatgtgaaccaccttcatgagggacttaagcatggcttgaagacagaacttgagaaaatttcacctgcactgggtcgcactgcaatttatactagagagtcgagaataaatgagctgcccaggtacttgactgtgcagttcgtacgtttcttttggaaaagggaatcaaaccaaaaggcaaagattttgcgcaaagttgattaccctctggaactggatgtttatgaattttgctcagatgaactgaagcagaaactccaagctcctcgacagatgctgagggatgcagaaaatgcaaagtttggattgaaaacagaggcgaaagctagcagctcaaaagaaaatgaggggtcatcaagtaccgcttgggactcatccagcatggacattgacaaagctgatacttctgtaccaaagaaacaattgactggtgtctacgatttagttgctgtattgacacacaagggaagaagtgcagactctggccactacgttggctgggttaagcaagataacggaaaatggatcgagtttgatgatgacaacccaaacaatcgcaaggaagaagatattttgaaactatctggaggaggtgactggcacatggcatatatctgcctgtacaaagctcgtgtggctgaattgaagagctagaggtctcttggctacactggatccacacctctcatgccgcgaatgtctcggcttgtttttgtgccgcatgagtgaattgtgtcaattatttttccagttggataagtggctactctggaattatcttcaatgtctctggcctgcgttcacctggatatgtatttttagaaagtcagacgggtacatttcgcgttacttttcaaaatatatagaacaaaaagattcagcgcaaaaaaaaaaaaaaaaaaaa

SEQ ID NO: 7046 - protein, 478 aa, Panicum virgatum
  misc_feature: Ceres CLONE 1897543
  misc_feature (1)..(369): Pfam Name: UCH Pfam Description: Ubiquitin carboxyl-terminal hydrolase
  misc_feature (1)..(375): Pfam Name: UCH Pfam Description: Ubiquitin carboxyl-terminal hydrolase
  misc_feature (1)..(375): Pfam Name: UCH Pfam Description: Ubiquitin carboxyl-terminal hydrolase
MPTVSVKWQKEVFPGIEIDTSQPPIVFKSQLYTLTGVPPERQKIMVKGGILKDDADWSTLGVKDGQKLMMIGTADEIVKAPEKGPVFVEDLPEEEQVVALGHSAGLYNLGNTCYMNSTLQCLHSVPELKSALLSYSDTGRGNGIDQASHNLTLATRNIFGELDQSVRPVAPLQFLQTLRKKYPQFAQQHNNVYMQQDAEECWTQLVYTLSQTLTSDASESAALSMKQLFGIDLVSRVHCAESGEESTETESVYSLKCHISQDVNHLHEGLKHGLKTELEKISPALGRTAIYTRESRINELPRYLTVQFVRFFWKRESNQKAKILRKVDYPLELDVYEFCSDELKQKLQAPRQMLRDAENAKFGLKTEAKASSSKENEGSSSTAWDSSSMDIDKADTSVPKKQLTGVYDLVAVLTHKGRSADSGHYVGWVKQDNGKWIEFDDDNPNNRKEEDILKLSGGGDWHMAYICLYKARVAELKS

SEQ ID NO: 7047 - DNA, 2756 bp, Panicum virgatum
  misc_feature: Ceres CLONE 1897755
  misc_feature: Encodes the peptide sequence at SEQ ID NO. 7048
acctttgcttggacatttcagtttccacaaccccttccagatagcctcctcattttcatcgccacctgatgaggagctagctcctctccggctcactcgctgatcatgttctctatgcactttgtttgcagaccgacatcatccaattctgcatggacagccagagctaagatcagcctcgcatcctccacaaagaagggacgacgcgggtatgctgggacctgggaatcagcgcctagccgcctagctcctcgcgggctcgcggcgtactcgctatccgggtgtgtcgagaaccgaagatcgaacaggcggcccactcgcacttccctaccacccgtcgtcggtggatgcggatagtcgggcgcttggtgagaggataagatgagagtgctttcttttgtttttttaagtagtttccaaacccgaacccaatagttccaaggaacaattcgatcccttcttccgttatcccaggtggcggccctgcggccaggatctaggcggcaagcaagcatgagcgccgctgctactctcccgaccggccaggcggcgccgcacgcggtgtgcgtgccgttcccgacgcagggccacatcacgccgatgctgaagctggcaaagatcctccacgccaggggcttccgcgtcaccttcgtcaacaccgagtacaaccaccgccgcctcgtccgctcccgcggcgccgccgccgtcgcgggcctcgcggcgttccgcttcgccaccatcccggacggcctgccggcgtccgacgccaacgccacgcaggacccggcgaccatcagctacgccaccaagcacagctgcccgccccacctgcggcgcctgctcgccgggctggacggcgtcacgtgcgtcgtggcggacaacctgatgagcttcagcgtggacgccgcgagggaggtgggcgtgccgtgcgcgctcttctggaccgccagcgcctgcggctacatgggctaccgcaacttccgcctcctcatcgacaggggcatcgtccccctccaagaccaagagcagctgaccaacgggttcatggacacgccggtgggctgggcgcccggcatgagcaagcacacgcggctcaaggacatgccgaccttcctccgcaccacggaccccgacgacgtgctgatgaacttccaactgcaggaggtggaacgctccgagcacgcgtccgccgtcgtcatcaacaccttggacgagctcgagcggccggctctcgacgccatgcgctccatcatcccggccgtgtacaccgtcggcccgctcgcctccgtcgcggagcgggtcgtcgaccgcagcctccaagcggtgagctgcagcctgtggcgggaggaccagtcctgcctccagtggctggacgccaccaagccccgcccgcggtcggtggtgtacgtcaactttgggagcatcacggtcatgagcgggcaggagctggcggagttcgcgtgggggcttgccggcagcggccaccgcttcctgtggatcgtccgcccggacgtcgtcaagggcggcggcggcgcctcctcggcggaggcggcggcgctgcccccggggttcctggaggcgaccgagggcaggggcctcgtggcgagctggtgcgaccaggaggccgtgctgcggcacgaggcggtgggcctgttcctcacgcacagcggctggaactccaccctggagagcctctgcgccggggtgcccatgctgtgctggccattcttcgcggagcagcagaccaactgccggtacaagtgcgtcgagtggggcgtggcgatggaggtcggcgacaacgtgcggcgggaggccgtggaggcgaggatacgggaggccatgggtggggacaagggcaaggacatggcgcgcagggccgcggagtggagagaggccgccgcggggtcggcggcgaggtcgcttgccaacctcgacaggctcatcaacgatgtgctgctctctccggcaccattattaccgggcggctcactcaaaatggcttagcttgaatgatgcgtggatggccctgatcaaacacacagcgagtatgtgtttcaaatgatactagtgaacatttcaatacaagtcgggatagttaaatgtctacccctgaaagaccgggtcgcagggggggcaaaccagactggagggtaggaagaactctggggccgaccgagatgtcgaagcggccgcgaaacgatccgtccaaggaggaagacgccgccgagggcgagcccgagacgaggaggagggtgtgtttggttccctggtctcactcgccgacggcgcggcgccgatgcctgtacctggtgctggacgactggaagaggggctacagcgtccaccggctgggcgaggccgactggtcctcgacgcccgctcgtccgcttccaggcgctgcacgtctacacgtcgaccttcgcggcccacgggtccaagatcctggcgatgcatcccgagcggttcagccccggcatccccgtgttcgacactttccggtgcggttactgtgcgcacagtggcccgtgcccaccccaacttagagcgcggcggcccgtgcccacccaatcccggggccgttcgatgcactccaagattcgcgtacgggcatagtggcaaagtaactaattaataacattcgatgttagccttcactaatgaaaatgcgttcacacctattcacactgatgggtgcatgtagacgcaaatcgggaaaagaggccgttcggctgatccaaaaaaaaaaaaaaaaaaaa

SEQ ID NO: 7048 - protein, 496 aa, Panicum virgatum
  misc_feature: Ceres CLONE 1897755
  misc_feature (1)..(121): Pfam Name: UDPGT Pfam Description: UDP-glucoronosyl and UDP-glucosyl transferase
MSAAATLPTGQAAPHAVCVPFPTQGHITPMLKLAKILHARGFRVTFVNTEYNHRRLVRSRGAAAVAGLAAFRFATIPDGLPASDANATQDPATISYATKHSCPPHLRRLLAGLDGVTCVVADNLMSFSVDAAREVGVPCALFWTASACGYMGYRNFRLLIDRGIVPLQDQEQLTNGFMDTPVGWAPGMSKHTRLKDMPTFLRTTDPDDVLMNFQLQEVERSEHASAVVINTLDELERPALDAMRSIIPAVYTVGPLASVAERVVDRSLQAVSCSLWREDQSCLQWLDATKPRPRSVVYVNFGSITVMSGQELAEFAWGLAGSGHRFLWIVRPDVVKGGGGASSAEAAALPPGFLEATEGRGLVASWCDQEAVLRHEAVGLFLTHSGWNSTLESLCAGVPMLCWPFFAEQQTNCRYKCVEWGVAMEVGDNVRREAVEARIREAMGGDKGKDMARRAAEWREAAAGSAARSLANLDRLINDVLLSPAPLLPGGSLKMA

SEQ ID NO: 7049 - DNA, 2057 bp, Panicum virgatum
  misc_feature: Ceres CLONE 1897956
  misc_feature: Encodes the peptide sequence at SEQ ID NO. 7050
gtctctgcctcgccccccgccgccgccgccggattcgcttccgcctccggcggccacgcccatttctcgcaccactacctcgcctcatccgccggctccgatcgtcagctgcggcatcatctctaccccacgaccacgccagccacaagaccagaacgcctcccacagcgggaagaatccattcggccagtccacacgcatcaggggcgccgcgcccccatctttgactcgcactccgcgtccggatctaggccggtggagcgaggaaagatgaacggaggcaccgccccatcggcggccgccgcggcggcgacgccgcctcaccggcggctgccggacttcctccagagcgtgaacctcaagtacgtgaagctgggataccactacctcatcacccacctgctcacgctgatgctgctcccgctcatggccatgatcctcctcgaggccgggcgaaccgaccccaacgatctgcgccagctgtggctccacctccagtacaacctcgtctccgtgcttgtcctctccgccgtcctcgtcttcggcgccaccgtctatgtgctcacccgcccacgacccctctacctcgtggacttcgcctgctacaagccgcccgcccacctccaggtccgcttcgacgagttcatgcgccactccaagctctgcggcttctctgaagacgcgctcgagttccagcgcaagatcctcgagcgctccggcctcagcgaggagacctacgtcccggaggccatgcacgccctcccgccccagcccacaatggccaacgctcgcgccgaggccgagaccgtcatgttcggcgcgctcgacaacctcttcaaggccaccggcgtcaagcccaaggacgtcggcgtcctcgtcgtcaactgcagcctcttcaaccccacgccatccctgtccgccatgatcgtgaacaagtacaagctccgtgggaacatccggagcttcaacctcggagggatgggctgcagcgcgggcgtcatcgccatcgacctcgcgcgtgacatgctgcaggtgcaccgcaacacctacgccgtggttgtcagcacggagaacatcacccagaactggtacttcgggaaccgcaaatcgatgctgatccccaactgcctgttccgcgtcggcggcgcagcggtgcttctctcgaaccgcggcgccgaccgccgccgcgccaagtacagcctcaagcacgtcgtgcgcacgcacaagggcgcggacgacaaggcgttcaactgcgtgtaccaggagcaggacggcgagggcaagaccggcgtgtcgctgtccaaggacctcatggccatcgccggcggcgcgctcaagacgaacatcacgacgctgggcccgctcgtgctgcccgtgagcgagcagctcctcttcttcgcgacgctcgtggccaagaagctgttcaacgccaagaccaagccctacatcccggacttcaagctggcgttcgagcacttctgcatccacgccggcgggcgcgccgtgatcgacgagctcgagaagaacctgcagctgagcccggcagacgttgaggcgtcccggatgacgcttcaccggttcggcaacacgtcgagcagctccatctggtacgagctggcctacatggaggccaagagccgcgtccgccgcggccaccgcatctggcagatcgcgttcggcagcgggttcaagtgcaacagcgccgtctggcacgctctgcggaacgtcaagccgtcgcccaacagcccgtgggacgactgcattgaccgctacccggtggagctcgtcgacggcttccccacacacaaggcggcgcagcaatagcatccacacccatcgacgctcctccaatacagatatcatagcttgttggatagattcaaatactcatctggctagtagtgtgacacaacacaatggaggctgctgcttttccagagcatgattgccatggaagaatctctaggcttactgcaggtctgctctgctctgttctgttgtaaccatgtgttcgtcagcattggctctttggtgtgtaaaaaaaaaaaaaaaaaaaa

SEQ ID NO: 7050 - protein, 517 aa, Panicum virgatum
  misc_feature: Ceres CLONE 1897956
  misc_feature (1)..(289): Pfam Name: FAE1_CUT1_RppA Pfam Description: FAE1/Type III polyketide synthase-like protein
  misc_feature (19)..(505): SWISSPROT Homolog: EC 2.3.1.- 3-ketoacyl-CoA synthase 11
  misc_feature (25)..(505): SWISSPROT Homolog: EC 2.3.1.- 3-ketoacyl-CoA synthase 18
MNGGTAPSAAAAAATPPHRRLPDFLQSVNLKYVKLGYHYLITHLLTLMLLPLMAMILLEAGRTDPNDLRQLWLHLQYNLVSVLVLSAVLVFGATVYVLTRPRPLYLVDFACYKPPAHLQVRFDEFMRHSKLCGFSEDALEFQRKILERSGLSEETYVPEAMHALPPQPTMANARAEAETVMFGALDNLFKATGVKPKDVGVLVVNCSLFNPTPSLSAMIVNKYKLRGNIRSFNLGGMGCSAGVIAIDLARDMLQVHRNTYAVVVSTENITQNWYFGNRKSMLIPNCLFRVGGAAVLLSNRGADRRRAKYSLKHVVRTHKGADDKAFNCVYQEQDGEGKTGVSLSKDLMAIAGGALKTNITTLGPLVLPVSEQLLFFATLVAKKLFNAKTKPYIPDFKLAFEHFCIHAGGRAVIDELEKNLQLSPADVEASRMTLHRFGNTSSSSIWYELAYMEAKSRVRRGHRIWQIAFGSGFKCNSAVWHALRNVKPSPNSPWDDCIDRYPVELVDGFPTHKAAQQ

SEQ ID NO: 7051 - DNA, 1688 bp, Panicum virgatum
  misc_feature: Ceres CLONE 1898032
  misc_feature: Encodes the peptide sequence at SEQ ID NO. 7052
tcccccctcccatcctcctttgatttcagccctgaattgaataatcccataccacaacagcctagctaccttgcacacaaacccttattcctcatcagtacagttcttccgatccctggctaggtaattcaccaactaacagtagcccgcgcgcgccggccaaaacaacaattaaaccaagaaccaaaccctgcaattctaaattattttccaatcctagctaagacatccactaataatatataacaagcaggaggaaatccccaaagcaagtcctatactgactatagcaacagcacaccactgtttgccatccagcagcataccataagctagcacatagtatactactggtcaaagttcaaggaagcagcaggccgggcaggaggcaggagagacatcgtctatcggcgtcctacttacctccacgcctcgatcgatcttgatcgctagctggaggcgacgatggagttcaccgccggcccggcgccgtcgggcggcggcgaggagcgggcgcagcaggcggtggcggtggagaaggagcacatgttcgacaaggtggtgacgccgagcgacgtgaggaagctgatccggctggtgatcccgaagcagcacgcggagaagttcttccccctggacgcggcggcgaacgagaagggcctcctgctcagcttcgaggaccgcaccagcaagccctggcgcttccgttactcctactggaacagtagccagagctacgtcatgaccaaggggtggagccgcttcgtcaaggagaagcgcctcgacgccggggacaccgtctccttcggccgtggcgtcggggaggcggcgcggggcaggctcttcatcgactggcgccggcgccccgacccgcccgtgcactaccaccgcctcccgctcccctccatcccctacgcgccgtgggcgcatcacccggccgcgctcggtgccaggacgacgacggtgctccacctgccgccctcgccctcctcgctctgctacgactacgactacgactcccgccgccgccacacctacggggcccccggcagcaggcagcagctgctcttctaccggccgcaccagcagaccatggtgctggactccgtgccggtacggataccgacgacgccagggcagcacgcggagccgccgcctcccgtggcgtcgtcggcctcgaagcgggtgcggctgttcgggatgaacctcgactgcgccggctccgaggaggagagcggcggcgggagggcgccgccgccgacgcaggcccagccgctgcagctgccgtcgccgccgtcatcgtcgtcctcctcctccgggaaagcgaggtgctccttgaatcttgacttgtgaagaggtcgtggtcgtacgatcccccgctacagcatctagctactacttcccggccgaccgcttctgggcttctggcacggcacaaatggtcgtcgtggagaggatggagatccaagtaaacaaaggcggcggtggcctgccggtgcaagaggaatcagatcggaggagcagcagcgacgacaggcccaggccagctacaattaatcttcgatcgtaacccgtatatagctcatctcgatctcttaattttctctaattaagctagcaattatttccgcgtgggaaacaagaaaattaagaagaaagcatctgcaacagaaaatatttcttgcttc

SEQ ID NO: 7052 - protein, 295 aa, Panicum virgatum
  misc_feature: Ceres CLONE 1898032
  misc_feature: Great-hit functional homolog of the protein sequence given in SEQ ID NO 9208
  misc_feature (1)..(108): Pfam Name: B3 Pfam Description: B3 DNA binding domain
  misc_feature: The sequence is a functional homolog of  SEQ ID NO 12 in the  10/838,616 US patent application
  misc_feature: The sequence is a functional homolog of  SEQ ID NO 320 in the  10/666,642 US patent application
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
  misc_feature: The rosette leaves do not appear in the normal fashion, i.e., their phyllotaxy may be abnormal or too many leaves may be emerging in comparison to the control.
  misc_feature: Useful for making plants with modulated growth and phenotype characteristics
MEFTAGPAPSGGGEERAQQAVAVEKEHMFDKVVTPSDVRKLIRLVIPKQHAEKFFPLDAAANEKGLLLSFEDRTSKPWRFRYSYWNSSQSYVMTKGWSRFVKEKRLDAGDTVSFGRGVGEAARGRLFIDWRRRPDPPVHYHRLPLPSIPYAPWAHHPAALGARTTTVLHLPPSPSSLCYDYDYDSRRRHTYGAPGSRQQLLFYRPHQQTMVLDSVPVRIPTTPGQHAEPPPPVASSASKRVRLFGMNLDCAGSEEESGGGRAPPPTQAQPLQLPSPPSSSSSSSGKARCSLNLDL

SEQ ID NO: 7053 - DNA, 1127 bp, Panicum virgatum
  misc_feature: Ceres CLONE 1898121
  misc_feature: Encodes the peptide sequence at SEQ ID NO. 7054
agtagacgatgaagaaaccgtgagcacacgctggctcaaacgcggcgaaatcgtcttcaaaatcatatttggatcgtataccttcgtcgagatccttgccagctcgaagcagagcagtcgccatggagctccggctcctcccccgccgcgacgcactcgtgccgctgctcatgctgctgctgctgctggtggtggtggttcacgttcacgccaccccacgcctggagatggtggtgacctcctccgcggcgtcgggcggcggcgcgggcaccaccagcagggcgcgagcggcgccggcgccggcggcggcgtgcgcgagctggcgcctcggggtggagaccaacaacatccggggctggtacggcatccccgcggagtgccggggctacgtcagcggctacatgctcggcgagcagttccggcaggactgcgcggtggtggcgcgcgaggccgccgcctacgccgaggggctcgcgctcgccggcgacggccgggaggcgtgggtgctggacgtcgacgacaccgccctcagcaacctcccctactacgccgacaccgggttcggggcgcagccgtacaacgcgacctacttcgacgagtacgtggcgaacgcgacggcgccggcgctgcgggaggtgctggagctctacgggaagctgctggcgctgggcatcagggtggtcttcatcaccggccggcacgactaccagagggagcccaccgtcgagaacctccgcagcgccggctaccacacctgggagaagctcgtgctcaagccgtcgtcgctgggttcgtcggtggtgccgtacaagtccggcgagcggcagaagctggtggacgccgggtaccgcatcgtgggcaacatgggcgaccagtggagcgacctcgtcggagcgccggagggcgaacgcaccttcaaggtgcctgaccccatgtactacgtcgcctgaatgagatcagagagctccaacaataaccggcaggttatggcattgctcaaggctcatcgcctttgttttgtacttgcgcggctgtcagtgcttgtttaccatacatggaataaatcgggagcacctgtgtgctactagcttgcttgtattgtaaaaaaaaaaaaaaaaaaaaaaaaa

SEQ ID NO: 7054 - protein, 275 aa, Panicum virgatum
  misc_feature: Ceres CLONE 1898121
  misc_feature (15)..(227): Pfam Name: Acid_phosphat_B Pfam Description: HAD superfamily, subfamily IIIB (Acid phosphatase)
MELRLLPRRDALVPLLMLLLLLVVVVHVHATPRLEMVVTSSAASGGGAGTTSRARAAPAPAAACASWRLGVETNNIRGWYGIPAECRGYVSGYMLGEQFRQDCAVVAREAAAYAEGLALAGDGREAWVLDVDDTALSNLPYYADTGFGAQPYNATYFDEYVANATAPALREVLELYGKLLALGIRVVFITGRHDYQREPTVENLRSAGYHTWEKLVLKPSSLGSSVVPYKSGERQKLVDAGYRIVGNMGDQWSDLVGAPEGERTFKVPDPMYYVA

SEQ ID NO: 7055 - DNA, 1025 bp, Panicum virgatum
  misc_feature: Ceres CLONE 1899645
  misc_feature: Encodes the peptide sequence at SEQ ID NO. 7056
ctcgccccaacaccttcctctccgcggccgcttcctccttcctccgctctctgccctccctctctccgccgattcagagctcggcgaattcggacagtgcgcggcgcggcgtcgtcggtccctcccccgttcccccgtgacgaatcccgcgcgggctcctgcggcgcctcggaccccggttgggcgaaatggaaggtgtggtcgtgaggagggtgatcccttcggacaacagctgcctcttcaatgccgcgggttacgtgatggaacataaccggaataaggcttctgagctcagacaggttatagcagcagcagtggctagtgatcctgtaaagtacaatgaagtgtttcttggcaaaccgaatgaagcatattgcgcttggattctggatcctgaaaagtggggaggagccattgagctctctattctatcggaatattacgggcgtgaaattgctgcatatgacattcagaccacccgctgtgatctatatggtcaggagaagaattatagtgaaagggtcatgctaatttatgatgggttgcattatgatgctctggctatgtctccagctgaaggagcaccagaagaatttgaccagacaatattcccagtcaaccataaccgttcaattggtccagcagaaggtcttgctctcaacttagtgagggaggcacagagaaagaggagctatactgacactgcaaacttcactctgcgctgcggggtgtgccagattggcgtcattggtcaaaaggaggccgtcgaacatgcgcaagccactggccatgtcaacttccaagaatacaaatgacagtagaagataagactggttgtgttgtaaacttatcatttgtttatcaatttgatattcttcttctgttggatatggttggcactttgtatcacaatgtatttgttacagtgaaaacataataattttgtatttattccggataatgtagatattgccaaccaataatggttcaaatgccccttctcgttaaaaaagaaaaaaaaaaaa

SEQ ID NO: 7056 - protein, 208 aa, Panicum virgatum
  misc_feature: Ceres CLONE 1899645
  misc_feature (1)..(111): Pfam Name: OTU Pfam Description: OTU-like cysteine protease
MEGVVVRRVIPSDNSCLFNAAGYVMEHNRNKASELRQVIAAAVASDPVKYNEVFLGKPNEAYCAWILDPEKWGGAIELSILSEYYGREIAAYDIQTTRCDLYGQEKNYSERVMLIYDGLHYDALAMSPAEGAPEEFDQTIFPVNHNRSIGPAEGLALNLVREAQRKRSYTDTANFTLRCGVCQIGVIGQKEAVEHAQATGHVNFQEYK

SEQ ID NO: 7057 - DNA, 1570 bp, Panicum virgatum
  misc_feature: Ceres CLONE 1899751
  misc_feature: Encodes the peptide sequence at SEQ ID NO. 7058
gtcggctcctatcaaagcagaactccggtccatgcaaacggcatggataataatatttaagtaggaaatgctgcaatcggatcggatcggatcacatcgtgccgctcaaggccagaaaaaaaaaatcacaataaaggcacgtgcacctcgcacctgccatgctctgctttgttttgcccatctttttgctgatcttgtcgctggtcgctggcgcaaacactgatagcaacgaggagggggagggaatcctcctgtcgctggagcagcagacggcatcggtttgcctgtagccgtgtagcgtgtataaaggcagtagctgtggtcgagtgcagtgactcagtgagaggtgagaaggaatctgaaagcttcgttgcagcagagagagtgagtgttacagggatggctgcacggcgagctgctaggaatatgggattgcggcttgttcaggtcctcctcgtcgcggtagtggcgagagctcctgccgcccacgcatggcgcaaggagggccactacatggtgtgcaagatcgccgagagctttctgacgagcgaggcctcggcggcggtgacgaggctcctgccggggtgggccggcggggagctcgcggcgacgtgctcgtgggccgacgacgagcggcgccggtacccgtggtcgggcgcgctgcacttcgccgacacgccgggcgactgccagttcttctacgatagggactgccacaacacgaaaggggagaaggacatgtgcgtggttggaggaatcaacaactacaccgcagccctgatgaacacgtctgctccattggttgatccgaccgtaagcctgatgttcctggcgcacttcgtcggcgacatccaccagcctctccactgcggcaacaccgtcgacttcggcggcaacaccatcatcgtccactggtacaacgcaacgaccaccaacctccatcgcgtatgggatttagacatcatcgagaaagccatgaaggacttctacaacgacgacctgagcatcatgacacacgtcatcatgcagaacatcactgaggcgtggtctgaagacgagagggagtgggaggcatgctctagccgagcaaagacttgtgctgacaagtacgctatggagagtgcgcaactggcgtgcgacgtggcgtacgcgggtgttgagcaaggctccatcttaggagacgactatttctactctgcgctgccggttgttcagaagagaatcgcgcaaggaggggtgaggctcgctgcaatactcaacaagatcttcggtgagagcagcaagccccagagcagttgaacccggaggcattaagggagaaaaagggcaaggagttggttgccatgatcaatcagaataagatcgtcctgtctgaaaatgttaattcagccattcacgatcactgctctatcggatttactttcagtttgtcggagtttctttccttgggaaccaaagggattttatttacgatgtagattttgtgcgaaatttagtaccgtcactcactgtagagcgtttcctgaactggacacttcttgcgttcctccaaaaaaaaaaaaaaaaaaaa

SEQ ID NO: 7058 - protein, 299 aa, Panicum virgatum
  misc_feature: Ceres CLONE 1899751
  misc_feature (1)..(256): Pfam Name: S1-P1_nuclease Pfam Description: S1/P1 Nuclease
MAARRAARNMGLRLVQVLLVAVVARAPAAHAWRKEGHYMVCKIAESFLTSEASAAVTRLLPGWAGGELAATCSWADDERRRYPWSGALHFADTPGDCQFFYDRDCHNTKGEKDMCVVGGINNYTAALMNTSAPLVDPTVSLMFLAHFVGDIHQPLHCGNTVDFGGNTIIVHWYNATTTNLHRVWDLDIIEKAMKDFYNDDLSIMTHVIMQNITEAWSEDEREWEACSSRAKTCADKYAMESAQLACDVAYAGVEQGSILGDDYFYSALPVVQKRIAQGGVRLAAILNKIFGESSKPQSS

SEQ ID NO: 7059 - DNA, 1680 bp, Panicum virgatum
  misc_feature: Ceres CLONE 1899791
  misc_feature: Encodes the peptide sequence at SEQ ID NO. 7060
agagcattgcagcgccggccacctcgcccccctctctcgctgtctcgcaccacccgcgcggagggaggggacgggcggtgagcgggagatctcgggagggctccgatcgaaccggggcggcgggaggagggagagcggagcggaggagaggagaggagtagattggttcgatggtaagggagacggggtactacgacgtgctgggagtgaccccggcggccaccgaggcggagatcaagaaggcgtactacgtcaaggcaaggcaggtccatccggacaagaaccccaatgatccgctcgcggcggagaagttccaggaattgggggaggcataccaagtactcagtgaccccgcgcagcgtcaagcctatgactcatatgggaaatctggtatttcaacggaagccataattgatcctgcagcaatatttgcaatgctgtttggtagcgagctctttgaggattacattggtcaactggcgatggcatccatggcttcacttgatggttttagtgaagacgaacaaatcgatgccaggaagttgcaagagcaaatgcgagttgtacagaaggaaagggaagagaagctagcagatgcactgaagaatagattgcacctttatgttcaaggaaacaaagaggaatttatccagcatgctgaagctgaggtgactagactctctaatgcagcatatggtattgacatgctgagtactattggttatgtgtactcaagacaagctgcgaaggagcttggaaagaaagctttatatcttggtgttccgtttatagctgaatggttcagaaacaaagggcattttattaaatcacaagtaacagctgtgacaggtgcaatagctcttatgcagctgcaggaagacttgaagaaacatctcagtgctgagtgccactacaccgaagaggaactggaggcttacttgcagactcacaaaagtgttatggtggattccttgtggaagcttaatgttgctgatatagaggcaaccctatcacatgtgtgtcaaatggtgcttcaagacagcagtgtcaggaaagaggaactgcgagctcgagctaaaggattgaaaactttaggcaaaatattccagcgtgttaagctggctacagagggagagccagcagcaatgagaaatacgataaataactcagatgacaatgatggtagttctccggattcatcaccaaattctcctagggatcaaatgttcgatgcaaatccaccttatgcccagagtccatacgtggaggcccctcgattcggcgattatttcttcccaatgcctaccgcaccaccaggcgcacagagggaccccattccatgactgcttggagcgcagcagctccgttttgtgtgggtcgtcattttgtacaatattgcttgtgtagtagatgatggcatggtcgccatttttatttgtaacattagtagcattagagtaaggcagcagcttggtatcattgcatcttttcttttcttattttcttcagttgtgtaatcaatcaatcaagcatgcaacggcgtcagccttgtgttgtgtatagggctgcaggcaggcttgtgctgctgttgtgtgttgaggcagctacaggtcaaccattgttgtacatgaactatcacctcccctttgcttcatgtgtctatgggtgcataattgtttt

SEQ ID NO: 7060 - protein, 390 aa, Panicum virgatum
  misc_feature: Ceres CLONE 1899791
  misc_feature (1)..(63): Pfam Name: DnaJ Pfam Description: DnaJ domain
MVRETGYYDVLGVTPAATEAEIKKAYYVKARQVHPDKNPNDPLAAEKFQELGEAYQVLSDPAQRQAYDSYGKSGISTEAIIDPAAIFAMLFGSELFEDYIGQLAMASMASLDGFSEDEQIDARKLQEQMRVVQKEREEKLADALKNRLHLYVQGNKEEFIQHAEAEVTRLSNAAYGIDMLSTIGYVYSRQAAKELGKKALYLGVPFIAEWFRNKGHFIKSQVTAVTGAIALMQLQEDLKKHLSAECHYTEEELEAYLQTHKSVMVDSLWKLNVADIEATLSHVCQMVLQDSSVRKEELRARAKGLKTLGKIFQRVKLATEGEPAAMRNTINNSDDNDGSSPDSSPNSPRDQMFDANPPYAQSPYVEAPRFGDYFFPMPTAPPGAQRDPIP

SEQ ID NO: 7061 - DNA, 1585 bp, Panicum virgatum
  misc_feature: Ceres CLONE 1899848
  misc_feature: Encodes the peptide sequence at SEQ ID NO. 7062
gatccccgccattcggacgcccgccgccgcaaccctagactctggtttcttcctcccccccgtcatctctgcggcgccgccatcgcataaatcctccgccctctccctcctccgtaaacccctccctctctcgcttcctcggccggcctgctcccgtgatctgtgctgcagatcggtcgacatggcgctcgtattgcattctggacctggaaacaagaatgctttcaaggcacttattgctgcagaatacagtggggttaaggttgagttgacaaagaattttgagatgggtgtcaccaacaagacccctgagtttcttaagatgaacccccttgggaaggtgcctgttctggagactcctgaaggtgctgtttttgagagcaatgctattgcacgctatgttgctcgcttgaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcgttgaagagagcgctcggttctctgaacacgcaccttccctcaaagacattccttgttgggcattctgtcactctagctgacattgtattgacatgcaacctctaccatggatttgcacggatcttgaccaagagcttcacatccgagttcccgcatgtcgagaggtatttctggaccatggttaaccagcctaacttcaagaaggtcatgggtgatgtcaagcaggcagagtcagtgcctcctgttccgaaaaagactgctgcccccaaggagccaaaggcaaaggatgtgaagaaagaagccccaaaggaggccccaaagccaaaggtggtcgaggcaccggcagaagaggaggcaccaaagccaaagcctaagaatcctcttgacttgctgccaccaagcaagatgatccttgatgactggaagaggctatactcgaacacaaagaccaacttccgggaggttgccatcaaaggtttctgggacatgtatgacccagagggctactctctgtggttctgtgactacaagtacaatgaggagaacaccgtctcctttgtgaccatgaacaaggttggtgggttcctgcagcggatggacctgtgccgcaagtacgcctttggcaagatgcttgtggttggctctgagcccccattcaagttgaaggggctctggctcttccgtggccaggaggtccccaagtttgtcatggatgaggtctatgacatggagctctacgagtggaccaaggtggacatctccgacgaggcccagagggagcgcgtcagtgcaatgatcgaggaccaggagcccttcgagggtgaggctctgcttgacgcgaaatgcttcaagtgaggttgcagctgctggagattgaattgtttaggccttatatttgctgtctatggaagtatgaagactttgcatgttagtacccttgtgaactggttgaagtttgtgcttcgttaacaattttgggctatttaaaaaaaaaaaaaaaaaaaa

SEQ ID NO: 7062 - protein, 417 aa, Panicum virgatum
  misc_feature: Ceres CLONE 1899848
  misc_feature (1)..(76): Pfam Name: GST_N Pfam Description: Glutathione S-transferase, N-terminal domain
  misc_feature (1)..(93): Pfam Name: GST_C Pfam Description: Glutathione S-transferase, C-terminal domain
MALVLHSGPGNKNAFKALIAAEYSGVKVELTKNFEMGVTNKTPEFLKMNPLGKVPVLETPEGAVFESNAIARYVARLNDGNPLFGSSRIEQAHVEQWMDFAATEVDPGVAWYLYPRLGYIPYSQTTEETAIASLKRALGSLNTHLPSKTFLVGHSVTLADIVLTCNLYHGFARILTKSFTSEFPHVERYFWTMVNQPNFKKVMGDVKQAESVPPVPKKTAAPKEPKAKDVKKEAPKEAPKPKVVEAPAEEEAPKPKPKNPLDLLPPSKMILDDWKRLYSNTKTNFREVAIKGFWDMYDPEGYSLWFCDYKYNEENTVSFVTMNKVGGFLQRMDLCRKYAFGKMLVVGSEPPFKLKGLWLFRGQEVPKFVMDEVYDMELYEWTKVDISDEAQRERVSAMIEDQEPFEGEALLDAKCFK

SEQ ID NO: 7063 - DNA, 1790 bp, Panicum virgatum
  misc_feature: Ceres CLONE 1899932
  misc_feature: Encodes the peptide sequence at SEQ ID NO. 7064
gccgaacgcgcaaagctccattagaaaaaccacagcagaagaccaaccagagatctaccgatccgacgccagcggcaaccgcagcgctataaaatggccgctccggcctcctcgtccgccgccgcagccgccgcgcccgcgtcttcgtcaccgcccaagcctccaaacaacgccgccaccagcaccaccacgaccaccatgctcgatccacagtcgtcgccctaccccgacgccgcggcctccagcgtcagctccgcgagcagcagcagtacaagcagcagcagcagcagccaggcggaccggtcgtcgaccttctccctggactcgtcgtcggccgcgacgccgtcgtcgtccccgcggcgcccgcaccgggcgagcgacgtggcgtgggcgcccatccggggccgggcgctcgggccgcgggacttcacgctcctccgccgcgtcggggccggggacatcggcaccgtctacctctgccgcctcgagggcggccaggccgaggccgccaccgccgcgtgcgcctacgccatgaaggtggtggaccgccgcgcgctcgccaggaagggcaagctgggccgcgccgccgccgagaagcgcgtcctgcgccggctcgaccacccgttcctgcccaccatgttcgcggacttcgacgccggcacggacttctcgtgcatcgtcatggagttctgccccggcggcgacctccactccctccgccaccgcatgccgggccgccgcttcccgctcgcctccgcgcggttctacgccgcggaggtgctcctcgcgctcgagtacctgcacatgatgggcatcgtgtaccgcgacctcaagcccgagaacgtgctcatccggggcgacggccacatcatgctcaccgacttcgacctctcgctcgagtccacggcgtcgccgtcgctggaggacgccaggagcgggggctccgacaagaagggggaggacgcccgggcgccgtcgccgatctgcctcccgatcccggagctgcagctcctccggctgcggaggtggaagcgccgcgccgccgcgccccggccgcggttcgtggcggagcccgtggacgcgcggtcgagctccttcgtgggcacgcacgagtacgtggcccccgaggtcgcccgcggcggcggccacggcgcggccgtggactggtgggcctacggcgtcttcctctacgagctcatctacgggcgcaccccgttcgtgggggagaccaacgaggccacgctccgcaacatcgtgcgccgcccgctcgagttccccgccgccccggcggcctcccacggcgacgacgccgcggcgcgggacctgatcgcgcggctcctggacaaggacccgcgcacccggctcgggtccaagcgcggcgccgccgacgtgaaggcgcacggcttcttcaagggcctcaacctggcgctgctgcggtcgtcgcccccgcccgtggtgccgcccgccgccgcgccgctgcaccggtgcgacgacaaggccgccgacgtgcagcagctgttcgatcacttctgacgcggtcgtccatgattcagaatcaaagcaaaagcatttttgttgttgatcgatcgacgaatagacactagccaggagcctaggacccggcctaaccatccagctggggtagccagagatgcaagcccgtgttgactcgctaattaatctagtagtcccattagcactgcctattgtacaccgctgttaattaattactagtttactgctaatcaatggattaagattaattatttcaaaaaaaaaaaaaaaaaaaa

SEQ ID NO: 7064 - protein, 479 aa, Panicum virgatum
  misc_feature: Ceres CLONE 1899932
  misc_feature: Great-hit functional homolog of the protein sequence given in SEQ ID NO 9658
  misc_feature: Useful for making plants with modulated biomass
  misc_feature: The plant is abnormally small.
MAAPASSSAAAAAAPASSSPPKPPNNAATSTTTTTMLDPQSSPYPDAAASSVSSASSSSTSSSSSSQADRSSTFSLDSSSAATPSSSPRRPHRASDVAWAPIRGRALGPRDFTLLRRVGAGDIGTVYLCRLEGGQAEAATAACAYAMKVVDRRALARKGKLGRAAAEKRVLRRLDHPFLPTMFADFDAGTDFSCIVMEFCPGGDLHSLRHRMPGRRFPLASARFYAAEVLLALEYLHMMGIVYRDLKPENVLIRGDGHIMLTDFDLSLESTASPSLEDARSGGSDKKGEDARAPSPICLPIPELQLLRLRRWKRRAAAPRPRFVAEPVDARSSSFVGTHEYVAPEVARGGGHGAAVDWWAYGVFLYELIYGRTPFVGETNEATLRNIVRRPLEFPAAPAASHGDDAAARDLIARLLDKDPRTRLGSKRGAADVKAHGFFKGLNLALLRSSPPPVVPPAAAPLHRCDDKAADVQQLFDHF

SEQ ID NO: 7065 - DNA, 2110 bp, Panicum virgatum
  misc_feature: Ceres CLONE 1899985
  misc_feature: Encodes the peptide sequence at SEQ ID NO. 7066
atcttcagatccccgacttgccgttcctctttcctccagccaaacacacccgtcgccgacccctccgccggccgccgctgtgctccgccgcaggagagttcaactcccccccccccccgcccgtcgtaatcttccaccacttcaaaattgctggaccttggattgctggcaaactcttttcggctcctactcgcgatttggtcggatccgtgggccgacggcgacggcgatggcggggtcggcggcggggaggaggaggcgcgcggcagtagttgtgcttggggatatcggccgtagcccgcgcatgcagtaccactccctctcactcgccagccaggctggcatggaggtggacattgttgcaaatggaggaagtgatcctcacctgtcattgagagagaatccatcaattcacatccacgagatgaaaacagtgaatttaactggaatttcaaagatatctggtgccctgtcacttttacttaaagccgctatccagtttgttatgctggtttggttcctttgttttaagattcctcggcctgatgtccttcttgttcagaatccaccctctgttccaacacttgctgctgtaaaactggcaagctggctaagaggtgccaaatttattgtggattggcataacttcggatatacattgctgggattatctcatggaagaagtcacatcatagtcaaaatctatttctggttcgagaagcactttgggcggatggctgatggcgccttttgtgttacaaaagcaatgcagcatgagcttgcccaaaattggggaatcagagcaacggttctttatgatcaatctcctgattttttccaccctgcttcattaatggaaaaacataggttgtttagcaggttagggaataccatttgcagtgctatgggcaatgctgattgcatatcagtggagaaagaggtgcaagacatgaacactattgtctttaccagtaagaataatggcgaaattttcctgaagcctaacagacctgcacttgtcgtgagcagcacaagctggacaccggacgaagatttcagcatacttctggaagcagcactgatgtatgatagacgtgttgctgcaacgttaggtgaagatgattcaatggatgaggggcaactttggatcgatatcaagaatggaaaacaatttgtctatccaagattactgttcattatcacaggtaaaggaccagataggaagaaatatgaggatcagataagaaggttgaagttgaggcgtgttgccttccggacgatgtggctcgcatcagaggactaccctttattgcttgggtcagctgatctaggagtgtcgttgcatacatcttcgtcagggctggacctacctatgaaggtggttgatatgtttggatgtggactgccagtttgtgctgcttctttctcctgcattgaggaacttgtgaaagtaaacaaaaatggtcttcttttctcaacatcttcagagcttgctgatgaacttatgatgctcttcaaggggtttccagaagaatgtgatgccttgaaatccctcaaagaaggtgccatggatacagcgtcatcttccaaatggtcaacagaatgggaaactaatgcactacctttggtgaatcaggtcagtggataagatgtgtgctaacatatacagtataagacggaaagttatttgtttcagagaatcagagataggtatactagactactggagtgagcagatgtgcatcaaaaaagggtactctttgctttcaccagctgccgccaggatcagttgttatgatgtgcatcgctgtagcaaaatcaatgcagtgacaatgtatttcggcaattctagagatacagtacaaggctctttcctttcaagaccgggaaatgtactctttgctgagcacatgtctaaattgtttaggatgtatacaacaatagattgtttgatgtggtatcatattggaatgtctctagtctgttgcatgatgagcaaaaacattaaaaaaacatattgttttctatggagttgaaggccatcttgtaagatgatatgcagacaggcatgtagcaaacaaagttgtacgaaaaaaaaaaaaaaaaaaaa

SEQ ID NO: 7066 - protein, 472 aa, Panicum virgatum
  misc_feature: Ceres CLONE 1899985
  misc_feature (1)..(109): Pfam Name: Glycos_transf_1 Pfam Description: Glycosyl transferases group 1
  misc_feature (318)..(467): SWISSPROT Homolog: EC 2.4.1.142 Chitobiosyldiphosphodolichol beta-mannosyltransferase
MAGSAAGRRRRAAVVVLGDIGRSPRMQYHSLSLASQAGMEVDIVANGGSDPHLSLRENPSIHIHEMKTVNLTGISKISGALSLLLKAAIQFVMLVWFLCFKIPRPDVLLVQNPPSVPTLAAVKLASWLRGAKFIVDWHNFGYTLLGLSHGRSHIIVKIYFWFEKHFGRMADGAFCVTKAMQHELAQNWGIRATVLYDQSPDFFHPASLMEKHRLFSRLGNTICSAMGNADCISVEKEVQDMNTIVFTSKNNGEIFLKPNRPALVVSSTSWTPDEDFSILLEAALMYDRRVAATLGEDDSMDEGQLWIDIKNGKQFVYPRLLFIITGKGPDRKKYEDQIRRLKLRRVAFRTMWLASEDYPLLLGSADLGVSLHTSSSGLDLPMKVVDMFGCGLPVCAASFSCIEELVKVNKNGLLFSTSSELADELMMLFKGFPEECDALKSLKEGAMDTASSSKWSTEWETNALPLVNQVSG

SEQ ID NO: 7067 - DNA, 3334 bp, Panicum virgatum
  misc_feature: Ceres CLONE 1900074
  misc_feature: Encodes the peptide sequence at SEQ ID NO. 7068
atcagagcatgccactcaatgcatgcagagctgctcatctcagctgccactgctcactccccgccattactcgtattcactaccgcggacagcagctgcagctctcaccttcctctctcttcttctctctaggcatctcgtcttcactactgtctcgcacttcacgctgcagcccagtgcccacacacagagtagctgtacaaagggagctcgtgagggagggaggagaaaagccggtggagtgagaacagagcagctcgaaatgctgtcattttcccattcgcccatcgtctcctacctcctgtggtgccttgtattgctggccttggcaagcagcaatggcgtgggtgccacagcgaagccgaaggttgttgggtccggctacaagctggtgtccctggttcagctgcccaacgggggaggccttgtgggctacctgcaggtgaagcagcgcacctccacctatggccctgacatccctcgcctcaggctgtttgtcaagcacgagacgagggaaagggtgcgcgtgcagatcaccgacgcggataagccgaggtgggaggtcccctacaacctgctcccgagggagccagccccacccgtgaccggcggcagggtcacgggcgcccccttcaccgccgccgagtaccccggcgaggagctggtcttcacctatggccgcgacccgttctggttcgccgtgcaccgccgctccacccggcagccgctgttcaacaccagcgccggcgcgctgctgttcaaggaccagtacctggaggtgtccacggcgctgcccaaggacgccgcgctgtacgggctcggcgagaacacgcagccggggggcatccggctgcggcccaacgacccctacaccatctacaccacggacatctccgccatcaacctcaacaccgacctctacggctcgcacccggtgtacatggacctccggagcctggccggccgcggcgtcgcgcacgccgtgctgctgctcaacagcaacggcatggatgtgttctacagggggacctcgctgacgtacaaggtcatcggaggccttcttgacttctacttcttcgccggggcgacgccgttggccgtcgtggatcagtacacgtccatgatcggccgttctgcacccatgccctactgggcatttgggttccaccagtgcaggtgggggtacaagaacctttctgtggttgagggtgttgtggagggctaccggaatgctcagatacccctcgacgtgatctggaatgatgacgatcacatggatgccgccaaggacttcacactggaccctgtcaactaccctcggccgaagctgctagcgttccttgacaagatccacgcgcaggggatgaagtacattgtccttatcgaccctggcatcgctgtgaacaactcctatggtgtgtaccagcgtggcatggcgcgggacatcttcatcaagctggatgggcagccataccttgcccaggtctggcctggccctgtctacttcccggacttcctcaacccgaacggcgtgtcatggtggattgacgaggtgcggaggtttcatgaccttgtcccggtggatggcctctggatcgacatgaacgaggcatccaacttctgcacgggcaagtgcacaatcccgaagaagcaccagtgccctattcctgactcgaagacgccgtgggtgtgctgcctggattgcaagaacctcacgaacaccagatgggatgagccaccttacaagatcaatgcctcggggcagaccgctcggctcggcttcaacaccatcgcgacaagtgccactcactacaatggcatcctggagtacaatgcccacagcctgtacggcttctcgcaggccattgccacgcacaaggccctgcaagggctgcaggggaagaggccgttcatcctgactcgctccactttcgtcgggtcgggcgcgtatgccgcgcactggaccggcgacaacaagggcacctgggaaaacctccggtactccatctcgacgatgctcaactttggcatcttcggcatgcccatggttggctctgacatctgcggcttttacccgtcgccgacggaggagctctgcaaccggtggatcgagctcggcgccttctacccgttctccagggaccatgccaacttcgcgtcgccgcggcaggagctctacgtgtgggagtccgtggccaagtcggcgcggaacgcgctgggcatgcggtacaagctgctcccgtacctgtacacgctcaactacgaggcgcacctgaccggcgcccccgtggcgcggccggtgttcttctccttccccgacttcacgccgtgctacgggctgagcacgcagttcctgctcggcgcgggcgtcatggtgtccccagtcctggaggagggcgccacctcggtgcgggccctgttcccgccgggcacctggtacaacttgttcgacacgaccaaggtggtggtgtccaaggccggcgaggcgccggtgaggctcgacgctccgctgaacgagatcaacgtgcacgtgtaccagggcacggtgctcccgatgcagcgcggcggggtcatctccagggacgcccgcgcgacgccgttcacgctggtggtggcgttcccgctgggcgccgcgcaggcggacgcggagggcgccgtgtacgtggacgacgacgagcggccggagatggcgctcgcggaggggcaggcgacgtacgtgcggttccacgcgagcgtgcgcggcagggcggtcacggtgcggtcggaggcgctgatggggagctacagcctgcgcgcgggcctggtgatcgagaagctcacggtgctggggctggaggggaccggcaaggacatctccatcgtggtcgacggcgcggacgccgacgcagcagccgtcgcgacgtcgagcccttacttcgcggcgggtgggggcgcgaagctgcaaggggaggagggagaaggcgtcgaggacagccagaggagcgtcgaggtggacgtcggcgggctggcgttgccgctggggaagagcttcaccgtgacctggaacatgcagatcgaagcctaggtcaagttctgttctgccctgctacatcatccatctctccatctgcttgcgttcgcttaaagcgtcgatccatgtctgattagatggtagatcctgcccgtgctgctccgcagcgaagattctggaaatttgcgtgtcatctggtgggtgcgctgtgcaaggagcagcgcacgcactcggtgacgcagagtttctgattttcttctggattttagccttcctggaataagaacctttaacgtctgcatggaaaaaaaaaaaaaaaaaaaa

SEQ ID NO: 7068 - protein, 1013 aa, Panicum virgatum
  misc_feature: Ceres CLONE 1900074
  misc_feature (1)..(492): Pfam Name: Glyco_hydro_31 Pfam Description: Glycosyl hydrolases family 31
  misc_feature (1)..(492): Pfam Name: Glyco_hydro_31 Pfam Description: Glycosyl hydrolases family 31
  misc_feature (196)..(468): Pfam Name: Glyco_hydro_31 Pfam Description: Glycosyl hydrolases family 31
  misc_feature (1)..(493): Pfam Name: Glyco_hydro_31 Pfam Description: Glycosyl hydrolases family 31
  misc_feature (194)..(466): Pfam Name: Glyco_hydro_31 Pfam Description: Glycosyl hydrolases family 31
  misc_feature (1)..(493): Pfam Name: Glyco_hydro_31 Pfam Description: Glycosyl hydrolases family 31
  misc_feature (167)..(434): Pfam Name: Glyco_hydro_31 Pfam Description: Glycosyl hydrolases family 31
  misc_feature (1)..(490): Pfam Name: Glyco_hydro_31 Pfam Description: Glycosyl hydrolases family 31
  misc_feature (196)..(468): Pfam Name: Glyco_hydro_31 Pfam Description: Glycosyl hydrolases family 31
  misc_feature (194)..(466): Pfam Name: Glyco_hydro_31 Pfam Description: Glycosyl hydrolases family 31
MQSCSSQLPLLTPRHYSYSLPRTAAAALTFLSLLLSRHLVFTTVSHFTLQPSAHTQSSCTKGAREGGRRKAGGVRTEQLEMLSFSHSPIVSYLLWCLVLLALASSNGVGATAKPKVVGSGYKLVSLVQLPNGGGLVGYLQVKQRTSTYGPDIPRLRLFVKHETRERVRVQITDADKPRWEVPYNLLPREPAPPVTGGRVTGAPFTAAEYPGEELVFTYGRDPFWFAVHRRSTRQPLFNTSAGALLFKDQYLEVSTALPKDAALYGLGENTQPGGIRLRPNDPYTIYTTDISAINLNTDLYGSHPVYMDLRSLAGRGVAHAVLLLNSNGMDVFYRGTSLTYKVIGGLLDFYFFAGATPLAVVDQYTSMIGRSAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNNSYGVYQRGMARDIFIKLDGQPYLAQVWPGPVYFPDFLNPNGVSWWIDEVRRFHDLVPVDGLWIDMNEASNFCTGKCTIPKKHQCPIPDSKTPWVCCLDCKNLTNTRWDEPPYKINASGQTARLGFNTIATSATHYNGILEYNAHSLYGFSQAIATHKALQGLQGKRPFILTRSTFVGSGAYAAHWTGDNKGTWENLRYSISTMLNFGIFGMPMVGSDICGFYPSPTEELCNRWIELGAFYPFSRDHANFASPRQELYVWESVAKSARNALGMRYKLLPYLYTLNYEAHLTGAPVARPVFFSFPDFTPCYGLSTQFLLGAGVMVSPVLEEGATSVRALFPPGTWYNLFDTTKVVVSKAGEAPVRLDAPLNEINVHVYQGTVLPMQRGGVISRDARATPFTLVVAFPLGAAQADAEGAVYVDDDERPEMALAEGQATYVRFHASVRGRAVTVRSEALMGSYSLRAGLVIEKLTVLGLEGTGKDISIVVDGADADAAAVATSSPYFAAGGGAKLQGEEGEGVEDSQRSVEVDVGGLALPLGKSFTVTWNMQIEA

SEQ ID NO: 7069 - DNA, 1811 bp, Panicum virgatum
  misc_feature: Ceres CLONE 1900094
  misc_feature: Encodes the peptide sequence at SEQ ID NO. 7070
gctttaccaaaagtgctcgccgaggccgcctttccgggccgcggctgcggccgcactcggggagagagagcgagcatattctgcctttgccgctgtgctcattccatttggagctcgaaagcttcgccaacctttttttctttaacctgatcgccacttgcaacgaatgctctgccgttactcacgctgcctccccgctggttgtttgtgttggttagcatcggcgccgccgcctccccgccggagtacatgacctctgcgtccgcggtgcagttcgcggcggcgcccatcagaatgggggtgtacgagcggccggcgccggcgccggtgatgggcatgtggagcagcgatccgttcaaggtcgacagcggccaggccaccagcgggtccaccgtcatggaggcggacaagttcgacactgggctagaagatgttccacaggtagcactggagcgggcaagaagtacggatcaggaaacaagcaggccgccagagagggtcctaagaagacttgcacagaacagagaggctgctcggaagagccggctgagaaaaaaggcctacatccagcagctagagacaagccggatgaagctggcacaactagagcaagagcttcaacgggctcgacagcagggtgcatatgcaaatgggaatttgggagacccaaatctcggtttcgcaggaacaatggatccaggtgttgctgcgttcgagatagactacagcaactgggtggaagagcagaacaggcacacagccgagctgaggtcggctctccaggggcagaccacggagctcgagctgcgcatgctcgtcgagaccgggctcaacaactacgagcacctgttcaggatcaaggcgctggccgccaactccgacgtgttctacgtcacgtccggcatgtggaagacccccgccgagcgcttcttcctgtggatcggcgggttccggccgtcggaagtgctcaagatcctgaggccgcagctggagccgctgacagaggcgcagctgatggccgtgggcggcctgcagcacaccttgacgcaggccgaggacgccctgtcgcagggcatggagaagctgcagcagaacctcgccgagactctgacggccgcggccgacccgttcgggccccccgacggctacatgctgcagatggcgcccgccgtggagaagctgaaagagctcgtcggcttcgtgacccaggcggaccatctccggcagacgacgctgcagcagatgcacaagatcctgacgactcggcaggcggcgaggggcctcctggcgctcggcgactacttccagcgcctccgcgcgctcagccatctgtgggcgacgcggccccgcgagtcgacgattagctagagcgcggtggcgaaaagctagccaccggggccggcgatgaccaaagacgacgacgacgacgaagagtagtagttcgttgtatacttcccaaggtgtaaggccagccgaggagggacgaagaagtcgtcgacctcgctggggttggttggagttggagatgaggaacgcagaggctttctcagccagcggcgccggcgccgtgccggtgcccgcgtctccgaggaacaggaaagtggtgtgcgtttgtcaggtgatcaaagaataacgggaaatttgaggcctttcgagacgtgtacatatcttgttttggtgtaccctgcccgtgcccggaggccttctacagccgtacaattaattggtataaatgatgggttttacaagtagcgttacggtatattacgaatttatgatgtaacgatatgtaaaaaaaaaaaaaaaaaaaa

SEQ ID NO: 7070 - protein, 372 aa, Panicum virgatum
  misc_feature: Ceres CLONE 1900094
  misc_feature: Great-hit functional homolog of the protein sequence given in SEQ ID NO 9747
  misc_feature (5)..(45): Pfam Name: bZIP_1 Pfam Description: bZIP transcription factor
  misc_feature: The sequence is a functional homolog of  SEQ ID NO 1493 in the  10/374,780 US patent application
  misc_feature: The sequence is a functional homolog of  SEQ ID NO 1563 in the  10/412,699 US patent application
  misc_feature: The sequence is a functional homolog of  SEQ ID NO 1786 in the  10/412,699 US patent application
  misc_feature: The sequence is a functional homolog of  SEQ ID NO 2024 in the  10/374,780 US patent application
  misc_feature: The sequence is a functional homolog of  SEQ ID NO 352 in the  10/412,699 US patent application
  misc_feature: The sequence is a functional homolog of  SEQ ID NO 819 in the  11/479,226 US patent application
  misc_feature: The sequence is a functional homolog of  SEQ ID NO 928 in the  11/435,388 US patent application
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
  misc_feature: Useful for making plants with modulated growth and phenotype characteristics
MTSASAVQFAAAPIRMGVYERPAPAPVMGMWSSDPFKVDSGQATSGSTVMEADKFDTGLEDVPQVALERARSTDQETSRPPERVLRRLAQNREAARKSRLRKKAYIQQLETSRMKLAQLEQELQRARQQGAYANGNLGDPNLGFAGTMDPGVAAFEIDYSNWVEEQNRHTAELRSALQGQTTELELRMLVETGLNNYEHLFRIKALAANSDVFYVTSGMWKTPAERFFLWIGGFRPSEVLKILRPQLEPLTEAQLMAVGGLQHTLTQAEDALSQGMEKLQQNLAETLTAAADPFGPPDGYMLQMAPAVEKLKELVGFVTQADHLRQTTLQQMHKILTTRQAARGLLALGDYFQRLRALSHLWATRPRESTIS

SEQ ID NO: 7071 - DNA, 1713 bp, Panicum virgatum
  misc_feature: Ceres CLONE 1900097
  misc_feature: Encodes the peptide sequence at SEQ ID NO. 7072
atagagacaagtaccctcaccatggtgagcattagaatgaatacgtactaatcaccgtcacaaagccacaccatggataaataaacacctcacagaaaagaattttgaacgtcctcccctgtctataagtactcatcttgtacaacctcaatgtgccgcaccaccctccacagcacacattaagcacaagcacaagctagcaagagctgcgtgtagctgcgccaaagccaccatggtgaaaatcaccgtaacaaggaaatcccagtccttcgtcgtgccggcatccgagccggcgccgccgtcggccgagacgacgacgctcgagctgtcggcgatcgaccgcgtgccgggccttcgccacacggtgcggtcactgcacgtgttccacaacaagaagaagtcctccaccaccggctgcggcgacgacgacgacgatgctgccaggccgggggaggtgatccgcgcggcgctgtcccgcgcgctggtggattaccgcccgttcgccggccgcttcgtcggctcggtcgccgccggggaggcctgcgtcgagtgcaccgacgacggcgcgtggttcgtggaggccgtcgccgactgcagcctcgaggacgtgaatggcctcgactacccgctcctggtctccgaggaagagctgctgcccgctccagaggaaggcgttgaccctacaagtattccggtcatgatgcaggttacagaatttgcatgtggaggatttgtggtcgggctggtagcagtccacacacttgcagatgggctgggtgcagcccaattcatcaacgcaatttctgagtttgctcgtggaatggagaagcccacagtagcacccatatgggctcgggctttaataccgaacccacccaaactgcttcctggggcaccaccatccttccattccttcgggttccaacacttcaccatggatgtgacctctgacctcattgccaatgttaagacccagtaccatcaggccacaggacagtactgttccagctttgatgttgccattgccaaggtttggcaagcaagaaccaaggcactcaggtacaacttggagtcccaagttcatgtctgcttcttcgccaacacccgccacctcctcactcaggtgctgcctaagaatgggggcttctatggtaactgcttctatccagtttctgtgacggctactgctgaggaggttgtcactgctgggttgcttgatgtgataaggatgataaggaatgggaaggctaggcttcccctggagttttccaagtgggcagcaggggatgcgagtgtggatccataccagttgacatttgagcacaatgtgttgtttgtgtctgattggacaaggcttgggttctttgaggttgactatgggtggggtgcaccaaaccatattgtaccattcacttatgcagactacatggcagtggcggttcttggggctccaccttcaccgaagaagggaactcgcatcatgacgcagtgtgtggaggagaagcatctcatggacttcaaggatgagatgaaggccttcttttaggggcttgtcatgtatctttagtgtgccaatgctatgtgtctctgtttatgtatatgatcgatcagaataaaattgttgttgaccagtttctgtcataagaaatgtaacattactgtctacagagttatattaagccatgattcatacaaaaaaaaaaaaaaaaaaaa

SEQ ID NO: 7072 - protein, 437 aa, Panicum virgatum
  misc_feature: Ceres CLONE 1900097
  misc_feature (3)..(435): Pfam Name: Transferase Pfam Description: Transferase family
MVKITVTRKSQSFVVPASEPAPPSAETTTLELSAIDRVPGLRHTVRSLHVFHNKKKSSTTGCGDDDDDAARPGEVIRAALSRALVDYRPFAGRFVGSVAAGEACVECTDDGAWFVEAVADCSLEDVNGLDYPLLVSEEELLPAPEEGVDPTSIPVMMQVTEFACGGFVVGLVAVHTLADGLGAAQFINAISEFARGMEKPTVAPIWARALIPNPPKLLPGAPPSFHSFGFQHFTMDVTSDLIANVKTQYHQATGQYCSSFDVAIAKVWQARTKALRYNLESQVHVCFFANTRHLLTQVLPKNGGFYGNCFYPVSVTATAEEVVTAGLLDVIRMIRNGKARLPLEFSKWAAGDASVDPYQLTFEHNVLFVSDWTRLGFFEVDYGWGAPNHIVPFTYADYMAVAVLGAPPSPKKGTRIMTQCVEEKHLMDFKDEMKAFF

SEQ ID NO: 7073 - DNA, 1861 bp, Panicum virgatum
  misc_feature: Ceres CLONE 1900108
  misc_feature: Encodes the peptide sequence at SEQ ID NO. 7074
cccgtcgacgagggtttaggcgcggcgagccggcgagaccactagtccaccactgcccaccgcatcccgcacagaaaaaccccagcgcatccctcgccgccgcccggcgcgcggccatggtgtcgcagcacggcatcctcctcgccgtcagcatcatctccgaccacttcggccccctcgtatcgaaggtgtgcggctgcctcctgcgccacggcgcgctgtcactgcatgagatcgtccgccgcctcgagctctcgcgggggcaggtgaaaaactccctcctcgttctcatccagcacaactgcgtccaggccttctcgacccctatagggagcagcggtaagacggggacggtctacttggccatcttcgacaatgtcctgcaccggctgcgcttctcaaagttcctttctgttgtccgtgcggatattccagagtcagaagctcttcttgaaggattacttctgaatggcaggctaacatttgatcaacttgtgtggcgaacaatctctaaaataccagatggcagccccaaaccaacaagggaagaaatacgaatgaacttcaacaaacttgtatatgcgcattatgtggaacgttgcccaaaaccagaacctttttttgatccgcttatagatgagcagcctacgtccacaaggaagcgagctcctagagctgttgagacggttctttcacttgagcaaaaagttgtccgtactgcagctctatctgatgctgaaaaattttctgagattccatactccatggacgagtcattgaatgcaaaggatgatgatcatcatgctgttgctggtggaaagcggaaacatgaagccctagaagtagatgaagaggattcaataattgcagaaaatgaagtactctggcgggcaaattttgagaggttcatattttgtttaaagaagaaattctgtgcagaccgaaagaaagcaaagctgaaggttggtacccttactatatgggaagcattttttgaggccaatgtaatgaacaatgacaacaagactgtgacatcaccaatgaatggaattttggagagagtaggacagaaggaaggaggttcatcaatgacagtggatcagataataagtgtattgaatgatctggagtgcatttctaccactagggacccagaacaattcactttcgatttaaacaaactggtcgagacatgtcgaaacgatgaggtagagtctcttatgaagaagaaacatgggcaagaagcttatacaatctttaggttattgctgaaacaagccggtccagttgagaccgatgaaattactgacaagacaattctagacaagcagattgttcatgaaactttatacaaactttggaaggatgaatacatagattcagagagagtcccttctgcggcatcaggaacaggaaatgcacagttttttgtttggagagtgaaaaatacatatcgggaacactacatcgatcatctttatcatgctgctttaaacttgcgccagatggtcaattgtatggctgaacttctactcgagggtacaaaggatgaaaccaaacttcggaacagaaagaacattttgatcctagctctcactagacatgatgagtccctcatggtgttccatgacttttgataacacaagaacagatgctggcggcctgtcagttgagcaacctacatgaaccaatactagtgttcttcgacgaacgacgagtacttgctgtgtcattgcttccagtttgaaagtggaaaaaatgccaaccatttggtttaaagtcgaaacttttgtgctgtctgtcaggtaaatttgatctgctaattggattcatttgatatgcaaaaaaaaaaaaaaaaaaa

SEQ ID NO: 7074 - protein, 506 aa, Panicum virgatum
  misc_feature: Ceres CLONE 1900108
  misc_feature: Great-hit functional homolog of the protein sequence given in SEQ ID NO 9758
  misc_feature (1)..(277): Pfam Name: RNA_pol_Rpc82 Pfam Description: RNA polymerase III subunit RPC82
  misc_feature: Useful for making plants with modulated biomass
  misc_feature: Useful for making plants with modulated flowering time
  misc_feature: The plant flowers significantly late compared to wild-type.
  misc_feature: The plant is abnormally small.
MVSQHGILLAVSIISDHFGPLVSKVCGCLLRHGALSLHEIVRRLELSRGQVKNSLLVLIQHNCVQAFSTPIGSSGKTGTVYLAIFDNVLHRLRFSKFLSVVRADIPESEALLEGLLLNGRLTFDQLVWRTISKIPDGSPKPTREEIRMNFNKLVYAHYVERCPKPEPFFDPLIDEQPTSTRKRAPRAVETVLSLEQKVVRTAALSDAEKFSEIPYSMDESLNAKDDDHHAVAGGKRKHEALEVDEEDSIIAENEVLWRANFERFIFCLKKKFCADRKKAKLKVGTLTIWEAFFEANVMNNDNKTVTSPMNGILERVGQKEGGSSMTVDQIISVLNDLECISTTRDPEQFTFDLNKLVETCRNDEVESLMKKKHGQEAYTIFRLLLKQAGPVETDEITDKTILDKQIVHETLYKLWKDEYIDSERVPSAASGTGNAQFFVWRVKNTYREHYIDHLYHAALNLRQMVNCMAELLLEGTKDETKLRNRKNILILALTRHDESLMVFHDF

SEQ ID NO: 7075 - DNA, 1601 bp, Panicum virgatum
  misc_feature: Ceres CLONE 1900150
  misc_feature: Encodes the peptide sequence at SEQ ID NO. 7076
ttttttccctcgtattttttaattttttccctttcgttacttgccctatactcctcaaactcgaatcgtgtatgtatggctcctaaatccgactcggcgcgcacctaaccccaatcattgatcctcgccgggttggggcaggtccttctcgcaccaattccgctggttttggtctccggtggggcggattccgtcgttcttgtgccgagtgtgggcaggatttttgtcttcctcctcgcaattttaggggcggtttcgccctggttcttgcgccgcggctccagggcatatggagccgcggaggtggctcgcggccgctgttttgttgtgcctggtggtgcattgctgcgggagagaactgaagaccaaacatgcgcccatatatgacccagctcttgcccagacgctcgctgaatatacttcggctgtttatactgctgatctgacccagttgttcacctggacgtgtgaaagatgtggcgacttaacagaggggtttgaggtggtagagctgattgttgatgtgaaaaattgcttacaggcatatgttggatttgctagagatatgaatgcagttatagtcgtgttcaggggcacacaagaaaacagcattcagaactggatagaggacttattttggaaacaactggatctcgactacccgggcatgcctgaagcaaaggttcacaatggattttattctgcttaccataacacaacattgcgtgatggagttgtcagaggtattcacaagaccaggggggtgtatggtaatattcctatcatggtcactggacactccatgggaggagctatggcctcattttgcgcccttgatcttgttgttaactttgggttaaaggatgttactctcatgacatttggacaaccacggattggcaatgctgtctttgcttctaatttcaaagggcatttgccaaatgcaatccgagtgaccaatgcacacgacattgtgcctcatttacctccctactaccgctacttcccacaaaagacataccaccattttccacgagaggtatggatccacaatgttggcctaggaactttcgaatattcaatagaggaaatttgtgatgattctggagaagacccaacttgtagcagttctgtgagtggaaacagtgtgcgggaccatatacactatcttggcatcagcatgcatgccgagtcattgggacattgcagaattgtcacgggaaccctgcagtataagatggatcctgctggcaacattgtgttctccaagcagcctggtttatcattcgatgagctatacagtgcacaatgaataaactcaagatgcatgaataaatttccccgtattgcttattcctattgttatgaaatcaaaaggggatatataggatgaatgacttcgcgaatggttctgttccgtcacataaaatatactgctagcaatcttcattttatagggtttacttgtcagctgtatatacatatgtatatataccaactttccagcaaactgcaacttgtacagcattgcagtaaaagcgaatattttttataaagaaattcgactatgttttccttgtcaaaaaaaaaaaaaaaaaaaa

SEQ ID NO: 7076 - protein, 340 aa, Panicum virgatum
  misc_feature: Ceres CLONE 1900150
  misc_feature (1)..(140): Pfam Name: Lipase_3 Pfam Description: Lipase (class 3)
MEPRRWLAAAVLLCLVVHCCGRELKTKHAPIYDPALAQTLAEYTSAVYTADLTQLFTWTCERCGDLTEGFEVVELIVDVKNCLQAYVGFARDMNAVIVVFRGTQENSIQNWIEDLFWKQLDLDYPGMPEAKVHNGFYSAYHNTTLRDGVVRGIHKTRGVYGNIPIMVTGHSMGGAMASFCALDLVVNFGLKDVTLMTFGQPRIGNAVFASNFKGHLPNAIRVTNAHDIVPHLPPYYRYFPQKTYHHFPREVWIHNVGLGTFEYSIEEICDDSGEDPTCSSSVSGNSVRDHIHYLGISMHAESLGHCRIVTGTLQYKMDPAGNIVFSKQPGLSFDELYSAQ

SEQ ID NO: 7077 - DNA, 1448 bp, Panicum virgatum
  misc_feature: Ceres CLONE 1900167
  misc_feature: Encodes the peptide sequence at SEQ ID NO. 7078
gtcgccttcgatcgtcgatctcgtcgcgaatccaaccagcccgctgcgaagctcgctctgtcccacaatcccagtgaacagtaaaaggaggagaggaatggggcggcgcgcttggcagctggccgcggcggcggcggctatcctggccgtgctcggcgcggcggcggtgcggccggccggggcggcgccgcaggtgccgtgctacttcatcttcggggactcgctggtggacaacggcaacaacaacctcatggtgtcgatggcgcgcgccaactacccgccctacgggatcgacttcgccggcgggccctctggccgcttcagcaacggcctcaccaccgttgacgtcctcgctaagcttctgggcttcgacgactacatccccccgttcgccggcgcaagcagccagcagctcctcaccggcgtcaacttcgcctccgccgccgccggcatccgggaggagaccggccagcagttgggcgggcggatcagcttcagcgggcaggtgcggaactaccagtcggcggtgcaggagctggtgagcatcctgggcgacgagggctcggcggcggcgcacctgagccggtgcatcttcacggtgggcatgggcagcaacgactacctcaacaactacttcatgccggccttctacagcacgggcagccgctacaccccggagcagtacgccgacgcgctggccgccgactacgcccggctcctgcaggccatgtacgtctacggcgcccgcaaggtggcgctgatgggcgtggggcaggtcgggtgcagccccaacgagctggcgcagcggagccccagcggcgtcgcctacgtcgaggagatcgacagcgccgtccggatcttcaaccggcggctcgccggcctcgccgaccgcttcaacgcgctccccggcgcgcacttcacctacgtcaacgtgtacggcatcttcgaggacatcatgcgcgcccccggcgcgcacgggctcagggtgaccaacaccggctgctgcggggtgggcaggaacaacgggcaggtgacgtgcctcccgttccagatgccctgcgccaaccgccacgagtacctcttctgggacgccttccacccgacggaggcggccaacgtcctcgtcgcccagcggacgtacagcgccaggctcgcctccgacgtccaccccgtcgacatccggacactcgcaaggctctagagctagctgcagggccggcggcggccgccgtggcaggcagcagatcaagcttaacttgtgcgcgacagatattcatacaccatcgtgtgggcgcgcgtgacccaccaaaagggttcctcttggggtacgacgtgcacagcgtataggcgacaggctgcaattttatttatggtctcattttcaaagtgtgtaaccatgtacggtttggagtaaacactcagttgtacaaaaaaaaaaaaaaaaaaaa

SEQ ID NO: 7078 - protein, 367 aa, Panicum virgatum
  misc_feature: Ceres CLONE 1900167
  misc_feature (1)..(313): Pfam Name: Lipase_GDSL Pfam Description: GDSL-like Lipase/Acylhydrolase
MGRRAWQLAAAAAAILAVLGAAAVRPAGAAPQVPCYFIFGDSLVDNGNNNLMVSMARANYPPYGIDFAGGPSGRFSNGLTTVDVLAKLLGFDDYIPPFAGASSQQLLTGVNFASAAAGIREETGQQLGGRISFSGQVRNYQSAVQELVSILGDEGSAAAHLSRCIFTVGMGSNDYLNNYFMPAFYSTGSRYTPEQYADALAADYARLLQAMYVYGARKVALMGVGQVGCSPNELAQRSPSGVAYVEEIDSAVRIFNRRLAGLADRFNALPGAHFTYVNVYGIFEDIMRAPGAHGLRVTNTGCCGVGRNNGQVTCLPFQMPCANRHEYLFWDAFHPTEAANVLVAQRTYSARLASDVHPVDIRTLARL

SEQ ID NO: 7079 - DNA, 1570 bp, Panicum virgatum
  misc_feature: Ceres CLONE 1900175
  misc_feature: Encodes the peptide sequence at SEQ ID NO. 7080
aagtggctctgccgcgccacgccccgcgcacatcgcgctgcgcggccctctgcccagctctgctgccgcggcgtgcgtgaaagatgggcctgtggggacgggctccctccttccctgcgctgcgccatgaatgagtgcgccggcgccggcggcgatggcgaaggagacggagtactatgacgtgctcgacgtctgtcccgcagcatctgacgacgagatccgcaaggcctactacatcaaggcgaggcaagtgcatccagacaagaatcccaacgacccgcaggcggccgagaagttccaggctcttggagaggcctaccaggttctgagtgaccctctacagaggaaggcctatgatggctacggtaagaacagcgtatcgagggacaacatactggatggcactgttgttttcaccctcctttttgggagcgagctgttcgaggactacattggtcatcttgcaatggcaacaatggcctccactgagatgacaagcgacaacgacaaccccgaaaagcttcaagacaggctcaagaatgtacaaagggaaagagaggaaaagctggctagattcctcaaggaattcctctcccaatatgttcgtggtgacaaagaaggatttgctaatcgtgcagaagctgaggcgaagaggctctccagcacttcatctggattggatattcttcgcaccatcggatatgtgtattctcgacaagcagcaaaggagcttggcaagaaggccatgtacctaggagtgccattcgtggctgagtgggtcaggaacaagggccacctatggaagtcacagatcacagcagcaaaaggagccctgcagctgttgcagttgcaacaggaggcctgcctgcagagtaacaaggatggcaatgccacggagcaggatgttgactttcagatgaggatgaacaaggatctgatgatgagctcactgtggaagctgaatgttgtggacatcgaaatgactctcctgcatgtttgtgaaatgaaagaagatctgaaggcccgagcaatggccttgaaaattcttgggaagatatttcagagggacaaggaggcattacctgggccagggccagggccgtcagggccatcaaaacgaacagttcttgatgatgacagcagttcagatgacagttcagatgatgacatagctcggacggtgccatatcgaactcctgcatttactcagggaatcggaaggctgttcggatgcttatgcaaccccgcttatgatgttgacgatgattttgagccccgcaaatgagttctgaagaagcagacaccaatagatgtgttcaaatgttcgtgaattttttctcaagtatatgattcagagccatgtgagtccatatcattcatcgccatcctttatcttaaggatacacacgtagatgctacttcagctctggtgagcacaatgacatttcagatttcaaggttccctttctctctcccaagaacagtagcacttctatttccccctttttttgaaatagattcagctgggttgtgttgtgcctatgtaatttgttgttatcgatgttgtcgg

SEQ ID NO: 7080 - protein, 384 aa, Panicum virgatum
  misc_feature: Ceres CLONE 1900175
  misc_feature (1)..(63): Pfam Name: DnaJ Pfam Description: DnaJ domain
MSAPAPAAMAKETEYYDVLDVCPAASDDEIRKAYYIKARQVHPDKNPNDPQAAEKFQALGEAYQVLSDPLQRKAYDGYGKNSVSRDNILDGTVVFTLLFGSELFEDYIGHLAMATMASTEMTSDNDNPEKLQDRLKNVQREREEKLARFLKEFLSQYVRGDKEGFANRAEAEAKRLSSTSSGLDILRTIGYVYSRQAAKELGKKAMYLGVPFVAEWVRNKGHLWKSQITAAKGALQLLQLQQEACLQSNKDGNATEQDVDFQMRMNKDLMMSSLWKLNVVDIEMTLLHVCEMKEDLKARAMALKILGKIFQRDKEALPGPGPGPSGPSKRTVLDDDSSSDDSSDDDIARTVPYRTPAFTQGIGRLFGCLCNPAYDVDDDFEPRK

SEQ ID NO: 7081 - DNA, 2129 bp, Panicum virgatum
  misc_feature: Ceres CLONE 1900192
  misc_feature: Encodes the peptide sequence at SEQ ID NO. 7082
ataaccgcatagcgcacgaccccggccgggccgagcgagccagagcccagagccagagcgaagagggagagagagagagagagagacagcgagcatatatgagacgtctacggtagctgtgctcatggtgatggggaggccgaaccagagccacgggagcgggggcgacgaggagcggctgcccctgcgcggcgggctggagacggagcgggcgccgccgccgccccaccacgccgcggagcagctcaaggaggcgaggcgcgggggcggcaggctctggcgcgcgtccgtgcgcgccggcctggtgctctgcctgctgacggttccggccgtcctgctcttgctgcggtggcaggccgactcctcgccgcagtgggtctttgacttcgaggcgcccgaggaagacgacgacgaccaagatatacaagatgatgtgtctgacgatatatctccgtccccacaaattgagtatgatagacttctgggtggccttctgatcgagggatttgatgaaaaatcttgtaggagcaggtatcagtttgcacgctatcacaagtcaccaagcataccttcaccgtacctcatagagaggttaaggaaacaagaattgttgcagaaaaagtgtggtccaggcaccaaagcatataaggaagcatcaaagcagctgaggtccggtcagagtcagaccaccaataccacagattgcaactatctgatactgaccatccacgctggcttggggaatcggatgcttgagattacttcagcattactatatgcgctacttacaaatcggattttgcttgtggaccgctacaaggagattggtgaccttttctgcgaacccttccctggaacctcatggttagtcccttcagatttccctctgagctatggcgagtttactcagagtagtccagagagctatggcaacatgctgcagaacaaagctgccggtggcaatacaaatcgatctttggctggtactcggcctaactatgtgtatctccacctcgatggtaactatggtttccatgacaaacttttcttctgcgaagacgaccagcagttcctgcaaggtgttccatggctgatcataagaacagacatgtactttgtgccgtccctgtttctaattccaggtttccaagatgaactcagcaggctatttccagagaaagacactgttttccatcacttggcacgctatctttttcatccaacaaacaatatttggtattctattacaaaatactaccggtcctacatggccaaagcggaaaaaagagtgggaattcagataagaatatatgaaaccaagggcatcttgcaaagaaatggcccattcccgcacattttgaatcagatcctttcatgtgcacagaatgagaagctcctgccagaaattggcatgatggagggagcagcagctgaagctcagaataagggagcagcagctgagactcaaaataaccaaacaatcgtcgttctaactacttctttgagctcttggtacagtgatcagatccagaagaaatacgaagaacacccaacagttgatggaactactgtcaaagtgtaccagccaagccacgaggagtaccagaggtcaaggaataggaagcacaacatgaaggcacttgccgagatctatctactgagcatgaacgatgagctaatcaccagtggcttttccacattcgggtacgcagctcaggggctcgctggcctgaagccatggatcatgttcaggtcagagaaccacgtgacaccagatccaccgtgcggccgcgtcatgtccattgagccgtgcttccaccaggctcccttctacgactgcaaggcaaagagggacactgacttgggcaaggtggtgccttacgtgaggcactgcgaggacgtgagctggggtctgaagattgtaaatgaaactaagttgtagctgtagttttgtcaggactcaaggcagattttctcgctaactagggcagaagtatttttttttgtttcaaaagaaactatacgttgtattctttccctctcctgtatttgatccaactgtagataagttgatgaacaggtccattaatctgttcgctctctgattccaaaaaaaaaaaaaaaaaaaa

SEQ ID NO: 7082 - protein, 605 aa, Panicum virgatum
  misc_feature: Ceres CLONE 1900192
  misc_feature: Great-hit functional homolog of the protein sequence encoded by LOCUS At2g03220
  misc_feature (24)..(494): Pfam Name: XG_FTase Pfam Description: Xyloglucan fucosyltransferase
  misc_feature (291)..(600): SWISSPROT Homolog: EC 2.4.1.69 Galactoside 2-alpha-L-fucosyltransferase
  misc_feature: Useful for making plants with altered cell wall content and/or composition
MVMGRPNQSHGSGGDEERLPLRGGLETERAPPPPHHAAEQLKEARRGGGRLWRASVRAGLVLCLLTVPAVLLLLRWQADSSPQWVFDFEAPEEDDDDQDIQDDVSDDISPSPQIEYDRLLGGLLIEGFDEKSCRSRYQFARYHKSPSIPSPYLIERLRKQELLQKKCGPGTKAYKEASKQLRSGQSQTTNTTDCNYLILTIHAGLGNRMLEITSALLYALLTNRILLVDRYKEIGDLFCEPFPGTSWLVPSDFPLSYGEFTQSSPESYGNMLQNKAAGGNTNRSLAGTRPNYVYLHLDGNYGFHDKLFFCEDDQQFLQGVPWLIIRTDMYFVPSLFLIPGFQDELSRLFPEKDTVFHHLARYLFHPTNNIWYSITKYYRSYMAKAEKRVGIQIRIYETKGILQRNGPFPHILNQILSCAQNEKLLPEIGMMEGAAAEAQNKGAAAETQNNQTIVVLTTSLSSWYSDQIQKKYEEHPTVDGTTVKVYQPSHEEYQRSRNRKHNMKALAEIYLLSMNDELITSGFSTFGYAAQGLAGLKPWIMFRSENHVTPDPPCGRVMSIEPCFHQAPFYDCKAKRDTDLGKVVPYVRHCEDVSWGLKIVNETKL

SEQ ID NO: 7083 - DNA, 1733 bp, Panicum virgatum
  misc_feature: Ceres CLONE 1900221
  misc_feature: Encodes the peptide sequence at SEQ ID NO. 7084
gttcagtgttcactgccctcccagctctcaatcaagtctctcagcaaccgaggcggcgacaccgccacgtacgcgcgccatggttgccgagctcgccgccggcggcggcggcgacatgcccgtgcacagctaccggctgtcgacggtggtaccggggtcggtgacgggggaggcggtggactacgagctcgcggacgccgacctgctgcacaagctgcactacctccgcgcggtgcacgtgttccgcgccccggcgccgggggacgccgccgcggcgctcgccgtccgggagctcaaggagcccatgttcccgtggctggacatgtacttccccgtcagcggccggctgcggcggcgccaggcggcggccggcggcgaggggggagcggcggcggcggggcggccgtacgtgcggtgcaacgactgcggcgtgcgcgtcgtggaggccgccatcgacgccaccgtggaggagtggctggagcaggaggcggagcgcggcggcatgtgcaaggcgctggcctacgacaaggtcatcgggccggagctcttcttctcgccgctgctctacgtgcagttcaccaacttcaagtgcggcgggatggctgtcggcttcacgtgggcgcacctcatcggcgacatcccctccgccgccgcctgcttcagcacgtgggcgcagctcctcagcggcaagaaggccccggcacccaccctgcgcgacccgcacaccaagccgccgccggccgcacctgccggcgcgacggccccgccgtcggtcaaggccgccgccgcgcccgtcggcgacgactggagggtccccaccgcctgtgaaatggtgtccatctccttccacgtcaccgagcagcagctgaagcgcctcctgctcggcgggcgccgtcatcatcaggtgggcacgttcgagctcgtcgcggcgctggtgtggcgcgcggtggccgcgatccggggcgccgaggaggaggcggcgacgcgcacggtgaccgtcgtgaagactgccgacccggcggccgcgccgggcggcggcggcggccgcctcgggctgaccaacgagcaccgcatcggccacgccgtcgccccggccggcctgctgccggcggcggcggccgacgtcgcggagctggcggcggtgctggccggcgcgagcctcgacggcgccggcgcggtcgcggccgcggcgctggcgggggcggacgacgccgacgcggtcgtgtacggcgccaacctgacgttcgtggacgccgagggcgtggacgtgtacggcgggctggagctcggcgcgcggcgccccgcgcacgtggagtacgccgtggacggcgccggcgccggcggcgcggccgtcgtgcaccgcgacaccggcgggcgcggccgcaccgtcgcggccgccgtgcgccggggcgaggcggaccgcctccgcgccgcgctccgtgacgcgctgcgcgttgcctgacggccgagctagtagcttgccttccgtcagcgggtcatcaataaagaatcttgcaagcacttgagcgcgtgctcccttgtgctgcatgtgttggtctgtttagttctgcgttctagtgcacttttgcaagcagtttagcgtgattgaactaaataatgtgggttatgaactttcgatgatatgaatttgctatgtttggtagataagttccttttgtgaaaaaaaactaatgtagacacaagttaaagtttaaaaaaaaaaaaaaaaaaaa

SEQ ID NO: 7084 - protein, 460 aa, Panicum virgatum
  misc_feature: Ceres CLONE 1900221
  misc_feature (1)..(123): Pfam Name: Transferase Pfam Description: Transferase family
MVAELAAGGGGDMPVHSYRLSTVVPGSVTGEAVDYELADADLLHKLHYLRAVHVFRAPAPGDAAAALAVRELKEPMFPWLDMYFPVSGRLRRRQAAAGGEGGAAAAGRPYVRCNDCGVRVVEAAIDATVEEWLEQEAERGGMCKALAYDKVIGPELFFSPLLYVQFTNFKCGGMAVGFTWAHLIGDIPSAAACFSTWAQLLSGKKAPAPTLRDPHTKPPPAAPAGATAPPSVKAAAAPVGDDWRVPTACEMVSISFHVTEQQLKRLLLGGRRHHQVGTFELVAALVWRAVAAIRGAEEEAATRTVTVVKTADPAAAPGGGGGRLGLTNEHRIGHAVAPAGLLPAAAADVAELAAVLAGASLDGAGAVAAAALAGADDADAVVYGANLTFVDAEGVDVYGGLELGARRPAHVEYAVDGAGAGGAAVVHRDTGGRGRTVAAAVRRGEADRLRAALRDALRVA

SEQ ID NO: 7085 - DNA, 2629 bp, Panicum virgatum
  misc_feature: Ceres CLONE 1900239
  misc_feature: Encodes the peptide sequence at SEQ ID NO. 7086
gaaatccctcatccgtgctgcatatgggtccaatgtttcttttgcagccaaaaaatcttctgacagggaatgcattaataatgcaccgttgaatgagagagaatctgttgctgctgatgtattagcaggcatatgtggcactctctctcctgagggaatgggctcatgcatcactagttctgctgatcttggtaagattagcatgacaagaatggagcatatcttagcccccgaatttgacagaagcattgatgaggaagattcactgtcagatgaagagtgtgaagttgatcctgttgattggaatgataatgagaagtcaattttcattgaggctatgaacaactacggaaaggacttcgctaggatttcatcatgtgtgaaaagcaagtcgtatgagcagtgcaaagtattcttcagcaaggctcggaaatcacttggtttggatttgatccatcaaggagcagctgatgttagtgtgccaactagtgatacaaatggagggaggagtgatactgatgaggcctgtgctgctgaaatggattcagctatctgtagcacacagtcatgttcaaaaattgagatggtatgccctactgaaaaagacattggaggtataatcacaaagcagccagaacttaatatatcaaatgggtttgatgttgtgaacagtaaaactggggaagatgagaagaaaactgaaaaaaaatgtggtattgttgatcatgaaaggttcgatgaaggtactcatcaagcagcatgtggtcctattgacatcaattgcccagaaagcacagggaagctgcatggaaaagatgatgtcattgaccaagtaaatatgcacaacaatagtgccatcagctcctcgactgagcaagcaaaggcagtgccctcggaagtccaatcctgtttagattctgttgaggtacttcatcaaacaagcaaatccccttcggggactggcactgatgcttcccagatggaagaatgttccaaccatgctcttgacgataagctaatgaaagctggaaattctggtgcctcatcttgcatagcttccgataaatgtattagggacaatgttcactttgcaaacaccattagtcctacattcgcttcaagttataagcattctgtgccagcggatatgcccccgacaaaaccaaagccattggttactccccttaccccaaaggacttaatgcctgtacagttcagttctgcagttcctgatcctaccgcaattcgttttgatggcatagcttcaataacaatgcccaattttgaggacagtggtaacagagtcagcagttctttagggcccaaagatatgagcaagtacccagcttttaaagacccaaccggtaatcagcatgtcacattgtttcgtaatgttgatggttacacgaaccatctgacaactgaattaccaattttttctgaaagaactgcaagtggcactgtgagtacttctcagactgatcggttcactctaacaaaattccagaatggcaggtccagcagtttgggccttccaaacacttccgatgggattcaatgggccagaaaacacgaagaagtactgcaaggttctctgaggtcatgctctcacaatacaagttctaatggtgatgagcaacaaaagcggcctggtgatgtcaagttatttgggaagattctcagtcatcaatcatccttgcaaagttctgtctcatcatgtaatggtaacaagagcaagcctccctcgccaaaggttgacacgtcatctgtgagattgtcgaacaatccaagggatcgtgtggtttgttcttccaggcctggcttcactcatttgggtctggaggaaagaacagctcggagctatggccatttggatggaagcacaacacagccagagccactgctaatgatggcgaagtgccagagcttagccggtgtaccgttttactcggctaaaaatggcactgttagtgtgttttcagattatcaacaaccttcgattcagccgcatcagtcagatccaaaacggctggaaaggttttctgatcctcagaagcgcaacggaatggagttcatctcgggtttccagcagcctggtaaaatctcacggtttgggggtgctggtatccttgtaagcggggtctcagaccctgtggctgctctcaaggcccagtatggtcccagttctaaggttatgggcagtgacgtggatccttggaaggacataggaagcaggtagcatcggtagtggtagcagctttagttcatgttttgttgcccctttgtatcatatttagtttttgtaacttaaatgaagaaaacaagggaaagtgaatggctttcctgttcatactatttgtaggctttgcagtagctgttcggttatgtatttggcattaacatctcttaccttttctgcagctccataccctttgctagcttgacctgtcaacagtggcacagtgctgtaggttcgctagaggtgctgtccacaggctgattgtgtttgtccggtaggattttgttttgtcagtctatgcagaaacctcacatcattgtaatatggtaatgccgaactcagaatatgctagtctgatggagttttggttaaaaaaaaaaaaaaaaaaaa

SEQ ID NO: 7086 - protein, 693 aa, Panicum virgatum
  misc_feature: Ceres CLONE 1900239
  misc_feature (1)..(46): Pfam Name: Myb_DNA-binding Pfam Description: Myb-like DNA-binding domain
MGSCITSSADLGKISMTRMEHILAPEFDRSIDEEDSLSDEECEVDPVDWNDNEKSIFIEAMNNYGKDFARISSCVKSKSYEQCKVFFSKARKSLGLDLIHQGAADVSVPTSDTNGGRSDTDEACAAEMDSAICSTQSCSKIEMVCPTEKDIGGIITKQPELNISNGFDVVNSKTGEDEKKTEKKCGIVDHERFDEGTHQAACGPIDINCPESTGKLHGKDDVIDQVNMHNNSAISSSTEQAKAVPSEVQSCLDSVEVLHQTSKSPSGTGTDASQMEECSNHALDDKLMKAGNSGASSCIASDKCIRDNVHFANTISPTFASSYKHSVPADMPPTKPKPLVTPLTPKDLMPVQFSSAVPDPTAIRFDGIASITMPNFEDSGNRVSSSLGPKDMSKYPAFKDPTGNQHVTLFRNVDGYTNHLTTELPIFSERTASGTVSTSQTDRFTLTKFQNGRSSSLGLPNTSDGIQWARKHEEVLQGSLRSCSHNTSSNGDEQQKRPGDVKLFGKILSHQSSLQSSVSSCNGNKSKPPSPKVDTSSVRLSNNPRDRVVCSSRPGFTHLGLEERTARSYGHLDGSTTQPEPLLMMAKCQSLAGVPFYSAKNGTVSVFSDYQQPSIQPHQSDPKRLERFSDPQKRNGMEFISGFQQPGKISRFGGAGILVSGVSDPVAALKAQYGPSSKVMGSDVDPWKDIGSR

SEQ ID NO: 7087 - DNA, 1657 bp, Panicum virgatum
  misc_feature: Ceres CLONE 1900242
  misc_feature: Encodes the peptide sequence at SEQ ID NO. 7088
acgagcctcgcagcgtttgagcccggagcccacgtgccagtgggactggagacgactcttgtgcagaatcgccgcccgccgcccccaacttggcaacttgccctttccaagagaaaaaaaaaaaatcttgcccttcccaagtagcctcctcgccttctccctcgtccccggccgccgctcacttccttctcccccgtcccctcctcgccagccgccgctcgcttccacctcccgtcctcatcccagggtgggggatggggtccgaatccaagcggacagcgtcgagccacaccacggaggcggagacgggcacgcactcgttcaagattgttgggtacagtctcaagaagggcttcggtttccgcaaatctatccagtcgggcaccttcaccgtcggcggttacgactgggccatccaattctaccccgacggagtgaacgaccttaccaaagggtacacggcagtctatctggtgcttgtgagcaagaaagttgaggtgcgagcgtcctatgtcctgagtttggttaatcagattacagggttgccagaaaacctgttttctgaaaccaccactagagtgttcagcgatgcaaatttattcagcccaaggacccccatagccaggagaagtaagctggagagtaaatcagctggctacatagttgacgattgcctgacaattgaatgtactgtcacggtcgtcaaagaatcgtgggtggaaaccacatctggctttgagatcgaagtaccaccctcggacatatcacagcattttggcaagttgttgtcggatgaagaggaagcagatgtcacattcagtgttggaggtgagattttccccgcgcacaggatcgtgctggccacacggtcccctgtcttcaaggcgcagctgtatggacagatgaaggagaggagggcccggcgtttgactgttgaaggcattcagcctgatgtctttaaggtcctgctgcaattcatctacacggattcactgcctgaatgggatgatcttgatgctgaggaatattgtgagatttccaggcatttacttgcggctgcagatagatatgccatggacatgttgaagttgttgtgtgcaagcaatcttgttgaccatcttgatgcggaaactgtggcaattacactggccttggctgatcagcataactgcgactgtctcaaggatgtttgcatcgaatttatggcctcttcagataagatgtacgctgtgttggaaacagagggttatgccaatctcaaaagaacttgcccttctatcctagtaaatgtactggagaagaatagcaggtatcgcaaggcataagtttgctgcccagctgactgcgtgtcttcagcttaaaaacactgagctaatcctatgagtagctagcttaattcctagtctatatgaatagctgctggttttccaatagaaggccatgctaactttgacctatggctggtaactttagtttcttaagtctctgtccttttgcaaagtattagatgcacaatagttgagcatcaatctgctgtgctttcatagcactttttgtaatggaatgccatgtggcagtagcatatggttgaaggagctagcatcagctgtgttattccaaagctgaacatcttgtgcaaaaaaaaaaaaaaaaaaaa

SEQ ID NO: 7088 - protein, 356 aa, Panicum virgatum
  misc_feature: Ceres CLONE 1900242
  misc_feature: The sequence is a functional homolog of  SEQ ID NO 1918 in the  10/374,780 US patent application
  misc_feature: Useful for making plants with modulated growth and phenotype characteristics
MGSESKRTASSHTTEAETGTHSFKIVGYSLKKGFGFRKSIQSGTFTVGGYDWAIQFYPDGVNDLTKGYTAVYLVLVSKKVEVRASYVLSLVNQITGLPENLFSETTTRVFSDANLFSPRTPIARRSKLESKSAGYIVDDCLTIECTVTVVKESWVETTSGFEIEVPPSDISQHFGKLLSDEEEADVTFSVGGEIFPAHRIVLATRSPVFKAQLYGQMKERRARRLTVEGIQPDVFKVLLQFIYTDSLPEWDDLDAEEYCEISRHLLAAADRYAMDMLKLLCASNLVDHLDAETVAITLALADQHNCDCLKDVCIEFMASSDKMYAVLETEGYANLKRTCPSILVNVLEKNSRYRKA

SEQ ID NO: 7089 - DNA, 3102 bp, Panicum virgatum
  misc_feature: Ceres CLONE 1900330
  misc_feature: Encodes the peptide sequence at SEQ ID NO. 7090
acagtgcagcaggcccaggccgctgctctctttcttcttgcttgcgactgcacgccgctgctgctgctgctgctgctgctccacgtctctgtctccgctttaaggctgtcacctttccccatccccccgagccctcctcccctccttcctcaattccacggagagccacacccaaaccctagtgcttgctgcgctcgcgtcctcccttcccccatccgtccgatcgatgggaggcggctcagcagcggggaggccgtgaccttcttctggacgtcgcgcgtcctgtgcaggggcagggcacggatcgccaactgcaacctcctcaaaccagtgttgttgtcaagggcggcaggacacaccatctaagaaagagtgccaagggaaggcaacaatggctgcggccgtggtggcgatgccagggggaagcagcaacagcggtggatttgataaagtccccgggatcgactcggggaaatacgtgcgttacaccccggagcaagtcgaggtactcgagcgcctctacatcgattgccccaagccaagctcctcacgccgccagcagttgctgcgggagtgtcccatacttgccaacattgagccaaagcagatcaaggtttggtttcagaaccgaagatgccgtgataagcagcgcaaggaatcctctcggcttcaggctgtcaacagaaagttgacggccatgaacaagctccttatggaagagaatgagcgtcttcagaagcaggtctctcagttggttcatgaaaatgcgcacatgcggcagcagctgcagaatacatcattggccaatgatacaagctgcgaatctaatgtgactacccctccaaaccctacaagggatgcaagtaacccttctggactcctttcgattgctgaggagaccttcacagagttcctctcaaaggctactgggacagctattgattgggtccagatgcctgggatgaagcctggtccggattcggttggtattgtggccatttcgcatggttgccgtggtgttgctgcccgcgcctgtggtttggtgaatctagaaccaacaaaagtcatagagatcttgaaagatcgtccatcttggttccgtgattgtcgaagccttgaagtatttacaatgtttccagccggaaatggggggacaattgaacttgtgtatatgcagatgtatgccccgacaactttagtccctgcacgtgatttttggacgttacgatacacaacaacaacggaagatggcagccttgtggtctgtgagagatccttaagtggttccgggggtggtccaaatgcagcctctacacatcaattggtaagagccgagatgcttccaagtgggtatttagttcgcccatgtgaaggtgggggttcgatcgtgcatatagtggaccatctagatctcgaggctcggagtgttcctgaagtgcttcgaccactttatgagtcttctagagtagttgctcagaaaatgactactgtggcactgcggcaccttagacaaattgctcaagaaacaagtggggaagtagtttacgccttgggcaggcaacctgcagtcctgaggacctttagtcaaaggctgagcagaggctttaatgatgccattagcggtttcaacgatgatggctggtctataatgggtggagatggaattgaagacgttatagttgcttgcaactcaactaagaaaattaggaatagcagcagcgtggggattgcatttggaaaccctggaggcattatttgtgcgaaggcgtccatgctactgcagagtgtcccaccggcagtactggttcgatttttgagggagcatagatctgaatgggccgattacaacattgatgcctatttggcttcatcactgaaggctagtgcgtgctcacttcccgggttgcgacccatgagattttctgggggccagatgatcatgccgctagctcacactgtggagaatgaggagattcttgaagttgtccgccttgaaggacaatcccttactcatgatgaagctcttctttcaagggacatccacattctccagctttgcactggaatagatgagaaatctgtgggttcctccttccagcttgtgtttgcaccaattgatgatcattttccagacgacacgccattgatttcttctggctttcgtgtcataccccttgatatgaaaacagatggtgtatcctctagtaggacactagatttggcatctagtcttgatgtgggttctgctgcatcccaagcctcaggggatgcatctccggatgactgcaatttgagatctgtgctgacaattgcctttcaattcccttacgagatgcaccttcaagaaagcgttgcaactatggcccgtcaatatgtccgtagtgttgtttctgcagtgcaaagagtttccatggctatatctccctcccagtctggtcttaatgctgggcagaggatgctttctggcttccctgaagcaggcacattggctagatgggtttgccagagctatcattaccatcttagcgcggaattacttaatcaatcagatgaagctggtgaggcattgttgaaaatgctctggcatcatccagatgctattctgtgctgctcatttaaggagaaacctatgtttacgtttgccaacaaggcagggctggacatgttagagacatcccttgttgctctacaagatctgactctagacaaaatcttcgacgagtctggaagaaaagcattgttctcagatatctcaaaattgatggaacagggctacgtgtacttgccgtcgggcgtgtgcatgtcaggaatgggtcgccatgtttcattcgatcaagctgtagcatggaaggtgctaggtgaggacagcaacgtccactgcctggctctctgctttgtgaactggtcctttgtgtgatgttgagctggtctctgtgattagcatatccatttttgtatgatctcgacaagggaaatcgtcagccatgataaggcttatgtcgcactagttgtaggtctggaatccagtgtattttatgacgaaactgaggttatgcaaagtctgatctcactttcatttgtcaaaaaaaaaaaaaaaaaaaa

SEQ ID NO: 7090 - protein, 841 aa, Panicum virgatum
  misc_feature: Ceres CLONE 1900330
  misc_feature: Great-hit functional homolog of the protein sequence encoded by LOCUS At5g60690
  misc_feature (1)..(61): Pfam Name: Homeobox Pfam Description: Homeobox domain
  misc_feature: The sequence is a functional homolog of  SEQ ID NO 1109 in the  10/412,699 US patent application
  misc_feature: The sequence is a functional homolog of  SEQ ID NO 1110 in the  10/412,699 US patent application
  misc_feature: The sequence is a functional homolog of  SEQ ID NO 1111 in the  10/412,699 US patent application
  misc_feature: The sequence is a functional homolog of  SEQ ID NO 666 in the  10/374,780 US patent application
  misc_feature: The sequence is a functional homolog of  SEQ ID NO 667 in the  10/374,780 US patent application
  misc_feature: The sequence is a functional homolog of  SEQ ID NO 668 in the  10/374,780 US patent application
  misc_feature: The sequence is a functional homolog of  SEQ ID NO 669 in the  10/374,780 US patent application
  misc_feature: The sequence is a functional homolog of  SEQ ID NO 720 in the  10/374,780 US patent application
  misc_feature: The sequence is a functional homolog of  SEQ ID NO 721 in the  10/374,780 US patent application
  misc_feature: The sequence is a functional homolog of  SEQ ID NO 783 in the  10/666,642 US patent application
  misc_feature: The sequence is a functional homolog of  SEQ ID NO 784 in the  10/666,642 US patent application
  misc_feature: The sequence is a functional homolog of  SEQ ID NO 785 in the  10/666,642 US patent application
  misc_feature: Useful for making plants with altered lignin content
  misc_feature: Useful for making plants with modulated growth and phenotype characteristics
MAAAVVAMPGGSSNSGGFDKVPGIDSGKYVRYTPEQVEVLERLYIDCPKPSSSRRQQLLRECPILANIEPKQIKVWFQNRRCRDKQRKESSRLQAVNRKLTAMNKLLMEENERLQKQVSQLVHENAHMRQQLQNTSLANDTSCESNVTTPPNPTRDASNPSGLLSIAEETFTEFLSKATGTAIDWVQMPGMKPGPDSVGIVAISHGCRGVAARACGLVNLEPTKVIEILKDRPSWFRDCRSLEVFTMFPAGNGGTIELVYMQMYAPTTLVPARDFWTLRYTTTTEDGSLVVCERSLSGSGGGPNAASTHQLVRAEMLPSGYLVRPCEGGGSIVHIVDHLDLEARSVPEVLRPLYESSRVVAQKMTTVALRHLRQIAQETSGEVVYALGRQPAVLRTFSQRLSRGFNDAISGFNDDGWSIMGGDGIEDVIVACNSTKKIRNSSSVGIAFGNPGGIICAKASMLLQSVPPAVLVRFLREHRSEWADYNIDAYLASSLKASACSLPGLRPMRFSGGQMIMPLAHTVENEEILEVVRLEGQSLTHDEALLSRDIHILQLCTGIDEKSVGSSFQLVFAPIDDHFPDDTPLISSGFRVIPLDMKTDGVSSSRTLDLASSLDVGSAASQASGDASPDDCNLRSVLTIAFQFPYEMHLQESVATMARQYVRSVVSAVQRVSMAISPSQSGLNAGQRMLSGFPEAGTLARWVCQSYHYHLSAELLNQSDEAGEALLKMLWHHPDAILCCSFKEKPMFTFANKAGLDMLETSLVALQDLTLDKIFDESGRKALFSDISKLMEQGYVYLPSGVCMSGMGRHVSFDQAVAWKVLGEDSNVHCLALCFVNWSFV

SEQ ID NO: 7091 - DNA, 548 bp, Panicum virgatum
  misc_feature: Ceres CLONE 1900333
  misc_feature: Encodes the peptide sequence at SEQ ID NO. 7092
gaattattgcccgacggcgcgatgctccagggcgtgctgtcccgcgcccccgcccccgccaccgacgcgccggcagcgatgaaggccaagcgggcgccggcgtcccccgacgaagaggaggacggggaggggcgcccggcgcgggggaagcggcagcagctgcttgggctcggctcggccgcggcggcggcggcggaggagggcccggagacgctgggtcttccgctgctccgcctgctgctgcgctgggcggaggcggtggccctggacctcctgacggaagcgcgggagctgctgcccgacatcgccgagctggcgtcgtcgttctggtcctcctcggagagcgcggcgagttacttccgggacgcgctgcgcgcgcgcgtgttcagttgctagatgacttggtactcgccgctggtgctccatttgatgggttccactcgcagacgcctcgcctgattggcgctccatttctttttcgcgctgggggagctcctcttcttcccttttggggagtttctgatttcattgtgccagcgctgtcttgg

SEQ ID NO: 7092 - protein, 124 aa, Panicum virgatum
  misc_feature: Ceres CLONE 1900333
  misc_feature (1)..(74): Pfam Name: GRAS Pfam Description: GRAS family transcription factor
MLQGVLSRAPAPATDAPAAMKAKRAPASPDEEEDGEGRPARGKRQQLLGLGSAAAAAAEEGPETLGLPLLRLLLRWAEAVALDLLTEARELLPDIAELASSFWSSSESAASYFRDALRARVFSC

SEQ ID NO: 7093 - DNA, 1832 bp, Panicum virgatum
  misc_feature: Ceres CLONE 1900335
  misc_feature: Encodes the peptide sequence at SEQ ID NO. 7094
acttctactccactaccgtccgcttcccaccgccccgccacgggcgcgcccggcacgccggcaccagcccaccgatccctttccttctcgaactcctcccctccagttctcttcccctgctgcgcgccataaatggccgcgccgtgacagcggcagcgcaccgcccttcctcgctcggcccccctctggcccccctcctccttccagaaaccgcaccaagcccacccggattcgcggccattgcccatacgcgagccaagaaccgaggaggggaccgcgagaacccaaaaaaacaggagggagcgccgcgagatgcagagcatggcggcggcgtgctcgtcctcctcctcctccagagcctgcgccgcggcgcgccgctcgtacccatcccccgccctgccttcctcgcgccacgtcgcgctctcgccctcaccgtcctccgccccttcttctcatggctgccgctggccggtcgccggcgccggcgcgccggcgctctcgctcggcattcgcgggggcctgcggccgctcccgtcgcccctgctcgcggcgaggacgcgggcggcggcggcagtggccgcgtcgccgccggcggcagacgggggcggaaaacccgagggcactgacggcattccacggacgctgcagctcggggccatgatcatcgtctggtacctgctcaacatctacttcaacatctacaacaagctggttctcaaagccgtgccctttccgtacaccatcaccaccttccagttcgcatccggatccttcttcatcgcgctcatgtggctgctgaatctgcatccgagaccgaggctctccctcaaacagtatgcaaagatcctgcctcttgctttgatccacatgctgggaaatgtttttaccaatgtgagtttgggcaaggtggctgtctccttcacgcacaccatcaaggccatggagcccttattctctgtcctcctctctgtcatgttccttggagagacaccttctgcattggtgttgggttcgctcgtccctattgttggtggagttgtattggcatccatgactgaagtttctttcaactggattggattttggagcgccatggcttcaaatcttaccaaccaatcacggaatgttttatgcaagaaacttctcactgatgaagaggacagttttgatgatataaacctgttctcaataatgactgtcatggcattcttgttatctgctccactgatgctatctgtagaaggcatcaagtttaatccatcgtacctgcagagtgctggagttaatgtaaaagagctatgtgtgaatgcagcacttgctggaacatgtttccatttttaccaacaggtttcatacagtttattggctagagtatctcctgtgacccattcggttaccaactctctcaaacgggtggtggtcatcgtgtcatctgttctcttcttcagaactccactttcacctataaatgccttaggaactggtattgctcttgctggagttttcctgtactctcaattcaaaaaggcaaaaccaaagtctaaggctgcataaatacaaccacctggtgaggtaacaaactatagaaggatcaagaattcgggaactgtcaactgatgtggtgaaatggacttgccttcatagtagcaaacatgaaacaggtgttgtttctccaagtttgtcttaaccatattctcttgtcagcttctttggctgtgagaatcctgtacacaatagtcaagaggttgtggtggaacagtaccgaaatagcattgtcagatagttttcaagagaatgcaaattttggcacataaaaaaaaaaaaaaaaaaaa

SEQ ID NO: 7094 - protein, 413 aa, Panicum virgatum
  misc_feature: Ceres CLONE 1900335
  misc_feature (1)..(147): Pfam Name: TPT Pfam Description: Triose-phosphate Transporter family
MQSMAAACSSSSSSRACAAARRSYPSPALPSSRHVALSPSPSSAPSSHGCRWPVAGAGAPALSLGIRGGLRPLPSPLLAARTRAAAAVAASPPAADGGGKPEGTDGIPRTLQLGAMIIVWYLLNIYFNIYNKLVLKAVPFPYTITTFQFASGSFFIALMWLLNLHPRPRLSLKQYAKILPLALIHMLGNVFTNVSLGKVAVSFTHTIKAMEPLFSVLLSVMFLGETPSALVLGSLVPIVGGVVLASMTEVSFNWIGFWSAMASNLTNQSRNVLCKKLLTDEEDSFDDINLFSIMTVMAFLLSAPLMLSVEGIKFNPSYLQSAGVNVKELCVNAALAGTCFHFYQQVSYSLLARVSPVTHSVTNSLKRVVVIVSSVLFFRTPLSPINALGTGIALAGVFLYSQFKKAKPKSKAA

SEQ ID NO: 7095 - DNA, 1524 bp, Panicum virgatum
  misc_feature: Ceres CLONE 1900408
  misc_feature: Encodes the peptide sequence at SEQ ID NO. 7096
aaccttaactgaacagcagcctccatacctgctccagtagagctagtttggaaacgagagagctaacccagggaggtacgccctggaaagtgaattctgcggcaaatgctctcatcgtctctttcctagaatgatcagtacagaacaggatttccatatggtcgaaggggaaggggaaaatagctacacgaagaattccaggtgccaggagaagatttttcatgggagtataccaatgcttgagaatggcatcagaaaagtatttgagactcttggtgtcaaaaccatgaccattgttgatctaggatgctcttcaggaccaaacacattgctctttgtctctaaattaatagatatcacaactgaacaatgcaacaaagctgttgagtgtgatcctatggaacttctgatcttcctgaatgacctaccaggtaacgacttcaaccaagttttccgttcactcgaaaacttggagaaaggtacatcagatcaaaagggaaacacaccagttttttaccatatttctgggttgccaaaatcatactacaacaggctattacccagagaaagtgtccatctctttcactcctcttccagccttcactggcggtcgcaggtacctgaggtactggaagcaagtagagatgccttgctaaacaaagataacatttacatctcagagactagtacatcatttgtagtaaagtgcttcagagagcagtttaataaggacttctctaccttcctaaagctgcgtcatgaagaacttgtgtatggagggaaaatggttctaacattttgtggaaggaaggatgaaaatgtatacaatggagatctcaacaaactttttggattacttgctatgtcactgcaatctcttgtcacaaagggtcttgtggagagcgaaaagctagactccttcaatttaccattttatgggccatcaatttctgaagtgaagtatatagtaatgcaaagccacatgtttgaattggatcatatcaaactatttgaaataaactgggatccttatgatgatacagaaggtgatgatgttcatgacagtgtctgcagtggcatcaatgtttctaagtttattagagcagcgctggaacctatgattgcacgccattttggggaaaccatacttgacacattgttcacggagtatgcatttttttgtctccaagcacctccagaaggagaagacgaagtttgcgataatcaccatgtccttgaagaaggtgtagtaggaacaaattaatgggatcaatcagattgcactcttccagataccatattgtgacgtcttgctatacatattttattttcattagtgtgtgtctacgggttaattgtcgtcagagtgtctatatctctttgctgtatgcatcctggttgtcgtgagtgacgaaaatgttgtttgctgtgtgtatcctcgttgtgcagagtctgctagtattttcaatatggatgtatatagttgatataccaacaatattgcaaaaaaaaaaaaaaaaaaaa

SEQ ID NO: 7096 - protein, 377 aa, Panicum virgatum
  misc_feature: Ceres CLONE 1900408
  misc_feature (1)..(311): Pfam Name: Methyltransf_7 Pfam Description: SAM dependent carboxyl methyltransferase
MISTEQDFHMVEGEGENSYTKNSRCQEKIFHGSIPMLENGIRKVFETLGVKTMTIVDLGCSSGPNTLLFVSKLIDITTEQCNKAVECDPMELLIFLNDLPGNDFNQVFRSLENLEKGTSDQKGNTPVFYHISGLPKSYYNRLLPRESVHLFHSSSSLHWRSQVPEVLEASRDALLNKDNIYISETSTSFVVKCFREQFNKDFSTFLKLRHEELVYGGKMVLTFCGRKDENVYNGDLNKLFGLLAMSLQSLVTKGLVESEKLDSFNLPFYGPSISEVKYIVMQSHMFELDHIKLFEINWDPYDDTEGDDVHDSVCSGINVSKFIRAALEPMIARHFGETILDTLFTEYAFFCLQAPPEGEDEVCDNHHVLEEGVVGTN

SEQ ID NO: 7097 - DNA, 1801 bp, Panicum virgatum
  misc_feature: Ceres CLONE 1900565
  misc_feature: Encodes the peptide sequence at SEQ ID NO. 7098
gccatgctcgcctccgttttcatcctcgttgcttgctgcacacaaacagtagagacaagcaagcaccatgacgatcttgtcatcttatatcagatcactccacgaacacgttctgaacactgtcattccactcatcatcacaaccgccttcatcctcgtggctgcacggtttggtttcgctgagcacacaatcttccatctccatgccacgcggtacatctactacctgctgctgcttgttgtcgccttactaccaccaccagctgcggcggcagttactgtctttttccttgtgagccgccgctcacgccgcagtgtgtatcttgtcgattattcttgcttcaagccaatttccgactgccggattcccatggccatgttcagagagtacatggcgcatttcatgccgttcctcgacgaccgcagcatccacttcatcacacgtgtgctcgacacctctggccttggtgaggagacctgcttgcccccttccctccgttacatacctccgagcttcggattcagccatgcccgagccgaggccgagctggtggtcttctcaaccatcgatgacctgttacgcaagacacgcatcagcccaactgcaatagacatactggtagtcaactgctccctgttctccccaaccccatcctacagcgacatgatcatgagcaagtacaagctccgcgacgacatccgcagcgtgcacctctctggcatggggtgcagtgcagggctcatagccgtggggcttgccaagaacctgttgcaggtcacgccgaatgcggcgtgcgcattggcggtgtccacggagacgctctcgagcttcatgtacaaagggaagaagcgagagatgcatctgcccaacgtcctgttccgcatgggtggggcggcggcgttgctctcaaactctaggaacaaggctcgattccggctcaaacaccttgtgcgcacgagtacgagcaccgaaagcgcgtatcggtcggtgatactagatgaggatgaggaggggaacttgggggttaacctttccaaggacatcatcggtgtctctggtgatgcattgaggagtggtatcagtgccattgggccccttatcctcccagcaccagagaagctactgtttgccctgtcatggatggcacggaaggttcttggtggcaaggtagtgcaaccgtacgttccaaacttttgcaaggcggttgagcacttctgcattcaccctggtggaccggcagtgatcaacgctgtccaaaaaaacctgcgcctgtctgaagcccttgccgagccatcgaggatgacactccaccgatttgggaacacgtcaagcagctctctgtggtacgagctagcgtacatcgaggctaaaggtagaatgcagaaacgggatcgagtgctgatgattgcctttggttcaggatacaagtgcaacgttgctgtatgggagtgtatccaaccatcagatcatgctgatgggccatggagtaagtgcatccatcggtacccagtgaaagcatgactgagctgtttctcttaatgaaacacgcgtttagccgcgttctctaaaaagatagcatggttgagctaatcgccacttgagcgctgagggtatgcaaacccccccaagccatccgaccttgacatattaataagattaaatgacatgtaaatccaatgcaattatatatgcggagtgacaataatccaagtattttgtaaactgaagtaaagagtgtatgtcttggaattataaatataatgtcgttgttttgcaccagaaaaaaaaaaaaaaaaaaaa

SEQ ID NO: 7098 - protein, 484 aa, Panicum virgatum
  misc_feature: Ceres CLONE 1900565
  misc_feature (7)..(288): Pfam Name: FAE1_CUT1_RppA Pfam Description: FAE1/Type III polyketide synthase-like protein
  misc_feature (76)..(483): SWISSPROT Homolog: EC 2.3.1.- 3-ketoacyl-CoA synthase 1
MTILSSYIRSLHEHVLNTVIPLIITTAFILVAARFGFAEHTIFHLHATRYIYYLLLLVVALLPPPAAAAVTVFFLVSRRSRRSVYLVDYSCFKPISDCRIPMAMFREYMAHFMPFLDDRSIHFITRVLDTSGLGEETCLPPSLRYIPPSFGFSHARAEAELVVFSTIDDLLRKTRISPTAIDILVVNCSLFSPTPSYSDMIMSKYKLRDDIRSVHLSGMGCSAGLIAVGLAKNLLQVTPNAACALAVSTETLSSFMYKGKKREMHLPNVLFRMGGAAALLSNSRNKARFRLKHLVRTSTSTESAYRSVILDEDEEGNLGVNLSKDIIGVSGDALRSGISAIGPLILPAPEKLLFALSWMARKVLGGKVVQPYVPNFCKAVEHFCIHPGGPAVINAVQKNLRLSEALAEPSRMTLHRFGNTSSSSLWYELAYIEAKGRMQKRDRVLMIAFGSGYKCNVAVWECIQPSDHADGPWSKCIHRYPVKA

SEQ ID NO: 7099 - DNA, 1896 bp, Panicum virgatum
  misc_feature: Ceres CLONE 1900570
  misc_feature: Encodes the peptide sequence at SEQ ID NO. 7100
ctccatctccatctccctctctgacggccggcttcgatcggcgcagcatcagctaccccgtttagttccgatccttctcccatcccggccgtggctcgcacgccttgacatcgatcgacgactctggcctccctcgctccttccttcctctccacaccaccaaacccagcacggacgaggcgacgacacccgccggccggcccacgtataaattaaagcagctagcgcgcacttgcgcggccgatcgagagaggcacacatcgctcgacgtgtagagcgagcgagcgggcgagcgagggagggagggagcaagttgatctatggtattgagggcttgcgcaatggagggtgcggcggcggaccgtttcgtcggcgtgccgtactacgagtggctcaagccgcggtcgtcgtcgccgtcgtcctcctcgtcgacgtcctcgacgctctcgacgccgtcatcgtcgtcggccgaccactcggccgccgatggccaggagcgcgacgccatgatgtgcctgccgcttctggggaggctcgaagggagggcgacgactcctgatcgcggaccagtccccgtcaagcaggaagagctggcgatgagcgatatcactgctgctaccaccaccggcggcgccgccggtggtgccgttattgacctgaacatcggcctgccggcgatcggcggctatagctccgaggaggcgcccatgggcgaggaagacgaagatgaggaggaggattacgaggaggaggaagaggaggagaagccaaggaagcatgacaagtgcaaggaggaggaagcgggagatcaccacgcgaacagtactgagatggccgtggagtccgtcgagggagcagagccggactacctccgtgtggacggggaggatggcgtcaggggcttcatggacagccgcgggcggcggttctggatcccgacgccggcgcagatactcgtcggccccgtgcagttcatctgtcaggtgtgcagcaagacattcagcagatacaacaacatgcagatgcacatgtggggccacgggcgcgagtaccggaagggcccggagtcgctcaagggcacgcaggcggcgacgctggcactgctgaagctgccgtgctactgctgcgcggcggggtgccgcaacagcgtggcgcacccgcgcgcgcgcccgctcaaggacttccgcacgctgcagacgcactacaagcgcaagcacggcgacaagcgcttcggctgccgccgctgcggcaagcccttcgccgtcaagggcgactggcgcacgcacgagaagaactgcggcaagcgctggttctgcgcctgcggctccgacttcaagcacaagcgctccctcaacgaccacgtccgctccttcggcggcggccacctccccgtcgcgcccgaccagcaggcggcggcggccgccgtgccgccgctcaagcccaaggagcggatcatacgcttcgaccaggcggcggcggcggcgccgtggaacggagcccacgccgcccaggcatgacactgcaacaagttgacatctatcgtcagcacgcatagagatcgatcgaattaatagagttacatcgattggaacggaacaggattatgcatatatactgctgccagctcggaggcgaggcgtacataggcaataagactctggagatcgaggttgcttttggaggctgtgaagtagatgaattttcttcccaaggagacgagagcttcttcagagactgggtatgtctctagactctagctatagctcatcaatttgcaagggagaaaatttctcagcttcacatgccgatatttattaggcaaccttgtatcaatgtatcatgcatgcatgcatgcatgatctgatcctatgaaatctagtacacgtgttaattatt

SEQ ID NO: 7100 - protein, 398 aa, Panicum virgatum
  misc_feature: Ceres CLONE 1900570
  misc_feature (1)..(23): Pfam Name: zf-C2H2 Pfam Description: Zinc finger, C2H2 type
MVLRACAMEGAAADRFVGVPYYEWLKPRSSSPSSSSSTSSTLSTPSSSSADHSAADGQERDAMMCLPLLGRLEGRATTPDRGPVPVKQEELAMSDITAATTTGGAAGGAVIDLNIGLPAIGGYSSEEAPMGEEDEDEEEDYEEEEEEEKPRKHDKCKEEEAGDHHANSTEMAVESVEGAEPDYLRVDGEDGVRGFMDSRGRRFWIPTPAQILVGPVQFICQVCSKTFSRYNNMQMHMWGHGREYRKGPESLKGTQAATLALLKLPCYCCAAGCRNSVAHPRARPLKDFRTLQTHYKRKHGDKRFGCRRCGKPFAVKGDWRTHEKNCGKRWFCACGSDFKHKRSLNDHVRSFGGGHLPVAPDQQAAAAAVPPLKPKERIIRFDQAAAAAPWNGAHAAQA

SEQ ID NO: 7101 - DNA, 2564 bp, Panicum virgatum
  misc_feature: Ceres CLONE 1900927
  misc_feature: Encodes the peptide sequence at SEQ ID NO. 7102
gctgaccgcagcctctcgccgcggcgcgcggaaaccctagccccacccgccgccgcccccctcgctctcctccggtgatccatggcaagcttcggcgtcgacacccggcctgccgccgcagcctcgggcggcggaggaggcggcggcggcggggtgggggcgggggcgggggccggggagggcgcgctgtccttcctctcccgcggcctgcgggaggacctccgcctcatccgcgcgcgggccggggagctcgagacgttcctcaacgcgccggtcgcggagcccgagctgctcgcgcgcctccgccgcgcctactcctcctcggcctcctccgcgcggacgcggctggacctgtccgcgatcgggaaggcgttcgaggccgagtcgtggaggggcgccagggggcaggccgggtggaggtgggaggaggaggccgaggagtgggagcccgtgcggctggtcaaggcgcgcctcagggagctcgagcggagggcgcaggggcagtccgccagcgacatgctgcaaaaggtcaagctcagcttgaaatcaatgagctttgcacctgaagcatctgaggatgttccaccactggatttaggagaaatttttgcttattttctaaagcaatctgtaccattatttgatcaacttggtataaaaagagatgtatgtgacaagttggtggagtctctatgcagcaagcgaaaggaccaccatgcttataattttctgtctgcaagtgaaccatcttcattgagaagtgacaatgttggggatgagctcgacctaagaatagctagtgtcctacaaagcacaggacaccattgtgaaggtggattttggagggatgtgcagaagtctgacatatctgacaagagacatgttgccatagtcactactgccagtcttccctggatgactggaacggctgtgaatcctttgtttcgagcagcatacttggctaaatcttccaagcaaaatgtaaccttggtagtgccctggctttgcaagtcggatcaagaacttgtctatcccaatagcatgacttttaattctccagaagaacaagaaaactatatgaggaattggctggaggaaagagttggtttcaagacagacttcaaaatatcgttttaccccggaaagtttcagaaagaaaggagaagcataattcctgcgggggatacttcacagtttataccatcaaaggaagctgacattgcaatcttggaagagcccgagcacctcaactggtatcatcatgggaaacgttggacagacaaattcaatcacgttgtcggtgttgtacatacaaattatttggagtacatcaagagggagaagaatggtgctattcaggcctttttcgttaagcacattaacaacctggtcgctagagcttattgccacaagattttgcggctttcaggtgctactcaagatctgcccaagtcaatgatctgcaatgtgcatggtgttaaccccaagtttctggaagtcggagagagaatagcagctgagcaggagtctggacagcaatctttctcgaaaggagcttattttctagggaagatggtctgggccaagggttacagagaactgatagatttgtttgccaagcacaagagtgatttggaaggcttcaagttggacatttatgggaatggtgaagattcgcatgaagtgcaatcgaccgccaggaagttgaatctgaacctgaactttcataaaggccgggaccacgcagatgattctcttcacgggtacaaggtcttcatcaacccaagcatcagcgacgtcctgtgcaccgcgaccgcggaggcactcgcgatgggcaagttcgtggtctgcgcggaccacccgtccaacgacttcttccggtcgttcccgaactgcctgacctacaagacctcggaagacttcgtggccagggtgaaggaggccatgactcgcgacccgcagcccctgacccccgagcagcggtacaacctgtcgtgggaggccgccacccagcggttcatggagcactcggagctcgacaatgtcctgaacggcagtaacgactgcagcagcagcggtaccgaactcgacgggagcgcgggcaggaggacgaggcggtccgtctcggcgcccagcatctcggacgtggtcgacggcgggctggcgttcgcgcactactgcctgacgggcagcgagcttctgagactgtccaccggagccgtccccggaacccgggactacaacaagcagcacagcgccgacctccgcctcctgccgccccaggtgcagaaccctatatacggatggtaatcagggcatactggcaccgtcgatcagtagctgtacacaggtctgtacacatgtagagcctcgcagtctgtaacactagagttcgttctcgccgcctcgtggctgttcgcctctgctgccaaaggcgacgccttgttcattcattgttacgaaccaccatatatatgctgctcgtgtatgtaacactagctctctagataaagaggccagcaaggctcctttttttgtggctccaaaaaaaaaaaaaaaaaaaa

SEQ ID NO: 7102 - protein, 742 aa, Panicum virgatum
  misc_feature: Ceres CLONE 1900927
  misc_feature (1)..(103): Pfam Name: Glycos_transf_1 Pfam Description: Glycosyl transferases group 1
  misc_feature (104)..(742): SWISSPROT Homolog: EC 2.4.1.241 Digalactosyldiacylglycerol synthase 1, chloroplast precursor
  misc_feature (45)..(742): SWISSPROT Homolog: EC 2.4.1.241 Digalactosyldiacylglycerol synthase 1, chloroplast precursor
MASFGVDTRPAAAASGGGGGGGGGVGAGAGAGEGALSFLSRGLREDLRLIRARAGELETFLNAPVAEPELLARLRRAYSSSASSARTRLDLSAIGKAFEAESWRGARGQAGWRWEEEAEEWEPVRLVKARLRELERRAQGQSASDMLQKVKLSLKSMSFAPEASEDVPPLDLGEIFAYFLKQSVPLFDQLGIKRDVCDKLVESLCSKRKDHHAYNFLSASEPSSLRSDNVGDELDLRIASVLQSTGHHCEGGFWRDVQKSDISDKRHVAIVTTASLPWMTGTAVNPLFRAAYLAKSSKQNVTLVVPWLCKSDQELVYPNSMTFNSPEEQENYMRNWLEERVGFKTDFKISFYPGKFQKERRSIIPAGDTSQFIPSKEADIAILEEPEHLNWYHHGKRWTDKFNHVVGVVHTNYLEYIKREKNGAIQAFFVKHINNLVARAYCHKILRLSGATQDLPKSMICNVHGVNPKFLEVGERIAAEQESGQQSFSKGAYFLGKMVWAKGYRELIDLFAKHKSDLEGFKLDIYGNGEDSHEVQSTARKLNLNLNFHKGRDHADDSLHGYKVFINPSISDVLCTATAEALAMGKFVVCADHPSNDFFRSFPNCLTYKTSEDFVARVKEAMTRDPQPLTPEQRYNLSWEAATQRFMEHSELDNVLNGSNDCSSSGTELDGSAGRRTRRSVSAPSISDVVDGGLAFAHYCLTGSELLRLSTGAVPGTRDYNKQHSADLRLLPPQVQNPIYGW

SEQ ID NO: 7103 - DNA, 1988 bp, Panicum virgatum
  misc_feature: Ceres CLONE 1900928
  misc_feature: Encodes the peptide sequence at SEQ ID NO. 7104
cactctcctcacgggctcacagatttgagggagtcgtcgtcctcttcttcctcggccggctagtcaagtccaccgctctgacaacccgtcccggcccgcaccaccggcaccagcactccattcccaaatccccaacttggcgatcagtcccccccaatccgagcaaacggcggtcctcctcttcttcctcttcggtatgagcggcttcttggtggtggtcggcaagatcggcaccttcctgctttgggtgctcttcctggtgctgcaaacggccacccggatcgtcggcaacctcctcgcggggccagccgagcagcaggaggacccgctgcaagagtcggcggcggcagcgcgccgcaggtcgccgacagcctcgccgcgccgcgacccctacgagccggcgtcggcgccgcctcagcagctctgggactcgcctctgctgccgtattctccctctgctcccgccgcggatgagtactcctcgtcctcgagcttccggcggcgtagcgcgccgccgccgccgccggatgaggacgtagtggtgtcctcgagtgcctactcgcgtccgccgccggcggcggcccatgcatattccttgtcggcgcctccgctgagggcaatcgagacgcgggcgatgccagcgagggcggtggcagctgggggtaagcggcccaggctggagaggaagtactccaagattgttgaccagtaccgctccctggatgaggttatcgaagcattagcacaagctggtctggagtcttccaatttaatcataggaattgatttcacaaaaagtaatgaatggacaggaaagaattccttcaatggtacgagcctgcatcatattggtgacaccccaaatccttatgaacaggcaatatcgatcattgggcagaccttatcagcttttgacgaggataatttaattccttgctatggttttggagatgcatctacacatgaccaagatgtatttgccttttatcctgatgaaagaccatgcaatggttttcaggaagctttagctcgatacagagagattgttcctcaccttcgcctttctggtcctacatcattcgctccaataattgaaatggccacaaccattgttgagcaaagtggtggccaataccatgttttagtaatcatcgctgatgggcaggtgacacgaagtgtagataccgaatttggtcagttaagtacccaggagcaaatgacagttgatgctattgtacaagccagcgaatttcccttgtctataattctcgttggagttggagatggtccatgggatatgatgaaggagtttgatgacaacataccagctaggtcttttgacaatttccagtttgtcaacttcactgcgatcatgtcaaaaaagataagtcaaagcaaaaaggagacagagtttgccctttcagcactcatggaaattccgttgcagtacaaagcaacattagagcttggaattttaggacggcgacttgcaaagtcgcctgatcgagttccacttcctcctccctttgcaagttatagcacagtttcaagagcaccaccatctcgagcaaatagctaccgaagcgtgccttcacgtcctagagaggagccaactgtagattcaacaatcacagcatcagtcacatccccaccagcagttgaaagtagagtttcagaaccccagatgtgcccagtttgcctttccaaaccccgggacatggcatttggttgtggccaccagacatgctcggaatgtggaccacaagtcgcagattgtccaatctgtcgaaggcccattgatacgagagtaaaattgtactagtcgtcatcatgtcatcatctgttgcgactaactaggtttagctgaatcgcatacgagcaggaagtagaatccattgaaaaggaactcttattagacattgttgatgtagtatgtattcgttcaataaatcagctgtacaaaaatggaaaaaaaaaaaaaaaaaaaa

SEQ ID NO: 7104 - protein, 541 aa, Panicum virgatum
  misc_feature: Ceres CLONE 1900928
  misc_feature (1)..(33): Pfam Name: zf-C3HC4 Pfam Description: Zinc finger, C3HC4 type (RING finger)
MSGFLVVVGKIGTFLLWVLFLVLQTATRIVGNLLAGPAEQQEDPLQESAAAARRRSPTASPRRDPYEPASAPPQQLWDSPLLPYSPSAPAADEYSSSSSFRRRSAPPPPPDEDVVVSSSAYSRPPPAAAHAYSLSAPPLRAIETRAMPARAVAAGGKRPRLERKYSKIVDQYRSLDEVIEALAQAGLESSNLIIGIDFTKSNEWTGKNSFNGTSLHHIGDTPNPYEQAISIIGQTLSAFDEDNLIPCYGFGDASTHDQDVFAFYPDERPCNGFQEALARYREIVPHLRLSGPTSFAPIIEMATTIVEQSGGQYHVLVIIADGQVTRSVDTEFGQLSTQEQMTVDAIVQASEFPLSIILVGVGDGPWDMMKEFDDNIPARSFDNFQFVNFTAIMSKKISQSKKETEFALSALMEIPLQYKATLELGILGRRLAKSPDRVPLPPPFASYSTVSRAPPSRANSYRSVPSRPREEPTVDSTITASVTSPPAVESRVSEPQMCPVCLSKPRDMAFGCGHQTCSECGPQVADCPICRRPIDTRVKLY

SEQ ID NO: 7105 - DNA, 1796 bp, Panicum virgatum
  misc_feature: Ceres CLONE 1900943
  misc_feature: Encodes the peptide sequence at SEQ ID NO. 7106
cacattccgtcggtactagctagcaggcagcaagatccaggcaccgtctttctgctgcggcggcaggcttgccaggcgccagagatctctcgggtcccgtgccaatgcagctcttccaaggggagaagccggcccatgacttcctctcgcttcacaccggaggcggctcgtcctcgccggtgcagcactccgcccaagggtacgatacgggggtgcacacttcgctcaagcctctcaagctgggcaagcggcgccgcggcgccggcggcggtggcggagcgatcggcatggcaccgtcgggtctggaggcggactcggcggagcatctcctgccgagcggcgtcgggacgttcagcatcaggcaggcgccgtcgactgcccagccgagggggcaacccgctggccacggcgtcgtcgccacgggcgcgttcgcgcccgtgctccatggctccaggacggaggccacgcacggagcggaatctggagccagggctcacagtgggcctgcctcaatgtggcaagattcgggcgccgatcaaagatccagagcgacgagaggggaggggagaagcagcggcagcagcggtgatcaggggcccagcacgccgagatcgaagcattctgccaccgagcagcggaggaggaccaagataaatgacagacttgaaatacttcgtgaacttctgccacatggcgaccagaagagggacaaagcgtctttccttctcgaggttatcgaatacataaggtttttgcaagagaaagtccaaaagtacgagtcagcccacccacaaaagaatcacgaggattcctccatgccatgggcaaaactttactacagatcatgctggaaaaacacagggaacattactcaagtccaaggaggatcgtcagcccccacacaggctatgaacaaagagcagtactgttccactaaaactacagtggcacctactctcttcagcacacatagtgctggagaaactagtatagacgagatttcctcccaaaaggcaacaagcacgccacaaaactgggcagatgacagcacacctagcaaacagccaccatggttgagcatgtcaacctctgattcaggcaacaaaacactaagcaagaaagagaaacagactcttcacgaggatactcgtagtctttctaatgcttactctcaagggttactaaacaggttgacacaagcactaaaaagttcgggagtagacccatctcaagctagtatatcagttgagatcaatatggacaaaagagcaacagaacctagcaatacacatggcaatttgaaggacaatgaatgtgaagaaacaatccacgtgaccaagaagcttcggtgctgacacaagccagatctctacctcaaactagaaaagtcacatatccccaagtccagaccaggactgaacagaagcaaaccacaattgatgcaattctttaacttatattgcaatcacatttactgacctaggcttccattcgaatgtagtagaggaagctgcttagggagggaagtcagaagccttcccgattcattcattcctcatttgtaaatgcaattcagattgtaaaacggtgtacatgtattaatttctcaaaatttgtcaacaaatatggtggtacactaggttgcaacatcactgtgtcaaccttccacaattcatccattatattggtagatagagatatggacaatgtaaactatactaagcttgtgacttgcagcaagcttgtgaaattgatattactctgaaccactgatccaaaaaaaaaaaaaaaaaaaa

SEQ ID NO: 7106 - protein, 416 aa, Panicum virgatum
  misc_feature: Ceres CLONE 1900943
  misc_feature (1)..(51): Pfam Name: HLH Pfam Description: Helix-loop-helix DNA-binding domain
MQLFQGEKPAHDFLSLHTGGGSSSPVQHSAQGYDTGVHTSLKPLKLGKRRRGAGGGGGAIGMAPSGLEADSAEHLLPSGVGTFSIRQAPSTAQPRGQPAGHGVVATGAFAPVLHGSRTEATHGAESGARAHSGPASMWQDSGADQRSRATRGEGRSSGSSGDQGPSTPRSKHSATEQRRRTKINDRLEILRELLPHGDQKRDKASFLLEVIEYIRFLQEKVQKYESAHPQKNHEDSSMPWAKLYYRSCWKNTGNITQVQGGSSAPTQAMNKEQYCSTKTTVAPTLFSTHSAGETSIDEISSQKATSTPQNWADDSTPSKQPPWLSMSTSDSGNKTLSKKEKQTLHEDTRSLSNAYSQGLLNRLTQALKSSGVDPSQASISVEINMDKRATEPSNTHGNLKDNECEETIHVTKKLRC

SEQ ID NO: 7107 - DNA, 1826 bp, Panicum virgatum
  misc_feature: Ceres CLONE 1900962
  misc_feature: Encodes the peptide sequence at SEQ ID NO. 7108
gctggcacgacacgacgatggagctcgcggttacagtagttcaattcccgttttcaaatggaggtgtcacgtcgtggacggacacgctagccttagcctagctagctgcggggggagctcagctcagctggctgcccgggcgcgctccgcccagattgcagtaggcatgctggctcggctaccttccccttcccttccgggggagccggagctctattaatacacgcgcacgggcgcccgaggccgccgcggacgtgcgagcgccatggttccccttccccggcgtgcgcattgaacgacgaggccgcagagagtgcgcagagcacagctgctgccaagccaatggcggcgagggcgccacggccgggggccctcgcggccagcttcctcctcctgttcctggccgccgccgccgcgccgtggtggcaccgtggtctggctgccgccgggctggtgcgcgtggacgggacgcagttcgtggtgggcggcaagaccgtctacttcagcgggttcaacgcgtactggctgatgctggtggcgtcggacccggcgcggaggggccaggtcgtggccgcgttccggcaggcggcgggccacgggctcaacctcgcgcggacctgggccttcagcaacggcggtgacgccccgctgcaggcggcccccggcgtctacgacgaggccatgttccaggggctggacttcgtgatcgccgaagccaggcggcacggcatctacctcctcctctgcctcaccaacaatttccacgacttcggcggcaagcgccagtacgtggcctgggccagggaggccggccaccacctcgccaccgccgacgacttcttcaacagcaccgtcgtcaagggatactacaagaaccatgtcaagacggtgctgacgcgggtgaacacggtgaccggggtggcgtacagggacgaccctaccatcctcggctgggagctcatgaacgagccgcgatgcgacgccgaccccaccggcgccatggtgcaggcctgggtggaggagatggcgccgtacgtcaagtccgtcgacggcgaccacctagtgacggcggggctggagggcttctacggcgacggcgcgcacgagagcaaggacctcaacccctggggcatctactacggcaccaacttcgtcgatacccaccgcgccgccggcgtcgacttcgccaccatccacctctacccggacctctggctctggggctccggcgccgccgcgcagctcgccttcttccggaactggacgcgctcgcacgccagggacgccgagctgtacctcgccaagccgctgctcgtcaccgagtacggcaagttcctgtgggacggcgtcgccaaccgcacgcagcgggaccgcttcctgggcctggtgctcgactcaatctacgcctcggccgccgccggcgggccgctcgtcggcggcgccttctggcaactgctggaccccggcatggacacgctcagggacgggtacgagatcatactcctcgaggaccaacgcgccgcgaccatcatcggcaaccactcccggcagctggccgagctcaacgggcaggacgtcgaggcggttcgccggaggagccggcggcgctggggcgcgcataggaaagtacacgtactaggcagcagcagctcgggtaggagtaggagtagcagtgacacgccacggttacacatgcccttggttcgtttcatcatctctttgttcagatcatcaatttcttcgctgttcagttcagcagcgtatataccgtagaaagaaaattttactgcacatacattacaggttaaaaaaaaaaaaaaaaaaaa

SEQ ID NO: 7108 - protein, 476 aa, Panicum virgatum
  misc_feature: Ceres CLONE 1900962
  misc_feature (1)..(329): Pfam Name: Cellulase Pfam Description: Cellulase (glycosyl hydrolase family 5)
  misc_feature (1)..(328): Pfam Name: Cellulase Pfam Description: Cellulase (glycosyl hydrolase family 5)
  misc_feature (1)..(467): SWISSPROT Homolog: EC 3.2.1.78 Mannan endo-1,4-beta-mannosidase 3 precursor
  misc_feature (26)..(467): SWISSPROT Homolog: EC 3.2.1.78 Mannan endo-1,4-beta-mannosidase 4
MAARAPRPGALAASFLLLFLAAAAAPWWHRGLAAAGLVRVDGTQFVVGGKTVYFSGFNAYWLMLVASDPARRGQVVAAFRQAAGHGLNLARTWAFSNGGDAPLQAAPGVYDEAMFQGLDFVIAEARRHGIYLLLCLTNNFHDFGGKRQYVAWAREAGHHLATADDFFNSTVVKGYYKNHVKTVLTRVNTVTGVAYRDDPTILGWELMNEPRCDADPTGAMVQAWVEEMAPYVKSVDGDHLVTAGLEGFYGDGAHESKDLNPWGIYYGTNFVDTHRAAGVDFATIHLYPDLWLWGSGAAAQLAFFRNWTRSHARDAELYLAKPLLVTEYGKFLWDGVANRTQRDRFLGLVLDSIYASAAAGGPLVGGAFWQLLDPGMDTLRDGYEIILLEDQRAATIIGNHSRQLAELNGQDVEAVRRRSRRRWGAHRKVHVLGSSSSGRSRSSSDTPRLHMPLVRFIISLFRSSISSLFSSAAYIP

SEQ ID NO: 7109 - DNA, 1532 bp, Panicum virgatum
  misc_feature: Ceres CLONE 1901045
  misc_feature: Encodes the peptide sequence at SEQ ID NO. 7110
atgggctatatcgagtcattttttcatatcgcttgcattgcacaaattttgtgtggttgatcgagctccgggtgggagtgcacaacatggaggactcgagcttgttcatgcagtgggccattgacacgctgctgaacgagcacccggagcctgccatcgtcggcgacggctgcggcgaggcaaccttcccttcgctccaagcgctccgcgacgcctcccacgccgtggaaatggtccgggagctgacggccgacgaagcccaccatgatgcggccaacagctggagctccggcgacggcgacatcacggacggcagcggcggcggcggcactactgttcgagccccagccgcggccagggatggccatggctcctggccgcagtcgccgagctcgttcaggcgcgccccgccgcggagcggcaacaccaataacctgccgttggttagctggaacttcgtcaccggctcggcgcagcctgcaggcagcggtggcatggtggtggaggaggccgccgccccacccccacgcagctttcctgagccggcccaccacggccacgggtcaccgccgccgacggggagagcctccctgagaagccagggagccgcatcgtcggcgtcgtacgcgccagaccacatcatcgccgagcggaagcggcgggagaagatcaacaaacgcttgatcgagctctccactgtcatccccgacctcaaaaagatggacaaggcaacgatcctcttcgacgcggccaagtacgtcaaggagctccagcagcggcttaaggccctggaagaggaggccaccgccgccggcagcaacgccaggagcaacgaaaccgtggtgcgcgtcaagaagccgtgcaacgccgccgtcgcggcgcccgacgagaatggctccccgtcgtcggcagcgtcggcgtcggggccaccagcgacgggcaaaccagcagctcttccagagatccaggcacggttctcggagaagagcgcgatggtgaggatccattgcgggggcggcaaggaggtggccgtgacggtgctcgccgaggtcgaggatctcgggctcagcatcgtccatgccaacgtcatgccgttctcggcttgcaccgtgatcataaccatcacggccaaggtggaggagggcttcaccataacagcggaggagatcgtagacaggctcaactctgcactatcacaccagcatatcaactgcaacggcggcactgaagaaacagaaaattgactagcgcagtgcgcaacggtggaataattaatatatctagatacatgcgcgtgggtacctttacttttttgtaaataagtttgatggcttggaaatttttgttggtgtgtgcaactagctagcgttgcatgagattgactagcaaattgcatgcactagtacagagtgtgaagtgatatgtgaaagtgtggtgtggacgtgcacacagatgcttgcaagttgctatagctatatacgagaattcctgcaccacatgtcttccttggcgaaaaaaaaaaaaaaaaaaaa

SEQ ID NO: 7110 - protein, 385 aa, Panicum virgatum
  misc_feature: Ceres CLONE 1901045
  misc_feature (1)..(50): Pfam Name: HLH Pfam Description: Helix-loop-helix DNA-binding domain
  misc_feature: The sequence is a functional homolog of  SEQ ID NO 1276 in the  10/666,642 US patent application
  misc_feature: The sequence is a functional homolog of  SEQ ID NO 1705 in the  10/374,780 US patent application
  misc_feature: Useful for making plants with modulated growth and phenotype characteristics
MEDSSLFMQWAIDTLLNEHPEPAIVGDGCGEATFPSLQALRDASHAVEMVRELTADEAHHDAANSWSSGDGDITDGSGGGGTTVRAPAAARDGHGSWPQSPSSFRRAPPRSGNTNNLPLVSWNFVTGSAQPAGSGGMVVEEAAAPPPRSFPEPAHHGHGSPPPTGRASLRSQGAASSASYAPDHIIAERKRREKINKRLIELSTVIPDLKKMDKATILFDAAKYVKELQQRLKALEEEATAAGSNARSNETVVRVKKPCNAAVAAPDENGSPSSAASASGPPATGKPAALPEIQARFSEKSAMVRIHCGGGKEVAVTVLAEVEDLGLSIVHANVMPFSACTVIITITAKVEEGFTITAEEIVDRLNSALSHQHINCNGGTEETEN

SEQ ID NO: 7111 - DNA, 1589 bp, Panicum virgatum
  misc_feature: Ceres CLONE 1901059
  misc_feature: Encodes the peptide sequence at SEQ ID NO. 7112
gaaccagaccaaggcaacagcagcgcccgagacgagatcccaatcttgcgctccattcagccgccgatggcgctgccgtcgagcgcctcggcagcgcggctgcggctgctcaccgtgccggcgcttctgctgttgctatcctccgccgcgctgctcgtattcctcatcctcccctcgctctccccgtcctcctcggccacctccccgcacctctgcacctgctcgcccccctccactcacaccaccaccaccgtcacaacgaccaccaccacggcctcccccgcgcccgtcaccacctcccctgcggacgtcgcctggctcaaggcccagctcgcgtccaactccctcctcgccggcggcgccgcggcctcccacgacgcctggcaccgtctgcgcaagggcatcaatccccgcactcgcgagcagcagctcttcgacatcaacaggcaccatgggatctctcactatccggatgaagaggcaagcaaccacaccgcactgccgtgccccggagagctccttgtggaagagcaccacagcaactacggtgaaccgtgggccggtggccgggacatcttcgagttccttgctaatgcctgtacgctcacgcccacggaccaggtccttgaaattgggtgtggaacacttcgtgttggtctgcattttattcggtatcttgaggctgggaggttccattgcctggaaagggacgagttgtctctcatggctgcgctccagtatgaactgccagcacaggggctgctgtataagcgtccgatgattgtgagaggggaggatatggacttcagcaagtttggggatacggttatgtatgatctcatttatgcaagtgctgtgttcatccatattccagataagcttgtttggactgggcttgagaggcttgcagggaagctgagaccgcagagaggccggatttttgtatcgcataaccttaagttttgcttaagactgggtcgtgatgagtgcacacggcggcttgcaaaattgggccttgaatatgtgggcaagcacactcatgatagcttgttatttaaccactacgatatttggtttgaattcagccggccagaagtttagatcttgatggtagaaagtggtttggtttctgtggtgcagttttggtggttttgagcacagatccagtcatgcttgtactattttgtacactactgggacttgacttcagatcagtattgatgttcgcttggtacctaattcaagcatatgcgccaaaagtcatgattaagagacactccggtgcttcagcgagtcttccaggttacattaggtgagtggtggatgaaggctatagctttaattagcacccattattggatgtactgtaactctagtaatgtttctggtactatggcctcatagggtaggcaggtagctgatgtcaaagacgtgtgatacatgcctgttactctgaaagctgcctcctgtgatcaaaatagaatcttatcagcacgcagagtttagtaagctgtgacaaggataactctgcttatcttattcgtgcattcattgaacagacactttgttaaaaaaaaaaaaaaaaaaaa

SEQ ID NO: 7112 - protein, 344 aa, Panicum virgatum
  misc_feature: Ceres CLONE 1901059
  misc_feature (1)..(105): Pfam Name: Methyltransf_12 Pfam Description: Methyltransferase domain
MALPSSASAARLRLLTVPALLLLLSSAALLVFLILPSLSPSSSATSPHLCTCSPPSTHTTTTVTTTTTTASPAPVTTSPADVAWLKAQLASNSLLAGGAAASHDAWHRLRKGINPRTREQQLFDINRHHGISHYPDEEASNHTALPCPGELLVEEHHSNYGEPWAGGRDIFEFLANACTLTPTDQVLEIGCGTLRVGLHFIRYLEAGRFHCLERDELSLMAALQYELPAQGLLYKRPMIVRGEDMDFSKFGDTVMYDLIYASAVFIHIPDKLVWTGLERLAGKLRPQRGRIFVSHNLKFCLRLGRDECTRRLAKLGLEYVGKHTHDSLLFNHYDIWFEFSRPEV

SEQ ID NO: 7113 - DNA, 1540 bp, Panicum virgatum
  misc_feature: Ceres CLONE 1901071
  misc_feature: Encodes the peptide sequence at SEQ ID NO. 7114
accggcacggaccatctcgtctccaccacgcccacggccaccttgtccgcccgcctccccggccccggccccgaaccctcacccccacggccccaccacatggcggcggcgctcgcttcctcccgctgctgctgcaggcgcccgtcgccgccgccgctccaggcccgcgcccgccgcgccgtcgcccggtgcgcgctcgccgggggagagaaaagaaattccttcagctggaaagagtgtgcgatttctgttgccttgtcagttggattgatcagtggcgcaccaacattaggatcatcggcctatgcttctcctcttgaacctgttcttccagatgtctctgttctgatctctggacctcccattaaagatccaggtgctttactgagatatgctttgccaatagataacaaagctattcgtgaggttcaaaagccactggaggatatcactgacagtctcaaggttgctggtgttagagccttggattcagttgaaagaaatgtcagacaagcatcgagagcactggacaatgggagaggcgtaattcttaatggtcttgctgagtccaaaagagcaaatggagaagagttattggataaattggctgttggacttgatgagcttcaaagaattgttgaagacagaaacagggatgctgtagctccaaagcagaaagagcttctccagtatgttggaactgtagaagaagacatggttgatggctttccctatgaaataccagaagagtacagcaacatgcctcttctcaaaggaagagctactgtggatatgaaggttaaaattaaggacaatcccaacatagaagattgtgtatttcggatagttctggatggatataatgctcctgtgactgctgggaacttcgtagatttggtggaacggaaattctatgatggcatggaaatccagagagctgacggttttgttgttcaaaccggagatccagagggaccagctgaggggttcattgatcccagcaccggcaaaattcgcacaatacctcttgaaataatggttgatggtgataaggctcctgtatatggtgaaacacttgaagaacttggccgctacaaggctcaaacgaaacttccttttaatgcatttggaacaatggcaatggctagagaagaatttgatgataattcagcttctagtcaagtcttttggctattaaaagagagcgagctaactccaagcaatgccaatatattggatggacggtatgcagtatttggatatgtaaccgagaatgaggatttcttggcggatgtcaaagttggggatgtcatcgaatcaatccaagtcgtttcaggcttggacaaccttgtcaacccaagctacaagatagtaggataacgtgttttgtatcagagttccttagccgcaaattctctatcttgaaattgatgtaaaacattataatatctaactttcataaccttctctcttaatgaggatgggtcatgcggaattcaatattcattggaagttcagaataagtgatcagttgtccgcc

SEQ ID NO: 7114 - protein, 426 aa, Panicum virgatum
  misc_feature: Ceres CLONE 1901071
  misc_feature (2)..(187): Pfam Name: Pro_isomerase Pfam Description: Cyclophilin type peptidyl- prolyl cis-trans isomerase/CLD
  misc_feature (37)..(426): SWISSPROT Homolog: EC 5.2.1.8 Peptidyl-prolyl cis-trans isomerase, chloroplast precursor
MAAALASSRCCCRRPSPPPLQARARRAVARCALAGGEKRNSFSWKECAISVALSVGLISGAPTLGSSAYASPLEPVLPDVSVLISGPPIKDPGALLRYALPIDNKAIREVQKPLEDITDSLKVAGVRALDSVERNVRQASRALDNGRGVILNGLAESKRANGEELLDKLAVGLDELQRIVEDRNRDAVAPKQKELLQYVGTVEEDMVDGFPYEIPEEYSNMPLLKGRATVDMKVKIKDNPNIEDCVFRIVLDGYNAPVTAGNFVDLVERKFYDGMEIQRADGFVVQTGDPEGPAEGFIDPSTGKIRTIPLEIMVDGDKAPVYGETLEELGRYKAQTKLPFNAFGTMAMAREEFDDNSASSQVFWLLKESELTPSNANILDGRYAVFGYVTENEDFLADVKVGDVIESIQVVSGLDNLVNPSYKIVG

SEQ ID NO: 7115 - DNA, 1628 bp, Panicum virgatum
  misc_feature: Ceres CLONE 1901128
  misc_feature: Encodes the peptide sequence at SEQ ID NO. 7116
cccaccaaacaactcccgctgcccactccccttttcctcggtgatggccgccgccgccgccgcacccacagccgccgcccgcctcttcctcctccagtccaccccgtccgcgaaccctagcaactccgcctcggcccaagcccaggcgctccgcgccccgtcccctcgcctcgcgctctcccgccgcatggcggggggcccgccggcggcgatcgcgggcgcctccggcggctccgagcgggacctgagcgcctcggcgttgtccatggaagcccaggagtccgtcgtcgcctcggattccggtttggaggcgaaggagccgagcgtggcgacaatactgacgagtttcgagaactcgttcgacatgtacggggcgctcagcacgcctctgtatcaaacggccacttttaagcagccttcagcaacagattatggaacttatgattatactaggagtggtaaccctactcgtgatgttctccagagccttatggctaagcttgagaaggcagatcaagcattctgcttcaccagtggaatggcagcactagctgcagtaacacacctcattcagtccggacaagaaattgttgctggagaggacatatatggtggatctgatcgtctactctcgcaagttgtgccaagacatggaatagttgtaaagcgagtggacacaaccaaaattagtgatgtggcctctgcaattggtcccttgactaaactagtttggcttgaaagtcccaccaatcctcgtcaacagattaccgacataaagaaaatatcggaaatagctcattcacggggtgctcttgttttggtagacaacagtatcatgtctccagtgctctcccgccctatagaacttggagcagatattgtcatgcactcagctaccaaatttatagctggacatagtgatcttatggcaggaattcttgcagtaaagggcgaaagcttggctaaagaagttgcatttctgcaaaatgctgaaggatctggtttggcgccttttgactgctggctctgcttgaggggaatcaaaaccatggccttgcgggtggagaagcaacaggctaatgcccagaagattgctgaattcctagcctctcacccgagagtgaagcaagtgaactatgctgggcttcctgaccatcctgggcgttctttacactactctcaggcaaagggagcgagctctgttctcagtttcctcaccggctcactggcgctctcgaagcacgttgtcgagaccaccaagtacttcaatgtgacagtcagcttcgggagcgtgaagtcgctcatcagcctgccgtgcttcatgtcgcacgcggccatcccggccgccgtccgcgagcagcgcggcctgactgacgacctcgtccggatttccgtgggcatcgaggacgtcgacgacctcatcgccgacctcgaccgtgcgctcagaaccggcccggcgtagagggctgcaagaccccgctgcttttctgaatcctgaacctcggtttacagaaacgatagtagtagaatcattaggtgtggtatgtcttggcaattcattggtgcactgcttgaggaataataataatggaaacgtttgttgagagcaaaaaaaaaaaaaaaaaaaa

SEQ ID NO: 7116 - protein, 472 aa, Panicum virgatum
  misc_feature: Ceres CLONE 1901128
  misc_feature (1)..(373): Pfam Name: Cys_Met_Meta_PP Pfam Description: Cys/Met metabolism PLP-dependent enzyme
  misc_feature (1)..(373): Pfam Name: Cys_Met_Meta_PP Pfam Description: Cys/Met metabolism PLP-dependent enzyme
  misc_feature (1)..(309): Pfam Name: Cys_Met_Meta_PP Pfam Description: Cys/Met metabolism PLP-dependent enzyme
  misc_feature (1)..(373): Pfam Name: Cys_Met_Meta_PP Pfam Description: Cys/Met metabolism PLP-dependent enzyme
  misc_feature (91)..(471): SWISSPROT Homolog: EC 4.4.1.8 Cystathionine beta-lyase, chloroplast precursor
MAAAAAAPTAAARLFLLQSTPSANPSNSASAQAQALRAPSPRLALSRRMAGGPPAAIAGASGGSERDLSASALSMEAQESVVASDSGLEAKEPSVATILTSFENSFDMYGALSTPLYQTATFKQPSATDYGTYDYTRSGNPTRDVLQSLMAKLEKADQAFCFTSGMAALAAVTHLIQSGQEIVAGEDIYGGSDRLLSQVVPRHGIVVKRVDTTKISDVASAIGPLTKLVWLESPTNPRQQITDIKKISEIAHSRGALVLVDNSIMSPVLSRPIELGADIVMHSATKFIAGHSDLMAGILAVKGESLAKEVAFLQNAEGSGLAPFDCWLCLRGIKTMALRVEKQQANAQKIAEFLASHPRVKQVNYAGLPDHPGRSLHYSQAKGASSVLSFLTGSLALSKHVVETTKYFNVTVSFGSVKSLISLPCFMSHAAIPAAVREQRGLTDDLVRISVGIEDVDDLIADLDRALRTGPA

SEQ ID NO: 7117 - DNA, 1801 bp, Panicum virgatum
  misc_feature: Ceres CLONE 1901138
  misc_feature: Encodes the peptide sequence at SEQ ID NO. 7118
ataaacaactcgcgcaaggacgcccaaaccagcagccgccgcagtcggaggcagccgaggaggcgaccaccggccgagcagcgcagccaccgcggggggagccttggctcggggggccgtcggccatgtcggtgagctgcgggctggagtgcgtggtgtgcctggggtgcacgcggtgggcgtggaagcggctcacctacatcggcgcctacgacagcgagacgtggccgccggcgaccaccggcgagttcgagcccgtcccgcgcctctgccgcgtcgtgctcgccaactacgacccggacctcagcgaccccaagttcgcgccgccgggccgcgggtacgccggcgtcgaccccaggggcatcgtcaggcgcgccacctacgaggacgtcggcaaccgctgcccgccctacctcatctacgtcgacgaggcgcacaaggagatcgtcctcgccgtgcgcggcctcaacctcgtccgcaacgccgactacaaggtgctcatggacaacaagctcgggatgcagatgttcgacggcggctacgtgcaccacggcctgctcaaggccgcccagttcatcctcgagcgggagacggagacgctgcgggacctgctgcgccggtacggccccgagtacaagctcatcttcaccggccactcgctcggctccggcatcgccgcgctcatgaccgtgctcgtcgtcaacaaccgcaaggagttcgacaacacacccaggagccggatcaagtgctacgcgctcgcgcccgccaggtgtatgtcgctcaatctcgccgtcaagtacgcggacgtcatcaactctgtcgtgctgcaggatgactttttgccaagaacaccaacaccacttgagtacatttttgggtctatattctgcttgccctgcttgctattcctcatttgcttgagagatacatttaaacaagacaagcgaaaattcaaggatccaagaagattgtatgctcctgggcgaatgtaccatatcgttgagaggaaattttgcagatgtggaagattcccacctgaggtcaaaactgcaattcctgtggaaggacgatttgagcatgttgtgctatcatgcagtaccacttctgatcatgctattgcttggatcgagcgagaatcgcaaaaggctttagagctaatgatggaaagtgagaatgcaatggctccacctccgcagcaaaagatggagaggttgcaaagttttgaggatgagcacaagagtgccctccagagagcaaaaacattggatgttcctcatgctgccgacctgtcagaagaggaaattctggaggatggtagcactgcaccaccctctgatactcatagcgagacaactacggaaccgaaatctgcaggaagaaccagctgggacgcactgatggagaagcttttcaccagggatgaagatgggaagcttatcgtgaagaaggacatggcaaaggagattgttgttgagtaatgacggttatgagagtactctgcacatggtagttcattctttaagccggatgtataaaggagtaagttgtgggtgcgatacatctatgcttttcccccctatagtccgttgaaaacgtctttttgaggtacattcatttttgcgtatatagaagaggggtagtgcaaaaggctatctagttcacttctgtgtagaggcttcatttgtgtgcattcttggaaattcgaagtctttgtaaatttatcagtacagactttgtacattattcccggtaatgaattgcaagttgagaatttatttgtcaaaaaaaaaaaaaaaaaaaa

SEQ ID NO: 7118 - protein, 450 aa, Panicum virgatum
  misc_feature: Ceres CLONE 1901138
  misc_feature (1)..(141): Pfam Name: Lipase_3 Pfam Description: Lipase (class 3)
MSVSCGLECVVCLGCTRWAWKRLTYIGAYDSETWPPATTGEFEPVPRLCRVVLANYDPDLSDPKFAPPGRGYAGVDPRGIVRRATYEDVGNRCPPYLIYVDEAHKEIVLAVRGLNLVRNADYKVLMDNKLGMQMFDGGYVHHGLLKAAQFILERETETLRDLLRRYGPEYKLIFTGHSLGSGIAALMTVLVVNNRKEFDNTPRSRIKCYALAPARCMSLNLAVKYADVINSVVLQDDFLPRTPTPLEYIFGSIFCLPCLLFLICLRDTFKQDKRKFKDPRRLYAPGRMYHIVERKFCRCGRFPPEVKTAIPVEGRFEHVVLSCSTTSDHAIAWIERESQKALELMMESENAMAPPPQQKMERLQSFEDEHKSALQRAKTLDVPHAADLSEEEILEDGSTAPPSDTHSETTTEPKSAGRTSWDALMEKLFTRDEDGKLIVKKDMAKEIVVE

SEQ ID NO: 7119 - DNA, 1604 bp, Panicum virgatum
  misc_feature: Ceres CLONE 1901141
  misc_feature: Encodes the peptide sequence at SEQ ID NO. 7120
agctcgatcctccctcccctcctcctcgtccctatcattcccgttgcggcattgccccaatttagcgcggagacgggcgcgccgacctcccattctcgctacccgcccgccattctcgctccgcagcggcggcagggcgccccggcagcgggagcagcgaaacacgcgagctaaaaacgggcaccgcgcgcgcgatccccggcacccgcgcccgccggccttacattgccagcccgggccctcggcattgggggaggttccggcgttgcgccgtcgttcccgcgtgttgcgttgattcctcgaaccaacgcgcggcgcggggtcccggccatggcgcagctgccgcccaagatccccgccatggcgccggcatggcccgagttcgggggcgggcaccaccaccacgcccaccaccatcaccagcgcagcccctccgtgggcacgttcctcgccgcgcccatgcccccgctcccgctccccccgccgcagcagccgtcctgggtcgaggagttcctcgacttcacggccgccaagcgcggcgcgcaccgccgcaccgtcagcgactcggtcgccttcctcgagcccggccccgacgacggcaatgccgcgcacgacttcgaccgcctcgacgacgaccagctcctgtccatgttctcagacgacctcccgccgccgccgccgccacagcagcaggccgctcccgtggcgagctcgtcgtcgccgtccgaccacaacagcatcaatgacgagaagacggacagggccgagaccgaggaggcgcagagcaagtgccacggggactgcgccgccgccgcgccggggcagccggcctccgccgccgcagttgatcccaagcgcgtcaagaggatcctggcgaaccggcagtccgcgcagcggtcgcgcgtgcgcaagctgcagtacatctcggagctggagcgcagcgtcacgtcgcttcagacggaggtgtcggcgttatccccgcgcgttgccttcctcgaccaccagcgctcgctgctgacgctggggaacagccacctcaagcagcggatcgccgcgctcgcgcaggacaagatcttcaaagatgctcatcaagaggccctgacgaaggagatcgagaggctgaggcaaatctaccaccagcagagcctgaagaacgccgagtcgtccccgacgcccgacgcggccccgatccgcagcgacaaggacctgatcgccagcgaggggaccgcggcgcccgcgccctgcccgccctcgtgatgaggccggagaccatccggtcgctgtagtgggtggggggtggggtggggggggggaggtggcctccgcctgtcgtccatgacaacgagaggtgtcgctgcttgggtttgtgcattccttgggggtgtaatcgtgatgttaaggagagtctcgattgatttggttttgttcattctcgcatcctactctgctgctggctgcctgctgctcctccttccacctccctgatttgtaatttttgtttgggcattttgggcgaaggttgttgtaggtaagagaccaaatgtaattcagattggttgaggtcgatttgtgtgtttggggtggttttgtatctgatcattcgg

SEQ ID NO: 7120 - protein, 308 aa, Panicum virgatum
  misc_feature: Ceres CLONE 1901141
  misc_feature: Great-hit functional homolog of the protein sequence given in SEQ ID NO 9690
  misc_feature (1)..(64): Pfam Name: bZIP_1 Pfam Description: bZIP transcription factor
  misc_feature (3)..(64): Pfam Name: bZIP_1 Pfam Description: bZIP transcription factor
  misc_feature (2)..(55): Pfam Name: bZIP_2 Pfam Description: Basic region leucine zipper
  misc_feature: The sequence is a functional homolog of  SEQ ID NO 1363 in the  10/374,780 US patent application
  misc_feature: The sequence is a functional homolog of  SEQ ID NO 1364 in the  10/374,780 US patent application
  misc_feature: The sequence is a functional homolog of  SEQ ID NO 1483 in the  10/412,699 US patent application
  misc_feature: Useful for making plants with altered carotene content
  misc_feature: Useful for making plants with modulated growth and phenotype characteristics
MAQLPPKIPAMAPAWPEFGGGHHHHAHHHHQRSPSVGTFLAAPMPPLPLPPPQQPSWVEEFLDFTAAKRGAHRRTVSDSVAFLEPGPDDGNAAHDFDRLDDDQLLSMFSDDLPPPPPPQQQAAPVASSSSPSDHNSINDEKTDRAETEEAQSKCHGDCAAAAPGQPASAAAVDPKRVKRILANRQSAQRSRVRKLQYISELERSVTSLQTEVSALSPRVAFLDHQRSLLTLGNSHLKQRIAALAQDKIFKDAHQEALTKEIERLRQIYHQQSLKNAESSPTPDAAPIRSDKDLIASEGTAAPAPCPPS

SEQ ID NO: 7121 - DNA, 1537 bp, Panicum virgatum
  misc_feature: Ceres CLONE 1901200
  misc_feature: Encodes the peptide sequence at SEQ ID NO. 7122
ctgaggcctcagctatagcctacagctgcagcagcagagcgccagcaccggaccacgtcaaccctagctccccgcttccccgtgcccatggtgtccatgagcacaacgccgcaccctctcgattccccgacggcaccgggcaaggaggaagaggcgcgcccgatgcgcctgcgccaggccgccgcgcccatggccctgccgctgggggacgacgacgacgaggggcccaggagggtgcgaaagccctacaccatcaccaagtcgcgcgagagctggaccgaacccgagcacgacaagttcctcgaggcgctgcagctgtttgatcgtgattggaaaaagattgaagcgtatgttggctccaagactgtaatacagatcaggagtcatgcgcagaagtactttttgaaggttcaaaagaatggaacaggtgaacatttgcccccgcctaggccaaaacgtaaggctgcccatccatatccacacaaagcatcgaaaaaagcacttcaagttgtcttaccgcaacaaacatctcatataatggagcaaggctgtggtacatctatggatacagctactgttgctacggacttaagtgcaaatgatgcttttccttcttgggagaatgatcctgttcaacatttaagtccgaggcatacacaaggttcaggtgcaacaaataattactctagtagcataggtagccaatctggaacttggccaacttctaaagctacagagcaagatatcatgcttccagcactgcgagccatgccagactttgctcgtgtatacagtttccttggaagcatatttgatccagagacaaatggacatttgcaaaagttgaaggaaatggatcctattgatgctgaaacggtactgttgttgatgaaaaatctttcgatcaacctaaccagcccaaactttgaggaacataggaggttgctttcttcacatggctcaaacatggaccaagatactggctcttctcacaccattcatcttccgttcatgataacgagcaaatgagagaaggtcccctcctgcgagcacccaagggtttggagtctgtagcgtggaagcgtgctggatgctagccgcatgttatagtttcgcatgtgtacatagcttttggtaatgccctaaccaccttaggctggttttgctcatcatgtagatggccagctagtttatgcgcatgtgattctttgccccttcagttttccctattttaacctatgtgtgagcctgccaccaagtatgagccaggtggtttgttatggtatgcttattgtcgatacctttttcccccacaaggaaggatggatggatggtatacaatgatatgtagtttttgcagtggtatgcaatggtatgtgtataggctaacaaactgctgttgtaatgcatagttgagagtgcatgattctgcagcagttcatgtcaaggactcctccgaatgatattgtattgaagaatggtggcagatgtaacataaataaaattcagttgcccttaaaaaaaaaaaaaaaaaaaa

SEQ ID NO: 7122 - protein, 313 aa, Panicum virgatum
  misc_feature: Ceres CLONE 1901200
  misc_feature (1)..(46): Pfam Name: Myb_DNA-binding Pfam Description: Myb-like DNA-binding domain
MVSMSTTPHPLDSPTAPGKEEEARPMRLRQAAAPMALPLGDDDDEGPRRVRKPYTITKSRESWTEPEHDKFLEALQLFDRDWKKIEAYVGSKTVIQIRSHAQKYFLKVQKNGTGEHLPPPRPKRKAAHPYPHKASKKALQVVLPQQTSHIMEQGCGTSMDTATVATDLSANDAFPSWENDPVQHLSPRHTQGSGATNNYSSSIGSQSGTWPTSKATEQDIMLPALRAMPDFARVYSFLGSIFDPETNGHLQKLKEMDPIDAETVLLLMKNLSINLTSPNFEEHRRLLSSHGSNMDQDTGSSHTIHLPFMITSK

SEQ ID NO: 7123 - DNA, 1816 bp, Panicum virgatum
  misc_feature: Ceres CLONE 1901299
  misc_feature: Encodes the peptide sequence at SEQ ID NO. 7124
cgtcccctcccccagctgcacgcaacgcaataacccacgcgtcgccaccctcccttcttccttggtctcttcgctcccagtcctcccccccaccgttccgaagcttccacgcctcgcctcgcctctccaggctcccccgcgcgcgctccgaggccagatccgcgccgccgctctgctcgagggcggcggaggccggcgcggggaggcggcaggcgaggtagcttccggccgggtaggcgggcgggctagcgagctagctagctacctgagctgtggttgcgatggcggtggagaagacggcgccgggcgcggccgcggccgcgggggcggggaggaccgtgctggtcactggcggggcgggctacatcggcagccacgccgtgctgcagctcctcctcgcgggcttccgcgccgtcgtcgtcgacaacctcaacaactcctccgagctcgccgtccgccgcgtcgccgcgctcgccggggaccactcccgcaacctatccttccacaagatcgatctccgtgacaagggagcactggaaatggtttttgcttcaacaagatttgatgctgtcgtccacttcgctgggctaaaagctgtgggtgaaagtgtgcagaagccattgctatattatgacaacaatgtcattgggacagtaaatcttctagaagttatgtctgctcacggttgcaagaagttggtgttctcatcatcagctgcagtttatggatcacccaagaactcaccctgcacagaagagtttcctctgactccaaacaatccatacggcaaaacgaagcttgttgttgaggatatttgccgtgacatctaccgttcagatcctgaatggaagatcattttactaaggtacttcaatccggttggtgcacatcctagtggataccttggtgaagacccatgtggaattcccaacaatcttatgccctacgttcagcaagttgctgttggaaggaggccagctctgacagttttaggaaatgactatgcaacaagagatgggactggggtccgagattacatccatgtggttgaccttgctgatggacatattgctgcattgcagaagctttttgagaactctagcatagggtgtgaagcatacaaccttggaactggaagaggtacatcggtgctggagattgttaaagcattcgagaaggcttctgggaagaaaattcctctgatttttggttcaagacgccctggtgatgcagagatactgttttcagtgactgctaaagcagaaagggagcttaactggaaagcgaaatacggcattgatgaaatgtgtcgcgaccagtggaactgggctagcaagaacccctatggttacggatcgcctgattccaccaaacagaatggccaccaaacaaatggatctgttgattcccccaggcagaatggtcaccacacaaatgggtcagttggctcacccaggcggaacggacactgtgggcatgggtcagctgactcacccagggggaacggccactatgcgtatggatcatctgactccaggcagaatggcaatggccgcctgcaatgagccgagtcagtctggcctgtgagccccctgtacattctgtatcgagaacccaccatccgagattgatgtgtatcaatcggttggcatacagtatagagtcgatggcagcagaattccagtttgttgtgggtaaacctattatttcctacgttggtatttattctttccttctttcaaacgtgtaggaatgtggtcatagtgtatcggctgattctattcgttgctgctaattgagctgcactgcgctttat

SEQ ID NO: 7124 - protein, 427 aa, Panicum virgatum
  misc_feature: Ceres CLONE 1901299
  misc_feature (1)..(264): Pfam Name: Epimerase Pfam Description: NAD dependent epimerase/dehydratase family
  misc_feature (1)..(264): Pfam Name: Epimerase Pfam Description: NAD dependent epimerase/dehydratase family
  misc_feature (16)..(360): SWISSPROT Homolog: EC 5.1.3.2 UDP-glucose 4-epimerase
  misc_feature (16)..(363): SWISSPROT Homolog: EC 5.1.3.2 UDP-glucose 4-epimerase GEPI48
MAVEKTAPGAAAAAGAGRTVLVTGGAGYIGSHAVLQLLLAGFRAVVVDNLNNSSELAVRRVAALAGDHSRNLSFHKIDLRDKGALEMVFASTRFDAVVHFAGLKAVGESVQKPLLYYDNNVIGTVNLLEVMSAHGCKKLVFSSSAAVYGSPKNSPCTEEFPLTPNNPYGKTKLVVEDICRDIYRSDPEWKIILLRYFNPVGAHPSGYLGEDPCGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGSRRPGDAEILFSVTAKAERELNWKAKYGIDEMCRDQWNWASKNPYGYGSPDSTKQNGHQTNGSVDSPRQNGHHTNGSVGSPRRNGHCGHGSADSPRGNGHYAYGSSDSRQNGNGRLQ

SEQ ID NO: 7125 - DNA, 1682 bp, Panicum virgatum
  misc_feature: Ceres CLONE 1901324
  misc_feature: Encodes the peptide sequence at SEQ ID NO. 7126
gaggtcagacgctgacccgccgcactccgcgacagagccaagaacacgcggtgacgcctttgcggccgccgcgcagccccccccccgccacaccgccccgcacgggcatccacgtcgcgcctccgtgcacgcacacgaccgccagcgcgatccctcctcaaaaccggcgtgccgtgcccatccggggcagcgccaccgccggatccgacggcctcgggggcggggccgcccgaagcagcaccgaaagcagcggaaacgcgcgctgctccggacggatcgggccggcgccgcgccgcctccgactctgctccgcgccggctccggcgcggggcgtcgccgagatgggcgcggacggcgggctgaaccgggcggcggaggcgccccagcaggggagggagggcggcgacgcgagggtgttccggtgcacggactactcgctgccgcggacgacgctggcgctggcgctctggctgggcggcatccacttcaacgtcctcctcgtcctcgcgtccctcttcctgctctccctccgcgccgccgccatagtggtggccgtccagctcttcttcatgttcgtccccgtcaacgaccgggacaaatggggacggagcattgccaggttcatattcaggcacgcaatgggctacttcccgatcaccctgcatgtggaggactacaaagccttccaccccagcagggcgtacgtgtttggttacgagccacactccgtgctaccgataggactgtcggctcttgctgatcttgttgggtttatgcctctgactaaggtcaaggtcctcgcgagcagcgcggtgttctataccccgttcttgaggcagatttggacatggcttggattggtacccgcgacaaggaagaatttctatttctaccttagagctggctatagttgtatcgtagtgccaggtggtgtccgggaaatgcttcatatggataatgattcagaggttgctttccttaaatcaagaaaaggctttgtcaagatagctatgcaatctggctgccctttggtccctgttttctgttttgggcagagctatgcatacaagtggtggaggccaggtggcaagttgtttgtcaagattgctagagcagttaaatttactcccattatcttctggggaagattcgggacaccctttccctttccaagaccaatgcatgtggtcgtgggtaaacctattgaagttgataaaaatccccagcctacgattgatgagattaatgaagtccatgagcagttcatcattggcttgcgggagctgtttgagaagtacaaggaaaaagctggatatcctggcctccatctaagagtcctatgacattccagtaccaggctccagttaggatttagcaataacgtggcccttcgctgctctcctgaagttccaaactgtgcacttcgcgtgcattcagtctgtagttgctgcgttgtggtgatggtcataaggctcctagctctgatgtgaaaacgtgcattggatgctcatgagtctgaaagccttcagttgcttgcttaactttggtggatgaaatgcgtatgtaacgatagccagataggtactctgaatacaaattacgtaatattgcagtcatgaagattggtgagataagctcccagctttaatcttctgaaataaaaacgagtaatacgggtgctt

SEQ ID NO: 7126 - protein, 333 aa, Panicum virgatum
  misc_feature: Ceres CLONE 1901324
  misc_feature (1)..(237): Pfam Name: DAGAT Pfam Description: Diacylglycerol acyltransferase
MGADGGLNRAAEAPQQGREGGDARVFRCTDYSLPRTTLALALWLGGIHFNVLLVLASLFLLSLRAAAIVVAVQLFFMFVPVNDRDKWGRSIARFIFRHAMGYFPITLHVEDYKAFHPSRAYVFGYEPHSVLPIGLSALADLVGFMPLTKVKVLASSAVFYTPFLRQIWTWLGLVPATRKNFYFYLRAGYSCIVVPGGVREMLHMDNDSEVAFLKSRKGFVKIAMQSGCPLVPVFCFGQSYAYKWWRPGGKLFVKIARAVKFTPIIFWGRFGTPFPFPRPMHVVVGKPIEVDKNPQPTIDEINEVHEQFIIGLRELFEKYKEKAGYPGLHLRVL

SEQ ID NO: 7127 - DNA, 1514 bp, Panicum virgatum
  misc_feature: Ceres CLONE 1901343
  misc_feature: Encodes the peptide sequence at SEQ ID NO. 7128
agatctccagccgatccgtgagctccccggttcgcccaaaccacggcaaccatggccgccgccagctaccactccccagcgcgcatcgccatctcctgctccgccgcctcctcgtccgcgccgggacgcccgctgcgcgtggccgtggtgggcggcggccccgcgggcgcctcggcggcggaggcgctggcctcgtcgggcgcccggacgttcctcctcgagcgcagccccgcgggcgccaagccctgcggcggcgccatcccgctctgcatgctggacgagttcgccatcccgcgggacctcgtggaccgccgcgtgacccggatgcgcgtggtctccccgtccaacctcgccgccgacttctcccgcgcgctgccccccggggcgcacatccccatgctccgccgcgaggtgctcgactccttcctccgctgccgcgcggtcgacgccggggcggagctcgtcccgggcctcgtcacctcgctctcgctccccgcggggcccgccgatccctaccgcgtccactacatctcctcctccgcggcggaggggcaggaccggggcgtgctggaggtggacgccgtcgtgggcgcggacggcgccaacagccgcgtggcgcgcgaggtgggcgccgggggctactcgacggccatcgcgttccaggagcgcatccggctccccgacgccgccatggcgtactacgacgacctcgcggagatgtacgtgggcggggacgtgtccccggacttctacggctgggtgttccccaagtgcgaccacgtcgccgtcgggaccggcaccgtcgccgccaagccggagatcaagcgcctccaggcgggcatccgcgcgcgcgccgggcccaaggtcgccggcggccgcgtggtcaaggtggaggcgcacccgatcccggagcacccgcgcccgcgccgcgtcgtgggccgcgtggccctggtcggcgacgcggcggggtacgtcacgcggtgctccggcgagggcatctacttcgccgccaagtcggggcggctgtgcgggcaggccatggcggaggagtgggcgcgcacgggcgccgtgacggaggccgggctgaggcgcgggtacctccggcggtgggatgacgagttcctgctcatgttccggttcctggacctgctgcagcgcgtgttctacggcgggaacgccgggcgcgaggcgctggtggagatgtgcgccgacgagtacgtgcagcggcggacgttcgagagctacctgtacaagcggatggtgcccggcaagccgtggggcgacctccggctgctgtggcggacggtgggcagcatggtgcggtgcggcgtcatcggcagggaggtggagcgcctgcggcggctcgagctgcaagcctagagagtccctagcactgtgctgaataatgtggctgcgctgcaatggatttctgaatgcatttagaatttcatatcccttctcacggcttcagaacacatgaatttcaccggaaccaaaaaaaaaaaaaaaaaaaa

SEQ ID NO: 7128 - protein, 442 aa, Panicum virgatum
  misc_feature: Ceres CLONE 1901343
  misc_feature (1)..(34): Pfam Name: Pyr_redox_2 Pfam Description: Pyridine nucleotide-disulphide oxidoreductase
MAAASYHSPARIAISCSAASSSAPGRPLRVAVVGGGPAGASAAEALASSGARTFLLERSPAGAKPCGGAIPLCMLDEFAIPRDLVDRRVTRMRVVSPSNLAADFSRALPPGAHIPMLRREVLDSFLRCRAVDAGAELVPGLVTSLSLPAGPADPYRVHYISSSAAEGQDRGVLEVDAVVGADGANSRVAREVGAGGYSTAIAFQERIRLPDAAMAYYDDLAEMYVGGDVSPDFYGWVFPKCDHVAVGTGTVAAKPEIKRLQAGIRARAGPKVAGGRVVKVEAHPIPEHPRPRRVVGRVALVGDAAGYVTRCSGEGIYFAAKSGRLCGQAMAEEWARTGAVTEAGLRRGYLRRWDDEFLLMFRFLDLLQRVFYGGNAGREALVEMCADEYVQRRTFESYLYKRMVPGKPWGDLRLLWRTVGSMVRCGVIGREVERLRRLELQA

SEQ ID NO: 7129 - DNA, 1593 bp, Panicum virgatum
  misc_feature: Ceres CLONE 1901353
  misc_feature: Encodes the peptide sequence at SEQ ID NO. 7130
gcacaatttaccttttctcccttctctagaatagagctccactaccccacgccgccgccgcccgatcacccgcgtccccgcccgcccgagatggcagctccggcgccggcgccggcgccggcgccgctcaaggacgccgtgggcggcctcgaccgcgacggcttcgtcgccctcctctccaagctcatcggcgagtccgcgcgcctgcagaacgacccgccggtccacaggccgcaggaggacctcgtggcgcagcacgtcgtcgacgcgctccggccggtgtccaccgagaccgggggcggcccactcgtcgtgcggaaggtcagctacgccgagggcaggagcaacgtcatcgtcgagtacccaggcaccgtccccggccgcgtcgtctccttcgtcggcatgcacatggacgtcgtcccggccaaccccagcgagtgggactttgatcctttctcactaacctttgatagtgaagacaaggataagcttcggggacgtgggacaactgactgtcttggccatgttgcgctggtggctcagctaatgcggcggcttggtgaggtcaagccacccttgaagcattctgtcattgccgtgttcattgccaatgaggagaactcatctgtcactggcattggtgtcgatggcctcgtgaaggatggcttgcttgacaagctcaagactgggcccttgttctggatagacacagctgataagcaaccatgcattggcaccggtggaatgattccatggcacctcaaagcaacagggaagctgttccacagtggtcttgcacataaggccataaattcgatggagatgaacatggaagcactaaaagaaatccagaaaaagttttatactgacttccctccacatgagaaagagaaagtctataaatttgctactccatcgacaatgaagccaactaaatggagctatcctggtggagggcttaatcaaattcccggagaatgtacaatttcaggagatataaggttgactcctttctatagcacttcccatgtcgtggagaagttgaaggaatatgtagaggacataaatgagaggctcgagacaactcttgatacccgtggtcccgtgtccaaatatgttcttcctgatgaaaatctgcgaggaaggcttgaaatcagttttgatggagatgtgatgaatggggttgcctgcaatctggagtctcgaggctttaaagcattatgcaaagcaactgaggaaatagttggccatgtggaaccatattccatcaccgggagtctacctctgattagggaattacaggacgaaggatttgatgttcaaacagctggatatggcttactgaagacgtaccacgccaagaacgagtactgcttgttttcagacatggcccaaggctttcaggtatttgtgagcatcatttcacagctggaagaggtctgagccgtcttgcagggatagaagagtgccttcaattggaattactcgtgttgctcagtgaatcttttggaactctcttcattagtccgtgacacggacatctataataataagatgggattgttggcgctcgaaaaaaaaaaaaaaaaaaaa

SEQ ID NO: 7130 - protein, 450 aa, Panicum virgatum
  misc_feature: Ceres CLONE 1901353
  misc_feature (1)..(344): Pfam Name: Peptidase_M20 Pfam Description: Peptidase family M20/M25/M40
  misc_feature (1)..(329): Pfam Name: Peptidase_M20 Pfam Description: Peptidase family M20/M25/M40
MAAPAPAPAPAPLKDAVGGLDRDGFVALLSKLIGESARLQNDPPVHRPQEDLVAQHVVDALRPVSTETGGGPLVVRKVSYAEGRSNVIVEYPGTVPGRVVSFVGMHMDVVPANPSEWDFDPFSLTFDSEDKDKLRGRGTTDCLGHVALVAQLMRRLGEVKPPLKHSVIAVFIANEENSSVTGIGVDGLVKDGLLDKLKTGPLFWIDTADKQPCIGTGGMIPWHLKATGKLFHSGLAHKAINSMEMNMEALKEIQKKFYTDFPPHEKEKVYKFATPSTMKPTKWSYPGGGLNQIPGECTISGDIRLTPFYSTSHVVEKLKEYVEDINERLETTLDTRGPVSKYVLPDENLRGRLEISFDGDVMNGVACNLESRGFKALCKATEEIVGHVEPYSITGSLPLIRELQDEGFDVQTAGYGLLKTYHAKNEYCLFSDMAQGFQVFVSIISQLEEV

SEQ ID NO: 7131 - DNA, 2092 bp, Panicum virgatum
  misc_feature: Ceres CLONE 1901380
  misc_feature: Encodes the peptide sequence at SEQ ID NO. 7132
atcccaagttcccaacaaggcacaagccaccccgtctccgttccttcgagcccaatccttcgcctcgcagaagagggaagccgccccgccccgccccgccgcgtctcgcttccatccccatcacaccagcagcgcgagcatccccccgattacagctgcgtctccctcctccgctccgtcgcctctcggccggcccttccaagaagcctggtcgcatctcgtccccgccgccggccgcattcttgaacgaacttttaggaagggacaatttgtggatgctctaatggagtcaaaaggtggcaagaagtctagtagtagtaatttgatgtacgaagctccccttggttacaaaattgaggacgttcgcccagccggaggaatcaagaagttccagtctgctgcttactccaactgcgtccgcaagccatcctgatatcccttcacatgcaattcgcagtagagtaggattttccttcaatttttctctcttgtttgataattctcccttggctggctgcattctctgcttctgagattccaactcgtcttctcccatctctccctccctttcccatcctcccttgcaacacatcatctaatggcgatgccttcggctgattcttggggctcttctcctgcctcccctattgggtttgagggctacgagaagcgccttgagataacattctctgatgcacctgtctttgaggacccatgtggtcgtggccttcgcgccctctctcgcgagcagattgactcgttcttggatcttgcacggtgcaccatagtgtcccagctctcaaacaaggactttgactcgtatgttttgtccgagtcgagcctttttgtgtatccccacaaggttgtcctcaagacctgtgggacgacaaagcttctgctctccattcctcgcatccttgagcttgctgcagagctctcactgcctgttctttcagtgaagtactctcgtgggacgttcatcttccctggtgctcagccggcaccgcaccgcagcttctcggaggaggtatcagtgctgaatggtttctttggtggcctcaagtctggtggcaatgcatatgtaattggtgatgcattcaagcccaataagaaatggcacgtctattatgccgcggaggagcctgagcagcctatggtgacactggagatgtgcatgacttggctggatgttaagaaagcagcagtgttcttcaagaactccgctgatggccgttgctcatctgcaaaggagataacgaagctttcaggaatttctgagatcatccctgagatggagatctgtgactttgagttcgacccatgcgggtacccgatgaatggtgtctttggacctgcagcctccaccatccacgtgacacctgaggaaggcttcagttatgcaagctacgaagccatgaactttgatcctagctccatagtctacaacgatgtcatcaagagggtcctggcaggcttctctccttcagacttttcagttgctgttaccatctttggtgggcatgggtttgccaaatcatgggcaaagggtgcagacattgactcctacatgtgtgatgatcttgtcgagcaggagcttcctggtggtggtctgctgatgtaccagagctttactgctattgcgcctggtactgtgtcgcccaggtcgaccttggagatggatggatggagcagtgatggaatggagacctttgtgaacagtgatgagatgtgtatctgttgggatgcaaagaagaaggtggtgaagaaagatgtggatgcgtgagaaagattgggtggttcttcacctcgagttgcgagttcaaggattgaggcttctgagacctctgttggccctgttctattttcggttaagcgctggctgggctaccggcaagcataataatcttatgttcttttatattttcctgcttaataagtgctctagatggtttactgcgtctgccatagtgagtttatcatctgtttatgctgccgatgcccttgtggggagaatgatcttgtaataactttgttctcaatcaattattggaatttggaatctccagtttatcaaaaaaaaaaaaaaaaaaaa

SEQ ID NO: 7132 - protein, 394 aa, Panicum virgatum
  misc_feature: Ceres CLONE 1901380
  misc_feature: Great-hit functional homolog of the protein sequence given in SEQ ID NO 9373
  misc_feature (2)..(333): Pfam Name: SAM_decarbox Pfam Description: Adenosylmethionine decarboxylase
  misc_feature (1)..(334): Pfam Name: SAM_decarbox Pfam Description: Adenosylmethionine decarboxylase
  misc_feature (2)..(333): Pfam Name: SAM_decarbox Pfam Description: Adenosylmethionine decarboxylase
  misc_feature (2)..(335): Pfam Name: SAM_decarbox Pfam Description: Adenosylmethionine decarboxylase
  misc_feature (2)..(332): Pfam Name: SAM_decarbox Pfam Description: Adenosylmethionine decarboxylase
  misc_feature (2)..(333): Pfam Name: SAM_decarbox Pfam Description: Adenosylmethionine decarboxylase
  misc_feature (1)..(390): SWISSPROT Homolog: EC 4.1.1.50 S-adenosylmethionine decarboxylase proenzyme
  misc_feature (13)..(358): SWISSPROT Homolog: EC 4.1.1.50 S-adenosylmethionine decarboxylase proenzyme
  misc_feature: Useful for making plants with modulated nitrogen use efficiency
MAMPSADSWGSSPASPIGFEGYEKRLEITFSDAPVFEDPCGRGLRALSREQIDSFLDLARCTIVSQLSNKDFDSYVLSESSLFVYPHKVVLKTCGTTKLLLSIPRILELAAELSLPVLSVKYSRGTFIFPGAQPAPHRSFSEEVSVLNGFFGGLKSGGNAYVIGDAFKPNKKWHVYYAAEEPEQPMVTLEMCMTWLDVKKAAVFFKNSADGRCSSAKEITKLSGISEIIPEMEICDFEFDPCGYPMNGVFGPAASTIHVTPEEGFSYASYEAMNFDPSSIVYNDVIKRVLAGFSPSDFSVAVTIFGGHGFAKSWAKGADIDSYMCDDLVEQELPGGGLLMYQSFTAIAPGTVSPRSTLEMDGWSSDGMETFVNSDEMCICWDAKKKVVKKDVDA

SEQ ID NO: 7133 - DNA, 1787 bp, Panicum virgatum
  misc_feature: Ceres CLONE 1901450
  misc_feature: Encodes the peptide sequence at SEQ ID NO. 7134
aattcccctcccccgtcttctgatttctggtggccgcgaaaccgatagcggcagagagggaggcacagcacgaagagctcgttggtggcatcaagcgagccgggcaaagtccacgagcgcgagcgcgaccgagatcagagcttctccttcgtcgcagtggtggggaacgcggcgagcgcttccgtgatgggcgcgggcgcccaggaggatgaggaggagacggccgtggttgccgagggaggaggaggaggaggcggagggggggaggaggagcagctggcggcggagggcgacggggagaaggagcaggtgggggagggcggggaggagaaggccgcggcggtggtgtcgtgctcgatctgcctcgacagagtggtcgtcggcggcgaggagaggtccaccgcgaggctgcagtgcggccacgaattccatctcgattgcattggttcagcatttaatgccaaaggaattatgcaatgccccaattgtcgcaaaattgagatggggaattggctttatgcaaatggtccccgatcatcacaagatgcaaacaatgatgaatggggctatgatgaagaccattatgatgttgctcactcagatatggcaacctttgtgccacttcacatccagtggtgtccagttgggcgcttaccagctttgttagaagaattagagaccgcaccgccagctacttttaatgattttatggggccaaacttcaattcggagcacatggctgtatctgtacctggcacagctcatccaggtccatatctcgcttactttcagcctgtgccaccgccagcaccatcaagctcccatgttgctgagagaacaatggatgttgctgcatatcatgatcactggaaccctctggctggaccatcagatggccgaccagcgcagacagtacatcccattgacttccataataacccctgggcacatatgttgcactcctattctcaatccaacaacaataatggtgtagctgagcagccagtactcccagttggggcaatgagggttggaggggttgacagtgatagccaacgaggatctcttccctcattttatggaaacgggtctggagcacctaggatcccaagtgttcctcctatggcaccacaattcataagagcaaatggcaacataaatgatcaatttcagcagagttctagcttatttgctgggtcacagcgatcaggaggcatgcatccgctaggagctggtgggcctgccgtgccacctccagatagcacctccttttgcctgttcccaccagcttcatcgggccctagtacaatggggactgaggatgtcagaggaaaccagttctatgcctgggagagggaccgccttgctccttaccctctggtttccacaaataatgaaggtacctggtggagctcttcacaacagcagcagcctcatggcttaccagagcctgcatctgcctcaagaaggctgcccaggcagtggattggtggcgctgctaggtcgcaaccacaggagaatagattgccagatgactcaccattccgtccaatgcacatccctcggatgtagcgcagtgccagtaaggcctaagttaatagcacagatttgctgttggttgtaagatgcggaaacaccgttgtaagaaagtccggttggatggtaaaccttgagataatgtggaggatgctgaacaaaatgacctgaggcgaaaacatttcgacttgggtttatctgattccatgaagtacataggttgacccttttaaaaaaaaaaaaaaaaaaaa

SEQ ID NO: 7134 - protein, 461 aa, Panicum virgatum
  misc_feature: Ceres CLONE 1901450
  misc_feature (1)..(46): Pfam Name: zf-C3HC4 Pfam Description: Zinc finger, C3HC4 type (RING finger)
MGAGAQEDEEETAVVAEGGGGGGGGGEEEQLAAEGDGEKEQVGEGGEEKAAAVVSCSICLDRVVVGGEERSTARLQCGHEFHLDCIGSAFNAKGIMQCPNCRKIEMGNWLYANGPRSSQDANNDEWGYDEDHYDVAHSDMATFVPLHIQWCPVGRLPALLEELETAPPATFNDFMGPNFNSEHMAVSVPGTAHPGPYLAYFQPVPPPAPSSSHVAERTMDVAAYHDHWNPLAGPSDGRPAQTVHPIDFHNNPWAHMLHSYSQSNNNNGVAEQPVLPVGAMRVGGVDSDSQRGSLPSFYGNGSGAPRIPSVPPMAPQFIRANGNINDQFQQSSSLFAGSQRSGGMHPLGAGGPAVPPPDSTSFCLFPPASSGPSTMGTEDVRGNQFYAWERDRLAPYPLVSTNNEGTWWSSSQQQQPHGLPEPASASRRLPRQWIGGAARSQPQENRLPDDSPFRPMHIPRM

SEQ ID NO: 7135 - DNA, 1430 bp, Panicum virgatum
  misc_feature: Ceres CLONE 1901457
  misc_feature: Encodes the peptide sequence at SEQ ID NO. 7136
gcgcactcgcccaaaaaaaaaaaaaactcgaagcttcccccgttccgttcagagcgccctgccggcctgcccaaatcccagcgtccgccgccgcgccccgccctcgtcgcgatctcccgcacaaatacccgatccgtccgccatggctggaataaggctgacgcccgaggagcccgagatgcccgtcggcacgccgccccgcccccagctcccggcatccgtcgccggagcaggcggtggtagcgggggcctcgaaatggcgtcggacgacgagcggtccgtggcggccgactcgtggtccgtgcggagcgagtacgggagcacgctcgacgacgaccagcgctacgccgacgccgcggaggtgctcgccgctgccgcggcctccgccaacttcccctccgccgcctccgattactgttctgataaggaagatcaagaccctggtgatgttgaaggatcaatgctgggtctccaaagctactgggatgcttcttattcagaagatcttgcaaattttcaggaacacgggcatgctggagaaatatggtttggtgcagatgtaatggatacagttgctgtttggacaaagagtttgtgtaacattattcaaggcgggattccatctggtcctgacagcatcaaaagtgaagtcgatgaacaattattctccaactaccctgtgctcgatgttggaactgggaatggccttctcttgcaagcacttgctaagcaggggtttagagatttaacaggaactgattacagtgaaggagccgttgaacttgcaagaaaccttgctactcgtgatggcttcgattcaataaaatttttggttgatgatatattagagacaaatttagataggaaattcaaaattattacagacaaagggactttggatgccattggattgcatccagatggtcgagcgaaaagaataatgtattgggagtctgtatcaaacttggttgagcctggtggcattgtggtcgtaacatcatgtaatcacacaaaggatgagcttctgcaagaagtagaagacttcagcaagagaaaatttggcaaggagaacatggatgaaggtgcaagacctgtgtcccagatcttccggtacatagatcatgtccgaacataccccaccataatgtttgggggagttgagggatctcaagtgtccaccgtggcctttcaacggatgtaacagagaattgaggcacgcatcatacttggtccaataccattttcgctctagaaggaaagttctttacttcacttgtgggactgttcccactgtatctgtctgaacgtgttatagtaagggaatcttccgaaccatttttgtgtaattgtaaacggacatgagatgcattgatgttgctgtattgttaatgtaccgtgaactttcctgataaaaaaaaaaaaaaaaaaaa

SEQ ID NO: 7136 - protein, 352 aa, Panicum virgatum
  misc_feature: Ceres CLONE 1901457
  misc_feature (1)..(102): Pfam Name: Methyltransf_12 Pfam Description: Methyltransferase domain
MAGIRLTPEEPEMPVGTPPRPQLPASVAGAGGGSGGLEMASDDERSVAADSWSVRSEYGSTLDDDQRYADAAEVLAAAAASANFPSAASDYCSDKEDQDPGDVEGSMLGLQSYWDASYSEDLANFQEHGHAGEIWFGADVMDTVAVWTKSLCNIIQGGIPSGPDSIKSEVDEQLFSNYPVLDVGTGNGLLLQALAKQGFRDLTGTDYSEGAVELARNLATRDGFDSIKFLVDDILETNLDRKFKIITDKGTLDAIGLHPDGRAKRIMYWESVSNLVEPGGIVVVTSCNHTKDELLQEVEDFSKRKFGKENMDEGARPVSQIFRYIDHVRTYPTIMFGGVEGSQVSTVAFQRM

SEQ ID NO: 7137 - DNA, 1969 bp, Panicum virgatum
  misc_feature: Ceres CLONE 1901465
  misc_feature: Encodes the peptide sequence at SEQ ID NO. 7138
catctctgagcgctgccttgctggctctgcgcctctgcctcgcctccctccaggaccccctcccctccctctcatctctccccgctctctcgcacccctcctcccggtctggttgcttctcctgtagttttttttgttctatctcgcttcgcttccgcgcttcaaataccctgtggagcggagcgggtgctctgatctgtctgcctgttcatcgatcgagtctgggaggcttggaaggaggagggggaagcaaagcggaacagcccatctttttttagtcttttcggttcggtttcctggttgcttcttttggatcccgcggaggagcccaccgtttctacaaaaccccaatctttgctgccctctccgcggccgagatcgataggtttccagacccctggctcagagatcgcgggcgcggcaatccggcgcgctgctactagggaaaaatatcctagaaaagattttgcgggtgcgacggggcaggaagaaggtattggggaacacaagggtaaaggaatggtcttcgtggccaagtgggcgatggggcggtggcggagatgagggatgctatcgactgtgatggattacttgagatcttgctgggggccggcctcgccggccgggcgcccccgcagaggatcggacgctgccggccgccaggacgggctcctgtggtacaaggacggcgggcaggttgtcgacggtgagttctccatggccgtggtccaggccaacaacctgctggaggaccatagccaagtggaatccgggccgctcagcgcaacggaccccagcctccaaggcaccttcgtcggcgtctatgatgggcatggtggcccggagacggcgcgctacatcaatgatcatctcttcaaccacctgaggggatttgcatctgagcacaagtgcatgtcagcagatgtgatccggaaggctttccgagcaaccgaggaggggtttatttctgtagttagtaaccaatggtcattgaggcctcaattagcagcggttggctcttgctgtcttgttggcgtgatttgcagtggaactctatatattgcaaaccttggggattcccgtgctgttcttgggagactagtcaagggaactggagaggttttggcaatgcagctctcagcagaacacaatgcatcctatgaggaggttagacgagagctgcaggcagcccatcctgacgatccccatattgtggtcctaaagcacaatgtttggcgtgtgacgggcatcatccagataacaaggtcaattggagatgtatatctgaaaaaaccagagttcaatagagaacctttatactccaagtttcgycttccggaaactttcaggagaccacttcttagttctgatccagcaattactgtacaccaaatacagccaactgataggttcatcatttttgcatctgatggactctgggagcatcttagtaatcaggaagctgttgacatggtccagagtagccctcgaaatggaatcgctcgaagattagtaaaggctgcaatgcaggaagcagcgaagaagagggagatgaggtattccgacctcaagaaaattgatcgcggggtgaggaggcacttccatgatgatataactgtcatcgtggtttttttcgattcaaatgccacggcaactgctgcctggagcagacccacagtctctctccgtgggggtggtgttccaatcccttcgaacacccttgctccattctcagttcccacagagctaaacagctcttactgaaaccatactggagatgaaggggccaggcaagaagatcaaaagaaagtaaaagaaaaggtaaaaagaaaaaaagaagaaaaaagagtagcagttgtgatcagctgtagtgtattttgtcgtctgccgtgttcttgtaaaaccttttttagattctcaacctggtgactagcgtactgatagcaagatataagattagattattctt

SEQ ID NO: 7138 - protein, 398 aa, Panicum virgatum
  misc_feature: Ceres CLONE 1901465
  misc_feature (1)..(279): Pfam Name: PP2C Pfam Description: Protein phosphatase 2C
MLSTVMDYLRSCWGPASPAGRPRRGSDAAGRQDGLLWYKDGGQVVDGEFSMAVVQANNLLEDHSQVESGPLSATDPSLQGTFVGVYDGHGGPETARYINDHLFNHLRGFASEHKCMSADVIRKAFRATEEGFISVVSNQWSLRPQLAAVGSCCLVGVICSGTLYIANLGDSRAVLGRLVKGTGEVLAMQLSAEHNASYEEVRRELQAAHPDDPHIVVLKHNVWRVTGIIQITRSIGDVYLKKPEFNREPLYSKFRLPETFRRPLLSSDPAITVHQIQPTDRFIIFASDGLWEHLSNQEAVDMVQSSPRNGIARRLVKAAMQEAAKKREMRYSDLKKIDRGVRRHFHDDITVIVVFFDSNATATAAWSRPTVSLRGGGVPIPSNTLAPFSVPTELNSSY

SEQ ID NO: 7139 - DNA, 1500 bp, Panicum virgatum
  misc_feature: Ceres CLONE 1901600
  misc_feature: Encodes the peptide sequence at SEQ ID NO. 7140
agcatcaaggctcacacactcgcccgcacaccagctctctcgcacagccgccgccgcagctgcggcctcttggcgccgtcgccgggattccgtttccctcccgcgaggttctgtttccagaatgtcctgctcagttggaagcagcaaggttacaagggtgctattctgcggcccctattttcctgcttctactatttacaccaaggagtatttgcagagctatccatttattgaggttgacgaagtaggccttgagcaggtacctgatgttattcaaaattaccatatatgtgtagtaaaaaatcggcgcatagattcagatatcattgccaaggcaacccagatgaagattattatgcagtatggtgttgggttagaaggcgttgatgtaaatgctgctactgagcacaaaattaaagttgcacggatacctgggagcaagacaggaaatgcggtgtcttgtgcagagatggcaatttatcttaccctcggtgttctgcggaagcaaaagttgatggataatgctgtcaatcagaaggacctgggcagtccaacaggagaaacaatatttggaaaaacagtccttatcctggggtttggagccattggcgtggaaattgccaagaggctaaaaccatttggcgtaaaaattcttgctacaaaaagaaattggtcattaggctcattgtcatgtgatattgaggggcttgtagataaaaaaggtggaccagaagatatgtatgaacttgctggagaagctgacatagtcataacatgcttgctacaaaccagtgaaacagttggaattgttgataatatgttcctcacagtgatgaaaaaggggtcatatctggtcaatattgctagaggacgtctattggactacaaggctgtgtttggtcacctcgagtcaggtcatttaggtcttttgggcattgatgttgcttggacagaaccatttgatccaaatgatccaattctgaaattctcgaatgttattttaacaccacatgtggctggagtcacagaatactcttacagaactatggcaaaggttgttggtgatgttgctctccagcttcattcaggagagccattcaccggaattgaatttgtgaactagatccagaggtggcagccggccttgatgttgtctgctgaattcagacagggtactggaattgtttgtgtgtgagacgtgcattgttccaagtgcatagggaataacttatcggcaatgccagtaagaaataattgtcgctctcccgaaattgaatttgggtgaagcaaaattacacattgcagcaggtctatccacattgatctgcacaaaagaaacaagaatagtgttttttttgccttattttcgcatagatattgcttagaagtaaaacagtttcccagcaagtggggctgaatgccattgtacgtgttctctttgtcaattatgtagttgataaaatttgttcggaatcattacaaaaaaaaaaaaaaaaaaaa

SEQ ID NO: 7140 - protein, 333 aa, Panicum virgatum
  misc_feature: Ceres CLONE 1901600
  misc_feature (1)..(276): Pfam Name: 2-Hacid_dh Pfam Description: D-isomer specific 2-hydroxyacid dehydrogenase, catalytic domain
MSCSVGSSKVTRVLFCGPYFPASTIYTKEYLQSYPFIEVDEVGLEQVPDVIQNYHICVVKNRRIDSDIIAKATQMKIIMQYGVGLEGVDVNAATEHKIKVARIPGSKTGNAVSCAEMAIYLTLGVLRKQKLMDNAVNQKDLGSPTGETIFGKTVLILGFGAIGVEIAKRLKPFGVKILATKRNWSLGSLSCDIEGLVDKKGGPEDMYELAGEADIVITCLLQTSETVGIVDNMFLTVMKKGSYLVNIARGRLLDYKAVFGHLESGHLGLLGIDVAWTEPFDPNDPILKFSNVILTPHVAGVTEYSYRTMAKVVGDVALQLHSGEPFTGIEFVN

SEQ ID NO: 7141 - DNA, 2007 bp, Panicum virgatum
  misc_feature: Ceres CLONE 1901644
  misc_feature: Encodes the peptide sequence at SEQ ID NO. 7142
gaaccacatcgcgtcgcgtcatccactccgccgcacacgcgctccccgctccgcaacgacgccggaaatggtcgccgccgccgccgccgccatggccaccgccgcgtccgctggcgtgcctccactcagcgggccccgcggcctcgcgcggcaccgcagccgcggtgtcatcgtgcgctgcgccgcggtggcgggcggcgcggccgaggcgccggcctccgcgggcgcgcgggcggccgcggactgcgtcgtggtgggcggcggcatcagtggcctctgcaccgcgcaggcgctggccacgaagcacggcatcggggacgtgctcgtcacggaggcccgcgcccgccccggcggcaacatcaccaccgtcgagcgccccgaggaagggtacctctgggaggaggggcccaacagcttccagccctccgaccccgtcctcaccatggccgtggacagcgggctcaaggacgacttggtgtttggggacccgaacgcgccgcggttcgtgttgtgggaggggaagctgaggcccgtgccatccaagcccgccgacctcccgttcttcgacctcatgagcatccctggcaagctcagggctggctttggggcgctcggcatcagaccgccgcctccaggccgtgaggagtcagtggaggagttcgtgcgccgcaacctcggggctgaagtctttgagcgcctcattgagcctttctgctcaggtgtctatgctggtgatccttccaagctcagtatgaaagctgcatttgggaaggtgtggcgcctggaagaggctggaggtagtatcattggtggaaccatcaagacaattcaggagaggggcaacaatcccaaaccacctagggatccccgccttccgaagccaaaggggcaaacagttgcatctttcaggaagggtctcgccatgcttccaaatgccattacatccagcttgggtagtaaagtcaagctttcctggaaactcacgagcattacaaaatcagatggcaagggatatgtattggtgtatgaaacacctgaaggggttgtttcagtgcaggctaaaagtgttatcatgacgattccatcatatgttgctagtgacatcttgcgtccactttcaagcgatgctgcagatgccctttcaagattctattatccaccagttgctgctgtaactatttcgtatccaaaggaagctattaggaaagaatgcctaattgatggggagcttcaaggatttgggcagttgcatccacgtagtcaaggagttgagacattaggaacaatatacagctcatcactctttccaaatcgtgctcctgctggaagggtgttactcctaaactacataggaggtgctacaaacacaggaattgtttccaagagtgaaagtgatctggtagaagcagttgaccgtgacctcaggaaaatgctaatcaaccctagagcagtggaccctttagtcctcggtgtccgagtgtggccacaagccatacctcagttcctggtaggacatcttgatcttctggaggctgcaaaatctgccctggaccgaggtggctacgatgggctgttcctcagaggaaactatgtagcaggagttgccctgggccgatgcgtggagggtgcctatgagagcgcctcgcaaatatctgacttcctgaccaagtacgcctacaagtgatgaaagaagtggagctgctcgttattttgcataggtgagaatgaaaccaggagcgcacaaagtttacgagcattttccatcttatctcctaagttctgctacttctgatcttttttccctgttagtaattagttagattgtagggctgtagggcattgttctgtaattctgttcgccatcctacaaaacacattttctttcacgttaacccacgagatctattaagactcgtgtagagttttcgtgcgaacactagttccagcaaaaatcaaatactatcttgcaagagcaaacataatgtcgaaaaaaaaaaaaaaaaaaaa

SEQ ID NO: 7142 - protein, 538 aa, Panicum virgatum
  misc_feature: Ceres CLONE 1901644
  misc_feature (1)..(381): Pfam Name: Amino_oxidase Pfam Description: Flavin containing amine oxidoreductase
  misc_feature (1)..(463): Pfam Name: Amino_oxidase Pfam Description: Flavin containing amine oxidoreductase
  misc_feature (1)..(459): Pfam Name: Amino_oxidase Pfam Description: Flavin containing amine oxidoreductase
  misc_feature (1)..(459): Pfam Name: Amino_oxidase Pfam Description: Flavin containing amine oxidoreductase
  misc_feature (1)..(462): Pfam Name: Amino_oxidase Pfam Description: Flavin containing amine oxidoreductase
  misc_feature (1)..(459): Pfam Name: Amino_oxidase Pfam Description: Flavin containing amine oxidoreductase
  misc_feature (151)..(503): Pfam Name: Amino_oxidase Pfam Description: Flavin containing amine oxidoreductase
  misc_feature (1)..(462): Pfam Name: Amino_oxidase Pfam Description: Flavin containing amine oxidoreductase
  misc_feature (1)..(463): Pfam Name: Amino_oxidase Pfam Description: Flavin containing amine oxidoreductase
  misc_feature (1)..(463): Pfam Name: Amino_oxidase Pfam Description: Flavin containing amine oxidoreductase
  misc_feature (17)..(538): SWISSPROT Homolog: EC 1.3.3.4 Protoporphyrinogen oxidase, chloroplast precursor
  misc_feature (37)..(538): SWISSPROT Homolog: EC 1.3.3.4 Protoporphyrinogen oxidase, chloroplast precursor
MVAAAAAAMATAASAGVPPLSGPRGLARHRSRGVIVRCAAVAGGAAEAPASAGARAAADCVVVGGGISGLCTAQALATKHGIGDVLVTEARARPGGNITTVERPEEGYLWEEGPNSFQPSDPVLTMAVDSGLKDDLVFGDPNAPRFVLWEGKLRPVPSKPADLPFFDLMSIPGKLRAGFGALGIRPPPPGREESVEEFVRRNLGAEVFERLIEPFCSGVYAGDPSKLSMKAAFGKVWRLEEAGGSIIGGTIKTIQERGNNPKPPRDPRLPKPKGQTVASFRKGLAMLPNAITSSLGSKVKLSWKLTSITKSDGKGYVLVYETPEGVVSVQAKSVIMTIPSYVASDILRPLSSDAADALSRFYYPPVAAVTISYPKEAIRKECLIDGELQGFGQLHPRSQGVETLGTIYSSSLFPNRAPAGRVLLLNYIGGATNTGIVSKSESDLVEAVDRDLRKMLINPRAVDPLVLGVRVWPQAIPQFLVGHLDLLEAAKSALDRGGYDGLFLRGNYVAGVALGRCVEGAYESASQISDFLTKYAYK

SEQ ID NO: 7143 - DNA, 1546 bp, Panicum virgatum
  misc_feature: Ceres CLONE 1901674
  misc_feature: Encodes the peptide sequence at SEQ ID NO. 7144
agccgcaggcttcggaaccgagaacagcagcaatggcagccgcagccgtggcctccagccccaccccgcggccgctccgcctggcgccgcgccgggctctcggcggcgcgcccgaccacgtcaacgccccgcccctccgcgcccgcttgaggccgcggctcgccgtgtcggcctcggccgggccggaggcggaggcggaggcccgcggcggcgagcggttctacttcaacttcaccgggttccccttcccgctcgggcccttcctcaacagccgcaccatccgcaccgaggcggtgaagggcagcatatggctgttccagcaggagcaggcgctgggcttcagcagcgtctccaccaacacccgcatgaccgtcatcaggctcaagtccggcgggctctgggtgcacgcacccatcgcgccgaccaaggagtgcatccagctgctcaaggagttgggcgcgccggtggagcacatcgtgctgccgaccttcgcgtacgagcacaagatcttcgtcgggcccttctccaggaagttccccaaggcgcagatatgggtggcgcccaggcagtggagctggccgatcaacctgccgctagagttcttcggcatcttccgggccaagcccctcaaggacgaggacgacgccaccccgtgggccgccgagatcgagcagaaggtgctcagctcgccggaagttgggattgagccatacgtggaggtggctttctaccataagccttcaaagacattgctggtgacggatgctgtcatctttgttccgcggcagcctccggagtgtatcagcaaagaatctttgttagcttctgccaagaacggattggcagtaaagttattgagcaaagggaaagaggttccagatgaaccagttgtggacaatacactgaatcgtcagaaaggatgggaaaggatggtgcttcaaatactgtttcttggcccctcaaatcttcttgagccaaatgcaagttttgctcaaatgtcacaaaaattgatcgtctcaccaattgtcaagacactcgttttcagcaaagttccagagaaggtgagggattgggtcgacaggatcactgccgactggccattccgacggataatcccttgccattttttggccccaatcaacgcgagccgatcagacttcctggccgccttcgccttccttgatgagctgctccctgatcgccctgccccggtgcctggcctctccctgctatttgcctcgttcatggggaaggcggccagctacttccctcctgacgacatgaagacgctttcgtcgctggacgagttcttggtttcggttggtgctgtcaagaagaccgtctccggaaggaagaggtgatgcggagacagctggtggattgtgcatagttttgtaaggaaacatagttgctcatgcttggagcacgggttacactgtcaaatctgtacgtagttagtggacaaaaactggtccattttaggctatgacataggaaagagtacatgtatcttcttgccttcaatagaaaagccagattttactgc

SEQ ID NO: 7144 - protein, 442 aa, Panicum virgatum
  misc_feature: Ceres CLONE 1901674
  misc_feature: Great-hit functional homolog of the protein sequence given in SEQ ID NO 9528
  misc_feature: Useful for making plants with modulated flowering time
  misc_feature: The plant flowers significantly late compared to wild-type.
MAAAAVASSPTPRPLRLAPRRALGGAPDHVNAPPLRARLRPRLAVSASAGPEAEAEARGGERFYFNFTGFPFPLGPFLNSRTIRTEAVKGSIWLFQQEQALGFSSVSTNTRMTVIRLKSGGLWVHAPIAPTKECIQLLKELGAPVEHIVLPTFAYEHKIFVGPFSRKFPKAQIWVAPRQWSWPINLPLEFFGIFRAKPLKDEDDATPWAAEIEQKVLSSPEVGIEPYVEVAFYHKPSKTLLVTDAVIFVPRQPPECISKESLLASAKNGLAVKLLSKGKEVPDEPVVDNTLNRQKGWERMVLQILFLGPSNLLEPNASFAQMSQKLIVSPIVKTLVFSKVPEKVRDWVDRITADWPFRRIIPCHFLAPINASRSDFLAAFAFLDELLPDRPAPVPGLSLLFASFMGKAASYFPPDDMKTLSSLDEFLVSVGAVKKTVSGRKR

SEQ ID NO: 7145 - DNA, 1897 bp, Panicum virgatum
  misc_feature: Ceres CLONE 1901704
  misc_feature: Encodes the peptide sequence at SEQ ID NO. 7146
agagagagagaggtcagtatagtttcaccaatcatttgtcatgctagtagtacttactactagtttaaaaccagagagataatggataggataggaatagagaggagaggggagagaggtgctgtggggagaggatacgctgctgctagcttctgagttctgaatctcttacgctttagaactcgtcatcctgcgcttcattgtcaggcttggagcaagcagtcctcaatatcttctgttcagtggtgaatggccaaagacactgacaacctcaaggcgccatgagcacacggagcattattgctgtgaagcaactaactggccctgacagaatggcacacacatgcactgctccgcagccttcaggtcatagtctgttcagtgctaaatccgatcactgtggttcagcgcatgatccgcagtcatcatgtgctgctcaatcctcgagcgttaagtcagagatgattggttcgttgagtctgacaaagatccttcctcctgaccttcataaacggagtcctgagtccaatcctgaaagttctgcttctcgcgcgtcacaagcccaactgtcggatccaatttcatctagttcttccacattctgcacaagtatgttctcctcgttcaagacaagctccgaatcgtgccagcaaaaaggcgctctgcctttcctaccccatcctcctaaatgtgagcagcagcagccgcagatttcggctcggcagtcatccagctcttcactgctctttggtgctgacctcagcaatggtggtcatgacgatgttgaacattcaggagatctcaaggactttcttaacctttctggagacgtttcagaaggtagtttccatggagaaagcaatgtcatggctttcagtgagcagatggagtttcagttcttgtctgaacagctcggaatggccatcaccaacaacgaagaaagccctcgattagatgacatctacgaaagaccaccacaagcctcttcttgtacagtgccatctttctctgaccaagaaaacctcccgagcgcggcatctattgtcaaagttccgctgagttcaccccgagctgaagcatgtaacaaaccaagactgaggtggacactggagctccatgagcgttttgtagaggctgtcaacaagcttggaggaccagaaaaggcaacaccaaagggtgtgctgaagctcatgaaggtagaaggcttgaccatctatcatgtgaagagccatctgcagaaatatcgtttcgccaagtatcttccagagacaaaacaagataagaagtcctcttcagaaggcaagaaatctcaatcggtaataccaggaaatgatgccgacaaaaagaagagcttacaagtagcagaagctcttcggatgcaaatggaggttcagaaacaacttcatgaacaattagaggtgcaaaggcaactacagctgcgcatagaagaacatgcaagatatttgcagaagatattagaacaacaacaaaaggcaaggaactccttatccaccacgagaaattcaacaaaagaggaagcgccagaatccacagagaaagaggaaaccaagatgaaagaggacacctcttcagatccactgtcaaggcgcaaaatttcagatactgacctggaatgcaattcgtgagtcacaagtggataacaacagtgcaaaggctcaggatgatcttgagaaggacacactatgttcatatctttgatgaacatggtgattggttgaatatttgcttctttttccttgtagaattttagcacttgcgcctagatgctgatctttcttctatgtatcttatgaccatgaccaactagtactgcgatgagtttagccgttgtatatgattaactttcagatgaaaatggaacaacaattgttcatac

SEQ ID NO: 7146 - protein, 454 aa, Panicum virgatum
  misc_feature: Ceres CLONE 1901704
  misc_feature (1)..(52): Pfam Name: Myb_DNA-binding Pfam Description: Myb-like DNA-binding domain
MSTRSIIAVKQLTGPDRMAHTCTAPQPSGHSLFSAKSDHCGSAHDPQSSCAAQSSSVKSEMIGSLSLTKILPPDLHKRSPESNPESSASRASQAQLSDPISSSSSTFCTSMFSSFKTSSESCQQKGALPFLPHPPKCEQQQPQISARQSSSSSLLFGADLSNGGHDDVEHSGDLKDFLNLSGDVSEGSFHGESNVMAFSEQMEFQFLSEQLGMAITNNEESPRLDDIYERPPQASSCTVPSFSDQENLPSAASIVKVPLSSPRAEACNKPRLRWTLELHERFVEAVNKLGGPEKATPKGVLKLMKVEGLTIYHVKSHLQKYRFAKYLPETKQDKKSSSEGKKSQSVIPGNDADKKKSLQVAEALRMQMEVQKQLHEQLEVQRQLQLRIEEHARYLQKILEQQQKARNSLSTTRNSTKEEAPESTEKEETKMKEDTSSDPLSRRKISDTDLECNS

SEQ ID NO: 7147 - DNA, 1435 bp, Panicum virgatum
  misc_feature: Ceres CLONE 1901856
  misc_feature: Encodes the peptide sequence at SEQ ID NO. 7148
aattcccctccccactcctcatccccgctccccgaaaggccgaaaccccccgaatcgaatccggcggagttcgatttggggatttcgacgcctcgcccccggaaatttcttggatctgaggccggccgtcgtcttcgatctgcggctggagcgagtcggcaagttttccggctcgattttggtcgggggggtagggggttttggttgcggagatggagtcgtctccggtgtcctactggtgctaccactgcagccgcttcgtgagggtgtctccggccaccgtcgtctgcccggagtgcgacggcggcttcctggagcagttcccacagccaccgccgcggggcggcggcgggagcggccggcgcgggacgatgaacccggtcatcgtgctccggggcggatcgctttccggattcgagctctactacgacgacggcgcgggcgacgggctgcggccgctgcccggcgacgtccagcacctcctcatggggtccggtttccaccgcctgctcgaccagttctcgcggctggaggcggcggcgccgcggccgccggcgtctaaggctgcggtggattccatgccgtccgtgacgatttccggaagcggggctcactgcgcggtgtgccaggaggcctttgagcccggcgccgccgggcgggagatgccgtgcaagcatgtctaccaccaagactgcatcttgccatggctatccctccgcaactcgtgccccgtttgtcgtcaagagcttccggccgcagccaccccagatgctgaggcggatgctgggctcaccatctggcgacttccgcgcggtggatttgccgtagggaggtttgccggcgggcccagagagcagctcccggtcgtctacaccgagctagatgggggcttcagtaacggagtcggcccgaggagggtgacatggccagagggagaagggcaagtggatggtggtgaaggtcggattcgccgtgtatttaggaatctgtttggctgctttggtcatggcagccgccaagcgagttcgtcgcaatctcgtagtggctgagcacagttttccttggtaactcattttcaattgatagtgctgaagaactagggttagtgtaagaagggaacccagattataatttcttgggattgatgtaaatgaaggtcttgcattatccccacttttgtcccatttaagaattacagagagatggttatgagtaaacatcttggagtgagcgtgacaagcaaactagttcaaagaagcacttcaagaaagtaatagcaatgaatgttggggaaatcagtccttggaaaaattgtagttagagagaatttctgtatttacatccctactatttgtgtacatactggatcaagatgaactgccatttggctatatcttatattgatataacaatccaaaaaaaaaaaaaaaaaaaa

SEQ ID NO: 7148 - protein, 278 aa, Panicum virgatum
  misc_feature: Ceres CLONE 1901856
  misc_feature (1)..(41): Pfam Name: zf-C3HC4 Pfam Description: Zinc finger, C3HC4 type (RING finger)
MESSPVSYWCYHCSRFVRVSPATVVCPECDGGFLEQFPQPPPRGGGGSGRRGTMNPVIVLRGGSLSGFELYYDDGAGDGLRPLPGDVQHLLMGSGFHRLLDQFSRLEAAAPRPPASKAAVDSMPSVTISGSGAHCAVCQEAFEPGAAGREMPCKHVYHQDCILPWLSLRNSCPVCRQELPAAATPDAEADAGLTIWRLPRGGFAVGRFAGGPREQLPVVYTELDGGFSNGVGPRRVTWPEGEGQVDGGEGRIRRVFRNLFGCFGHGSRQASSSQSRSG

SEQ ID NO: 7149 - DNA, 1148 bp, Panicum virgatum
  misc_feature: Ceres CLONE 1902056
  misc_feature: Encodes the peptide sequence at SEQ ID NO. 7150
acgcacccctgcttacttaacaccccaactggtgccttgcccctgtggtcttccccaagcctccttgatccacttctccgacgatcctgcctggtcctcgcacacaacacccaccgccccgtctcctctcctactagtagtagctctccacagcttcttctctctctacggctcgacaaggagagagaaaggcgtccagcagcagcagctgatccgcccgggaacgcagcgcaggcgaagcatggagcaatacgacgagctctttcctcccgcctacgtggactcctcccccaacctcctggtgcccaacggcacggcgcaaggggagaggccgagagcgcggcacaggaggcggcgtgcggcgaggtgcggcggcggcgacggcggcggcgagctggacggtggaggggaccccaagaagcggcggctgagcgacgagcaggtggagatgctggaactgagcttccgggaggagaggaagctggagaccggccggaaggtgcacctggccgccgagctcgggctcgaccccaagcaggtcgccgtctggttccagaaccgccgcgcccgccacaagagcaagctgctcgaggaggagttcgccaagctcaagcaggcacacgatgccgccatcctccacaaatgccacctggagaacgaggtgatgaggctcaaggagaggctggaggtgaccgaggaggagctggcgcgggtcagatccgccgcggggagccacgctgtctccggcgacggcggggacgccatgggccgcgtcgtctgcagcgggagcccgagctcgtccttctccacgggcacctgccagcagccgtgcgtcggcggcggcgatcacctcggggacgacgacctgctctatgtccctgactacgcctacgctgacaacagcgtggtggagtggtttagcctgtatggaattggaatgatgtaagagagcgtgaagcgatcagtgatggtgtgtcgtcagattaattctagctactagctagagtcatcacggtgtcattgctgtgtgctgatttctaagtgtgcgcgtttaattatgtacataaaccaagttcttaatcagtggcaaaaaaatagccagctagctactaccagtacttgaatttcaaaaaaaaaaaaaaaaaaaa

SEQ ID NO: 7150 - protein, 234 aa, Panicum virgatum
  misc_feature: Ceres CLONE 1902056
  misc_feature (1)..(55): Pfam Name: Homeobox Pfam Description: Homeobox domain
  misc_feature: The sequence is a functional homolog of  SEQ ID NO 581 in the  11/479,226 US patent application
  misc_feature: Useful for making plants with modulated growth and phenotype characteristics
MEQYDELFPPAYVDSSPNLLVPNGTAQGERPRARHRRRRAARCGGGDGGGELDGGGDPKKRRLSDEQVEMLELSFREERKLETGRKVHLAAELGLDPKQVAVWFQNRRARHKSKLLEEEFAKLKQAHDAAILHKCHLENEVMRLKERLEVTEEELARVRSAAGSHAVSGDGGDAMGRVVCSGSPSSSFSTGTCQQPCVGGGDHLGDDDLLYVPDYAYADNSVVEWFSLYGIGMM

SEQ ID NO: 7151 - DNA, 1132 bp, Panicum virgatum
  misc_feature: Ceres CLONE 1902084
  misc_feature: Encodes the peptide sequence at SEQ ID NO. 7152
accccgaccgaccgtcgagccgtggtacccgccctcgtcgcaggaaccgctccagtcgagtaagttgcgctccgtgacgaacctcactcgccggagcaccaccgacaaggcagagatggccgaggaggtgaagcacctggagacgcgcgcggccgagcgccccgtgtggctcatgaaatgccccacagtcgtctcccgcgcatggcaggaggccgccgccgccgccacgtccaacccagaggccggcggcgccaaccctaaccctaacccggtggtcgccaaggtcgtcctctccctcgaccccctccgcgacgagcagcctaccaagttgaagatggagatggctcaaacaaacaatggaaatacaccaaagagttactctctgaatatgtacaacgactttgtgccaatgtgcatcttttctgagtctaaccaagggaaatatgcatgtgaagggaaagttgagaacaagtttgacatgaaacctcatagtgaaaatcttgcggaatatggaaaattatgccgtgagagaaccaccaagtgtatggctaaaccaagaagagtggaggtacttgcggatgaccatggaagccgcatgagacccatgcctggcatggttggcctgatgccttcttctgctacaaatgcaaaggagaagaagaaaccagtaccaccacgatcttttgaaacgaaaagaacacgaaggggtcgtacagaaatggagaatatcctattcaagcttttcgagaggcagccaaattggtcgctaaagcagcttatgcaagagacagaccaaccggagcaattcctgaaggagatactgaacgacctctgtgtctacaataaaagaggaccgaatcaagggacgcacgagctcaagcctgaatacaagaagtcgacagaagacgacaatgctacatgaagaagttcttcctctgattcgccaaacatgagttccccagtctcgactgattggaactccagcctattagttgctccgtataagcagtcgctgatgcttggttgggctgccccttgcaactttgcacgtttttgccactggcagccatatgagactatgaatgtgaggaaccgcccaaattatcccgatcaaaaaaaaaaaaaaaaaaaa

SEQ ID NO: 7152 - protein, 268 aa, Panicum virgatum
  misc_feature: Ceres CLONE 1902084
  misc_feature: Great-hit functional homolog of the protein sequence given in SEQ ID NO 9600
  misc_feature: Useful for making plants with altered Lignin content
MAEEVKHLETRAAERPVWLMKCPTVVSRAWQEAAAAATSNPEAGGANPNPNPVVAKVVLSLDPLRDEQPTKLKMEMAQTNNGNTPKSYSLNMYNDFVPMCIFSESNQGKYACEGKVENKFDMKPHSENLAEYGKLCRERTTKCMAKPRRVEVLADDHGSRMRPMPGMVGLMPSSATNAKEKKKPVPPRSFETKRTRRGRTEMENILFKLFERQPNWSLKQLMQETDQPEQFLKEILNDLCVYNKRGPNQGTHELKPEYKKSTEDDNAT

SEQ ID NO: 7153 - DNA, 1291 bp, Panicum virgatum
  misc_feature: Ceres CLONE 1902101
  misc_feature: Encodes the peptide sequence at SEQ ID NO. 7154
gaagctatcttcacatttgtctctcacctgaaagcaccagatctggagaaaatggctcctaaattagtctttgttctgccaattgtgctcctcggctgggcattccaggcgattctccggcctcctgccgcaaaactgtgtggctccccaggtggccctcctctcacatctccgaggatcaagctcagggatggaaggtaccttgcatacagagaagatggagtacataaagacaaggccaggtacaagatcatcacaatacatgcatttgatagcaccaaggacatacccttgcctgtttccaaggagcttgtggaagaactgggaatttacctccttgcttttgatagagctgggtatggggaaagtgacccaaatcccaggcgcgatgtaaagagcgaggcactggatatcgaggagctcgctgaccagctggaacttgggcagaagttctatgtcttggggacctctatgggaggatactcagtttggggatgcctccagtatatacctcacaggctcgcaggtgctgcgctagttgttccggttatcaactactggtggccttcttttccagctgaactatccaggcaagccttcaagaaacaggtagtgccagagcagaggaccctgtggattgcacacaacgtaccttccttgctctacctgtggatgacccagaagtggctcccttcttctgcggctgccatgcaccaccctgaaatatttagcaagcatgatatggaggttcttcagaagatgatggcaatgccaagaaccatcgtgaataaatcaaggcaacaaggcacttatgaatcaatccaccgtgatttacttgtcgcttttggaaggtgggagtttgatcctatgaacattaccaatccatttcctcaaaatgagggttctgtacacatctggcaaggatatgaagacaggttggtgcttgttgagctgcagaggtacatttcgaagaaacttccatggattaagtaccatgaagtcccagaaggtggacatatgttcatgctggtagatggatggactgaccgaattctcaaggcactcttggtaggagaagagccctcagctgtgtgacagtagatccattttcaaaatgctgaaaagccagcggctattcagtttaattttttcttctattgtattcctacaacatcaagactggtctaattcataatatgttatactgtcactttaagctattgttctccgacatatcatgtaattgcaacagcatgtgagaccatggtattaaaaaaaaaaaaaaaaaaaa

SEQ ID NO: 7154 - protein, 347 aa, Panicum virgatum
  misc_feature: Ceres CLONE 1902101
  misc_feature (1)..(244): Pfam Name: Abhydrolase_1 Pfam Description: alpha/beta hydrolase fold
MAPKLVFVLPIVLLGWAFQAILRPPAAKLCGSPGGPPLTSPRIKLRDGRYLAYREDGVHKDKARYKIITIHAFDSTKDIPLPVSKELVEELGIYLLAFDRAGYGESDPNPRRDVKSEALDIEELADQLELGQKFYVLGTSMGGYSVWGCLQYIPHRLAGAALVVPVINYWWPSFPAELSRQAFKKQVVPEQRTLWIAHNVPSLLYLWMTQKWLPSSAAAMHHPEIFSKHDMEVLQKMMAMPRTIVNKSRQQGTYESIHRDLLVAFGRWEFDPMNITNPFPQNEGSVHIWQGYEDRLVLVELQRYISKKLPWIKYHEVPEGGHMFMLVDGWTDRILKALLVGEEPSAV

SEQ ID NO: 7155 - DNA, 1247 bp, Panicum virgatum
  misc_feature: Ceres CLONE 1902350
  misc_feature: Encodes the peptide sequence at SEQ ID NO. 7156
ctctcgccgccttgccgagccaattcaagcaaaacgatcgatcgacccgacccactccccgcggaggcccaagtgagggggagatggccgtccctgtccacctcgccgcctcatcccttgtgctcctcctcctcgtcctgctgctaccaccgctcctcgcgtccgcctgcgaccgctgcgtccaccgctccagggccgcctactacgcctcctcgctcaccctcgccggcggttcatgcgggtacggcgccgaggcggcgtccatgggcgccggcttcctcgccgccgcgggccccgcgctgtaccgggccggcgtcagctgcggcgcctgcttccaggtccggtgcaaggacaggaagctctgcgccgcggcgggcgcccgggtggtcgtcacggaccgcgccaggaccaaccgcgccgacctcgtgctcagcggcccggccttcgccgccatggcgcgccccggcatggccgcgcgcctcgccaagctccgcaccgtcgacgtcgagtacaagagggtgccgtgcgagtacaagcaccggaacctctcggtgagggtggagcagaagagccgcgcccccgccgagctgaccatcaggttcctctaccagggcggccagaccgacatcgtcgccgtcgacgtcgcgcaggttggttcgtccaactggaagttcatggcgcgcgactacggcccggcgtggagcacgagccaggcgccgccggggccgctgcagctcagggtggtggtgaccggcgggtacgacggcaagtgggtctgggccgaccgggaggtgctcccgcggcggtggcgtgccggcgaggtctacgacacgggcgtccagatcgccgacatcgcccaagagggctgctacccctgcgacacgcacgagtgggagtgacggcatgctcacccaagccgaagcttcctgccacgaccctcctccctgacactgcctgtttggccgggctttgatcagaggactagagatagacgacgattaacagacaagactgacagagtgacgtcgatcagagcccgaatccctcggcaaccttcgcttcttctccttgtccaaatccccccatgtacatgaactgctgatgtgtcggataagtagtagcctaagagtcacgaaggctgaaaaaaaaaagaataatgaaatgaaacgaaacgaaacgagtcgtctcacggcggcggggctgtcgccgccgccttcttgaacgtgaagcaacagctacttcccccc

SEQ ID NO: 7156 - protein, 271 aa, Panicum virgatum
  misc_feature: Ceres CLONE 1902350
  misc_feature: Great-hit functional homolog of the protein sequence given in SEQ ID NO 9546
  misc_feature: Useful for making plants with altered Lignin content
  misc_feature: Useful for making plants with altered cell wall content and/or composition
MAVPVHLAASSLVLLLLVLLLPPLLASACDRCVHRSRAAYYASSLTLAGGSCGYGAEAASMGAGFLAAAGPALYRAGVSCGACFQVRCKDRKLCAAAGARVVVTDRARTNRADLVLSGPAFAAMARPGMAARLAKLRTVDVEYKRVPCEYKHRNLSVRVEQKSRAPAELTIRFLYQGGQTDIVAVDVAQVGSSNWKFMARDYGPAWSTSQAPPGPLQLRVVVTGGYDGKWVWADREVLPRRWRAGEVYDTGVQIADIAQEGCYPCDTHEWE

SEQ ID NO: 7157 - DNA, 1410 bp, Panicum virgatum
  misc_feature: Ceres CLONE 1902421
  misc_feature: Encodes the peptide sequence at SEQ ID NO. 7158
ctttcctccctccttcctctgctttcgctcgcttccgatcaccagaaaaaggcctttctttcccgtcgccccctcggtggtcgctgcggcgcccgtctctaaaagcaaggcctcgtgggcgccgacgcggacgcagcagcaatttcgggagagggcgagatcggccgatcgctagctagctagctacctgctgcgggccggggacgggatgaagaagtgcgcgtcggagctggagctggaggccttcatccgcagccgggatgacgccgccgccgcggcggcggcggccgagcacaagcccggccacgacatcgccgcgcaggccgcgttcgccgcgggcgtgttctcccccggcgacctctccgggttcagcttcgccgactcgaacaccctcaacggaagcattcctaatcacctatggtcccataaccacaacgtgaggcatcctgcagtctccacgacaatcgagtcgcagtcatcgatctgtgcagcagcagcaagtccaacatcagcaaccaacctatatctgaaagagagccaaactctggggggcacaagtggttcagattccgatagcgaatcactgttggatatcgaaggcggtccatgcgagcaaagcacaaacccacaggacgtgaagagaatgcggcggatggtgtcgaaccgtgaatccgctcggcggtcaaggaagagaaagcaagcccacttagctgatcttgagacacaggttgaccagctgcgaggcgaaaatgcttcactcttcaagcagctgacagacgccaaccagcaattcacaactgcagtcacggacaacaggatcctcaagtcagatgtcgaggccctcagagtcaaggtgaagctggcggaggacatggtggcccgcggcgcgctgtcgtgcgggctgggcagcctggggctgtcgccggtcctgaacccgcggcaggcgtgccggggccccgacgtgctgtccgggctggacttcaccggcggcgacgacgcgtgcttcgcggggctgtccccgacggagcaggtccagaactcgccgctgcagagccttgccagcctcgagaacaggatgaacaacgaggtgacgagctgcggcggccccggcgtcgacgtctggccgtgggacgccggcctgtccaagtgaagaggaaagcgcacgccgatggcaagctactgccctgtacgcgtatcgatatgcattggtactatatatatatgaactgcaagtgtatgtcagctgccattgctatgtcagctggagtcgtgaactgaacggacttgagtttttcagagtcctcgtctcggtcggtatattgcctagtagttctgtaatacactaatactagaactgagtggctaactagctactcttatataattatatatgctaagagactgaactcg

SEQ ID NO: 7158 - protein, 313 aa, Panicum virgatum
  misc_feature: Ceres CLONE 1902421
  misc_feature (1)..(60): Pfam Name: bZIP_1 Pfam Description: bZIP transcription factor
  misc_feature (1)..(55): Pfam Name: bZIP_2 Pfam Description: Basic region leucine zipper
MKKCASELELEAFIRSRDDAAAAAAAAEHKPGHDIAAQAAFAAGVFSPGDLSGFSFADSNTLNGSIPNHLWSHNHNVRHPAVSTTIESQSSICAAAASPTSATNLYLKESQTLGGTSGSDSDSESLLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQACRGPDVLSGLDFTGGDDACFAGLSPTEQVQNSPLQSLASLENRMNNEVTSCGGPGVDVWPWDAGLSK

SEQ ID NO: 7159 - DNA, 1229 bp, Panicum virgatum
  misc_feature: Ceres CLONE 1902497
  misc_feature: Encodes the peptide sequence at SEQ ID NO. 7160
accaactccggcggccagcgtgcagctagcggtgctcgctcctctcctactcgtacgtcttcagatctgcttccagctagctagctactagctagtgccatcttcgtacgcaaagcttaccaggtagcttagcttggtgaacatggcgcctcaaagcttggaccttgggctgagcctcggcctgggcctggcggcgctgcagcccgacttctgctactccggcaataatgccggcgccgagcgggaggcgagcccggccgcggcggaggagagggagaggaggtgctcgcccgccggcagcccggtgtcgagcggcagcggaagtggtggaaaacgtgccgcggcggataggtcggccggcggcgccggcagcggcagcggcgacgaggacgacgacggggccgcgcgcaagaagctgcgcctgtccaaggaccaggccgccgtgctcgaggagtgcttcaagacgcaccacaccctcactccgaagcagaaggtggcgctggcgagcagcctgggcctgcggccgcggcaggtggaggtgtggttccagaaccgccgcgcccggaacaagctcaagcagacggaggtggactgcgagtacctcaagcgctggtgcgagcagctggccgaggagaaccgccgcctcggcaaggaggtcgccgagctcagggcgctcaacgccgcgccggcgccggcgcccccgctgaccaccctcacaatgtgcctctcctgcaggcgcgtcgcgtcgtcgtcgtcgtcgtccccctctagcgcgtccagcatccccgccacgcacgcctcgcacgcgcacgccgctgccaatgcgggcggcatggcgtgtccggcggcggcgacgttgcccggacacaggcagttcttctgcggattcagagacgccgccgccgcagcttacgggacttcatctgggctcgcaaaggctgtcaaggcggccagatagctgtccgctgatctgaaatttgctctgctctcaggctgatctgaaatttgtcatggaaatggcaaagtttaagttgcaactgcaaagcaattgtagctgaaaagtttaaatccttctctatcttttgagggaaatgcaaatgtagtttttaacaaagttattaggatcggttgttgatgagctccgaggatcgatgctgtaaatccatgtgaaaaaaaaagctgtggaaatcaataacagtagacgaagctaaaaaaaaaaaaaaaaaaaa

SEQ ID NO: 7160 - protein, 271 aa, Panicum virgatum
  misc_feature: Ceres CLONE 1902497
  misc_feature (1)..(55): Pfam Name: Homeobox Pfam Description: Homeobox domain
  misc_feature: The sequence is a functional homolog of  SEQ ID NO 568 in the  11/479,226 US patent application
  misc_feature: Useful for making plants with modulated growth and phenotype characteristics
MAPQSLDLGLSLGLGLAALQPDFCYSGNNAGAEREASPAAAEERERRCSPAGSPVSSGSGSGGKRAAADRSAGGAGSGSGDEDDDGAARKKLRLSKDQAAVLEECFKTHHTLTPKQKVALASSLGLRPRQVEVWFQNRRARNKLKQTEVDCEYLKRWCEQLAEENRRLGKEVAELRALNAAPAPAPPLTTLTMCLSCRRVASSSSSSPSSASSIPATHASHAHAAANAGGMACPAAATLPGHRQFFCGFRDAAAAAYGTSSGLAKAVKAAR

SEQ ID NO: 7161 - DNA, 1163 bp, Panicum virgatum
  misc_feature: Ceres CLONE 1902646
  misc_feature: Encodes the peptide sequence at SEQ ID NO. 7162
acatcaggctgggcatacctgaaagcgtgtacttgagagctgggcgtacagactgcgcagcatcgtccatggcttcttccagactctgtcggcctctcgtcgccgcgtccttcttggctgccttcgccgccgtgtccagcgccggcaaggtcgccgtttactggggccagggcggcggggagggaaccctcgcggacacgtgcgcctccgggctgtacgacttcgtgaacatcgccttcgtcagcgcgttcggcaacggcggcggccagcccccggtcctcaacctcgccgaccactgcgaccccgccgcgggcacctgcgccgtgttcagctccgacatccggtcgtgccaggcgagaggcgtcaaggtgctcatctccctcggcggcgccacgccgacctactccctcacctccgccgaggaagcgcgcgggctcgccgactacctgtgggacaacttcctcgggggcgcctcggcggcgtcccgcccgctcggcgacgcggcgctcgacggcgtcgacttcgacatcgagcagggcggcggcgaccactacgacgagctggccagggccctgtcgtcccggtgcggcggcgcgtgcctgctcacggcggcgccgcagtgcccgtacccggacgcgcacctcggcaaggcgatcgggacggggctgttcagccacgtgtgggtgcagttctacaacaacccgatggccaggtgccagtacgcgccgggcggcgcgagcgacctggaggacgcgtgggcgcggtggacggccgccgtgccgccgccggcggacgtcttcctgggcctcccggcggcggagagcgcggcggaaaacggcgggtacatcgacgcggacacgctgaagtcgcaggtgctgccggcggtgcgaggcgcggccaactacggcggcctcatgctgtgggaccgcgccagagacgccgcctcgggttacagcagcagcgtgcgcgggagcgtgtgaacgcttgccaagtgaactgctaataatctgctactaggtgacccgagcatgctcagctcagttgcgtccccctttctccttcaaatgataccctgctcggctacaagtcctgtaatctctatacacaaataaatgaatccgacgagtagttcttttttttttcaaaaaaaaaaaaaaaaaaaa

SEQ ID NO: 7162 - protein, 303 aa, Panicum virgatum
  misc_feature: Ceres CLONE 1902646
  misc_feature (1)..(262): Pfam Name: Glyco_hydro_18 Pfam Description: Glycosyl hydrolases family 18
  misc_feature (7)..(303): SWISSPROT Homolog: EC 3.2.1.14 Acidic endochitinase precursor
MASSRLCRPLVAASFLAAFAAVSSAGKVAVYWGQGGGEGTLADTCASGLYDFVNIAFVSAFGNGGGQPPVLNLADHCDPAAGTCAVFSSDIRSCQARGVKVLISLGGATPTYSLTSAEEARGLADYLWDNFLGGASAASRPLGDAALDGVDFDIEQGGGDHYDELARALSSRCGGACLLTAAPQCPYPDAHLGKAIGTGLFSHVWVQFYNNPMARCQYAPGGASDLEDAWARWTAAVPPPADVFLGLPAAESAAENGGYIDADTLKSQVLPAVRGAANYGGLMLWDRARDAASGYSSSVRGSV

SEQ ID NO: 7163 - DNA, 2133 bp, Panicum virgatum
  misc_feature: Ceres CLONE 1902742
  misc_feature: Encodes the peptide sequence at SEQ ID NO. 7164
attcctaatccgtgcggctccgtcgtcctcctcgtcctcgtttcttccaccccgcggccatcagagccaatccgccacggccgtgccagccaggcgaaaaggccacctccttccccttccccttcccctttccctttcccagccagcctttgaccgcagattcccgctctaaccttcccttcccttccacccaaggagccccgtggcataaatatacctctttggaatacccatcctcgtcaaagggagaggcgagctccagctccccacgagcctcagccctcaggagtcctgcaaggccggggagcaatggcagcggagtcgctgtccggtttcctggacatccgcgcggcggcgccgttcctggtggcggcggtggcgttctacttcctggtggagcagctgtcttaccaccgcaagaagggccccctgcccggcccgccgctcgtcgtgcccttcctcgggagcgtcgcgcacatgatccgcgacccgacggggtactgggacgggcaggcggcgcgcgccaagaagtccggcgcggggctcgccgcggacttcctggtcgggcggttcatcgtgttcatccgcgactcggagctgtcgcagcgcgtgttcgccaacgtccggcccgacgcgttccacctcatcggccaccccttcggcaagaggctcttcggggagcacaacctcatctacatgttcggcgaggaccacaaggacctgcgccgccggatcgcgcccaacttcacgccgcgcgcgctctccacctacgccgccctccagcagagcgtcatcctggcgcacctccggcggtggctcgaccggagcgccgccgagggcaagcgggccttcccgatacgggtcccctgccgcgacatgaacctggagacctcgcagacggtgttcgtggggccgtacctctccgaggcggcgcggcggcggttcgagcgggactacaacctcttcaacgtcgggctcatggccttgcccgtggacctgcccgggttcgcgttccggcgcgcgcggcagggcgtggcgcggctggtgctcacgctgggggagtgcgcgcgggagagcaaagcgcgcatgcgcgccggcggcgagcccgagtgcctggtggactactggatgcaggacacgctgcgggagatggaggaggccgcggcggcggggcgcccgccgccggcgcacaccgacgacgagaagatcggcgggttcatgttcgacttcctgttcgcggcgcaggacgcgtcgacgtcgtccctctgctgggcggtctcggcgctggactcgcacccggacgtgctggcccgcgtgcgcgccgaggtggccgcggtgtggtcgccggagtcgggcgagcccatgaccgcggagaagatccaggcgatgcggtacacccaggcggtggcgcgcgaggtggtccggcaccggccgccggcgacgctggtgccgcacatcgcgggcgaggcgttccggctgacggagtggtacacggtgcccaagggcgccatcgtgttcccgtcggtgtacgagtcgtcgttccaggggttcccggaggcggaggcgttcgacccggagcgcttcttctcggaggagcggcgggaggacgtggcgttcaagcgcaacttcctggcgttcggcgcggggccgcaccagtgcgtggggcagcggtacgcgctcaaccacctagtgctgttcatggcgctgttcgtgtcggtggtggacttccggcgggagaggacgccggggtgcgacgacccggtgtacatgccgaccatcgtgcccaaggacggctgcgtcgtgcacctcgcgcagcgctgcgccaagttcccgtccttctgaggctcctcctggtcgtcctgcctgcctgcctcctctgccgtgccatttttcttttcgatttcttggtggtggtggtggtggtggtggtgatttgtaggttgtggtgttggcttgctcgtgtctgctctgtggcggggacactccattcaattattttgttggcaattgggttgggttgggttggctgctccccagcctgtcgggaggaggaaggagacggtagagtgtcagtgtgaatgaatacgagtagtacaagtgggttggtgactgcaaaaaaaaaaaaaaaaaaaa

SEQ ID NO: 7164 - protein, 510 aa, Panicum virgatum
  misc_feature: Ceres CLONE 1902742
  misc_feature: Great-hit functional homolog of the protein sequence given in SEQ ID NO 9397
  misc_feature: Useful for making plants with altered sterol content
MAAESLSGFLDIRAAAPFLVAAVAFYFLVEQLSYHRKKGPLPGPPLVVPFLGSVAHMIRDPTGYWDGQAARAKKSGAGLAADFLVGRFIVFIRDSELSQRVFANVRPDAFHLIGHPFGKRLFGEHNLIYMFGEDHKDLRRRIAPNFTPRALSTYAALQQSVILAHLRRWLDRSAAEGKRAFPIRVPCRDMNLETSQTVFVGPYLSEAARRRFERDYNLFNVGLMALPVDLPGFAFRRARQGVARLVLTLGECARESKARMRAGGEPECLVDYWMQDTLREMEEAAAAGRPPPAHTDDEKIGGFMFDFLFAAQDASTSSLCWAVSALDSHPDVLARVRAEVAAVWSPESGEPMTAEKIQAMRYTQAVAREVVRHRPPATLVPHIAGEAFRLTEWYTVPKGAIVFPSVYESSFQGFPEAEAFDPERFFSEERREDVAFKRNFLAFGAGPHQCVGQRYALNHLVLFMALFVSVVDFRRERTPGCDDPVYMPTIVPKDGCVVHLAQRCAKFPSF

SEQ ID NO: 7165 - DNA, 1507 bp, Panicum virgatum
  misc_feature: Ceres CLONE 1902850
  misc_feature: Encodes the peptide sequence at SEQ ID NO. 7166
acgagcgacagccagtcaccacctacccgaagccgccgcgaccgatcgagccgagcgccgccgccgcctccgcggcagcggaggtcagcgcaatccccaacgctaaggttgcgcagccatccgccgtcgtacaggccgagcgtaacctgctcggctccgactccagccttgccgtccacgcgggcgagaggctgggaagaaggatcgccacggatgcgatcaccacgccagtagtgaacacgtcggcctactggttcaacaactcgcaagagctaatcgatttcaaggaggggaggcatgctagcttcgagtacgggaggtatgggaacccgaccacagaggcattggagaagaagatgagcgcactggagaaagctgaatccactgtgtttgtggcgtcggggatgtatgcagctgtcgctatgctcagcgcacttgtcccagctggtgggcacattgtgaccaccactgattgctaccgcaagacaagaatttacatggaaaatgagctccctaagaggggagtttcgatgactgttattaggcctgctgacatggatgctctccaaaatgcattggacaataataatgtatctcttttcttcaccgagactcctacgaatccatttctcagatgcattgatgttgagcttgtcgcaaatatgtgccatagcaagggagctctgctttgcattgacagtacttttgcctcccctatcaatcagaaggcactaactttaggtgctgacctagttattcattccgcaacaaagtacattgctggacacaatgacgttattggaggatgtgtcagtggcagagatgagttagtttccaaagtccgcatttatcaccatgtagttggtggcgttctgaacccgaatgctgcctacctgatccttcggggcatgaagacactgcatctccgtgtgcaatgtcaaaataacactgctctgcggatggcccaatttttagaggaacatccaaaggttgcacgtgtctactatcctggtttgccgagtcaccctgaacatcacattgccaagacccaaatgactggctttggtggtgttgtcagttttgaggttgctggggattttgacggtacaaggagattcattgattctgttaagataccctatcatgccccttcttttggaggctgtgagagcattatcgatcagcctgccatcatgtcttactgggattcaaaggagcagagggacatatacgggatcaaggacaacctgatcaggttcagcattggagtggaggatttcgaggatctgaagaatgatcttgttcaggcccttgaaaaggtctaatcacttgattcgttcactttaatattcatatcagatcacggttgtcctggatcttgagagatctgtgagaatatttgagccgatggctgccaataatttttctccttttgcttaatttgttctttcattccaataagttgagctctctgtactgtgcagtctaaaaaaaaaaaaaaaaaaaa

SEQ ID NO: 7166 - protein, 322 aa, Panicum virgatum
  misc_feature: Ceres CLONE 1902850
  misc_feature (66)..(385): Pfam Name: Cys_Met_Meta_PP Pfam Description: Cys/Met metabolism PLP-dependent enzyme
  misc_feature (66)..(385): Pfam Name: Cys_Met_Meta_PP Pfam Description: Cys/Met metabolism PLP-dependent enzyme
  misc_feature (66)..(385): Pfam Name: Cys_Met_Meta_PP Pfam Description: Cys/Met metabolism PLP-dependent enzyme
  misc_feature (39)..(358): Pfam Name: Cys_Met_Meta_PP Pfam Description: Cys/Met metabolism PLP-dependent enzyme
  misc_feature (1)..(322): SWISSPROT Homolog: EC 2.5.1.48 Cystathionine gamma-synthase, chloroplast precursor
MSALEKAESTVFVASGMYAAVAMLSALVPAGGHIVTTTDCYRKTRIYMENELPKRGVSMTVIRPADMDALQNALDNNNVSLFFTETPTNPFLRCIDVELVANMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEEHPKVARVYYPGLPSHPEHHIAKTQMTGFGGVVSFEVAGDFDGTRRFIDSVKIPYHAPSFGGCESIIDQPAIMSYWDSKEQRDIYGIKDNLIRFSIGVEDFEDLKNDLVQALEKV

SEQ ID NO: 7167 - DNA, 2192 bp, Panicum virgatum
  misc_feature: Ceres CLONE 1902919
  misc_feature: Encodes the peptide sequence at SEQ ID NO. 7168
agcatctcctcatccttggcgccccacctcctcgctcgttgtcgtgccgactgcccgtagcgccactgtcgacgagccgccacctcaccactcctcctcgccttctttccatagccgcatcgtggagagagcaattgccagcccttttccccttactcttgtgctctacagcagcgccgccgagcatagtcggactttcgcgccgtgataacacgccgttcgagggaaatcaagagcaactatattaggaacagaataagcagtttggcgaggaagccagcaaccaaaaacgatcagagtcctgcagaaggaatcagggacagtatggtctctgggtactcgtcaccaaatctacagggatattgaacccggctggcatgggccgggtgtaactgcatgcatgggcgatgtgccctctcgatacatgaatgagcagcatgtgatgtgccactgtcccgagacagagacggagtaattcatgccaactactcctaccaaacaacggcgcgctagtaactgcgaattactactaatgacatggggtgtctacctgctccgatcctcgactatatataagatcgccccgacggaatgatccagccagcagcagagcgctcgtcagcgttcgcaaatcacacggagcgtcgatctggttctctggtagtggtgtgtagagctcgagcgatcaagatctgtggttagtcagccagcagattccaacaccatggccttggcagcagcaaccgtgctcaggtttgggtacccgtcgtgtaaaccaaatgctccagctgggagaaaccgctgctgctgcaacccacaaacaactaccggcaatggtgtcctagctatcaatcgcagcacctggtgcgggcatttcttactctagaagttaattaatttttacgagctgtgttcccgtacgatatatatgtatataactgcgcatgctgagtgccggcatgagggcaggaggtgcaggaacggggctgcagcgagcagtgaggcgacggccgcggctggacgccggcgagacaagaaggacgtggtggacgaggaggacgaatggccgagctacctgacgccggagaggctggacgtgctgagggagatggagccgtgggtggaggaacacgtgctcacgctgctcaagcccgtggaggcgtcgtggcagccgtccgacctgctgccggatccggcggccctgggcagcgacggcttccacgccgcgtgcctcgagctccgcgcgggggcggcggaggtgccggacgagctcctcgtgtgcctcgtggcgaacatggtcacggaggaggcgctgcccacgtacccgagcgggctgaaccgcttcgaggtcgtgcgtgacgccacgggcgccgaccccacgccgtgggcgcgctggatccgcgggtggtccgctgaggagaaccgccacggcgacgtgctcaaccgctacatgcacctctccggtcgcttcgacatgcgcgaggtggagcgcaccgtgcagcgcctcatccgcgacgggatgagcttccacgggccggtgaggagcccgtaccacggcttcgtctacctcaccttccaggagcgcgccacggccatcgcgcacgggaacacggcgcgcctcgtgggcgcgcgcggcgccggggactcgaccctcgcgcggatctgcggcaccgtcgccgccgacgagaagcggcacgaggcggcctacacacgcatcatggggaagctcttcgaggtggaaccggacgccgccgtgcgcgcgatggcgtacatgatgcgccaccggatcgacatgccgactggcttaatcaatgacggccgccatagcggccgcgacttctacgatcgcttcagcgccgtcgcgcagcaggccggcacgtacacggtttccgactaccgcggcatcctggagcacctcatagggcagtggggagtgaaggagctcgcctcggggctctccggcgaagggaggcgcgcgcgtgactacctgtgcgcgctgccgaacaaaatgcagcggatggaagataaggttctggagagagcagtcaaggcgagaaacgagcccactcgtatcccaatcaactggatcttcgatagggtcatcagtgtcgttctaccctgatcggctgatcctgtatgcaattagtttgcgaataaagagtgctttattacaaaaaaaaaaaaaaaaaaaa

SEQ ID NO: 7168 - protein, 397 aa, Panicum virgatum
  misc_feature: Ceres CLONE 1902919
  misc_feature (1)..(337): Pfam Name: FA_desaturase_2 Pfam Description: Fatty acid desaturase
  misc_feature (50)..(394): SWISSPROT Homolog: EC 1.14.19.2 Acyl-[acyl-carrier-protein] desaturase, chloroplast precursor
MYITAHAECRHEGRRCRNGAAASSEATAAAGRRRDKKDVVDEEDEWPSYLTPERLDVLREMEPWVEEHVLTLLKPVEASWQPSDLLPDPAALGSDGFHAACLELRAGAAEVPDELLVCLVANMVTEEALPTYPSGLNRFEVVRDATGADPTPWARWIRGWSAEENRHGDVLNRYMHLSGRFDMREVERTVQRLIRDGMSFHGPVRSPYHGFVYLTFQERATAIAHGNTARLVGARGAGDSTLARICGTVAADEKRHEAAYTRIMGKLFEVEPDAAVRAMAYMMRHRIDMPTGLINDGRHSGRDFYDRFSAVAQQAGTYTVSDYRGILEHLIGQWGVKELASGLSGEGRRARDYLCALPNKMQRMEDKVLERAVKARNEPTRIPINWIFDRVISVVLP

SEQ ID NO: 7169 - DNA, 1442 bp, Panicum virgatum
  misc_feature: Ceres CLONE 1903135
  misc_feature: Encodes the peptide sequence at SEQ ID NO. 7170
aacgcactacttcgtgctctccctaggccaaaaccaaacccacccgctccacccctcctcttccccttctccatccccatcgccgccgtccccgatctcctccggcctctcgggaatgggcagcctggcgtcggagaggacggtggtggggtgggccgcccgggacgccaccgggcacctctccccctacacctacaccgtcaggaagacaggccctgaagatgtggtggtcaaggtgctgtactgtgggatttgccatactgacatccaccaggccaagaaccacctcggcgcttccaagtaccccatggtccctgggcatgaggtggtcggcgaggtggtggaggtcgggcccgaggtgagcaagcaccgcgtcggcgacgtcgttggcgtcggggtgatcgtcgggtgctgccgcgagtgccgcccctgcaaggccaacgtcgagcagtactgcaacaagaggatctggtcctacaacgacgtctacaccgacggccgacccacgcagggcgggttcgcctccaccatggtcgtcgaccagaagttcgtggtgccgatcccggcaggcctggcgccggagcaggcggcgccgctgctgtgcgcgggcgtgacggtgtacagcccgctgaagcacttcgggctgacggccccgggcctccgcggcggcatcctggggctcggcggcgtgggccacatgggcgtgaaggtggcgaaggcgatgggccaccacgtgacggtgatcagctcgtcgtcccggaagcgcgcggaggcgatggacgagctgggcgcggacgcgtacctggtgagctccaacgcggaggccatggcggcggccgccgactcgctggactacatcatcgacacggtgccggtgcaccacccgctggagccgtacctggcgctgctgcggctggacggcaagcacgtgctgctgggcgtggtcggcgagccgctgagcttcgtggcgcccatggtgatgctgggccgcaaggccgtgacgggcagcttcatcggcagcatcgacgagaccgccgagctactgcggttctgcgtcgacaaggggctcacctcccagatcgaggtggtcaagatggggtacgtcaacgaggcgctcgagcgcctggagcgcaacgacgtccgctaccgcttcgtcgtcgacgtcgccggcagcaacatcgaggaggcgacgggggcgccggccaactgacggggcgccgcccatggaaccgtgtgaggctgtgccggcgtcgtagcgttcgttctcgtgtccgaggtgtgtgggtcgtgtgcgttggatcggcttgcagatggtggatgcttgatgtgagtttcgttgtggagtactattattttgaagtttacatgtatctggttctggtctcaccaaccattacaatctctgctaaaaaagaatctgaatctgcccaagcatctatcag

SEQ ID NO: 7170 - protein, 364 aa, Panicum virgatum
  misc_feature: Ceres CLONE 1903135
  misc_feature: Great-hit functional homolog of the protein sequence encoded by LOCUS At3g19450
  misc_feature: Great-hit functional homolog of the protein sequence encoded by LOCUS At4g34230
  misc_feature: Great-hit functional homolog of the protein sequence given in SEQ ID NO 9252
  misc_feature (1)..(116): Pfam Name: ADH_N Pfam Description: Alcohol dehydrogenase GroES-like domain
  misc_feature (1)..(363): SWISSPROT Homolog: EC 1.1.1.195 Cinnamyl alcohol dehydrogenase
  misc_feature (1)..(364): SWISSPROT Homolog: EC 1.1.1.195 Cinnamyl alcohol dehydrogenase
  misc_feature: Useful for making plants with altered cell wall content and/or composition
  misc_feature: Useful for making plants with altered lignin content
MGSLASERTVVGWAARDATGHLSPYTYTVRKTGPEDVVVKVLYCGICHTDIHQAKNHLGASKYPMVPGHEVVGEVVEVGPEVSKHRVGDVVGVGVIVGCCRECRPCKANVEQYCNKRIWSYNDVYTDGRPTQGGFASTMVVDQKFVVPIPAGLAPEQAAPLLCAGVTVYSPLKHFGLTAPGLRGGILGLGGVGHMGVKVAKAMGHHVTVISSSSRKRAEAMDELGADAYLVSSNAEAMAAAADSLDYIIDTVPVHHPLEPYLALLRLDGKHVLLGVVGEPLSFVAPMVMLGRKAVTGSFIGSIDETAELLRFCVDKGLTSQIEVVKMGYVNEALERLERNDVRYRFVVDVAGSNIEEATGAPAN

SEQ ID NO: 7171 - DNA, 2079 bp, Panicum virgatum
  misc_feature: Ceres CLONE 1903162
  misc_feature: Encodes the peptide sequence at SEQ ID NO. 7172
aggcggcccgcgggcgacaatcccaaagacccaaacccagagctacgccgccgccccgctgagtcgctgacccgcctcgccgctgtcgccagcctcgtggactgctctcagccgccgcagcgagcagccatggctaccaccgctcgctctctccacctcccgacaactcccaaacccgctatcccctcccaccaccgcctccctgtccccttccacttccggccccgcccccagcgcctcggccgccgcctggccgcctcgtcctccgacctcacctcgttccccgacccggccccgaccccgaacggcgtctacgtcccgtgggcggcggcccaccccgcggcggccgcggccatcgacgtggacgccgccacggaggcggagctgcgggagaatgggttccggagtacgcgccgcaccaagctggtctgcaccattgggcccgccacctgcggcgccgccgagctcgaggcgctcgccgtcggcggcatgaacgtcgcgcgggtcaacatgtgccacggcgaccgcgagtggcaccgcggggtcatccgcgccgtgcgaaggctcaacgacgagaaggggttcgccgtcgccgtcatgatggacaccgaggggagcgagatccacatgggcgacatcggcggcgcgccctccgcaaaggccgaggatggacaagtttggacattcagcgttagatcttctgacacatcactaccagatcgtatcattcatgtgaattacgatggatttgctgaagatgttaaaactggcgatgaactatttgtggacggtggaatggccaggtttgaggtgattgaaaagctagggccagatgtgaagtgtcgttgcactgatcctggtttggtgctgccacgagctaatcttactatatggcgtgatggcagtgtagtgcgagagaggaatgctatgctacctacaatttcatcaaaggactggattgacattgattttggaattgctgaaggtgtagatttcatcgctgtatcatttgtcaagtctgcagaagtaattaaacatctgaagagctacattactgcacggagccgtggaagtgacataggggtcattgcaaagattgagagcattgatgctttgaagaacttggaagagattatccgtgcatcagatggagtaatggtagcccgaggggacttgggggcacagatccccctggaacaggtcccttctgtacagcagaaagtagttagaacgtgcagacagctcaacaagccagtcattgttgcttctcagcttctggaatcaatgattgagtatcctacacccactagggctgaggttgctgatgtttctgaagcagtccgccagcgtgcagatgctctcatgctttctggtgagtcggccatgggaaggtatccagagaaggctctcagtgtccttaggagtgttagtctgaggattgaaaagtggtggagagaagagaaacgccatgaggcattggagcttgaagatgtctcgtcttccttctctgataagatatcagaggaaatatgcaattcggcagcaaaaatggccaacaacttgggagtcgatgctgttttcgtctacacaaaggatggccacatggcctccctgctctcacgatgccgccccgactgcccaatcttcgcattcacgtcctcgacttctgtcaggagacggctgaacctacagtggggtctcatcccgttccggctcagtgactctgatgacatggagagcaacctcaaccgcaccttctccctgctcaaggccaggggtatggtgcagtctggtgacctggtgattgcgctttccgacatgctgcagtccatccaagtgatgaatgtaccctaggaattgtatccccgtgtcctgtcatttcctgtacaatcattatcccgactaattttgaaactgagctgtactgtagcatggaaggacacttatcttttgtggctttgcgcgacttgagagcttgttatattgtgtcgatgttcaatggtgcacacttgaatatactgcattcgcttgctaccaataagttgaagtttgtgagtccaaaaaaaaaaaaaaaaaaaa

SEQ ID NO: 7172 - protein, 574 aa, Panicum virgatum
  misc_feature: Ceres CLONE 1903162
  misc_feature (1)..(354): Pfam Name: PK Pfam Description: Pyruvate kinase, barrel domain
  misc_feature (1)..(354): Pfam Name: PK Pfam Description: Pyruvate kinase, barrel domain
  misc_feature (1)..(354): Pfam Name: PK Pfam Description: Pyruvate kinase, barrel domain
  misc_feature (11)..(574): SWISSPROT Homolog: EC 2.7.1.40 Pyruvate kinase isozyme A, chloroplast precursor
  misc_feature (67)..(574): SWISSPROT Homolog: EC 2.7.1.40 Pyruvate kinase isozyme A, chloroplast precursor
MATTARSLHLPTTPKPAIPSHHRLPVPFHFRPRPQRLGRRLAASSSDLTSFPDPAPTPNGVYVPWAAAHPAAAAAIDVDAATEAELRENGFRSTRRTKLVCTIGPATCGAAELEALAVGGMNVARVNMCHGDREWHRGVIRAVRRLNDEKGFAVAVMMDTEGSEIHMGDIGGAPSAKAEDGQVWTFSVRSSDTSLPDRIIHVNYDGFAEDVKTGDELFVDGGMARFEVIEKLGPDVKCRCTDPGLVLPRANLTIWRDGSVVRERNAMLPTISSKDWIDIDFGIAEGVDFIAVSFVKSAEVIKHLKSYITARSRGSDIGVIAKIESIDALKNLEEIIRASDGVMVARGDLGAQIPLEQVPSVQQKVVRTCRQLNKPVIVASQLLESMIEYPTPTRAEVADVSEAVRQRADALMLSGESAMGRYPEKALSVLRSVSLRIEKWWREEKRHEALELEDVSSSFSDKISEEICNSAAKMANNLGVDAVFVYTKDGHMASLLSRCRPDCPIFAFTSSTSVRRRLNLQWGLIPFRLSDSDDMESNLNRTFSLLKARGMVQSGDLVIALSDMLQSIQVMNVP

SEQ ID NO: 7173 - DNA, 1830 bp, Panicum virgatum
  misc_feature: Ceres CLONE 1903186
  misc_feature: Encodes the peptide sequence at SEQ ID NO. 7174
agaacaacactcactgatatatgtatcttgtaaaatccaattacgcctcttgcttgttcgcataaaacaaagccacatttccctatttcttgttaggagcaaccaatcgagtctagcaaacgcttcttgctcgtttagtccatgatcgattgatccatggctgccgctaccatcgtcttcctcccttgctgggaatccggccacttcatgtccatggtcgcggccggcaagcggatgctcgacgccagcggcggcgccctctccctgaccgtgctggtcatgcaggcgcccacggcggccaaggcggccgaggtcgacggccatgtacgacgtgaggcggcgtccggcctcgacatccgcttcctgaacctcccccctgtcgagccgccgaccagctacgtcgcccccgaggagttcaacttcaggtacacccagctccacgcgccccaggtcgaggaggccgtagccgggctggcgtctcccgtggctgcgatcgtcgtggacctcttctgcacgcccctgctcgacgcggccggcgagctcgccgtgccccggtacgtgtacttcgcctccacgggcgcgttcctcgcgctgatgctgcgcctgccggcgttccgcgaggagctcaccgccaggctcagggagacggaaggcacggtgcacgtgccgggcttgccgccggtgccgctgccctacatgccggcgtgcctgtcgggggacaagatcggcaactacgagtggttcgaggactacgggtgccgcttcatggacgccagcggcatcatcatcaactcctcgatcgagttcgagcccggggttctcgccgccatcgcggacggccgctgcgtgccggggcgcccgcctcctttggtccacgccatcggcccggtgatctggttcgccgcgcgcgagcagcagcagcacgtgtgcgtccggtggctggacacgcagccgccagcctcggtcgtgttcctctgcttcgggagcaaggggttcgtcgactgggcgcaggtcggggaggtcgacgccggcctggacgcgacgctcccaggcgggttcctgacgaggatccgggggcgcgggctcgtgtggccggcgtgggcgccgcagaaggaggtcctggcgcacccggccgtgggcggcttcgtgacgcactgcgggtggaactcgaccctcgagagcctgtggttcggcgtgccgatggtgccgtggccgctgtacggcgagcagcacctgaacgcgttcgagctcgtgacggccatgggtgtcgccgtcccgatgaagagcatggacgggggcaaggtggagcccttcgtgggggcggcgttgctggagcaggcggtgcggggcctgatgggcgggacggaggaggggaggaaggcgagggagaaggcggcggggttgttgaaggccgcgtgccggaaggccgtggcggagggcgggtcctcggacgccgcgcttcggaagctcgtcagcgagatcttaatctcatccggcggaggggcgccgccgccgtgacgtccggctggggggagacccgcactcgccccgccgggctatggtcggagatggcacgccaccggcaatgcaacatgatcaactttattgcattgtgtgcgatgcagatcttaatctcatcgctgtgctgtggtcagtggctgttgctgatttgttgtgagagaaaaatactggctgactgactggtgtttattggttggtgctgatctggacgcagcgaacagagtgagtggcatgatggcgtgtgttaatttgccctgttaatcgagaaaaaaaatgtaatagctttgcgaaaaaaaaaaaaaaaaaaaa

SEQ ID NO: 7174 - protein, 453 aa, Panicum virgatum
  misc_feature: Ceres CLONE 1903186
  misc_feature (67)..(135): Pfam Name: UDPGT Pfam Description: UDP-glucoronosyl and UDP-glucosyl transferase
MAAATIVFLPCWESGHFMSMVAAGKRMLDASGGALSLTVLVMQAPTAAKAAEVDGHVRREAASGLDIRFLNLPPVEPPTSYVAPEEFNFRYTQLHAPQVEEAVAGLASPVAAIVVDLFCTPLLDAAGELAVPRYVYFASTGAFLALMLRLPAFREELTARLRETEGTVHVPGLPPVPLPYMPACLSGDKIGNYEWFEDYGCRFMDASGIIINSSIEFEPGVLAAIADGRCVPGRPPPLVHAIGPVIWFAAREQQQHVCVRWLDTQPPASVVFLCFGSKGFVDWAQVGEVDAGLDATLPGGFLTRIRGRGLVWPAWAPQKEVLAHPAVGGFVTHCGWNSTLESLWFGVPMVPWPLYGEQHLNAFELVTAMGVAVPMKSMDGGKVEPFVGAALLEQAVRGLMGGTEEGRKAREKAAGLLKAACRKAVAEGGSSDAALRKLVSEILISSGGGAPPP

SEQ ID NO: 7175 - DNA, 2556 bp, Panicum virgatum
  misc_feature: Ceres CLONE 1903286
  misc_feature: Encodes the peptide sequence at SEQ ID NO. 7176
aaccaaacccacgcttccctgcttgcaccgcttgagctagctagctttgcgcggcacagcagcatgtggaggctaaaggtcggcgagaagccgagcgacccattgctacggtcgcccaatggcttcctggggcgggaggtgtgggagttcgaccccgccgccggcacgccggaggagcgcgccgaggttgaaaggctgcgccgtgagtacgcccgcaaccgcttcacgcaacgggagagcagcgacctcctcttgcgcatgcagtatgcaaaagcgaacctccatacaaaacttccagccatcaggattaacgacgattcagaagtcaccaaagaagcactattaactgtcttgaggcgtggcctcaaccatatttcttccgtccaagcaccagatgggcattggccaggcggtttcagtggagtcttgttcattcttcctctcacgatatttgctttgcatgttacggaatcgctgaatgatgttttatcattggagcacaaacgtgagatgtgtcgctacatctacaacattcagaatgaggatggtggatggggcacacattctgctttgacccaaagtaccatgtttggcacctgcgtaaactatgctaccttaaggctcctgggagaggtgcttgatggagaaagcgatgcattatcgaggggtcgtgcatggatattgtctcatggaagtgcaactgcagcaccacaatgggcaaagatatatctctcagtaataggtgtatacgattggtcaggaaacaatgcaattcttcctgagttatggatgcttccacattttcttccaattcatccaggaaacttctggtgcttctgtcggatggtttacatgccaatggcttacatttatggaaaaaagtttgttgggcctatcaccccaactattcttgcaataagagatgagatctacaatacggcatataatgaaatcgattggaataaggctcgtagttcttgtgccaaggaagaccttatctatggcccttcatggttgaaaaatattgcaatggcttattttaataagtttgtggaaccaatattggatttatggcctatgaataagctaagagagagagctctaagaagcataatggagcatatccactatgaagatgaaaacagcaactatattggcttatgtcctgtcaacaagatgctaaatatgatatgttgttggatagaaaaccgcaaatccaaagaattcaagcaacatcttccaaggattcatgatcatttatggcttgcagaagatggaatgaaatcgaaggtatataatggttcccatagctgggatactgcgttaacaattcaggcagtttgctcaacaggccttacggaagagtttggtgcaactctaaaaaatgctcatgagttcattaaaaatgcacaggttattgataatttgcctaattacagaagttactaccgtgaaaaaacaaaaggatcatggactttttcaaatggggagaattgttgggctattgctgatactactgcggaagccattaaggcagtactgctgttgtcaaaaattccttcagacctggttggggatccaataaaagaagaacgactttatgatgccgttgattgcctcctttcttatgtgaataaagacggttcgttgtctggggcagaacgtaaaagaacaactccattgctagagtttctcaatccttctgagagttttcggaacatcattgttgactacccatttgttgaatgcacatcatcactggttcaagctttagtattgtttaaagcgatccatcctacatatcgtcgggacgagatagaaaaaataataaggaatggttcatctttcatcgagaaaaaacaactaaaggatggttcgtggtatggtggatggggtgtatgttttacatatgctggcttctttgctatcaaagcattagttgccgcaggaagaacatacgagaacagttcgtccatcaggcgagcatgcaatttcttactgtcaaagcaacaaagtacaggtggatggggagagagctatgtctcttgtcaaattgaggagtatgtcgatagtgggcgtccacatgctgtgaacactgcttgggcaatgttaagtttactttatgctggacagatagaacgggacccttcaccgctctaccgtgctgcaaaagaattaatcaacatgcagacagagacaggagaatttccccagcaagaaatcgttgggaacttcaacaactcactattcttcaatttcaccagctaccgcaacttattccctatatgggccctaggagagtttcaccgccgacttgttgcaagaaatggttaaagcggccaccactttattgtgttcgcagaagttatgaaaaaaatggtataaaggatacaagtacctatgtatatctaaagacataacttctttgtgataagggtaaataaaagcattataatacaaatgtattattagtaaattatagcagtatctttgtaagattatgtcaattcacataatgttagctacatttctgtccaaaaaaaaaaaaaaaaaaaa

SEQ ID NO: 7176 - protein, 756 aa, Panicum virgatum
  misc_feature: Ceres CLONE 1903286
  misc_feature (1)..(54): Pfam Name: Prenyltrans Pfam Description: Prenyltransferase and squalene oxidase repeat
  misc_feature (1)..(756): SWISSPROT Homolog: EC 5.4.99.8 Cycloartenol synthase
MWRLKVGEKPSDPLLRSPNGFLGREVWEFDPAAGTPEERAEVERLRREYARNRFTQRESSDLLLRMQYAKANLHTKLPAIRINDDSEVTKEALLTVLRRGLNHISSVQAPDGHWPGGFSGVLFILPLTIFALHVTESLNDVLSLEHKREMCRYIYNIQNEDGGWGTHSALTQSTMFGTCVNYATLRLLGEVLDGESDALSRGRAWILSHGSATAAPQWAKIYLSVIGVYDWSGNNAILPELWMLPHFLPIHPGNFWCFCRMVYMPMAYIYGKKFVGPITPTILAIRDEIYNTAYNEIDWNKARSSCAKEDLIYGPSWLKNIAMAYFNKFVEPILDLWPMNKLRERALRSIMEHIHYEDENSNYIGLCPVNKMLNMICCWIENRKSKEFKQHLPRIHDHLWLAEDGMKSKVYNGSHSWDTALTIQAVCSTGLTEEFGATLKNAHEFIKNAQVIDNLPNYRSYYREKTKGSWTFSNGENCWAIADTTAEAIKAVLLLSKIPSDLVGDPIKEERLYDAVDCLLSYVNKDGSLSGAERKRTTPLLEFLNPSESFRNIIVDYPFVECTSSLVQALVLFKAIHPTYRRDEIEKIIRNGSSFIEKKQLKDGSWYGGWGVCFTYAGFFAIKALVAAGRTYENSSSIRRACNFLLSKQQSTGGWGESYVSCQIEEYVDSGRPHAVNTAWAMLSLLYAGQIERDPSPLYRAAKELINMQTETGEFPQQEIVGNFNNSLFFNFTSYRNLFPIWALGEFHRRLVARNG

SEQ ID NO: 7177 - DNA, 2333 bp, Panicum virgatum
  misc_feature: Ceres CLONE 1903331
  misc_feature: Encodes the peptide sequence at SEQ ID NO. 7178
aaggccccaactaaccagcccacccattcctttcctccccttctccggctgcagctgctccccatttcccgtgccgcacctccgcgtcgtcgcctccctccgtttcccacctcgccggccggtctccgatcctgctcatgccgccgccccattgattcgcccctgtacttgctggaatcatctccctggccggatcatacggttttctcaatcagttcaaccagagaaagctgcaaattgatttggacttacctgagattttgagccagttcagcgtaaaaggtctagaagtgtttgaggaaagttatgtctttcgttaggcgagcagacccgtcaacagcttacacagataatttttacatccataaatttgctgcaccaagttcaaacttcgctgtacgaagattttcctctgatacacagttgttccgttatggccctgaaccatacaatggtgagtatgggcacatgggtttcactggatcaccatcggctgcatttcaaaactctttttacagtcaacaggcttcactaacaccataccctttaaatgctgatggacgatctctgagtgttgcagatacacagtccaactcatgctctgatgcagcaaaagaatcaccagcggcctccaatgtctctcagcagaactcccagtctgtatcagatactcaaagctctgaaattgaagtagagtttgatgaagacgagattagattgaaacttcaggagctagagcatgctttacttgaggatggtgatgacatcttgttcgagatttcacaggcaagtagcataaatgatgaatgggttgatccaatgaggaatgtattgcttccaaattcaccaaaagaatcagaatcaagcatcagttgtgctgttagcaatagtagagccacacggactccaaagcagttgttatttgattgtgccacagcattatccgaatacaacatagatgaagcacaggcgatcatatcagacctccgtcagatggtctcaattcaaggggacccttctcagaggattgcagcttacctggtggagggccttgctgcaagaatagtagcttcagggaatggcatctacaaggccttgacttgcaaggatcctccaactctttatcagctctcagcaatgcaaatcctctttgaaatatgtccatgcttccgtttgggtttcatggctgctagttatgctatacttgaagcctgcaaaggtgaagaaagattgcacattatcgactttgatatcaatcagggcagccaatacattacattgatacaatttctgaaaaacaatgcaaacaaaccacagcatttgaggataactggtgttgatgaccctgagacggtgcagaggccaattggaggtctgaaggtcattgggaaacgcctagagcagcttgcacaggactgtggactatcttttgagttcagggcagtgggtgctaatctcggggatgttacacctgcaatgctagattgccgtcctggggaagcacttgcagtcaattttgcattccagctgcaccaccttcctgatgagagtgtttcgattgtgaatgagagagaccagctccttcgcatggtaaagggtctccaaccaaagttagtgacccttgttgaacaggatgccaatactaatactgcaccctttctcacaaggttccgtgaagtctatgattactacgctgcacttttcgattcactggatgctacacttccaagggaaagtccggataggatgaatgtggagaggcagtgccttgcacgggaaattgttaacatcttagcttgtgaaggtcctgatcgtgtggagagatacgaagttgctgggaaatggagagcgagaatgacaatggctggcttcacaccgtgcccatttaacagcaatgtcatcagtggaataaaatcaatactgaaatcgtactgcgacaggtataagttcgaagaggaccatgggggacttcacttcggctgggggaagaaaactctcatcgtctcctccgcatggcaatagagcattagagctgatgagttgcattagtattgctgtatgttaggagcttctggtgcatactgcaaaaagatgtgaaccactgggctgttaactgaaccttacctaatcttagatgtctgcttgtcggaaataattgagtttggctgattacccctgtgctatgttgtatggtagtacactatcatcttctcacatgattgatttgtattttaggaccgaatcataacatgtcaaatctgcttcatgtacaaaattaagtattgctggaatacccattggggaactattcggaaaaaaaaaaaaaaaaaaaa

SEQ ID NO: 7178 - protein, 571 aa, Panicum virgatum
  misc_feature: Ceres CLONE 1903331
  misc_feature: Great-hit functional homolog of the protein sequence given in SEQ ID NO 9206
  misc_feature (1)..(305): Pfam Name: GRAS Pfam Description: GRAS family transcription factor
  misc_feature: Useful for making plants with altered Lignin content
  misc_feature: Useful for making plants with altered alkaloid content
MSFVRRADPSTAYTDNFYIHKFAAPSSNFAVRRFSSDTQLFRYGPEPYNGEYGHMGFTGSPSAAFQNSFYSQQASLTPYPLNADGRSLSVADTQSNSCSDAAKESPAASNVSQQNSQSVSDTQSSEIEVEFDEDEIRLKLQELEHALLEDGDDILFEISQASSINDEWVDPMRNVLLPNSPKESESSISCAVSNSRATRTPKQLLFDCATALSEYNIDEAQAIISDLRQMVSIQGDPSQRIAAYLVEGLAARIVASGNGIYKALTCKDPPTLYQLSAMQILFEICPCFRLGFMAASYAILEACKGEERLHIIDFDINQGSQYITLIQFLKNNANKPQHLRITGVDDPETVQRPIGGLKVIGKRLEQLAQDCGLSFEFRAVGANLGDVTPAMLDCRPGEALAVNFAFQLHHLPDESVSIVNERDQLLRMVKGLQPKLVTLVEQDANTNTAPFLTRFREVYDYYAALFDSLDATLPRESPDRMNVERQCLAREIVNILACEGPDRVERYEVAGKWRARMTMAGFTPCPFNSNVISGIKSILKSYCDRYKFEEDHGGLHFGWGKKTLIVSSAWQ

SEQ ID NO: 7179 - DNA, 1102 bp, Panicum virgatum
  misc_feature: Ceres CLONE 1903370
  misc_feature: Encodes the peptide sequence at SEQ ID NO. 7180
ctccggttctcccgccgttcccctccagcctcccctcgcggcttgggcatctctctctctgcgctcggtcatggcggattaccacttcgtgtacaaggacgtggaggggaggaccacggagtgggacgacatccagcgccgcctcgggaacctgccgccaaagccggagcccttcaagccgccgcccttcgcccccaaggtcgacgccgacgagcagcccaagtccaaggaatggctcgacgcgcgtgagcccgaggagctcgaggaactcgaggacgacctggacgacgaccgcttcctcgagcagtacaggaagatgaggcttgcagagcttagggaggctgcaaaagccgcgcgatttggcagtatagtgcccatcaccggctcggacttcgtacgtgaggtgtctcaggcaccatcagatatttgggttgtggtcttcctctacaaggacgggataccggaatgtgggttgcttcaaaattgtttggaggaattggctacaagacacccagcgacaaaatttgttaaaattatctcaacagactgcattcccaactacccagatagaaatgttcctacaatactggtgtataacaacagtgctgtcaaagggacttatgttggtttgcagaagtttggtgggaagagatgcacacctgaatctgttgcgttagccctttgcctgtcagacccagtactgaatgatgggcatggtggcaacgattcatcccgggacaatgtcatagaaggtgttcgcaggaagtttatagagaaggttgtggcccagcacgaagagcgggaagaagaggatagcgactaagcttatattgtttgtgttagtttgcctcagctagctgatcctatttggttccactgtttactgattttatgtgggtgtttatcacaatatactgatttatctggtttgctgatctgtgcctgggtttgtggttagagttaaagatctgccatctgtgaattatcttctatatgggtagtcttggtgttagtaacctttaagctgtaacacgactcaatactattgtttgagagatcaatatgattatgcaacctttcctaaaaaaaaaaaaaaaaaaaa

SEQ ID NO: 7180 - protein, 250 aa, Panicum virgatum
  misc_feature: Ceres CLONE 1903370
  misc_feature (1)..(227): Pfam Name: Phosducin Pfam Description: Phosducin
MADYHFVYKDVEGRTTEWDDIQRRLGNLPPKPEPFKPPPFAPKVDADEQPKSKEWLDAREPEELEELEDDLDDDRFLEQYRKMRLAELREAAKAARFGSIVPITGSDFVREVSQAPSDIWVVVFLYKDGIPECGLLQNCLEELATRHPATKFVKIISTDCIPNYPDRNVPTILVYNNSAVKGTYVGLQKFGGKRCTPESVALALCLSDPVLNDGHGGNDSSRDNVIEGVRRKFIEKVVAQHEEREEEDSD

SEQ ID NO: 7181 - DNA, 1440 bp, Panicum virgatum
  misc_feature: Ceres CLONE 1903389
  misc_feature: Encodes the peptide sequence at SEQ ID NO. 7182
aacctccgtcttcttcttcttcgattttcactgctctactcctccacgagctagctaggctagactatggggtgctggggctccaaggccagcgcggacgtcgctgtggccgacgtctaccgcccgccgcccaccagcgtctccctcttcgacatcagcgccgtcgaggagccctggctcatcgccaagaacaaagccggtgacgaggaagatgacgacgaagaggaggaagaagaaaccgatgaggaagacgacgaggaagaggagaagaccgtcgtgccgctcccgctcctggaaaagctcgagggctacgagctcgccccggcctcgtggtccgaggtcagcaaggccctggaggacatgaagcccgtgctgctggattccaagcaggccaacaccaagccaccggatcccaagaagaagaagaagaagaagatggccaagaagaagaaggaagaagaacaaccagcagcggagcagaagctgcagcagccgacgacgacgacggccgtagctgctgctggtggtggtgccgcgaacgaggaggctggcaagaaagcgccgccggagctggcggggcggcgcgtggtgaaggacaaccccttcctgatgcgcgaccgcgagagcagcaaggcgggcagcgcgccgaggtggaagcggcgcgacccgttcgagggctgccccgagcgacggccgccgggcgcggcgggcggtggggttgtgctgtacacgacgacgctccacggcgtgcggcgcaccttcgaggactgcgagcgcgcgcggggggtggtggaggcctgcgcggaggcggcgggcgtgggcgcggtggacgagcgcgacgtgtcgctgcacggggagtacctccgcgagctgcgggagctggccggcgatggcgcggcggcgccgccgcggctgttcgtgatggggcggtacgtgggcggcgcggaggagtgcgtgaagctggccgagtccgggaggctgagggagatgatgcgctgggtgaaggcgcgcggcgaggcgggcgcggccatggacggccgcggctgcgagggctgcggcggcgcgcgcttcgtgccgtgctgggagtgcggcggcagccgccgcaaggtggtggcggagggaggcggccatcagcatcaggtggagaggtgcgccaagtgcaacgagaacggactcatgatgtgcccactctgccactgaatctatctgtcttacggatcatcctccatgcgtcatcaatagcatcttactagcttgcactgcatcatccctttgttcattcattcaagagatttgaactactactactacatttgtatgtatacatatacactccagtagcatccactgtatgtatattgtacacgtatggtatgatgattccattccttgaatatatatgttggctgcagagttgtgcaaaaaaaaaaaaaaaaaaaa

SEQ ID NO: 7182 - protein, 377 aa, Panicum virgatum
  misc_feature: Ceres CLONE 1903389
  misc_feature (1)..(76): Pfam Name: Glutaredoxin Pfam Description: Glutaredoxin
MGCWGSKASADVAVADVYRPPPTSVSLFDISAVEEPWLIAKNKAGDEEDDDEEEEEETDEEDDEEEEKTVVPLPLLEKLEGYELAPASWSEVSKALEDMKPVLLDSKQANTKPPDPKKKKKKKMAKKKKEEEQPAAEQKLQQPTTTTAVAAAGGGAANEEAGKKAPPELAGRRVVKDNPFLMRDRESSKAGSAPRWKRRDPFEGCPERRPPGAAGGGVVLYTTTLHGVRRTFEDCERARGVVEACAEAAGVGAVDERDVSLHGEYLRELRELAGDGAAAPPRLFVMGRYVGGAEECVKLAESGRLREMMRWVKARGEAGAAMDGRGCEGCGGARFVPCWECGGSRRKVVAEGGGHQHQVERCAKCNENGLMMCPLCH

SEQ ID NO: 7183 - DNA, 1364 bp, Panicum virgatum
  misc_feature: Ceres CLONE 1903403
  misc_feature: Encodes the peptide sequence at SEQ ID NO. 7184
accgccgctgcactctctcacttcccttgctgcctctccggcccttctcgctccattctcccgcttcctcgccggccatggccgccgccgccgccgtcgccgccaccttccgctccctgaagcagcccgtgtccaacggcgtccccgtcccgctccccagcgtccggctccagcgccaccgcgtcggcctcggcctccgcctcttcgcgtccccccgcggccgccccgtcctgctcccgccccccgcggcggccgccggcgaggcgttctcgtcggacggagaggagttcagcggggaagaggagtactttgacgagggagagagcgaggcggaggaggagcaggaggtcgaggccccgcgcgcgtactcgtcgccacgaagccggccgccgcgcggcgaggatcccggccggctcttcgtgggcaacctgccctacaccttcacctccgaggagctctccgaggccttcgccgaggccggcagggtcgacgacgcgcagataatctacgacaaggtcaccaaccggagccgcggcttcgccttcgtcaccatggccaccgccgaggaggccaccaaggccatccagatgttcgatggcgccctgctgggagggaggacggcgagggtgaactacccggaggtgccccggggcggggagaggagaacggtcacaatggctggccgcaggcgtgatgatggcacttacaagatttacgccggcaacctggggtggggagtgcgagcagactcgctgaggtcagtgttcgagggccaggccggcttgcttgatgccagggtcatcttcgagcgtgacaccgggcggtcgagagggtttgggttcgtctccttcaggaccgcagaggatgcacaggctgcattggaggctttggatggagtggagttggaagggagacctctgcggcttagcctggcagaacagaacccaccacctggttctccgcctagcgcggcgcaggcacagcaggaagaaaccacttcagacatatctgatgcaaagacggaagcaaccagttcttcagaactatctgaagcagaattggacgagagcaacttacagacatctgcgacttattaataactacaaaccaagggttataagaagtgttgtaattgtaacgacttccaaattctgccattcaaatccaagttgtacctatttgagcgaaaattttgacaccattaaagctgtagtgaggattcagcatttcagctatagatactagaatgtgttaggtatctagatgctgctgttgttcttgtaatgtattatgcaaaatatattgttctaaagtgcaacagtgtagctctttcgcttcctgtaaaatgatccaattcacatgtt

SEQ ID NO: 7184 - protein, 339 aa, Panicum virgatum
  misc_feature: Ceres CLONE 1903403
  misc_feature: Great-hit functional homolog of the protein sequence given in SEQ ID NO 9274
  misc_feature: Useful for making plants with altered Lignin content
  misc_feature: Useful for making plants with altered cell wall content and/or composition
  misc_feature: Useful for making plants with altered terpenoid content
MAAAAAVAATFRSLKQPVSNGVPVPLPSVRLQRHRVGLGLRLFASPRGRPVLLPPPAAAAGEAFSSDGEEFSGEEEYFDEGESEAEEEQEVEAPRAYSSPRSRPPRGEDPGRLFVGNLPYTFTSEELSEAFAEAGRVDDAQIIYDKVTNRSRGFAFVTMATAEEATKAIQMFDGALLGGRTARVNYPEVPRGGERRTVTMAGRRRDDGTYKIYAGNLGWGVRADSLRSVFEGQAGLLDARVIFERDTGRSRGFGFVSFRTAEDAQAALEALDGVELEGRPLRLSLAEQNPPPGSPPSAAQAQQEETTSDISDAKTEATSSSELSEAELDESNLQTSATY

SEQ ID NO: 7185 - DNA, 1482 bp, Panicum virgatum
  misc_feature: Ceres CLONE 1903463
  misc_feature: Encodes the peptide sequence at SEQ ID NO. 7186
aattccaacaaatttcgatctccatcgatcgatcgatccctcccgaacccgacccccatggcctccgacgccgccgccgccgagccctcctccggcgacacccagcgtcccccgcgctacgccatcgggtacgcgctcgcgccgaagaagcagcagagcttcatccagccgtcgctggtggcccgcgcggcggcgcggggcatggacctcgtccccgtggatgcggcgcggcccctggcggagcagggccccttccacctcctcatccacaagctctacggcgacggctggcgcgcccagctcgaggccttcgccgcgcgccacccggccgtgcccgtcgtcgacccgccccacgccatcgaccgcctccacaaccgcatctccatgctccaggtcgtctccgagctcgaccacgccgccgacaaggaccgcaccttcggcatccccagccaggtcgtcgtctacgacgccgccgcgctcgccgactccggcctcctggccgcgctccgcttcccgctcatcgccaagcccctcgtcgccgacggcaccgccaagtcccacaagatgtccctcgtctaccaccgcgaggggctcgccaagctccgcccgccgctcgtgctccaggagttcgtcaaccacggcggcgtcatcttcaaggtctacgtcgtcggcggccacgtcacctgcgtcaagcgccgcagcctgccagacgtgtcccccggggacgacgcgtccgccgagggatccgtctccttctctcaggtctccaacctccccaacgagcgcaccgcggaggagtactacggcgaaaagagcctcgaggacgccgtcgtgccgcccgccgcattcgtcaaccagatcgcgggtggcctccgccgcgcgcttggcctacaactcttcaacttcgacatgatccgggacgtccgcgccaccggtgaccactatctcgtcattgacatcaactacttcccgggctacgccaagatgccgggatatgagactgtccttactgattttttctgggagatggtatgtaaggaggatgatgtggtccaggaggagaaggggagaaaccatgtctcggtgaaataagacgatggtttgattgcaaaactgcaagtgtcttgggaatgctgctggttctggatgcagaatttgatgaggggatttagttgggtttcaaccggcagcatgtggaggacctgcgccgtgctgtgtaaatcctttctcctaactctttccataccagttgtttaggtatcttgctgttttttcttgggaagtctgttcatctagtttagtctgtcagaacaaaagagagggacataactcaatccggaattctaatgagaaatgtgctctccatatgcaagccttctgttcttgagcaatggatgaatagcaatccaatgtcagtatccattcctgcagctcaaaaaatgcaggggtagcttctttaattaaaaaaaaaaaaaaaaaaaa

SEQ ID NO: 7186 - protein, 344 aa, Panicum virgatum
  misc_feature: Ceres CLONE 1903463
  misc_feature (1)..(313): Pfam Name: Ins134_P3_kin Pfam Description: Inositol 1, 3, 4-trisphosphate 5/6-kinase
  misc_feature (5)..(309): Pfam Name: Ins134_P3_kin Pfam Description: Inositol 1, 3, 4-trisphosphate 5/6-kinase
  misc_feature (1)..(344): SWISSPROT Homolog: EC 2.7.1.134 Inositol-tetrakisphosphate 1-kinase 1
MASDAAAAEPSSGDTQRPPRYAIGYALAPKKQQSFIQPSLVARAAARGMDLVPVDAARPLAEQGPFHLLIHKLYGDGWRAQLEAFAARHPAVPVVDPPHAIDRLHNRISMLQVVSELDHAADKDRTFGIPSQVVVYDAAALADSGLLAALRFPLIAKPLVADGTAKSHKMSLVYHREGLAKLRPPLVLQEFVNHGGVIFKVYVVGGHVTCVKRRSLPDVSPGDDASAEGSVSFSQVSNLPNERTAEEYYGEKSLEDAVVPPAAFVNQIAGGLRRALGLQLFNFDMIRDVRATGDHYLVIDINYFPGYAKMPGYETVLTDFFWEMVCKEDDVVQEEKGRNHVSVK

SEQ ID NO: 7187 - DNA, 1268 bp, Panicum virgatum
  misc_feature: Ceres CLONE 1903517
  misc_feature: Encodes the peptide sequence at SEQ ID NO. 7188
aaccgcgtcgcgtgtccaaatcattctgcggcctgctggagggcagcaccaggtatcatcagtctactagcgtccaccaccctactcccagttacgagaagcactcgcgggcaccagctcagctcagctcagctaacctcccgcgccgcggccggaaaccagagcggcgcccgcggcccgcgccgagcataaagccggcgctcgtggcattccgatcccctgttcggttctagtgctctgttcggttctgttctcccgagtgaaaccaattcgagcctcttctcgtctccgacctcgagctcggtccgtggccgtcgccatgaggagcgccgcgtccctgtccctcgtcttgctcatggtcttcctcgcggtcccggccccggctcgcggctgcgaccgctgcgtgcgccgctccaaggccacctaccaggcctcctcgctcgccctcaacgccggttcgtgcgggtacggctccctggccgcgtccttcaacggcggcttcctcgccgcggcgggccccgagctctaccggggcggcgtcggctgcggcgcctgcttccaggtgcggtgccgggacagcgagctctgcagcgccgccggcgccaaggtggtggtgactgaccaggcgcggacctcgagccgcacgggcctggcgctgagcggcgcggcgtacgcgaccatggcgcgcgccggcatggccgcgcggctcagggcgcggcgcgtcgtggacgtcgagtacaagaggatcccgtgcgagtacgcgaaccgcaacctgtcgatccgcgtggaggagaagagccggccgccgagcgagctgtccatccggttcctctaccagggcggccagaccgacatcgtcgccgtcgacgtcgccacggtggggtcgtccaactggcggttcatgacgcgggagcacgggccggcgtggagcacggcgcaggcgccggcggggccgctgcagctccggctggtggtgaccggcgggtacgacggcaagtgggtgtgggcggagtcggaggtgctgccgcggcggtgggaggccggccgggtctacgacgccggggtgcaggtcgccgacgtcgcgcaggaagggtgctacccctgcgacacgcacgagtggcagtgacgtcgcgcgcgcacgcgcagcctggattgtaaaactgtacagcccttgtttgccttttttgtgtcttttttctggaccgtccgtttctggacggatggacggatggatgaaagtgcgaaatgatgaatcgaatgggagagtc

SEQ ID NO: 7188 - protein, 268 aa, Panicum virgatum
  misc_feature: Ceres CLONE 1903517
  misc_feature: Great-hit functional homolog of the protein sequence encoded by LOCUS At3g45960
  misc_feature: Great-hit functional homolog of the protein sequence encoded by LOCUS At3g45970
  misc_feature: Useful for making plants with altered cell wall content and/or composition
MRSAASLSLVLLMVFLAVPAPARGCDRCVRRSKATYQASSLALNAGSCGYGSLAASFNGGFLAAAGPELYRGGVGCGACFQVRCRDSELCSAAGAKVVVTDQARTSSRTGLALSGAAYATMARAGMAARLRARRVVDVEYKRIPCEYANRNLSIRVEEKSRPPSELSIRFLYQGGQTDIVAVDVATVGSSNWRFMTREHGPAWSTAQAPAGPLQLRLVVTGGYDGKWVWAESEVLPRRWEAGRVYDAGVQVADVAQEGCYPCDTHEWQ

SEQ ID NO: 7189 - DNA, 1546 bp, Panicum virgatum
  misc_feature: Ceres CLONE 1903551
  misc_feature: Encodes the peptide sequence at SEQ ID NO. 7190
gagagctctacgcgccgctcctcctcgccgcgcgccgccgccaccgctgccgttgccgccgccaccgctgccgttgccgcgactcctccccgccgtggccgccgcggatctgcgccgccgccgccaccaccacctcctgtgaccgcggccgcatctcctcttgtcctccgtccacccgcgacgccctcctccctgctgcggggcagcggggctgagatccggcgcggagctcaagcgcagcgtttggtgggcagcggagctccggcaggcggctcggtgggctgccgccgcggggcaccaggcgaccgcgttcgaaatggccgcatccggggtgcacggcggcgcccgacggcgagaggcctgcgcccttgtctcctctccttgcaatcctctcctctgcctgcttctcatcgattatgtgcagcctctaatctccttcctctttctcgttttttgattttcagtgtcaatttcggatctcgtggtgcaaagccaagaaaatatctgtaccccctcttgatttcttccttttatgcaaaggatgttggaagcttgcatggatatgcagctagagttacagcgttctgtaaggcaagaagtttcagcagccttgaatcgtttcattggggagcaaggggagagtaaagaaataattgacgatggttcaaaatggataaatgtgagaaaagggacctgctgtatatgctgtgagaccccaattgactcccttttgtacagatgcgggcacatgtgcacgtgctcaaaatgtgcgaatgaattggttcggggcggaggraaatgcccgctgtgccgtgcgcccataatcgaggtgatccgagcatacttcatcatgtagatacaaggaagacgtcaaggagatagaggaatacatgtgatgtttgtgggctcaaatgtggagttgttagtgggtggtgtatgattgtattcaattttgttcattctatctaattcgttgggttcctttcgttttggcctgcccagccctgccacggtgtaagtagtgttatggttttggttgtggtggcagatcggggaggtggccttcgattgggacttgggttgggtcaccactaattttgtttcacaacgactaatggggttgggggttcgttgaaacttgaaacatgaggtggagaaaaggtgcaagttaaaaaaaaaaaaaaagaaaamctcragggggggcccgcccaattcgcctcyactmcccgtgcctctatacscttgctcccccatcccctcaccgccgccaggcctacggaaggcttcaccaagtcggtcgcggcaggcggcggccgggaggaaggcgcactgctgcgcggcggtcctggcatcgttgttatcgcccaagccagcggcggccaaggacgcacggtcggtctaggtgcaagagctctacgcgccgctcctcctcgccgcgcgccgccgccaccgctgccgttgccgccgccaccgctgccgttgccgccactcctccccgccgtggccgccgcggatctgcgccgccgccgccaccaccacctcctgg

SEQ ID NO: 7190 - protein, 104 aa, Panicum virgatum
  misc_feature: Ceres CLONE 1903551
  misc_feature (1)..(41): Pfam Name: zf-C3HC4 Pfam Description: Zinc finger, C3HC4 type (RING finger)
MLEACMDMQLELQRSVRQEVSAALNRFIGEQGESKEIIDDGSKWINVRKGTCCICCETPIDSLLYRCGHMCTCSKCANELVRGGGKCPLCRAPIIEVIRAYFIM

SEQ ID NO: 7191 - DNA, 2083 bp, Panicum virgatum
  misc_feature: Ceres CLONE 1903565
  misc_feature: Encodes the peptide sequence at SEQ ID NO. 7192
ggccattgctccctctcgttcgctcctcctccccgcctcccaaccaccgcctgcggcctgcctcccctcccggatccccaagggccgccggatccggcgaggcagaggggcgcgcgccccgcggcagatccgaggcggctccgcggagcattcctctggtccgagcggacgccacctggcaggcgaggggcgtaattccgagaggaggacgagcagggaggcgcgggggtggtggatgagcgcggggaggccccgccgcggcacagcgtaggagccccgcgcgccgacgagaaggcgccatgatcgagcaattcgttaatttcgtcatccgcccgccccggtcagaatataatccagatcagtatctatgggacacagagtttatcctcgctggacggaaatacaaacgactagacttggagcttacaaatgcaagaggctatatcctaaaatgcagccactatgttcctgcttttatcccagagaacactgccctcccatgtgtggtctactgccatggaaatagcggatgccgagcagatgcaaatgaagccgctgtaatactgctttcttcaaatatcactgttttcacacttgacttttctgggtcaggtctatcgggtggagattatgtcagcttgggttggcatgagaaagaggacctcaaatgtgcagtgtcacatctccgggccaataagcaagtttccactataggcctttgggggcgatcgatgggtgctgtcacaagcctactctatggagctgaagatccctctattgctggcatggtattggatagtgcttttactaatttgtatgacttgatgatggaactcgtcgacgtttacaaaattcgagttcctaaattcacggttaagatggctgtacagtacatgcggcgaatcattcagaaaagagccaagtttgacataatggatcttaatgttttaaagttggctcccaagatgtctatccctgcattatttggtcatggtttgaatgatatgtttattcagccccaccattgcgagcgtattcaccaggcatatgggggggataaaagaataataaaatttgagggtgatcacaattccccaagacctcaatcgtattatgattcagtttcaatattcttctacaaaactttgcgtcctcctctgttgccttcagcacgttcaaataaacgacttatgggtgcatataaagttggtaacataaccaatgagagcttcttctctgaaatcgtcaatggtctacagtcagctaacattgctgcctgcagttcatcgacagatgcaccaaacattccgaatgctaaaacacctgcagttgaattgctgtcagaaagcttgaagcagctgtctgttaagaaagagactgactcgggcttgctttcaaatgaaaatcatagcctatcagagatggatggggattgtgttggatcacgtttgcaggataaaattagtaggcacaatgaggagtcctgctcatacacgagctctaacagagaaagttggggcagatgttcatctttaggagcgaccagtgatgatgaatcactttcaggggataataatgataagcaggagaataaggcagtgaaggctctggctacgcctctaagacaaagccagaggaaaccatctgagaaagctaaggagaagaagatccgagtactgtggaagaaaattaagtgtgagaaggtggagatgggggacagtctatcacagcgcttcaggatgtgcctcgggcaatctcctcagcacaagaggaataaatcatctggagcgcttgcaacttcatagccctgacaagcctgcttgaaccattgatcgtcctgattctgaccgactgttgtcactacgacactgtgacctgtaaccataggtgaatataccgtatacgtagcttgacgccacaatcgcgtgccaggatgctcaaacagctgagaggcgcgcccttgtatcataccccgtaattgccacctccgccttgctgttacatgtaactcccttgccccacttttgcgtcttgtagatgcaatgtgacaacagcttgttggtgaaatggaatgggtttggtg

SEQ ID NO: 7192 - protein, 501 aa, Panicum virgatum
  misc_feature: Ceres CLONE 1903565
  misc_feature (1)..(98): Pfam Name: Abhydrolase_1 Pfam Description: alpha/beta hydrolase fold
MIEQFVNFVIRPPRSEYNPDQYLWDTEFILAGRKYKRLDLELTNARGYILKCSHYVPAFIPENTALPCVVYCHGNSGCRADANEAAVILLSSNITVFTLDFSGSGLSGGDYVSLGWHEKEDLKCAVSHLRANKQVSTIGLWGRSMGAVTSLLYGAEDPSIAGMVLDSAFTNLYDLMMELVDVYKIRVPKFTVKMAVQYMRRIIQKRAKFDIMDLNVLKLAPKMSIPALFGHGLNDMFIQPHHCERIHQAYGGDKRIIKFEGDHNSPRPQSYYDSVSIFFYKTLRPPLLPSARSNKRLMGAYKVGNITNESFFSEIVNGLQSANIAACSSSTDAPNIPNAKTPAVELLSESLKQLSVKKETDSGLLSNENHSLSEMDGDCVGSRLQDKISRHNEESCSYTSSNRESWGRCSSLGATSDDESLSGDNNDKQENKAVKALATPLRQSQRKPSEKAKEKKIRVLWKKIKCEKVEMGDSLSQRFRMCLGQSPQHKRNKSSGALATS

SEQ ID NO: 7193 - DNA, 1637 bp, Panicum virgatum
  misc_feature: Ceres CLONE 1903575
  misc_feature: Encodes the peptide sequence at SEQ ID NO. 7194
gatgcgtgtgcgagtgagggagcagtggaagcagctagccagcccaagcccagagctactaacaccatggtgatgtattctgacgacgtgcaggtggaggtggtggagagcagcctcgtatccccgagccaggggacgccgggaggacaactctggctctcccccctcgacctcctgctcgtcaacaggggtcacaccccgaccgtctacttctaccgccccgccgccgccgacttcttcgacgtggcacggctcaaggagtccatggccagagccctggtggacttctacccgctcgccgggcgcctcggcgtcgacgccgacggccgcttcgtcatcgactgcaacgccgcgggcgcgctcctcgccgtggctcgctccgaccacctcacggtcgacgacttccgcgacgtcagcccgtcgcccgagttgaaggagctcttcgttccccgcgtcgagccgtcctccatcatgctcgccgtacaggtcaccttcctcaagtgcggcggggtggccttcgggacggcgctgcaccacgccgccgccgacgccatcggctccttccgtttcttccacgcgtggtcggccctgtgcggcgggcgcgacggcggcggcgccatggcggaaacggagctcccgtgccacgaccgcggcctcctccgcgcgcggtcgccgcctttcgtcaacccggacgccttcgccgtgttctgccctaagctaaccctgacggagccctcggggcccgtcgccagcaaggtcctcaccgtctccaaggaccacgtcgccgctctcaagcaggcctgcggcggcgtcagcaccttctgcgcgctcagcgcccacgcgtggcggtgcctgtgctccgcgaggggcctgccggcggacgccaccacccgcctcaccctcccggccaacgtccggcgccgcaccaagccgccgctccccgacagctacttcggcaacgcgctcatctgggtgggcacgtccggcgtggtgcgcgacgtcacctcggaggcgctggccgataccgccgcccggatcaggggcgccgtccgccggatggacgacgacgtggtgcggtcggccatcgactacttcgagctcgcggagaagaacgcccggccgattccgggcagcctgccggagacggagctgagggtgatcagctggctgggcatgcccgtgtacgacgcggactacgggtgggggaagccgcagctcatggtgcgcgccgagtcggagcgctcgggcttcgtgtacctgatgaacgacgacggcggcggcgtgcaggtggtggtgtgcgcggaggccgcaagcctcaaggaattcgagaagctgctgattgcaaagacgatgtgcccatgaaaaatgcgcggcacggcggccaaaccatttgacctcttctctctcggagcgagcattatattcttcaaaacttttaatttaagatgcatgcgtgttctttatggtagccggcctctcgaatctcgatgtagtagcttggaaacgccccttagggcacccgcaacagttatagagcagctctctataatattatccacgtcagagagtacgtcagctatagagagtaatatagatgattcacccagcagattgtctaaaaaaaaaaaaaaaaaaaa

SEQ ID NO: 7194 - protein, 431 aa, Panicum virgatum
  misc_feature: Ceres CLONE 1903575
  misc_feature (2)..(422): Pfam Name: Transferase Pfam Description: Transferase family
MVMYSDDVQVEVVESSLVSPSQGTPGGQLWLSPLDLLLVNRGHTPTVYFYRPAAADFFDVARLKESMARALVDFYPLAGRLGVDADGRFVIDCNAAGALLAVARSDHLTVDDFRDVSPSPELKELFVPRVEPSSIMLAVQVTFLKCGGVAFGTALHHAAADAIGSFRFFHAWSALCGGRDGGGAMAETELPCHDRGLLRARSPPFVNPDAFAVFCPKLTLTEPSGPVASKVLTVSKDHVAALKQACGGVSTFCALSAHAWRCLCSARGLPADATTRLTLPANVRRRTKPPLPDSYFGNALIWVGTSGVVRDVTSEALADTAARIRGAVRRMDDDVVRSAIDYFELAEKNARPIPGSLPETELRVISWLGMPVYDADYGWGKPQLMVRAESERSGFVYLMNDDGGGVQVVVCAEAASLKEFEKLLIAKTMCP

SEQ ID NO: 7195 - DNA, 1410 bp, Panicum virgatum
  misc_feature: Ceres CLONE 1903698
  misc_feature: Encodes the peptide sequence at SEQ ID NO. 7196
aaattttttcgtcgaaattggccgtgagatccgcccggttcgcgctcggatccggcgccctccgtcggggtaaggttccgcctccctccgacgagatggcggggaagggagccaaggccacggcggccaagtcggcggacaaggacaaggggaagaaggcccgcggttccgtctcgcgctcctcccgtgccgcacctcaggagaaatctgctccgaagaaagatgtttatcaattgtttgctgagaaggttagggataacaaacaactggaatcaagatgggcaatcatgcaagaaactcgagtggagtattttcgtggaaaagatttcactaccttcataaaaaataatccagaagtcagagaaattttagggccggataaagatttagaagtggaggacattgttaacactttgctgaccaagaaccttgttataagatgtgaccgagttatgaaaactgtcaggcctggcaagaaaaaactatcatcctggcctgctcatttggagatacataatgaacaagtgtttactgaaaatgatggtttctttgcttggatgtttctaaaaaggcggaccttgtggcagacaattctttcatttgtttggcctctttttgcactggcagtctgcttatttccagtttacccatatcaatgcaagattgttgtactgtactcatgtgctggagctctacttttcatcgtctccattcttttgctaagagctgctatcttcggcatcttatgggtcatttttgggaaacgtgtatggtttttccccaatataaatgcagaggagacaacatttagagaactcgttcgtttttggcctgaaaaggatgaaggagagcggccaaagtggacatcaagacttttctatgctcttgtcgctgtattggtgatattgctccttaggcaccatgctccagatgaggcagctagagccaggtaccaaaagaaggtttctaacataatcgatgatgttcttgagtggtctccaaagttggcgatttctggaatgattgaaaagcatactggggctaatatgacggaagctagcaactacaccagcagtgctgggagcagtcataccgctccctctgccgaaggcaaggctacacaaccaaacccagatacggatgcagatggggatacccaggctgactcagatgaaatccgagatagcggatatgctgacgatacaagaacaagatcaaatgaagcttaaaacgacatcaagtttatcatgtagttcttttttagtactcttcattgctgttcatcttccgaattaatagatagattactgacaacaaaagatccaagcgctcatgttttgaccatgttccattcatatattgccaacaatggctgtattccaaggttctcaaaaaaaaaaaaaaaaaaaa

SEQ ID NO: 7196 - protein, 377 aa, Panicum virgatum
  misc_feature: Ceres CLONE 1903698
  misc_feature: Great-hit functional homolog of the protein sequence given in SEQ ID NO 9574
  misc_feature: Useful for making plants with modulated drought sensitivity
MAGKGAKATAAKSADKDKGKKARGSVSRSSRAAPQEKSAPKKDVYQLFAEKVRDNKQLESRWAIMQETRVEYFRGKDFTTFIKNNPEVREILGPDKDLEVEDIVNTLLTKNLVIRCDRVMKTVRPGKKKLSSWPAHLEIHNEQVFTENDGFFAWMFLKRRTLWQTILSFVWPLFALAVCLFPVYPYQCKIVVLYSCAGALLFIVSILLLRAAIFGILWVIFGKRVWFFPNINAEETTFRELVRFWPEKDEGERPKWTSRLFYALVAVLVILLLRHHAPDEAARARYQKKVSNIIDDVLEWSPKLAISGMIEKHTGANMTEASNYTSSAGSSHTAPSAEGKATQPNPDTDADGDTQADSDEIRDSGYADDTRTRSNEA

SEQ ID NO: 7197 - DNA, 1325 bp, Panicum virgatum
  misc_feature: Ceres CLONE 1903770
  misc_feature: Encodes the peptide sequence at SEQ ID NO. 7198
attttcccgtccggccggcggccaacacccgccacaaccatgacccgcgccactaccgcccggcaccacctcctcctcctcctctgcctctccatcgccgcggccaccacgcgggcgcacggcgggggggacgcggatgcggacggcggcgactccccggcgcccgacctgcgcgcgcgcggcctggtggcggccaagctgtggtgcctggcggtggtgttcgcgggcacgctgctgggcggggtgtccccctacttcctgcgctggaacgaggcgttcctcgcgctgggcacgcagttcgccggcggggtcttcctcggcacggcgctcatgcacttcctcagcgacgccgacgagacgttcggggacctgctccccgacagcgcctacccctgggccttcatgctcgcctgcgccggctacgtcgtcaccacgctcgccgacgtcgtcatcgcccacatcgtctcgcggggacgcgccgccgctggttcccgcggcggcgacggtgcaggccttgaggagggcaaggtgagcaccccaaacggcaccagctctgagccacagcaagctgatgcgcacggatctgatcactcggtggcatcaatgctgcgcgacgcgagcaccctgggagatagcattctgctcatcgccgccctctgctttcactccgtcttcgaaggcatcgccatcggagtcgctgagacgaaggctgacgcgtggaaggcgctgtggaccatcagcctgcacaagatcttcgcggcgatcgccatgggcatcgcgctgctccggatgctcccgaaccggccgctcctctcctgcttcgcctacgccttcgctttcgccatctcgagccccatcggcgtcggcgtcggcatcgtcatcgacgccaccacgcagggccgggtggccgactggatcttcgccgtctccatgggcctcgccacgggcatcttcgtctacgtctccatcaaccacctcctctccaaggggtacaagccccggaggcccgtcgccgtggacacgccggtcggcaggtggctcgccgtggtgctcggcgtggccgtcatcgccgttgtcatgatatgggacacctgatgtgagagatagagagacatgggattattatgcagagtttggggcgtttggttctagcaggagggagtgagggacttttcttatattatactagatttgaagggaatttgtgccaaattgctttgggaaattgtgccaaatctccaggtaaagagatcaactttctcgagacaaggtcgtaaggtttcgataaatccttttttttttttgaaaaaaaaaaaaaaaaaaaa

SEQ ID NO: 7198 - protein, 351 aa, Panicum virgatum
  misc_feature: Ceres CLONE 1903770
  misc_feature: Great-hit functional homolog of the protein sequence given in SEQ ID NO 9192
  misc_feature: Useful for making plants with altered Lignin content
MTRATTARHHLLLLLCLSIAAATTRAHGGGDADADGGDSPAPDLRARGLVAAKLWCLAVVFAGTLLGGVSPYFLRWNEAFLALGTQFAGGVFLGTALMHFLSDADETFGDLLPDSAYPWAFMLACAGYVVTTLADVVIAHIVSRGRAAAGSRGGDGAGLEEGKVSTPNGTSSEPQQADAHGSDHSVASMLRDASTLGDSILLIAALCFHSVFEGIAIGVAETKADAWKALWTISLHKIFAAIAMGIALLRMLPNRPLLSCFAYAFAFAISSPIGVGVGIVIDATTQGRVADWIFAVSMGLATGIFVYVSINHLLSKGYKPRRPVAVDTPVGRWLAVVLGVAVIAVVMIWDT

SEQ ID NO: 7199 - DNA, 2061 bp, Panicum virgatum
  misc_feature: Ceres CLONE 1903919
  misc_feature: Encodes the peptide sequence at SEQ ID NO. 7200
gagcccgtgctccgagctgccgagtccgtcgcctccgccggcgcgcgcctccctcccctccccccccatgggcccccgcgcccgagccgggaccgccccacccaccggccggtgcgcgcgccgcggatagatcccacgccccgtcgccaccggatccgatgctggagacggcggccgcctcctccccccgcgccgccgctgctgccgctgctgctgctgctgcggcggcggcttctgccgtttcctccccgcggcggggtgggggcgctgcgcatcaccacgggcggtgggcgccggcgccgttcagggcgtgcctcgtcgcgctctggctggtggggttcgcgctcgtcttcctgtggcagagcacctccgtgggccgcgtgcggctctacacgcgcccgcccatgcccaagcgcgcggcgccgtccatggggcagtgggtggcctccccgcccgtctacgatctgagggagttcggggcgttcggggacgggagaacggtgaacacggccgcgttcgaggcggcggtcgcggcgatcgccgagaggggcggcgggaggctcaccgtgcccgcggggcggtggctcaccgcgccgttcaacctcaccagccgcatgacgctattcctcgctgccggcgctgagatcctgggaatccaggatgaaagatattggccattaatgtctccattaccatcatatgggtatagaagagagcacaagggacctcgatatggaagcctcatacatggtcaagacctgaaggatgtgactataacaggtcataatggtaccataaatggacaaggtcaaagttggtgggtaaaatttcggagaaaactccttaatcacacaaggggtcctctagtgcagctcatgcgatcaagtaatattatcatttcgaatatcactcttcgcgattctcccttttggactcttcacacatacgactgcaagaatgttactatctcagaaacgaccatcttggctccaattgctggagctccaaatactgatgggatagatccagattcttgtgaaaatgtggtgataaagaattgctacatttctgttggtgatgatgggatagctataaagagtggttgggatcaatatggaatttcttatgggcgtccatctgctaacattattattcagaatgtcataatacgctccatggtcagtgccggtgtatcgataggaagcgagatgtctggtggtgtctctaatgtgttggtagagaatgttcatgtttgggattcacggcgaggtgtgaggataaagactgcccctggaagaggggcctatgtaagcaacattgcgtatcggaatattagcttagagaatgtccgtgtcggtattgtcataaagacagactacaatgagcacccagatgaaggcttcaacccgaaggctctgcccatcatcgaaaacatttcttacacgtcaatccacgggcatggtgtgcgcgtacctgtcaggatacagggatgcgcagagatccccgtgaagaatgttaccttccatgacatgtcagtgggtatagcagacaggaagcaccatgttttccagtgctcctttgtccaggggcaggtcattggctatatttttcccatgccttgcaagaacctggacatttataacgagcggcgtgagttggtcaaacaatcgacgtttcagaacatttctgatattgactacagtttttgacaagggcagttgatcccattgtactattgctgtaggaattattcacagctctcatagtcctttcaacacgtttagaagcattttttgggtagccttttacaaccttcacctcaggcatgtatttaaggaggtttcacttgtctatactgtctcatttcatttcccatctctgtattatcacaaacttggttacacagtcaactgtacacttttgataggttttactgttgaggcacttggcttgcccttctccacaggtctccatgtataatgtagattgaaattggaatggtgggtcctttcaaagttgtattcataaagctcagtttgtcaaaaaaaaaaaaaaaaaaaa

SEQ ID NO: 7200 - protein, 516 aa, Panicum virgatum
  misc_feature: Ceres CLONE 1903919
  misc_feature (1)..(359): Pfam Name: Glyco_hydro_28 Pfam Description: Glycosyl hydrolases family 28
  misc_feature (1)..(359): Pfam Name: Glyco_hydro_28 Pfam Description: Glycosyl hydrolases family 28
  misc_feature (1)..(361): Pfam Name: Glyco_hydro_28 Pfam Description: Glycosyl hydrolases family 28
MLETAAASSPRAAAAAAAAAAAAAASAVSSPRRGGGAAHHHGRWAPAPFRACLVALWLVGFALVFLWQSTSVGRVRLYTRPPMPKRAAPSMGQWVASPPVYDLREFGAFGDGRTVNTAAFEAAVAAIAERGGGRLTVPAGRWLTAPFNLTSRMTLFLAAGAEILGIQDERYWPLMSPLPSYGYRREHKGPRYGSLIHGQDLKDVTITGHNGTINGQGQSWWVKFRRKLLNHTRGPLVQLMRSSNIIISNITLRDSPFWTLHTYDCKNVTISETTILAPIAGAPNTDGIDPDSCENVVIKNCYISVGDDGIAIKSGWDQYGISYGRPSANIIIQNVIIRSMVSAGVSIGSEMSGGVSNVLVENVHVWDSRRGVRIKTAPGRGAYVSNIAYRNISLENVRVGIVIKTDYNEHPDEGFNPKALPIIENISYTSIHGHGVRVPVRIQGCAEIPVKNVTFHDMSVGIADRKHHVFQCSFVQGQVIGYIFPMPCKNLDIYNERRELVKQSTFQNISDIDYSF

SEQ ID NO: 7201 - DNA, 1539 bp, Panicum virgatum
  misc_feature: Ceres CLONE 1903961
  misc_feature: Encodes the peptide sequence at SEQ ID NO. 7202
gcaactgcaatcccaaagccatctctctctttctcagcagcagaagcagcagcaatagtagcagggatcgatgggggtctgcgcgtcgtcgaggaggcgggtggagcaggagcaggagtgcgacgagagcgtggtgtacgtgatggacgggcagtgcggcggcgggggaggggaggacgccgacggcggcgcggcggcggcggcggcctgccggaaggtggcctccctctactcgcagaagggcaagaaggggcccaaccaggacgccgtcatcctctgccaggggttcggcatggaggacggcgtgttctgcggcgtcttcgacgggcacggccggtgcgggcagttcgtcagcaagctggtgcgggactacctccccttcatgatcctcagccaccggaacgcgctcttcctgggcgtcgacgacgacaacccggccttcagcgacgcgtcgccgtcctcgtccacggacggcagcggcggcggctcctcgccgtcctcgccggcgcagctgctggaggagtggcgcgaggcctgcgccaacgcgttcgaggccatggacaaggagctcaagctccagcccaacctggactgcagcttcagcggcaccaccgccgtgtgcgccatcaagcaggggcgggacctcatcgtcgccaacctcggcgactcccgggcggtgctcgccaccatgtcggacacggggtacctcaccgccgtgcagctcaccaccgaccagaagcccaacctgcctcaggaggcggagcggatcaagcgctgcaacgggcgcgtgttcgcgctcaaggacgagccgtcggtgcagcgcgtgtggctccccgacgaggactgcccggggctagccatggcgcggtcgctgggggacctgcggctgaagcggcacggcgtggtgtcggagccgcaggtgacgcaccgctgcgtcgggcgcggggacctgttcatcatcctggccacggacggcgtgtgggacgtgctgagcaacgaggaggtggtgtccatcgtgtgcgccacgccgcggaagcagcacgcttccaaggccgtcgccgaggccgcggcgcagcggtggcggaccaggtacccgtcgtcccgcgccgacgactgctccgcggtctgcctcttcctgcgggaccaggactggggcaccagcgtcgccgcggccaaggccaaggcggcctccgccgctgccgccgcgagggcgccggcgcacggccactgctaagccggggaggtgctccgccgagagtgtaactaagtgctgtaacatagtggtaattaagaagctcttgctgtgttttttttttctttttgcaaaaaaaaatgcaaaggagatgaggagggaatgggcgggtaattctcagttttgactcttgatcggtgatcggtgatcggtgatcagctgaccacggtgacgggggaaacaagggagtgggtggcgggaacgccgtttgtactctgtcagtagcatgtaatgttatcaagtggagtgcttctttgatgttgccggaaaaaaaaaaaaaaaaaaaa

SEQ ID NO: 7202 - protein, 387 aa, Panicum virgatum
  misc_feature: Ceres CLONE 1903961
  misc_feature (1)..(302): Pfam Name: PP2C Pfam Description: Protein phosphatase 2C
MGVCASSRRRVEQEQECDESVVYVMDGQCGGGGGEDADGGAAAAAACRKVASLYSQKGKKGPNQDAVILCQGFGMEDGVFCGVFDGHGRCGQFVSKLVRDYLPFMILSHRNALFLGVDDDNPAFSDASPSSSTDGSGGGSSPSSPAQLLEEWREACANAFEAMDKELKLQPNLDCSFSGTTAVCAIKQGRDLIVANLGDSRAVLATMSDTGYLTAVQLTTDQKPNLPQEAERIKRCNGRVFALKDEPSVQRVWLPDEDCPGLAMARSLGDLRLKRHGVVSEPQVTHRCVGRGDLFIILATDGVWDVLSNEEVVSIVCATPRKQHASKAVAEAAAQRWRTRYPSSRADDCSAVCLFLRDQDWGTSVAAAKAKAASAAAAARAPAHGHC

SEQ ID NO: 7203 - DNA, 2279 bp, Panicum virgatum
  misc_feature: Ceres CLONE 1904099
  misc_feature: Encodes the peptide sequence at SEQ ID NO. 7204
acccctcgcccccccccctctccctcatcccggacggccccctcgcttccgtgtggtaaatgctgcgaaatccttgcccattttttgttccgagcgccggatttctgtgagatatcgggttgttgtcagtgttcccgtggggttttctggctggtggtagcagatttggggatatctgtagatttcattttggtgcgggtttgaatttgggggctggattttggtgggttttgcggttcgcttcgcggctggagcggctacttttgcatagatctgcagcgctccagatttgttttgacttttggtttttaaatcatatatctctcggatggggatttaagttctcgattcttacttgggattttttaggggctttgctcatatatggaggtgcttcgctgagatattaccttgaaatttctgatagatctaagtctgctctgcacttgctctgagatgctatcgataggggtttgaagtttctgcgactcaagatttgttttatttttttttcaatttcatcgcattttgcggccggatctgtttgatttggtgcttgagctagtgattggtcttcagatctggtcctccagtctcatttcggagtaatgtctccatcgttttctcgccactaaccacatatccctctgctcccctcccacctgcagctacctaccttgagatccagccatgagggagatcctccacatccagggcggccagtgcggcaaccagatcggatccaagttctgggaggtggtgtgcgacgagcacggcatcgaccccaccggccgctacgtcggcacctccgacctccagctcgagcgcgtcaacgtctactacaatgaggcctcctgcggccgcttcgtgccgcgcgccgtgctcatggacctcgagcccggtaccatggacagcgtccgcaccgggccctacggccagatcttccgccccgacaacttcgtcttcggtcagtctggtgctgggaacaactgggccaagggccactacactgagggagctgagcttatcgactccgtgcttgacgtcgtgaggaaggaggctgagaactgcgactgtctccaaggcttccaagtgtgccattcccttggaggaggcactggatctggaatgggcactcttcttatctcaaagatcagggaggagtaccctgataggatgatgctcacattttctgtcttcccttcgcctaaggtgtcagatactgttgttgagccatacaatgcaacattgtctgtgcatcagttggtggagaatgcggatgagtgcatggttcttgacaatgaggctctttatgacatttgtttccgcactctgaagctaaccactcctagctttggagacctgaatcacttgatcagtgcgacaatgagcggtgtcacttgctgcctccggttcccaggacagctgaactctgaccttcgcaagcttgcagtcaacttgattcccttccctcgtctccacttcttcatggttggctttgcgccactcacctcgcgtggctcgcagcagtaccgtgccctcactgtccctgagctgacccagcagatgtgggatgctaagaacatgatgtgtgctgctgacccgcgccatggccgctacctcacagcctctgccatgttccgtggcaagatgagcaccaaggaggtggacgagcagatgatcaatgtccagaacaagaactcttcctacttcgtggagtggatcccaaacaatgtcaagtccagcgtctgtgacatcccaccgtgtggcctctccatggcctccaccttcatcggcaactccacctccatccaggagatgttccgccgtgtgagcgagcagttcactgctatgttccggaggaaggctttcttgcattggtacaccggtgagggcatggatgagatggagttcactgaggctgagagcaacatgaatgacctggtgtccgagtaccagcagtaccaggacgccactgcggacgaggagggcgactatgaggacgaggaggtgatccaggacgagtaaggtggtctggaccctgccccatgttgtacccaccagatcctggtttgctttaagctggagcttgcctatgtttggttactgttatttgcgtatgttatgctgagtatgtagtaagtacctccgtggtggtagcatgttgcatgctaccgcttattctctttcaccaccagaaagacatgttcgcctgcactgcttgatatgccatcgcgtatatgggaggagtattggatcaaaaaaaaaaaaaaaaaaaa

SEQ ID NO: 7204 - protein, 445 aa, Panicum virgatum
  misc_feature: Ceres CLONE 1904099
  misc_feature: Great-hit functional homolog of the protein sequence given in SEQ ID NO 9198
  misc_feature: Useful for making plants with modulated flowering time
  misc_feature: The plant flowers significantly late compared to wild-type.
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPCGLSMASTFIGNSTSIQEMFRRVSEQFTAMFRRKAFLHWYTGEGMDEMEFTEAESNMNDLVSEYQQYQDATADEEGDYEDEEVIQDE

SEQ ID NO: 7205 - DNA, 1898 bp, Panicum virgatum
  misc_feature: Ceres CLONE 1904188
  misc_feature: Encodes the peptide sequence at SEQ ID NO. 7206
gtcccgtctccgagtctctcctccctccctcagcggcgccggcacggtggctaggctagtctgatccccgtgcttgccttgtctaggcccttctccttctagatcccggccgcgcgcggctagcacgcagctcctgcgcctagagctataaacgcacggcctctcctaaataatcggcatcctctcgcttgctgctgccgaaaggcgggttgtgttcaagtagtgttcaactcggtttaggaatcgagccggacggcgaggttgctaaagctacaagcttctgcggcacagcgtcgtcgaggagaagctcgctcgcttctgcgggaggaaggtctaggcagcagcggtggtgtggtggtgagggcgagccccggcgaggaaggagcagctgcttcgcacaggcgcgcgaggagcgcggccgatcgagaccgtgaagctggcggccggcaagtggtgggagcggccagatgacacggccatgcccggaatggaccccggcggaggcggcagctcgcgctacttccatcagctgctccggccgcagcagccctcgccgctgtcgcccaactcccacgtcaagatagagcaccacaagatgtcgccagacaagagcccggtgggcggcgaggccgagccgggcggcagcggcagcggcagcggcgccggcggcggcgaccagccgtcctcgtcggccatggtcccggccgagggtggcagcgggtcaggcgggcccacgcggcgcccgcgcgggcgcccgccgggctccaagaacaagcccaagccgcccatcatcgtgacgcgtgacagccccaacgcgctgcactcgcacgtcctcgaggtcgcggccggcgcagacgtcgtcgactgcgtcgccgagtacgcgcgccgccggggccgcggcgtgtgcgtgctcagcggcgggggcgccgtcgtgaacgtggcgctcaggcagcccggcgcgtcgccccccgggagcatggtggccacgctgcggggccggttcgagatcctctccctcaccggcacggtgctgcccccgccagctccccccggcgccagcggcctcaccgttttcctctccggcgggcagggccaggtcatcggcgggagcgtcgtgggcccgctggtggccgcgggccccgtcgtcttgatggcggcgtcgttcgcgaacgccgtgtacgagcggctgccgctggagggggaggaagaggagacagccgcggccgccgccggagcggaaccgcaagatcaagtggcgcagtcggcgggactccacgggcagcagccgactgcctcccagtcctctggtgtgaccggaggggacgtgggcggcggcggcatgtcgctctacaacctcgccgggaatgtaggggcctaccagctcccgggagacaacttcggaggctggagtggaggcggcggcggcggtgtccggccacagttctgatccatgccttgccacccccaattctcatcggcggcatatgaagacgtacatcacatagattcaaatggtgcacgcagaagctaggcttgctatccagaactgagacatgcatgctggattgttcattggagagatcgacctttcatctgggtgctgctagaatataatgcatgtgtttgcacacggggaggatgcattggaaatcatctgggcgtttaaaaaaagagagtagtggtggttaatcaagggacaagaggaaagctatggattcatgcaaggcctagctcaataaactgaaaggtcagtgagatccgatgttttgtgtttccagcgttttcttttccccattttgatttgtaatgtggtattatattctgattgtatcttgctgtagaatgatgtttctattataaccatttgcttctctcctccaaaaaaaaaaaaaaaaaaa

SEQ ID NO: 7206 - protein, 322 aa, Panicum virgatum
  misc_feature: Ceres CLONE 1904188
  misc_feature: The sequence is a functional homolog of  SEQ ID NO 10 in the  10/669,824 US patent application
  misc_feature: The sequence is a functional homolog of  SEQ ID NO 10 in the  10/870,198 US patent application
  misc_feature: The sequence is a functional homolog of  SEQ ID NO 1399 in the  10/374,780 US patent application
  misc_feature: The sequence is a functional homolog of  SEQ ID NO 1400 in the  10/374,780 US patent application
  misc_feature: The sequence is a functional homolog of  SEQ ID NO 1412 in the  10/374,780 US patent application
  misc_feature: The sequence is a functional homolog of  SEQ ID NO 1495 in the  11/479,226 US patent application
  misc_feature: The sequence is a functional homolog of  SEQ ID NO 1509 in the  10/412,699 US patent application
  misc_feature: The sequence is a functional homolog of  SEQ ID NO 1510 in the  10/412,699 US patent application
  misc_feature: The sequence is a functional homolog of  SEQ ID NO 1838 in the  10/412,699 US patent application
  misc_feature: The sequence is a functional homolog of  SEQ ID NO 2078 in the  10/374,780 US patent application
  misc_feature: The sequence is a functional homolog of  SEQ ID NO 296 in the  11/435,388 US patent application
  misc_feature: The sequence is a functional homolog of  SEQ ID NO 298 in the  10/714,887 US patent application
  misc_feature: The sequence is a functional homolog of  SEQ ID NO 340 in the  11/435,388 US patent application
  misc_feature: The sequence is a functional homolog of  SEQ ID NO 342 in the  10/714,887 US patent application
  misc_feature: The sequence is a functional homolog of  SEQ ID NO 4 in the  10/669,824 US patent application
  misc_feature: The sequence is a functional homolog of  SEQ ID NO 4 in the  10/870,198 US patent application
  misc_feature: The sequence is a functional homolog of  SEQ ID NO 54 in the  10/225,066 US patent application
  misc_feature: The sequence is a functional homolog of  SEQ ID NO 64 in the  10/669,824 US patent application
  misc_feature: The sequence is a functional homolog of  SEQ ID NO 64 in the  10/870,198 US patent application
  misc_feature: The sequence is a functional homolog of  SEQ ID NO 718 in the  10/412,699 US patent application
  misc_feature: The sequence is a functional homolog of  SEQ ID NO 87 in the  10/669,824 US patent application
  misc_feature: The sequence is a functional homolog of  SEQ ID NO 90 in the  10/669,824 US patent application
  misc_feature: Useful for making plants with modulated growth and phenotype characteristics
MPGMDPGGGGSSRYFHQLLRPQQPSPLSPNSHVKIEHHKMSPDKSPVGGEAEPGGSGSGSGAGGGDQPSSSAMVPAEGGSGSGGPTRRPRGRPPGSKNKPKPPIIVTRDSPNALHSHVLEVAAGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEETAAAAAGAEPQDQVAQSAGLHGQQPTASQSSGVTGGDVGGGGMSLYNLAGNVGAYQLPGDNFGGWSGGGGGGVRPQF

SEQ ID NO: 7207 - DNA, 1935 bp, Panicum virgatum
  misc_feature: Ceres CLONE 1904245
  misc_feature: Encodes the peptide sequence at SEQ ID NO. 7208
gtcgtgtggtcagcgatctgcgagactgcgaccgctcctcggctccgctcagccgccgccgccgccgccgccgccgccaccccaccagccggcggctgccaccatgtcccgcggcagctccaattccgtattcctaggcgtcgacatcggcaccggcagcgctcgcgcaggtatctttgatcagaagggcaagttgctggggtcagcgagcagtcctatacagatatggaaggagaaagactgtattgagcaatcctcgacggatatctggcatgcagtctgtgctgcagtgaaatctgcttgctcactggcaaatgttgctcctgaggaagttgccggccttggtttcgccgctacttgctcccttgttgctgttgatgctgatggttcccctgtgtcggtttcttggagtggtgatacgcggaggaatatcattgtgtggatggaccatagagctgtgaaccaggcagagcgaatcaatgctagcaattcaccagtactgcaatactgcggtggcagtgtttcccctgaaatgcaggctccaaagctcctatgggtgaaggaaaatctgcaagagtcttggtctatggtttgtaggtggatggacctcagtgactggttagcatatagagcaactggtgacgacacccgcagcttatgcacaactgtctgcaaatggacatatctgggacatgcacacatggaacagtggcaagaatccgattcacgtgatatggaggcatgtggatgggacaatgttttttgggaagaaatagggttgggagaccttgtcgaaggaaactgtgcaaaaataggacgcagtgttgcttttcctggtcatcctcttggttctggtttgacagctgctgctgcaaaggaattgggcttgcttcctggtacacctgttggaactccgcttattgatgctcatgctggtggagttggagtcatggaaagcataccagatgaacaatttaaagctgatgtgcctgatgaagaagcaatatgccatcggatggtattggtttgtgggacatctacatgccacatggctgtctcaaagaacaaattgtttgttcctggtgtctggggaccattttggtctgcaatggtacctgagttttggctcacagaaggtggccaaagtgcaactggtgctctacttgattacattactgaaaaccatgttgcagcccctcttctttctaatcgtgcttcttctcaaagtatatccatatatgaactactgaacaagatgttgctttcaatgtcgcatgagcaaaatagcccttttctttcagcattgactcaagacatccatgtccttccagattttcatggaaatcggtctcccatggctgatccaaaatccaaaggggtgatttatggcctgacacttgatacaagcgagaaacatttggctcttatgtacctagcaaccattcagggcattgcttacgggactcgtcatatcgtggagcactgtaatgctcatggacacaagatcgacactcttcttgcctgtggcggacttgcaaagaactctgtttatatccaagaacatgcagatattatcggatgccaaataatacttcctagagagaatgagcctgtgcttttgggcgctgctgttcttggtgctgttgctggcaagaagtttcctggtgttcgtgatgcaatgaaagcgcttaacgcagcagggaaggttgtaaatccgtcgtcagatcctagagtgaagaaataccacgatgcaaaatatcagatattgaggtccctgtatgagcaacaactctctcatcgctcaaccatggtgcaggcattgcaaaagcgagcaggtcagcaggccaagacgatcgttgttacagaatggggaacccacaagtttatgtgatgttaataaagagaggaggttgataaaaaaaaaaaaaaaaaaaa

SEQ ID NO: 7208 - protein, 595 aa, Panicum virgatum
  misc_feature: Ceres CLONE 1904245
  misc_feature (17)..(247): Pfam Name: FGGY_N Pfam Description: FGGY family of carbohydrate kinases, N-terminal domain
MSRGSSNSVFLGVDIGTGSARAGIFDQKGKLLGSASSPIQIWKEKDCIEQSSTDIWHAVCAAVKSACSLANVAPEEVAGLGFAATCSLVAVDADGSPVSVSWSGDTRRNIIVWMDHRAVNQAERINASNSPVLQYCGGSVSPEMQAPKLLWVKENLQESWSMVCRWMDLSDWLAYRATGDDTRSLCTTVCKWTYLGHAHMEQWQESDSRDMEACGWDNVFWEEIGLGDLVEGNCAKIGRSVAFPGHPLGSGLTAAAAKELGLLPGTPVGTPLIDAHAGGVGVMESIPDEQFKADVPDEEAICHRMVLVCGTSTCHMAVSKNKLFVPGVWGPFWSAMVPEFWLTEGGQSATGALLDYITENHVAAPLLSNRASSQSISIYELLNKMLLSMSHEQNSPFLSALTQDIHVLPDFHGNRSPMADPKSKGVIYGLTLDTSEKHLALMYLATIQGIAYGTRHIVEHCNAHGHKIDTLLACGGLAKNSVYIQEHADIIGCQIILPRENEPVLLGAAVLGAVAGKKFPGVRDAMKALNAAGKVVNPSSDPRVKKYHDAKYQILRSLYEQQLSHRSTMVQALQKRAGQQAKTIVVTEWGTHKFM

SEQ ID NO: 7209 - DNA, 1625 bp, Panicum virgatum
  misc_feature: Ceres CLONE 1904314
  misc_feature: Encodes the peptide sequence at SEQ ID NO. 7210
atcccccttctctctattcctcccctcgatcctccgtgttgatccagtcgctgtccaggcctgttccattggaggagaatcgcccgggtggaaggagaggcttgcaaagcaaggtgattacttgacatggatgaacacatgggaagacgaacagtcggcggcctcctcttcacgaagggagggtcaattcttctcttcagggaagacggttcgcgctccaaggctaagaattgctgctcgcgccatggttgtagcggtcggcattcagttgacaaagccaaaggcaaggaggtgcacagggcagcggcgcccaatgaatcagcaccggctacccctgggagatcacgaattttgaggaagcccagcagaaagcctccacagccacaggaaagcagtgcttcagacagcatcagcagggatgcaggaggctcctgcagtgagaccggcaacaggtcaagagacactcctgggcgtgatctattggctcggctcaaggatagggtcaatgcgtcaaggaagcgatcgttgaacagggaaagcagcccaccgtcgccgaacggactcggtgctagttccccgagcagtagccggtccatctcaaggccgtcgcatcgggcagcttcaaggataagaaaagcagatgacagtgcaaatgcaggaactgacagtgcgcccaggaacggctctggagatgctaggaggaattcagagaggagtgacgatgacttgctgctagttgagcaggtagcaagagaccatgtgccttctgaaggttttctttctggattcatggcaagatacagaagcggccttcagggaggagtttcatctctggaggacagcgtggaggattcaaatggatactggcgctttgatacgggagtaactgaagagcttgagaacttcttcatattcaatgatcgccatagaggaatgaggatggatatcgacggcatgtcttacgaagaattgcttgccttgggggagcgaattggtactgtaaacactggtctttcagatgatgcgttggcaaagtgcctgaataggagcatttacatgcccacagcttcaggttctcatgaagattgtgacagaaagtgtagcgtttgccaggaggagtatttagccggtgaggagctgggcaagatggcatgcaaacactactaccacatgccctgcatacagcgctggctcaggcagaagaactggtgccccgtctgcaaatcagttgctctgaatacgaactagcaaattacttccccagcaatgttgtgtatagattgctcatgtctagacacattattttctctctctacttcttcctagaacaaacctgtcatttgtttggaccttcaagcttccttgctactaccttcagctcagaatctgcagcaactgggcaaggaaaaggaatcaaggaataactcaagtgaaaagttccactttctcctactgttgaagacagaatttgttgctggtcaattcatgttctttgtctgtgttgtaaatacacaccttctcatccttaatttcttttttagtgaaacaaagatccatatatttgttaaccgtagagtttgatccaaatacgtagggatacagcataaaaaaaaaaaaaaaaaaaa

SEQ ID NO: 7210 - protein, 373 aa, Panicum virgatum
  misc_feature: Ceres CLONE 1904314
  misc_feature (1)..(41): Pfam Name: zf-C3HC4 Pfam Description: Zinc finger, C3HC4 type (RING finger)
MDEHMGRRTVGGLLFTKGGSILLFREDGSRSKAKNCCSRHGCSGRHSVDKAKGKEVHRAAAPNESAPATPGRSRILRKPSRKPPQPQESSASDSISRDAGGSCSETGNRSRDTPGRDLLARLKDRVNASRKRSLNRESSPPSPNGLGASSPSSSRSISRPSHRAASRIRKADDSANAGTDSAPRNGSGDARRNSERSDDDLLLVEQVARDHVPSEGFLSGFMARYRSGLQGGVSSLEDSVEDSNGYWRFDTGVTEELENFFIFNDRHRGMRMDIDGMSYEELLALGERIGTVNTGLSDDALAKCLNRSIYMPTASGSHEDCDRKCSVCQEEYLAGEELGKMACKHYYHMPCIQRWLRQKNWCPVCKSVALNTN

SEQ ID NO: 7211 - DNA, 1599 bp, Panicum virgatum
  misc_feature: Ceres CLONE 1904382
  misc_feature: Encodes the peptide sequence at SEQ ID NO. 7212
agcggcgggagtccgcatctcgtttctctttcagctctcccccggatgaactccgccgccgtatccgtctcggcaacccctgggttctgactctgatcacttgatcagagctcacaaaaccaaagctggactcgtgctctgttcctcaagcagccggtggttgttcctctcgagctccttcgacggacaggcgacgggatgcaaggtttgcagcatctccgtatcatggttcaacttcaaccggatcctggattagacgtctctgcttgtgtttttcttggtttcaggggaggatcgccaggtgccggtgtacgcgtcgggcatcgaggtactcgaaaagcttcaggagaaatgggaatccacccagcgacggtacccggcaatgtactccagtgtcgttggtggcatcgtccttgatccatccatgatggtgatccccatcgacgaccacatggtccaccgcggccatggcgtcttcgacaccgccaccatatctgatggatgcttgtacgaactggattcacacctggatcggctgctagcatctgcatccaaagcaaagatcgatccaccgttctcgcgagagacgatgcgtgaaattctgatccagatgaccgctgcctccggatgcaaggacgggtcgatcaagtactggctgagcgccggccccggcgacttcctgctgtccccgacgggctgcacgggacccgcgttctacgccgtcgtcatagccgccgcctccgcctccgccgccggccgccgctctcagcggaacgatggcgtcaaggcgatcacgaccgccgtgccgatgaagcacccgttcttcgcggggatcaagagcgtcaactacctcccgaacgcgctggcgctggcggaggcggaggcgcggggtgcgtacgcgccggtgtgggtcgacgaggaagggtgcgtcgcggaggagcccacgatgaacgtcgcgttcgtcacggcggccggggacctggtgctgccggcgttcgacagggtgctcggcgggtgcacggccaagcggatgctcgcgctggcgccgaggctggtcgaggccggccttctcaggggtgccggagaggcgaggatctccgccgacgaggccaggcggtgcgccgagatgatgttcgtcggcagcgggctgccggttctgccggtcgtcgagtgggacggccagccagttggggatgggcgagttgggaaggtcagtcttgccctgtctgaaatgctccgggatgacatgaagtctggtccagataggatccctgttccttacagttaaggaggcatgattgctctgcatcagagaagaatgaacatcaggggtttctatgctatgtacatattttgctctaacaagtgcaaacaaggctgttttatttttttcactttgaggtccctgatttcttgaaggacaaaagaggcactactttttacattttggaactgaataaggttgatgcttctgcagaatagcagagcagttagaacagttgctcttacagtaacagttgtactagcttacatctgcacccggcatgaatattcgaagccagtttccagcagttttttcaaaaaaaaaaaaaaaaaaaa

SEQ ID NO: 7212 - protein, 301 aa, Panicum virgatum
  misc_feature: Ceres CLONE 1904382
  misc_feature (1)..(279): Pfam Name: Aminotran_4 Pfam Description: Aminotransferase class IV
MYSSVVGGIVLDPSMMVIPIDDHMVHRGHGVFDTATISDGCLYELDSHLDRLLASASKAKIDPPFSRETMREILIQMTAASGCKDGSIKYWLSAGPGDFLLSPTGCTGPAFYAVVIAAASASAAGRRSQRNDGVKAITTAVPMKHPFFAGIKSVNYLPNALALAEAEARGAYAPVWVDEEGCVAEEPTMNVAFVTAAGDLVLPAFDRVLGGCTAKRMLALAPRLVEAGLLRGAGEARISADEARRCAEMMFVGSGLPVLPVVEWDGQPVGDGRVGKVSLALSEMLRDDMKSGPDRIPVPYS

SEQ ID NO: 7213 - DNA, 1532 bp, Panicum virgatum
  misc_feature: Ceres CLONE 1904388
  misc_feature: Encodes the peptide sequence at SEQ ID NO. 7214
aaattatccatccacacgcagacacgctcccactcccccgagctcgctcgctcgcacgcacgccgcggcggaacaccgccgccgccatggcctccacgtgcaccttcctctcgctgcgcctccccaccccgtcccctgcccacgcggcttcgtctccttccctcccgctgcccctgctccggcaggcgcggggcggggcggcgtcctcggctctggtggcacgcgcggcggcgccagcggcggctccgtcgccgctgttcaaccccaggggggaccctttcctgtccaccctcgcggccgcctcgccggaggaccttgcggccgccgctggtggcgagcgccgcggcgaggaccacctgccgttcctcgagatcttccagaacgccaagctcatggccacgcccgcgcaggtggagcgttctagcagttcttacagtcaacacagacctagaaggcctccaccagatttgccttcattgcttcttcatggtcgaattgtttatattggaatgccgttggtgccagcagtgactgagcttgttgttgcccagttgatgtaccttgaatggatgaatagtaaagaacctgtttatatatacatcaactcaacaggaacagctcgtgatgatggtgaaccggtcgggatggagagtgaaggttttgcaatctacgatgcaatgatgcgtatgaaagctgagatccacacactttgtataggagctgcagcaggtcatgcttgtcttgtgcttgcggccggaaagaaaggcaaacgctatatgttccctcatgccaaagctatgattcagcaacctcgtattccttcgtatgggatgatgcaagcatcggatgttgttattcgagctaaggaggtcgtgcacaacaggaacacgttggtcaaacttttagcaaggcatacaggaaatccgccagagaaaatagacaaggtaatgagaggaccgttttacatggactccttgaaggcaaaggagtttggggtcattgacaagatcctctggcgcggtcaggaaaaatacatggctgacatgctctccccggatgagtgggacaaagttgctggagtcagacgccctgatccaatgtgatgttgtacactggaacattagtacttagttaggctcaaagcttgcaaggggaggtaacagctgttgctgaaaaataatgcttgattgtcatggtgacggtcagttagagccaagggaaacttgtcttgctagataagcgtagattagagcacgggccatcaaaatatcgtgtgtggtgtctggatgagagctagcacgagctttccatgaagttattcttgttcctctcaccaattcttggccagattttggtatttattgttagtatatatagttcacacattttggtcgatccaaaggttgaactagccaagcccatagtattatccttcatatttccatggccacagtgcccttataatctggacttctgcgaatccgatgtacgagtcatgtgacctacaatcatcagcacacttggtttccgct

SEQ ID NO: 7214 - protein, 338 aa, Panicum virgatum
  misc_feature: Ceres CLONE 1904388
  misc_feature (1)..(183): Pfam Name: CLP_protease Pfam Description: Clp protease
MASTCTFLSLRLPTPSPAHAASSPSLPLPLLRQARGGAASSALVARAAAPAAAPSPLFNPRGDPFLSTLAAASPEDLAAAAGGERRGEDHLPFLEIFQNAKLMATPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKAEIHTLCIGAAAGHACLVLAAGKKGKRYMFPHAKAMIQQPRIPSYGMMQASDVVIRAKEVVHNRNTLVKLLARHTGNPPEKIDKVMRGPFYMDSLKAKEFGVIDKILWRGQEKYMADMLSPDEWDKVAGVRRPDPM

SEQ ID NO: 7215 - DNA, 1462 bp, Panicum virgatum
  misc_feature: Ceres CLONE 1904486
  misc_feature: Encodes the peptide sequence at SEQ ID NO. 7216
gcatcccatcccatttcggccctcctcttccgtcactcctccctcctctcctcctcctgcgcccccactatttattcatcccaccacgccgatgcgccgccccggtggtgccgccgtcgtgccgccgtagaccgaccgccactcttttacaccccgcccccagtcgcaggtgagacggaggcgtggcgccggcgatggcgtcggagcccgtggcgcgcgcggtggccgaggaggtggcgcggtggggcgccatgcgccagaccggggtcagcctccgctacatgatggagttcggggcgcggcccacggagcggaccctactcctcgccgcgcagttcctgcacaaggagctccccatccgcatcgcgcgccgtgcgctcgacctcgagtcgctccccttcggcctctccaacaagccacccatcctcaaggtgagagattggtacgtggactcattccgtgacatccggtccttcccggaggtgaggagcaaggaagatgagctcacattcacccagatgatcaaaatgattagggtgcggcacaccaatgtggtccccacaattgcattgggagtgcagcagctgaagaagaacttgggcggttcgaaggcatttccccctggaatcgatgagatccatcaattccttgaccgcttctacatgtcaaggattgggatccggatgctgatagggcagcatgttgctttgcacgatcctgatccagagcctggtgtgataggacttataaacacaaaaatgtcacccatgacggtagctcgaattgctagtgaagatgcacgtgctatttgcatgcgggagtatggatcagctcctgatgtcgacatatatggagatccagattttacgtttccatatgttacaccacatctacatctcatgattttcgagttggtgaagaactcccttcgtgccgtacaggaacggcacatgaactctgataagcacgcacctccagttcgaatcatagttgcagatggagcagaggacgtaactattaagattagtgatgaaggtggtggaataccaaggagtggcctctcaagaatttttacttatctatatagtacagcagaaaaccctcctgatctggatgaacacaacgaaggagtaactatggctggatatggttatgggatccctattagtcgtctctacgctcgatatttcggtggggacttgcagatcatctctatggaaggatatggaactgatgcttacctccacctatcacggctgggagattcggaggaaccattgccctaatcaattgggaagaagccattgctgtaattaggactctatttgctttcgcgattgctgtgctggtatgcaaatatagttccgaaggccagccagctttatatagttcatctgtacgtgtcatactctggaagcaacttgcttctgatttcttccactattacaattgttcaacctcg

SEQ ID NO: 7216 - protein, 363 aa, Panicum virgatum
  misc_feature: Ceres CLONE 1904486
  misc_feature (1)..(128): Pfam Name: HATPase_c Pfam Description: Histidine kinase-, DNA gyrase B-, and HSP90-like ATPase
MASEPVARAVAEEVARWGAMRQTGVSLRYMMEFGARPTERTLLLAAQFLHKELPIRIARRALDLESLPFGLSNKPPILKVRDWYVDSFRDIRSFPEVRSKEDELTFTQMIKMIRVRHTNVVPTIALGVQQLKKNLGGSKAFPPGIDEIHQFLDRFYMSRIGIRMLIGQHVALHDPDPEPGVIGLINTKMSPMTVARIASEDARAICMREYGSAPDVDIYGDPDFTFPYVTPHLHLMIFELVKNSLRAVQERHMNSDKHAPPVRIIVADGAEDVTIKISDEGGGIPRSGLSRIFTYLYSTAENPPDLDEHNEGVTMAGYGYGIPISRLYARYFGGDLQIISMEGYGTDAYLHLSRLGDSEEPLP

SEQ ID NO: 7217 - DNA, 2953 bp, Panicum virgatum
  misc_feature: Ceres CLONE 1904640
  misc_feature: Encodes the peptide sequence at SEQ ID NO. 7218
acctgcagcctgcaggcaccgcggtcgagcactctgccgccgccgccgcccctcgccgcactctgccggcgaccatgtcggaccaggcgccaccttacgcgcctctccccctcgtctcctcccttcccccagatcctaactccaccccgacgccgaaccccacctttgtcttccccaatcctgccttccccaacaagcgcaagcgcaccggattccgccgcaaggtcccctctgggtccccggccgcccccgcggcctctcccgcggcgccctcccagccgccaccccttgcttccgctgccgacgacatcatagtgatcaaccgggagcctaccgcggaggccgtcaccgcgctcaccgcgggtttcccggcggactctctcaccgacgaggagatcgaggctggcgtggtctccgacgtgggcggcatcgagcaggtcaactacatcctcatccgcaaccacctcctctgccggtggcgcgagacctacaactcctggctcgccaaggagcccttcgcgacgctcatccctccccattgcgagcacctcctgaacgccgcctactccttccttgtgtcccacagctacgttaacttcggtgtcgcgccggccatcaaggagcgcatccccaaggagcccacgaggcctaccaccatcgtcgtcattggagcaggccttgccgggctcgccgcggcacggcagcttgtggcgttcgggtttaaggttatagtcttggagggccgcaagcgctgcggtggccgtgtgtacacgaagaagatggaaggcagtgggcgttcagctgctggtgatcttgggggcagcgtgcttaccgggacgtttggcaacccactgggaattgtggcgaagcagctcggcttgccaatgcacaagattagggacaagtgcccactctaccgtccggatggatcaccagtcgacccggaggtggataagaaagtagagattacatttaacaagcttcttgataagtcaagcaacctgcggtcatccatgggggaggtggcagtagatgtttcgctcggggctgctcttgagacattacgccagacagacggaggcatatccacacaggaggagaagaacttgttcaattggcatctagcaaatctcgagtatgccaatgcgggattgttgtcgaagttgagccttgcgttctgggaccaggatgatccctatgacatgggtggggatcactgcttcttgcctggtggcaatgggagacttgtgcaagccctggcagagaatgtgccgattgtttacgagaggacggtgcacactgtacgatatggaggggatggggtgcaggtggttgtcaatggagggcaggtgtatgaaggggacatggcgctgtgcacagttccacttggggttctgaaaaatggaggcatcaagtttgtacctgagttgccacagaggaagcttgatagtattaagaggcttggattcgggttattgaacaaggtagccatgctgtttccgcatgttttctggagcactgaccttgatacatttgggcatctggttgaagatccaaggcgacgtggggagttctttctgttctatagctatgcgacagtggctagtggcccattgttgatggccttggttgctggtgaagctgctcacaattttgaaaccacaccgccaactgatgctgtcagctcagttcttcagatactacgaggtatctatgaaccacaagggattgaggttccagatcctctacagagtgtttgcactagatggggcactgactccttcagtctaggttcatattctcatgttgctgtcggagcatctggagatgactatgacatattagctgaaagtgttggtgatggacgacttttctttgctggcgaggctaccacgagacgttacccagcaacaatgcatggtgcttttatcagtggtttgcgggaggctgctaatatcacactccatgccaatgcccgagtagcgaagacaaaagtggacagaagctcgtcaacaaacacacaggcttgtgctactatactaacggacttgtttaggcaaccggatttggagtttgggagcttctctgttattttcggaggaaaagcttccaacccaaaatccccagctattctaaaggtggaattaggtggccagcgaaagaagaatgcaactgaaggtgcgaagacagaacagaaccactcaaacaaattgttgttccagcagctccagtcacattttaaccagcaacaacaactttatgtttacaaattgctatcacgacagcaagctatggagttaagagaagttagaggaagtgatgacatgaggttgcattacctctgtgaaaaaatgggggtgaaattagttggcaggaaaggcctcggtcctggtgccgatgcagtgattgcatccattaaggcagaacgtaacaggagtcgagctaaacctggcccgtcaaagctgaagaaatcaatgaagcctaatgttgttgcgtcatgatcactgactgctgatttcttgtggggcctgactgccaatagttgataacttgatatttaccaggcaacgaatgtgttcatttggatggagcatccgctcctgctgaatttgtctcaagccaacttgcatcgaatatttggcaattgcttgaggttaaagtaattttgaacgatacctcttagattccagtgattttccatttttttttttcagagaggctgttgtgatgttgcatctgaaatctgcggattctgcaaagcttatttgttggtggtgtaacctctaattgttgaaggagcttgtatgtggatgtccttctgtaatctcaaattggaagagaaatgtagctggtgtaaatgttttttttaagaaaaatggatgagaaatgtgacttttcttggaatttttgcccctatatttttctctatgctcaaaaaaaaaaaaaaaaaaaa

SEQ ID NO: 7218 - protein, 808 aa, Panicum virgatum
  misc_feature: Ceres CLONE 1904640
  misc_feature: Great-hit functional homolog of the protein sequence given in SEQ ID NO 9194
  misc_feature (1)..(429): Pfam Name: Amino_oxidase Pfam Description: Flavin containing amine oxidoreductase
  misc_feature (1)..(426): Pfam Name: Amino_oxidase Pfam Description: Flavin containing amine oxidoreductase
  misc_feature (1)..(428): Pfam Name: Amino_oxidase Pfam Description: Flavin containing amine oxidoreductase
  misc_feature (1)..(425): Pfam Name: Amino_oxidase Pfam Description: Flavin containing amine oxidoreductase
  misc_feature (1)..(424): Pfam Name: Amino_oxidase Pfam Description: Flavin containing amine oxidoreductase
  misc_feature (2)..(433): Pfam Name: Amino_oxidase Pfam Description: Flavin containing amine oxidoreductase
  misc_feature: Useful for making plants with modulated flowering time
MSDQAPPYAPLPLVSSLPPDPNSTPTPNPTFVFPNPAFPNKRKRTGFRRKVPSGSPAAPAASPAAPSQPPPLASAADDIIVINREPTAEAVTALTAGFPADSLTDEEIEAGVVSDVGGIEQVNYILIRNHLLCRWRETYNSWLAKEPFATLIPPHCEHLLNAAYSFLVSHSYVNFGVAPAIKERIPKEPTRPTTIVVIGAGLAGLAAARQLVAFGFKVIVLEGRKRCGGRVYTKKMEGSGRSAAGDLGGSVLTGTFGNPLGIVAKQLGLPMHKIRDKCPLYRPDGSPVDPEVDKKVEITFNKLLDKSSNLRSSMGEVAVDVSLGAALETLRQTDGGISTQEEKNLFNWHLANLEYANAGLLSKLSLAFWDQDDPYDMGGDHCFLPGGNGRLVQALAENVPIVYERTVHTVRYGGDGVQVVVNGGQVYEGDMALCTVPLGVLKNGGIKFVPELPQRKLDSIKRLGFGLLNKVAMLFPHVFWSTDLDTFGHLVEDPRRRGEFFLFYSYATVASGPLLMALVAGEAAHNFETTPPTDAVSSVLQILRGIYEPQGIEVPDPLQSVCTRWGTDSFSLGSYSHVAVGASGDDYDILAESVGDGRLFFAGEATTRRYPATMHGAFISGLREAANITLHANARVAKTKVDRSSSTNTQACATILTDLFRQPDLEFGSFSVIFGGKASNPKSPAILKVELGGQRKKNATEGAKTEQNHSNKLLFQQLQSHFNQQQQLYVYKLLSRQQAMELREVRGSDDMRLHYLCEKMGVKLVGRKGLGPGADAVIASIKAERNRSRAKPGPSKLKKSMKPNVVAS

SEQ ID NO: 7219 - DNA, 2409 bp, Panicum virgatum
  misc_feature: Ceres CLONE 1904725
  misc_feature: Encodes the peptide sequence at SEQ ID NO. 7220
agctggccacaagcagtagtcccttcccacgctttgagagtgccctgctgcggctgtctgcctgccgctctcgtcgtcgtcctcctccatgggcctcttcagctcgccagcgaaggtctacaagccggccgccgatgtcgacctcggccccggcagcgacgagttctacatcagccccaatgtcaaagctcctcgagttgctgggctcctggtgaagatattcgtgtggatcctggagatgccgatcatcgggcagattgtactctacatcctgaagaaggacaatctcatcaacaagctggtatctgacgccgacatcccggagccgccgctgttcacggcaacccacaactgggaagacattccggagcagaacgtggtgctgaccaagcccgacctgtcggcggccgagcgggtccaggaggccgtcggctgcctcccggcgcggctggaagccacgctcgccggcgacgagccgtcgttgggcctgaagcggtggacgatccgggacttctacgacgcgtacagctcgggggagacgactcctgttcaggtggcgacgaggttcctggcggcggtgaaggagagctcggggcctggcctgaacatggccttcttcatcagctgcgcccccgaggacgtgatgaggcaggccgaggagtccaccctgagataccagagaggtgcgccgctgtcggcgcttgacggcgtgctggtggcggtcaaggacgagatcgactgcgcgccgtacccgacgacgggcgggacgcggtggctgggcgcggcgcggcggtgccaggcggacgcggcgtgcgtggcgcagctgcgggcctgcggcgccgtcctcgccggcaaggccaacatgcacgagctcggcgccggcaccagcggcatcaacccgcaccacgggtccacgaggaacccgtacaacgccggcaagatcgccggcgggtcctccagcggctccgccgccgtcgtctgcgccggcctctgccccgtcgccctcggcgtcgatggtggcggttctgtccggatgccggcggcgctgtgcggcgtcgtggggttcaagcccaccgccggccgcctctccagcgccggggtgcttccgctcaactggacggtcgggatacccgggatcttggcggggacggtggaggacgccgtcatcgcatactcggcgatcgtcgatcagtcccagccatcctatttacggcctgaactgaatctgcctcagctcaagtccagcctgtccatcaacaacatcaaactagcgaaatacgcaaagtggttcaacgacagtgccgaggacatcaggagctgctgcgacaaggctctcaagacgctgcaggcgcactacggctggcagaccgtggatgtgaccattcctgagatcgaggagatgcggctggcgcactacgtcaccatcgggtccgagtgcacgacgtcgctcgccaaatacctcgacaagctgaagaggtctgagatcggctgggacgccagggtcgcgctgagcgtctacggttccttcagcagcagagcctacctgaactcgcaaagacttaggaaccggcagatgtacttccacaaggagatcttcaagaccgccgacgtgatcgtctcaccgatgaccggtgtgaccgcctacacgctgcaagacgacgcgttcgacactggggagctggactacataaacggagccgcgctggtccgctactccatcgcagggaacttcctgggcctgccggccatcaccgtcaaggtcgggtacgacaagggcgggctccccatcgggctccagttcatcggccggccgtggtccgaggcgaccctgctccacatcgcgttcgcgatgcaggaggcctgcgccaagtgctacaagaagccggtggtgttctacgatctcctcaagaaggagtgacggcgaccgacgagcgcagagaggatctccagctccgcccgttttgatcctgcttgtgtcccttgtagagccttcgcctggatcatggatggatgccttcaattggagtggtaaacagggagccggcgcgactgtgcatccaatccaggcggaggattgtactgcgagattgttcttgtttagcgtagagaatgtttttgtccggggcgaagccagagcgaaaccgagggggtgtgccactttaccacaaaattcgaagatctctatattttaatagagtcagtcatcgcgatgactagtaaatggtcgtatagatattatggattattttttttgccgggaattttgtcttagagtttcaaatttcagtcaatactttaccccaattttagaacaatcgatcaaaatttttcttgctttatttgtaatttcactagaattccgctaatggaaaccataagcattgtgcggaaaaaaaaaaaaaaaaaaaa

SEQ ID NO: 7220 - protein, 609 aa, Panicum virgatum
  misc_feature: Ceres CLONE 1904725
  misc_feature (1)..(421): Pfam Name: Amidase Pfam Description: Amidase
  misc_feature (1)..(214): Pfam Name: Amidase Pfam Description: Amidase
  misc_feature (2)..(430): Pfam Name: Amidase Pfam Description: Amidase
MGLFSSPAKVYKPAADVDLGPGSDEFYISPNVKAPRVAGLLVKIFVWILEMPIIGQIVLYILKKDNLINKLVSDADIPEPPLFTATHNWEDIPEQNVVLTKPDLSAAERVQEAVGCLPARLEATLAGDEPSLGLKRWTIRDFYDAYSSGETTPVQVATRFLAAVKESSGPGLNMAFFISCAPEDVMRQAEESTLRYQRGAPLSALDGVLVAVKDEIDCAPYPTTGGTRWLGAARRCQADAACVAQLRACGAVLAGKANMHELGAGTSGINPHHGSTRNPYNAGKIAGGSSSGSAAVVCAGLCPVALGVDGGGSVRMPAALCGVVGFKPTAGRLSSAGVLPLNWTVGIPGILAGTVEDAVIAYSAIVDQSQPSYLRPELNLPQLKSSLSINNIKLAKYAKWFNDSAEDIRSCCDKALKTLQAHYGWQTVDVTIPEIEEMRLAHYVTIGSECTTSLAKYLDKLKRSEIGWDARVALSVYGSFSSRAYLNSQRLRNRQMYFHKEIFKTADVIVSPMTGVTAYTLQDDAFDTGELDYINGAALVRYSIAGNFLGLPAITVKVGYDKGGLPIGLQFIGRPWSEATLLHIAFAMQEACAKCYKKPVVFYDLLKKE

SEQ ID NO: 7221 - DNA, 1872 bp, Panicum virgatum
  misc_feature: Ceres CLONE 1904805
  misc_feature: Encodes the peptide sequence at SEQ ID NO. 7222
aaggaaaagcagcagccgccgcggccacagccaacaggtgggtccagcccgagccccgaggccgcgcctcgtttcccctgccccaaagcacacgactcctgcgattctgccagcaaaagaaatgaaaaattttaggaatttttcgcggaattaaacagacaaagccaaggaaagaaaccaaccaaatcacgggagagtcggacccactcagcgcgtccaccctggcccacgacatggcgcagctggaggccggcgccgccgacgccgcggcgatggatccggccccggcggcgccgccggtggtcgagtggcccgagggcggcgcgctgacgcgggactgggtggcgaggctggcgtccacgctggactggtgctcgcgccacctccccgcggaccgcctcccgacggtgctcccgcccgcgctcgtccagcggctggttctggccgcggccgccatcctgcaccgcgagcccaacctcgtgcgcgtggacccgcggcccgggcagtccgtcgtcgtcgtcggggacgtccacggccagctccacgacgtcatcttcctgctccgcgacgccgggttcccctccgaggagcgggtcttcgtcttcaacggggactacgtggaccgcggcgcctgggggctcgaaaccctcctcctgctcctcgcttggaaggtgttacttccgaattgcgtttttcttctcagagggaatcatgaatccaagtattgcacttcggtttatggttttgaaaaggaggtaatgactaaatataaagatcaaggccctcaggtttatcggaagttcttaagatgttttgaggaccttcctctagcaacaataatagcaggatgtgtgtacaccgcccatggtgggatcttccgtgggacgattgtgttaccatcaaagagatcaaaaaagggaaagaaaggtcgcaaaaacaaggctgattttactgttgattcgacgtccatcaggcttggatctctggatgagttattgaaagcaaggagaactgttcttgaccctccttatgagggtcaaaatttgatccctggagatgtgctttggtccgacccttccttgcagatgggtctttcaccgaatcaggaaagaggcatcggtttgctttggggtccagacatcactcagcagtttctgcgtacaaataatttgaagttaatcatcaggtctcatgaaggtccagatgctagagacaaacgacacgatctattaggaatggataaaggatatacaatcgaccatgatgtagaatgcgggaaacttattactctcttcagtgctcctgactacccgcaatttcaggcttcagaggaacgatacaacaactgcggagcatatattgtccttaatccaccagattttgctacccctgttttccatagctttgaagctgtcaagcctcgacctccggcgcatccgttctatgattttgtagatgtggccgactcagatgaagagttgaatctagacgccatggacagtggcacgtcgagccaatgatgatatcttctcgccctgtatcattgtatctatcatgcaaactgtcaccaaagaagcgtgccatcaattttttgttgtcattgatgctgacgtagtggcgttgcaggtaatggcatagcctcctgtcatgtgcgccaatctgatttgttggttcagattaggttgatctgcatctaaaaagcagtgacccagaaatatgacatcttgagattgagtgcgagaaaatcagacggttgagccttcctcctgccgatgcattcgctcatgttatctgaagaagcttgtctgcttctgctttggagtctttcagcaaatgatgcaaatttcaacagaaaaaaaaaaaaaaaaaaaa

SEQ ID NO: 7222 - protein, 428 aa, Panicum virgatum
  misc_feature: Ceres CLONE 1904805
  misc_feature (1)..(234): Pfam Name: Metallophos Pfam Description: Calcineurin-like phosphoesterase
MAQLEAGAADAAAMDPAPAAPPVVEWPEGGALTRDWVARLASTLDWCSRHLPADRLPTVLPPALVQRLVLAAAAILHREPNLVRVDPRPGQSVVVVGDVHGQLHDVIFLLRDAGFPSEERVFVFNGDYVDRGAWGLETLLLLLAWKVLLPNCVFLLRGNHESKYCTSVYGFEKEVMTKYKDQGPQVYRKFLRCFEDLPLATIIAGCVYTAHGGIFRGTIVLPSKRSKKGKKGRKNKADFTVDSTSIRLGSLDELLKARRTVLDPPYEGQNLIPGDVLWSDPSLQMGLSPNQERGIGLLWGPDITQQFLRTNNLKLIIRSHEGPDARDKRHDLLGMDKGYTIDHDVECGKLITLFSAPDYPQFQASEERYNNCGAYIVLNPPDFATPVFHSFEAVKPRPPAHPFYDFVDVADSDEELNLDAMDSGTSSQ

SEQ ID NO: 7223 - DNA, 2612 bp, Panicum virgatum
  misc_feature: Ceres CLONE 1904809
  misc_feature: Encodes the peptide sequence at SEQ ID NO. 7224
ggctcggttccttcagtaggtcgctcggcttcctcgtcagattacggccggcgggccttgccgcagagctcggggcggcgccctccagcccgtgcatcgacttgcccccacccctgcccctcagggctcaaggccccaggcttttctttccccctatttatctgacgactaggtgagcggcggcggcattagtcacgtctttgcctagccctttgccggcgacgagcatccaccaggcaaagtgcggatggagcagcatgattccatggctgactcaccaaggaggcggcataaccttctgcgagacaaggtccaactggtgaaaaggaaggactcaaaccgctatgagatcattcgctttcatgatccattgtcttttgagaaaggcttctttgttgtgatccgtgcctgccagcttctggtgcagcacaatgaaggtataatatttgtgggtgttgctggaccctctggtgctgggaagacagtgtttactgagaaggtcgttaatttcatgcctgatgttgctgtgatatcaatggacaactacaatgacgcaactcgcatagtcgatggcaatttcgatgatccacgtctgacagactatgacacactgttggaaaatattcacggtctgaaggaaggacggtcagttcaggttccaatatacgatttcaagtcgagctgccggactgggtatagaacagttgatgcccctagctcccggattgttatcattgaaggtatatatgcactaagtgagaagttacggcctgtgatggacttgcgtgtttctgtcactggtggtgttcattttgacctggtgaagagggttttaagagacatacaacgagctggccaggagcctgaagaaataatccatcagatctcagaaacagtttatccaatgtacaaggctttcattgaaccagatttggagactgcacatattaaaatcatcaacaagttcaacccattctcagggttccaaaatcccatgtacattctaaagtcaccaaggtctctatcacctgagaaaatcaaagctgtgcttggcgatgatcatacaggaagcaatgaagaaacttatgatatatatctacttccacctggggaagacccagaagcgtgccaatcttatttgagaatgcggaatagggaagggaaatataacctaatgtttgaggaatgggtgaccgacaatccttttattatatcaccaaggattacttttgaagtcagtgtacgtcttcttggcggtttgatggcactgggatatactatagcagctatactgaagagaagcagtcgtgttttttctgatggcaaggcaactgttaaaattgactggctggagcaacttaaccggcagtatatacaggtgcaaggaagagatcggctttacgtcaaatttgtagcggagcagttaggcttggatggttcttatataccacgcacatatattgaacaaattcagctggagaaattgataaatgatgttatggcattaccagaagatttgaagacaaagctcagcattgatgatgagctggtctcaagtccaaaggaagcattttcccgtgtttctgcggataaaagaaacaaacttatgaagagtggtctatcacattcatattcaacacatggagacaaaaatattgtgaagttgagtaaactgacagatagcaacaggaggtatggtggagggcgagcccctgaacctcctgccatcaaccagggtgcaatcacccagctttctgagcagatatcaacattgaatgaaaggatggacgagtttacctctcgagttgaagaacttaattcaaagtttacagtgaagaaacatttacccagtcagcagaatttagctcttccaaatgatgcttgtaatggttccacgcctacaaatctctttgtttctcagttaggcaatggtactctgatacctaattcttcttcgtcgaacctactttcaaaggattccccgatgatagaagagattatgaacatagcaagaggtcaacgccaagttatacatcagctcgacaatctgaccaacctgcttcatgagcatttggtcttgactcgtcagtctaatgctgccagcaggaatcgagtgttggatatcgacactgtcatctgtccacttatttgcctaacagtagctagtattgggtacttcatgtttaaaggtctgagccggagctgaccaaaatgaatcagcccaagaatgcccggctccgttgagtttggcaaaggagtggaggaaaacaactgtgacaactgatctgcaagaccatggagtccaagattccatactgatgttctgtcctgcaagctgaagaaagacagcctctcaaacgtttacacccggaagaccatatcaaacagcttacaatagtcctaatacagatatagtgaaataccctcgcaagcaacaaagcctttgtttttttgggaattactcagaaattgatgtaccagaggcatatactttttcctgtaacggatactggcagtccccagtatcaataaattttggagatgattataatcctcagatgatgtcaatgaaatcatgagaaaatcctgctgaaaaaaaaaaaaaaaaaaaa

SEQ ID NO: 7224 - protein, 652 aa, Panicum virgatum
  misc_feature: Ceres CLONE 1904809
  misc_feature (1)..(175): Pfam Name: PRK Pfam Description: Phosphoribulokinase / Uridine kinase family
MEQHDSMADSPRRRHNLLRDKVQLVKRKDSNRYEIIRFHDPLSFEKGFFVVIRACQLLVQHNEGIIFVGVAGPSGAGKTVFTEKVVNFMPDVAVISMDNYNDATRIVDGNFDDPRLTDYDTLLENIHGLKEGRSVQVPIYDFKSSCRTGYRTVDAPSSRIVIIEGIYALSEKLRPVMDLRVSVTGGVHFDLVKRVLRDIQRAGQEPEEIIHQISETVYPMYKAFIEPDLETAHIKIINKFNPFSGFQNPMYILKSPRSLSPEKIKAVLGDDHTGSNEETYDIYLLPPGEDPEACQSYLRMRNREGKYNLMFEEWVTDNPFIISPRITFEVSVRLLGGLMALGYTIAAILKRSSRVFSDGKATVKIDWLEQLNRQYIQVQGRDRLYVKFVAEQLGLDGSYIPRTYIEQIQLEKLINDVMALPEDLKTKLSIDDELVSSPKEAFSRVSADKRNKLMKSGLSHSYSTHGDKNIVKLSKLTDSNRRYGGGRAPEPPAINQGAITQLSEQISTLNERMDEFTSRVEELNSKFTVKKHLPSQQNLALPNDACNGSTPTNLFVSQLGNGTLIPNSSSSNLLSKDSPMIEEIMNIARGQRQVIHQLDNLTNLLHEHLVLTRQSNAASRNRVLDIDTVICPLICLTVASIGYFMFKGLSRS

SEQ ID NO: 7225 - DNA, 2093 bp, Panicum virgatum
  misc_feature: Ceres CLONE 1904865
  misc_feature: Encodes the peptide sequence at SEQ ID NO. 7226
atccgaaaacctcgaccgaaacagcaaaaccctttccttcccttccctcctctcagatctcccacattccccctcacactccaaaccctaagcttcgcccagcccccaaggccccaaccatggcgtcgatgatgcaaccgcagatcatcctgctcaaggagggcacggacacgtcgcaggggcgcgcgcaggtggtgagcaacatcaacgcgtgcacggcggtggcggacatcgtgcggaccacgctggggccccggggcatggacaagctcatccacgacgacaagggcagcgtcaccatctccaacgacggcgccaccatcatgcgcctcctcgacatcgtgcaccccgcgtccaagatcctcgtcgacatcgccaagtcacaggactccgaggttggtgatgggacaactactgtggtgcttctagctgcagagttcttgaaggaagcaaaaccttatgttgaggatggagtgcacccccacagtctaatccgcagctacagggctgcgggtaatatggcaattcaaagggttaaagaactggcagttagcattgaagggaaaagcctggaagagaagaaatcattgctagccaagtgtgctgccacaacattgtcatcaaaacttataggtggtgaaaaggaattctttgcttctatggttgtggatgctgtccttgccattggcaatgatgacaggcttaatcttattgggattaaaaaggttcctggaggtaccatgagagattctttcctggtgaatggtgttgcattcaagaagacattttcatatgctggatttgagcaacaaccaaagaagttcctaaatccgaagattcttttgttgaacattgaactagaattaaaatctgagaaggaaaatgcagagatcagattatcagatcccctacaataccaatcaattgttgatgctgaatggaacattatctatgacaaactggataactgtgtaaaaagcggggcaaagatagttctatctcggctagctattggtgatcttgcaacacagtattttgcggatcgagatattttctgtgccggtcgtgttacagaagaggatttgcaacgtgtggctgcagcaactggtggaatggttcaaacttctgtaaataatgtcatcgatgaggtacttggttcttgtgaggtctttgaggaaaaacaagtaggtaatgaaagattcaacatatttagtggctgcccttctggacagacagcaaccattgtcctccgtggtggcgcagaccagttcatcgaggaagctgaacgaagtctccatgacgccatcatgattgtgaggagagctcttaagaactctacagttgtgccgggtggtggtgctattgatatggaaataagcaaatatctcagacagcatgcacggaccattgctgggaagtctcagttctttgttaattcgtttgctaaagcccttgaggttatcccaagacaactttgtgataatgctggatttgacgcaactgatgtgcttaataagctcaggcagaagcatgcatctggtgaaggtgctaattatggtgtagacataaacactggcggaattactgattcttttgctaactttgtgtgggaacctgctgttgtaaagatcaatgctataaatgccgcaactgaagcttcgtgccttattctaagtgttgacgaaactgtgaaaaacccaaagtcggagagtgcacaaggtgaggctgcagctggtgcgatggctggtcgtggtggaggagcaatgcgaggccgtggtgggaggggcatgcgcaggcggtaaaccgagtcactccaaccttgtagcttcatgttttaatcacctgtgggtcagatcttgtgccatactgcacatgtaatgtgtgtttatggacactgcatgtgtaatgaatttttgttttagaagcagtgctagcccttttgtttcagaacaggagagatacgccaagcatttatctgttaactgctgccgtgttgtgatatagctggtgggagccgtggatcatggtttgtttgctcccaatttttttgatgcaagaatgtagcctcttgttaaaaaaaaaaaaaaaaaaaa

SEQ ID NO: 7226 - protein, 560 aa, Panicum virgatum
  misc_feature: Ceres CLONE 1904865
  misc_feature (1)..(494): Pfam Name: Cpn60_TCP1 Pfam Description: TCP-1/cpn60 chaperonin family
  misc_feature (1)..(493): Pfam Name: Cpn60_TCP1 Pfam Description: TCP-1/cpn60 chaperonin family
  misc_feature (1)..(493): Pfam Name: Cpn60_TCP1 Pfam Description: TCP-1/cpn60 chaperonin family
  misc_feature (1)..(252): Pfam Name: Cpn60_TCP1 Pfam Description: TCP-1/cpn60 chaperonin family
  misc_feature (1)..(493): Pfam Name: Cpn60_TCP1 Pfam Description: TCP-1/cpn60 chaperonin family
  misc_feature (1)..(495): Pfam Name: Cpn60_TCP1 Pfam Description: TCP-1/cpn60 chaperonin family
  misc_feature (1)..(493): Pfam Name: Cpn60_TCP1 Pfam Description: TCP-1/cpn60 chaperonin family
  misc_feature (1)..(498): Pfam Name: Cpn60_TCP1 Pfam Description: TCP-1/cpn60 chaperonin family
  misc_feature (1)..(493): Pfam Name: Cpn60_TCP1 Pfam Description: TCP-1/cpn60 chaperonin family
  misc_feature (1)..(488): Pfam Name: Cpn60_TCP1 Pfam Description: TCP-1/cpn60 chaperonin family
MASMMQPQIILLKEGTDTSQGRAQVVSNINACTAVADIVRTTLGPRGMDKLIHDDKGSVTISNDGATIMRLLDIVHPASKILVDIAKSQDSEVGDGTTTVVLLAAEFLKEAKPYVEDGVHPHSLIRSYRAAGNMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDNCVKSGAKIVLSRLAIGDLATQYFADRDIFCAGRVTEEDLQRVAAATGGMVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGITDSFANFVWEPAVVKINAINAATEASCLILSVDETVKNPKSESAQGEAAAGAMAGRGGGAMRGRGGRGMRRR

SEQ ID NO: 7227 - DNA, 1954 bp, Panicum virgatum
  misc_feature: Ceres CLONE 1904970
  misc_feature: Encodes the peptide sequence at SEQ ID NO. 7228
aaaccgtcagcaaattgacggcgcctcacctcaccccctccccgtccgcgcgccagagaccgtgtgtgcgagagagcagagcagagcgcgggcaccaatggcgacagctgcctcgtcagcccctcccctgctcgccttcttgccgctcctgctgctcagactcctcgcggccttctcaccggccacagccacagcagcgcgcccctccaaccccaagaaggcgccgttcccgaccgtcgctcctctgcacctgcaggctctccggcagcagcgggctcgcgccggctcgtcagctgccaagcacgtcgccgccgatggcgccagcgccagcgacggcacggcggcgaagccgttcacggcgcactacttcccgcaggagctggaccacttcaccttcacgcccaacgcgtccatgctcttctaccagaagtacctcgtcaacgacaccttctggcggaggcccggcggcggcaaaggcgccgccgggccgctgttcgtgtacaccggcaacgagggcgacatcgagtggttcgccaccaacaccgggttcatgttcgacatcgcgcccaagttcggtgccctcctcgtcttcatcgagcatcgcttctatggggagtcaacaccgttcgggaacgactcggataattccgcgaagacactgggctacttggcatcaacgcaggccctcgctgactatgccatcctcatcaccagcctaaagcggaacctatcggccgaggatgcccccgttgtggtcttcggtggctcctatggtggcatgctggcttcttggttcaggctcaagtacccccatatcgccattggggccttggcatcctctgcgccaatcctgcagtttgacaacataacaccgtggagcagcttctacgatgcaatctcacaggactataagtctgagagcttgaattgctttgctgtgatcaaggcaacctgggatgtgctggatgagaggggatcaagtgacaaagggctacttgagctcagcaaattgttcagagcttgcaagactgtgaagtacgctgattcaattggaggctggctggagacagcgttcacctacactgccatggtggactatccaacaccggccaatttcctggagaacctgcctgcctaccccgtcaaggagatgtgcaagatcattgatggattccccgcgaatgcagacatcctggaaaaggtgttcgcagccgcgagcttgtactacaactacacaggagaccagacttgcaaccagattgagtatgaagacaactccgatacttcagttctcggcggctgggggtggcaggcttgcacagagatgatcatgccgatgtcgatctccaacgagagcatgttcccgccagacacattcagctacgatgacacgtctgatgcctgttttcagttgaatggggttcggccgaggccgcattggatcacaactgagtatggtggacataagatagataaggtgctcaagcggtttgggagcaacatcatcttctccaacggaatgcgagacccatggagtcgaggcggggtgctcaagaatatctcatccagcattgtggcccttgtcacaaagaaaggggctcatcatttggacctcagatctgcaaccaaggatgatccagattgggttgtagaacaaaggagacaagaggttgagatcatacagggatggatagatcagtatcatcaggacatggcataattatcctactgatactactgattttctttctctctttctttgtgtcttgagtgggtttgtaaaaactctctttctttttgctctttcaattaatatatatatatatatatatatatatataaccagtaggggatgctcatcccctcctgttgcatcaaaaaaacaatggtgaattgttgtaaatcactaataagtctgccctttcagtttttttaaaaaaaaaaaaaaaaaaaa

SEQ ID NO: 7228 - protein, 540 aa, Panicum virgatum
  misc_feature: Ceres CLONE 1904970
  misc_feature (1)..(374): Pfam Name: Peptidase_S28 Pfam Description: Serine carboxypeptidase S28
  misc_feature (1)..(431): Pfam Name: Peptidase_S28 Pfam Description: Serine carboxypeptidase S28
  misc_feature (1)..(429): Pfam Name: Peptidase_S28 Pfam Description: Serine carboxypeptidase S28
  misc_feature (1)..(423): Pfam Name: Peptidase_S28 Pfam Description: Serine carboxypeptidase S28
  misc_feature (1)..(439): Pfam Name: Peptidase_S28 Pfam Description: Serine carboxypeptidase S28
MATAASSAPPLLAFLPLLLLRLLAAFSPATATAARPSNPKKAPFPTVAPLHLQALRQQRARAGSSAAKHVAADGASASDGTAAKPFTAHYFPQELDHFTFTPNASMLFYQKYLVNDTFWRRPGGGKGAAGPLFVYTGNEGDIEWFATNTGFMFDIAPKFGALLVFIEHRFYGESTPFGNDSDNSAKTLGYLASTQALADYAILITSLKRNLSAEDAPVVVFGGSYGGMLASWFRLKYPHIAIGALASSAPILQFDNITPWSSFYDAISQDYKSESLNCFAVIKATWDVLDERGSSDKGLLELSKLFRACKTVKYADSIGGWLETAFTYTAMVDYPTPANFLENLPAYPVKEMCKIIDGFPANADILEKVFAAASLYYNYTGDQTCNQIEYEDNSDTSVLGGWGWQACTEMIMPMSISNESMFPPDTFSYDDTSDACFQLNGVRPRPHWITTEYGGHKIDKVLKRFGSNIIFSNGMRDPWSRGGVLKNISSSIVALVTKKGAHHLDLRSATKDDPDWVVEQRRQEVEIIQGWIDQYHQDMA

SEQ ID NO: 7229 - DNA, 1990 bp, Panicum virgatum
  misc_feature: Ceres CLONE 1905039
  misc_feature: Encodes the peptide sequence at SEQ ID NO. 7230
atgagccaagctgtaacctaagcacagcgaaaacctccctgctcttaagcttcctcatcacccccgctctctactcgttctctctctcctcccccctctctatctgtctctctctcccctgcggcaactcctctctcctccaatcccaggcgaattcctcgccccccctccagcgcgtgccggagcttcgtcttccccgaccctcccgccctgattcgccgctccgcgctccccccttccgccgcaaagggggggaactcatggcgaggctagtggctctggcattggcggtggcggtggcggtgggggtcctcctcgtcgcccgggcggaggcggagccgcggtgcgcgcggcgcggccggagcgcgccgccgcggccgcacagcgtgacgatcaccgagttcggggccgtcggcgacggcgtcaccctcaacacggtgcccttccagaacgccgtcttctacgtgcggtccttcgccgacaagggcggcgcgcagctgtacgtgcccaagagacggtggctcaccggcagcttcaacctcaccagccacctcaccctcttcctggagagtggcgctgtcatcgtcggcacgcaggaggtgtcacagtggcctgttgcggaacctttgccatcatatggacggggaatggatcttccaggtctgagacatcgtagcttaataaatgggcagaatctaactgatgttgtaattactgggaataatggaatcattgatggccagggttccacatggtggaactggtttcgctcaaataagttgaactatagccgtcctcatcttgtggagtttgtggattctgaacaaattgttatttcaaatataacattcttaaattcccctgcatggagtatacatccagtgtattgcaggaatgttgtgctcaataatatcacaattcagacttcattggatgctccacttaatcacggaatcgttccagattcaagctcaaatatgtgcatcgaagatagcaacatcagcgttagccatgatgccatctcattaaaaagtgggtgggacaactatggcattactttcggaaggccaacttcagacattcacattagaagagtgaatctgcaatccccgttgggtgctgcccttgcatttgggagcgagatgtctggtgggatctcggatattcatgccgatcacctccgaatccacggttcatccaaaggcatcttcttcaagactgcacaaggccgcggaggctatataagagataccgtaatttcagacgtccaaatggaagatgttaatgttgccattgcattcaccggttcttggtcaagtcacccagatgaccattttgatccagctgcactcccactcattaatcgaattaccctgaagaacatgactggaacaaaaatctcggtcgccggcgttttgtcaggaatcactggcgatccattcaccggaatatgcctctccaatatcaatttttccctagccgattcggccaattccacctcctggtcttgctccaatgtttctggatactccaagctggtacttcctgagccttgcttagatctccggactacaccttcaaactcctccatctgctctgccctccctagctaccatgccatcgcagtagcataaatgcatagagtacaaagtgttcatccttaccctgtttcagtccctgtacaattcagagacatctagccttttcctccaaattctttcaagccagggcgtgccgtcaagggatcattcaccgttcctacaatcagcttcaaggctcagaatacattccgcatcgccttcttgaggagcaagcccgtcgggtgatcaatcggcatcgagctgttgatttgcttgtacagttaaaatttcttcattcaatctgtaagaaaaatttttgtggtagggggttgagtcgtgtgagtccggagagttgcttcatacagttgtcagatttggtggtaaaaaataaacacatcatgagtttcatg

SEQ ID NO: 7230 - protein, 457 aa, Panicum virgatum
  misc_feature: Ceres CLONE 1905039
  misc_feature: Great-hit functional homolog of the protein sequence encoded by LOCUS At3g16850
  misc_feature (1)..(354): Pfam Name: Glyco_hydro_28 Pfam Description: Glycosyl hydrolases family 28
  misc_feature: Useful for making plants with altered cell wall content and/or composition
MARLVALALAVAVAVGVLLVARAEAEPRCARRGRSAPPRPHSVTITEFGAVGDGVTLNTVPFQNAVFYVRSFADKGGAQLYVPKRRWLTGSFNLTSHLTLFLESGAVIVGTQEVSQWPVAEPLPSYGRGMDLPGLRHRSLINGQNLTDVVITGNNGIIDGQGSTWWNWFRSNKLNYSRPHLVEFVDSEQIVISNITFLNSPAWSIHPVYCRNVVLNNITIQTSLDAPLNHGIVPDSSSNMCIEDSNISVSHDAISLKSGWDNYGITFGRPTSDIHIRRVNLQSPLGAALAFGSEMSGGISDIHADHLRIHGSSKGIFFKTAQGRGGYIRDTVISDVQMEDVNVAIAFTGSWSSHPDDHFDPAALPLINRITLKNMTGTKISVAGVLSGITGDPFTGICLSNINFSLADSANSTSWSCSNVSGYSKLVLPEPCLDLRTTPSNSSICSALPSYHAIAVA

SEQ ID NO: 7231 - DNA, 2178 bp, Panicum virgatum
  misc_feature: Ceres CLONE 1905053
  misc_feature: Encodes the peptide sequence at SEQ ID NO. 7232
atttctctccccttccgttcccgaaaagctccccgtgcttataaattcgcggctcaccccgtcccgtcgcccccttccgatcgatccccagcccccctccaccggataccaccgccaccaaccgattccgtctcacgcctccccgggctcccgaggcgaggcgaggcgaggctctccggcccgcggattcctacagctctcgtgccgatcgcgacccgctccccggccgctccgaccccgagggagtggtgatgataaaggataattactgatcaaacttgctataattctccttaaggaaatttgacatcatgtcacatagaaatatggtctggacacatcagtcgattaatcctggatgggaacaaggacatgtccaagttcaatcagaaagttcctattatggaggccctggaattgattcatccaacctgggtgtgcaagttgctgccggagttccaggaaatactgctaatgttggtatctgtgatctgcggaatcatgagctccagcatgttcataattcatacccacatgttggtgttacatcaagttttgtcttcccaactgctatgcataaccccggaatggcaacagcagctgttaacatatatattcctcatactcaaagctttggactgggcaatgtgctaccaccatctttatatcatcaagttcccacaggaaatattgatgagagtagcagcagtctcaattttggtgacacgggtagtggattcatcaaaaggaaaaatgcagttgtggctggtaaccatcattttcttcatggatttgcaggttcgagttcatctgctcatgtgcctcagaatccttcacgtgggccatggaatgcttcatttcaatcaaattgtttacctaactctgcagcttcaattccttcaaacccaccagagttccacagtagcaatggttggccatttttagaaggaccttctacagatgttcctagcagtttcagttcaatggctactcgaccagagttggtacctcatggtaactacgtgtttccaacctgtcacatgggccagtgcaatacatggattccacaggctgcaaatggtgttgctcatggagtaccacagtggggatatagtaatttattggccaatcctccaggaaccacagacatgccgaatggaattgttcaggggcctctacctcatttctcccagaatcctttgcatagtatgcaaatgcaagtacctcaaatacaagtatcccatcaacagttccttggtaacaatgtggtacatggtttaaatccttctgccgcaggccttcctttagatccaagaatgctgtctctcccattcaattctgagcacacttttgggcatccaatgcatccacctcttacaaaccatgttaacagtggggttttaagaattctgccatatcagaatgctaccatgctggatcgatcaaggattcatgaagcaggacatgttattgatgaacatcgagaattgcgtctggatatggataacatgacttatgaagagcttgtagcattggaagagcagataggcaatgtcaatactggtttgacagaaagttacatccaagagaacttgaggtcaactttctatgttccaggagcagctggagtgtgtgatcagttttctgagctctctttggagaatgatgcttgcataatatgccaggaagagtatgaagctgaagaacttataggaacccttgaatgcggccacaagtaccatgcgacgtgcataaagcaatggttggtgatgaagaacctgtgccccatctgcaagacaacagcgttgtcatcagatagtaggaatggatgaccatcgccgataacattattggttatttacagcgagcaaaattagctcggctttgtatatagacacggttgcctgtatttactgcccccttcactgtggacataaactgaggtttccgaaaactgtacagacattttgtaggatattctttaggtgtttaacggccccatggagtgtgaagctcccatgatggccttgctcgatgctcccttcctttccattgtacattgtatttatctttttcttcttcaaaagagaagcacaagaacctttagttctgtacattccggaattgaaagaaaccaagccttcctcgcttgtggagcaaaaaaaaaaaaaaaaaaaa

SEQ ID NO: 7232 - protein, 506 aa, Panicum virgatum
  misc_feature: Ceres CLONE 1905053
  misc_feature (1)..(41): Pfam Name: zf-C3HC4 Pfam Description: Zinc finger, C3HC4 type (RING finger)
MSHRNMVWTHQSINPGWEQGHVQVQSESSYYGGPGIDSSNLGVQVAAGVPGNTANVGICDLRNHELQHVHNSYPHVGVTSSFVFPTAMHNPGMATAAVNIYIPHTQSFGLGNVLPPSLYHQVPTGNIDESSSSLNFGDTGSGFIKRKNAVVAGNHHFLHGFAGSSSSAHVPQNPSRGPWNASFQSNCLPNSAASIPSNPPEFHSSNGWPFLEGPSTDVPSSFSSMATRPELVPHGNYVFPTCHMGQCNTWIPQAANGVAHGVPQWGYSNLLANPPGTTDMPNGIVQGPLPHFSQNPLHSMQMQVPQIQVSHQQFLGNNVVHGLNPSAAGLPLDPRMLSLPFNSEHTFGHPMHPPLTNHVNSGVLRILPYQNATMLDRSRIHEAGHVIDEHRELRLDMDNMTYEELVALEEQIGNVNTGLTESYIQENLRSTFYVPGAAGVCDQFSELSLENDACIICQEEYEAEELIGTLECGHKYHATCIKQWLVMKNLCPICKTTALSSDSRNG

SEQ ID NO: 7233 - DNA, 1746 bp, Panicum virgatum
  misc_feature: Ceres CLONE 1905136
  misc_feature: Encodes the peptide sequence at SEQ ID NO. 7234
ctccgtgtccattggaaactttcgaaaatacccctggcgatttcatcttcgccgtcgccgctctactccggccatggccaccgccggcaagcccgctgcagccacgccctccacatcctcccacgcgctagattcggtccacttctcctcggggaacccccgcatcgaggagacccgcggcgtcgtcctcctccaccccgacccgcccgccgcctcctcctcgcctcatctcccggtggggaggaagccgcgtgtatgcttgctcgcggtgcccaaccacatgacctacgccgacttctgccgcttctgcggcgcctttgtcccccatacactcgagatgcgcattgtcaggactgatggtgcagaggaccagtatagtgttcttataaatttcaacactcagaactccacagacaacttttataagcacttcaatgggaagcagttctcttcactggagggggatgtttgccatgtccgttttgtggaagatgtgcactacactcaattgattgagcatgcacatagctcagttacaagcttggctgagcaacctacatgtccagtatgtcttgaacgacttgaccaagatcctggaggcattctcacaacaatctgcaatcattctttccactgctcatgcatatcaaaatggacagactcatcatgcccggtctgtagatattgtcagcagcaaccagagaaatccatgtgttctatttgcggaacttcggagaatctttggatatgtgtaatatgtggccatgttggttgtggaaggtacaaaggcggccatgctatcgaacactggaaggaaactgaacattgctattcacttgaattagagacacagaaagtttgggactatgctggggacaactatgtccatcggcttattcagtcaaaaacagatggaaagctagttgagtacaattgccatggtggtcacacagcagagaacacatgttcactatgcagtggtgatgccgcaatgagtgaagctctactgaacagtaaatttgaagctattgttgaagagtacaatgatcttgtcacgtctcagcttgaaaagcaaagaaattactatgagtcacttctattagaagacaaagaggaaactgagaaagaaattgctgctgctgttgagaaagctgtgagcatgaaagtccaaaagttggaagcaaagattgagaaatgcacagaagagaaaaggtttcttgatgaagttaatggcaatcttgtcaagaatcaggagaagtggattgagacaatacgaaaggcacaagcaagggagcaagctaccctcagattgaaagatgaaaagattgaaaaacttcaagaagagataagagacttgatagctcacttcgagtgccaaaatgccattgcacaagctcctgacttgatctcaagcgatatacaagggggaacgattcttcctgtagcatcctcggcatcgtcaagcaacagcagcagaagcagccctgttcgtggcacgatgaacgggaagctgaagtgagatctgcactctctgcaggctgcacttatgtggatgatgtttgactgttggcgacctagatcatagttcgttacggtaaatagtagcatacatctgtcaccttcctgatctttctgatgtgttgtcgataattgatgctagcatggtgtggtattttattttattttttgacttctcaacttcatataaccagaaattccacagtttaaaaaaaaaaaaaaaaaaaa

SEQ ID NO: 7234 - protein, 481 aa, Panicum virgatum
  misc_feature: Ceres CLONE 1905136
  misc_feature (1)..(40): Pfam Name: zf-C3HC4 Pfam Description: Zinc finger, C3HC4 type (RING finger)
MATAGKPAAATPSTSSHALDSVHFSSGNPRIEETRGVVLLHPDPPAASSSPHLPVGRKPRVCLLAVPNHMTYADFCRFCGAFVPHTLEMRIVRTDGAEDQYSVLINFNTQNSTDNFYKHFNGKQFSSLEGDVCHVRFVEDVHYTQLIEHAHSSVTSLAEQPTCPVCLERLDQDPGGILTTICNHSFHCSCISKWTDSSCPVCRYCQQQPEKSMCSICGTSENLWICVICGHVGCGRYKGGHAIEHWKETEHCYSLELETQKVWDYAGDNYVHRLIQSKTDGKLVEYNCHGGHTAENTCSLCSGDAAMSEALLNSKFEAIVEEYNDLVTSQLEKQRNYYESLLLEDKEETEKEIAAAVEKAVSMKVQKLEAKIEKCTEEKRFLDEVNGNLVKNQEKWIETIRKAQAREQATLRLKDEKIEKLQEEIRDLIAHFECQNAIAQAPDLISSDIQGGTILPVASSASSSNSSRSSPVRGTMNGKLK

SEQ ID NO: 7235 - DNA, 1786 bp, Panicum virgatum
  misc_feature: Ceres CLONE 1905144
  misc_feature: Encodes the peptide sequence at SEQ ID NO. 7236
gggatcacgggagcgcagtatcgggcggatgcggccaacctcgccaccgccgcaaccacatgcgctcgccttccactgttttgtccgcgcacctgcgaacaaggccccgctttccctcgcttgtccccgctcgcgctaccggcctgcgggataagacagccgtgtcgctcgcctcgtcgccctctggcgcttccgagttcttcgttccggcctgggcttcctcctagctcgccgtagcaaaccaacaagccatgggttcctctgggggcatccgcggcctccgccgtcgcgtcagccgcctgctgctcctgctcctgctcgccgcgtcaaccggcgggccgacggcgcgcgccagggaggcgcagccgctgcccgaggccgcggcggccggcaccaggcgggcgccggagcggcatgggctgtcgctcgacttctacgccaagacgtgccccgcggtcgaccagatcgtcgccaacgtcaccgccgcccgctacagggacttccccgccgccgggcccgccgtgctccgcctcttccaccacgactgcttcgtcgagggctgcgacgcgtccatcctgatcgccccgacggccagcgcgtcgcccaaggtggagcgcgacatggaggagaacaagaacctggcgcaggaggcgttcgacgcggtggaactggccaaggccgccgtggagagcaggtgccccggcgtcgtctcctgcgccgacgtcctcgccctcgccacccgggactacgtccagcaggctggtgggccgtactacgcggtgaagaagggccgaaaggacagcagggtgtccctggcggggaaggtccgcggcagcctgccccgcgccaactccacggtggacgagctcctccgcgtgttcgccggcaagggcctgggcgcggcggacctggtggcgctctccggcgcgcacaccgtggggttcacgcactgcgtccacgtgctgggccgcatctacgacttccggggcacgcggcggccggacccgctcatggacgcccgcctcgtgaaggcgctgcgcatgtcgtgcccgtcctcgggcggcagcgcccgcgtggtggtgcccttcgacgtgagcaccccgttccagttcgaccacgcctactacgccaacctgcaggcgaggctgggcctgctggggtcggaccaggcgctgttcctggacccgcggaccaggccgctggtgcaggagcttgccggcaacaagacccgcttcttccaggcgttcgtcgccagcatggacaggatgggggccatccggatcaagaaggggaggaagggggaggtcaggaaggtctgcagccagcacctgcttcctccggtctgatcgatcgccatcaaccgtcgtctccccggcttaattcgccttgcatccgatctgtacgtcggcgagttgatcaaatcagcatgtggcagcttatacaggaaaagatagctggttcaaggtcacgttttcgagctcattgcattgcgtgatgcttagtgcttagttacatcggctatttttgtgctgtatatggcagtttattagagagtagctttcaggttttttttctttttttgtgtcgcgtgtttgtgcaggagatatcgatgcaggtatctagggtatggctctttgttctgtcgtgtgcctttttttctttctttctcttcttggagtgttctcttgggcgtgccggttatttgtacgagcacgcccgctgtgcgagtgtgagtgtgtggtattccatttgtttgattcgactgcaaaaaaaaaaaaaaaaaaaa

SEQ ID NO: 7236 - protein, 364 aa, Panicum virgatum
  misc_feature: Ceres CLONE 1905144
  misc_feature: Great-hit functional homolog of the protein sequence encoded by LOCUS At2g34060
  misc_feature (1)..(250): Pfam Name: peroxidase Pfam Description: Peroxidase
  misc_feature (51)..(356): SWISSPROT Homolog: EC 1.11.1.7 Peroxidase 19 precursor
  misc_feature: Useful for making plants with altered cell wall content and/or composition
MGSSGGIRGLRRRVSRLLLLLLLAASTGGPTARAREAQPLPEAAAAGTRRAPERHGLSLDFYAKTCPAVDQIVANVTAARYRDFPAAGPAVLRLFHHDCFVEGCDASILIAPTASASPKVERDMEENKNLAQEAFDAVELAKAAVESRCPGVVSCADVLALATRDYVQQAGGPYYAVKKGRKDSRVSLAGKVRGSLPRANSTVDELLRVFAGKGLGAADLVALSGAHTVGFTHCVHVLGRIYDFRGTRRPDPLMDARLVKALRMSCPSSGGSARVVVPFDVSTPFQFDHAYYANLQARLGLLGSDQALFLDPRTRPLVQELAGNKTRFFQAFVASMDRMGAIRIKKGRKGEVRKVCSQHLLPPV

SEQ ID NO: 7237 - DNA, 1322 bp, Panicum virgatum
  misc_feature: Ceres CLONE 1905197
  misc_feature: Encodes the peptide sequence at SEQ ID NO. 7238
tcgtcatctccatcgcaggggaggggagaggggagagatcagacacagagatggcggaggaggagaggaaacgggtgctggtggtgggcggcagcggctacctgggccagcatctcctcgccgcgctcgcccccgccaccgatcgcctcgacgtcgctttcacccaccgcagccaagccccgccgcagccgctactcgatgcgctcccttccgtccgcgccttccgcgccgacctccgctccggcgacggcctcgaggcaatctccgcgtccttcggacagccacatgtagttgtcaactgtgccgcaatctcagttcctcgggcatgtgaaatggatccacctgctactatggctaccaacgtgccttcttcactagtcaattggttgctaagctttgggaatgatgaatcgcttttgattcatctctccacagatcaagtttatgagggggtgaaatccttctacaaagaagaggacgagacattgccggtgaacatgtatggaaaatctaaagttgctgcagagaaattcattattgaaaaatgctcaaactatgcaatcctaagaagcagcattatttacgggccacaaacagtatctcctgtggcaaaatcccttcccattcagtggatggatagtgttctttcacagggccaacaagttgaattctttaatgatgaatttcggtgccctgtttatgtcaaagatatggtggatgtaatattgtctttagcaaaaacttggctatcagatggcaaaaaggtccaggtccttctcaatgttggtggtccggatagggtttcaagactgcagatggctgagtctgttgctactgttcgaggatatgaccacaatataatcaaatctgtatctgcatcatcggttaaccgcggggtagcttctccatcagacatatccatggatatcaccaagctaacccagatgttaaatatcaagccaatgtcatttcaagatggagtcagagctacacttgttgcagaagctagttaatctttctcaacgttttgttcgagttcgtaagagagttgtttatactgaaacgtggaagcatgacaaagaatcacagttggtttgcaaaattgcagctgtggtgaattctgctgggtctgggtgacatgtaacgttgtattgactaaacaccaacgccatcattggtgttactgcttggttgtaccattctgaataaaaatggtattcatttttaaagaaattgcagaagtctgtaaatgtattcttcatgtatactgttaagagttatcatcaatgaagaatctttacccaaaaaaaaaaaaaaaaaaa

SEQ ID NO: 7238 - protein, 320 aa, Panicum virgatum
  misc_feature: Ceres CLONE 1905197
  misc_feature (1)..(171): Pfam Name: Epimerase Pfam Description: NAD dependent epimerase/dehydratase family
MAEEERKRVLVVGGSGYLGQHLLAALAPATDRLDVAFTHRSQAPPQPLLDALPSVRAFRADLRSGDGLEAISASFGQPHVVVNCAAISVPRACEMDPPATMATNVPSSLVNWLLSFGNDESLLIHLSTDQVYEGVKSFYKEEDETLPVNMYGKSKVAAEKFIIEKCSNYAILRSSIIYGPQTVSPVAKSLPIQWMDSVLSQGQQVEFFNDEFRCPVYVKDMVDVILSLAKTWLSDGKKVQVLLNVGGPDRVSRLQMAESVATVRGYDHNIIKSVSASSVNRGVASPSDISMDITKLTQMLNIKPMSFQDGVRATLVAEAS

SEQ ID NO: 7239 - DNA, 1726 bp, Panicum virgatum
  misc_feature: Ceres CLONE 1905209
  misc_feature: Encodes the peptide sequence at SEQ ID NO. 7240
acgactggacgactcggctgggggaatcatgaatctagccgccttcccctcctccccctcccctgccacgcccgcgggccgcggcctcctccctgagatgccattaaatccctcctccgctttctcctcctcgctgctccgccgctcgctccgcgcgtccctccggaggatctccccgacggcctccgccgccgcccccacctccacgcccgccgccgccgccgagaacggcgccgcgaaggcggcggagcagcagcccgcgcaggtcgcaaagcgattggaaaagttcaggaccacaattttcactcagatgagcatgcttgccatgaagcatggggcaataaaccttggccagggctttccgaattttgatggcccagactttgtgaaagaggctgctattcaagctataaatgctgggaagaatcagtatgcaagagggtttggtgtgccagaactgaactcagctattgctgaaagattcctgaaggacagtggattgcaagtcgaccctgataaagaagtcactgttacatctggatgcactgaagcgatagctgcaacaatactgggtctcatcaaccctggtgatgaagtgatattgttcgctccattctacgattcatatgaggctacactgtcaatggccggtgccaatgtaaaggccattaccctccgtgctccagatttcgcagttccacttgaagagctaaaggctgcagtctccaagaacaccaaagcaataatgataaacacaccgcacaatccaactgggaagatgttcacaagggaggaacttgaatttattgccaccctctgcaaggaaaatgatgttttgctgttttctgatgaggtctataacaaattggcattcgaggctgatcatatatcaatggcttctatccctggaatgtatgagaggactgtgaccatgaactctctaggcaagacattctctcttacaggatggaagattgggtgggcaatcgcaccacctcacctgacatggggtctaaggcaagcacactcattcctcacattcgccacctgcacaccaatgcaagcagcagcagcggcagctctgagagcaccagatagctactatgaggagctgaagagggactacagtgcaaagaaagctatattgttagaaggactaaaagccgcggggtttattgtttacccatcaagtggaacatacttcatcatggtcgatcacacccctttcggttttggcaatgacatagagttctgtgagtatttgattcgtgaagttggcgttgttgctataccaccaagcgtgttttacctgaaccctgaggaggggaagaagctggtgaggttcaccttctgcaaggacgaagatacgctgcgggccgcggtcgagcggatgaagacaaagctgaggaagaaatgaagcgcggggaaaattccatgtggctggtgatggctgaataatctgctaggtttgcacttcggcaggatgcatgtactaccctttttctagcaatagttgtcctgtcagtgacttcatacctattgtctttactacttgtccgtgtaaggagatggtgatggatcaggatagctgccggtatacctttttgtagcctactgaacaatttgcggccgctatgcgttcacccttctcaacctatcctgtcaccagacctgccaataaactgatggaaccaaatccttgcaacaaaaaaaaaaaaaaaaaaaa

SEQ ID NO: 7240 - protein, 462 aa, Panicum virgatum
  misc_feature: Ceres CLONE 1905209
  misc_feature: Great-hit functional homolog of the protein sequence encoded by LOCUS At1g77670
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature: Useful for making plants with modulated nitrogen use efficiency
MNLAAFPSSPSPATPAGRGLLPEMPLNPSSAFSSSLLRRSLRASLRRISPTASAAAPTSTPAAAAENGAAKAAEQQPAQVAKRLEKFRTTIFTQMSMLAMKHGAINLGQGFPNFDGPDFVKEAAIQAINAGKNQYARGFGVPELNSAIAERFLKDSGLQVDPDKEVTVTSGCTEAIAATILGLINPGDEVILFAPFYDSYEATLSMAGANVKAITLRAPDFAVPLEELKAAVSKNTKAIMINTPHNPTGKMFTREELEFIATLCKENDVLLFSDEVYNKLAFEADHISMASIPGMYERTVTMNSLGKTFSLTGWKIGWAIAPPHLTWGLRQAHSFLTFATCTPMQAAAAAALRAPDSYYEELKRDYSAKKAILLEGLKAAGFIVYPSSGTYFIMVDHTPFGFGNDIEFCEYLIREVGVVAIPPSVFYLNPEEGKKLVRFTFCKDEDTLRAAVERMKTKLRKK

SEQ ID NO: 7241 - DNA, 1626 bp, Panicum virgatum
  misc_feature: Ceres CLONE 1905277
  misc_feature: Encodes the peptide sequence at SEQ ID NO. 7242
ccgatccagctgaagaaaattaagcaacttggagcagtttccgtgcaattgttacactagcgccgcgcatgatcctccaagccgcaaagattccaatttgatagcgtaatttttgatttctcggagccagacgtcggaatggcgtctcctccgcttcagttcgcggccgcgcccttgctgctgctgctgctgctggtagcagtcgtcccggccgcacggtccagccgcatcttctccgtgactgactacggcgcggcgggcgatgggtcccgctacgacacggtggcaattcaggccgccgtggacgactgcgcggcggcgggcgggggccgcgtcctcctcccggcgccgggcaactacctgacggcgacggtccacctccgctcgcgggtggtgctggaggtggcccccggcgcgcggctgctgggcggaaccaggcaggcggactacccgcccgaatcgcgccgttggtacgtcgtcctggccgagaacaccacgggggccggcatcacgggcggcggcgagatcaacggccagggcggggcgttcgtggtcacgcccagcgaggtgaagaacgtcatggtgagctggaacgccaccggcgattgcctgggcgacgagtgccggccgcggctcgtcggtttcatcgactccaaggatgttaggatccacgacatcacactcaaccagcccgcctactggtgtcttcaccttgtcagatgtgacaacacagtgatccgcaatgtgtctatatttggggattttaagagtcccaacaatgatggcattgacattacggattctaacaacactgtcataaccgattgccacatagacaccggagacgatgctttatgcccaaagtcatccgcggggcctgtttacaacttgacagccacaaactgttggattcgaactaaatcttgtgctatcaagtttggaagtgcaagcttcttcaacttcaataagctggtcttcgacaacattacaatagttgattcacatcgaggacttgggatgcagattcgggatggaggaaatgtgagtgatgtgctgttttcaaacatcaaaatgagcaccagatactaccatcctttatggtggggaagagccgaaccaatctacattacaacttgctcaaggtacccggattcaaaagaaggtaccatttcagacataagattcatcaacatctcatcagtatcagaaaacggagttttcctggctggatcaaagcacgggctgctccgcaatctgaaattcaagaatgtcgacctgacctacaagcgttggacaaactacccgggaggcctgtatgattacagacctggatgcgaaaagatggttaagcataaaactggtggcatgatgctggagcacatctccggcctggagatcgacaacgtgaggatgagatgggcgagaggaaacctgaaaggctgggacgtcaaccccatccttttccggccgtcgaccatcgacaagctgtctttccatgactggcagtcagtggaagttcagtgaatttgcccttccccaattgtacctgtgtatctgtatcacgatgaataaaaggggtgattctttttgcgaaatatgctaataagagatcccaattcccaacag

SEQ ID NO: 7242 - protein, 461 aa, Panicum virgatum
  misc_feature: Ceres CLONE 1905277
  misc_feature: Great-hit functional homolog of the protein sequence encoded by LOCUS At3g57790
  misc_feature (5)..(347): Pfam Name: Glyco_hydro_28 Pfam Description: Glycosyl hydrolases family 28
  misc_feature: Useful for making plants with altered cell wall content and/or composition
MASPPLQFAAAPLLLLLLLVAVVPAARSSRIFSVTDYGAAGDGSRYDTVAIQAAVDDCAAAGGGRVLLPAPGNYLTATVHLRSRVVLEVAPGARLLGGTRQADYPPESRRWYVVLAENTTGAGITGGGEINGQGGAFVVTPSEVKNVMVSWNATGDCLGDECRPRLVGFIDSKDVRIHDITLNQPAYWCLHLVRCDNTVIRNVSIFGDFKSPNNDGIDITDSNNTVITDCHIDTGDDALCPKSSAGPVYNLTATNCWIRTKSCAIKFGSASFFNFNKLVFDNITIVDSHRGLGMQIRDGGNVSDVLFSNIKMSTRYYHPLWWGRAEPIYITTCSRYPDSKEGTISDIRFINISSVSENGVFLAGSKHGLLRNLKFKNVDLTYKRWTNYPGGLYDYRPGCEKMVKHKTGGMMLEHISGLEIDNVRMRWARGNLKGWDVNPILFRPSTIDKLSFHDWQSVEVQ

SEQ ID NO: 7243 - DNA, 1713 bp, Panicum virgatum
  misc_feature: Ceres CLONE 1905282
  misc_feature: Encodes the peptide sequence at SEQ ID NO. 7244
atctctcctgttatcccccggcgctcctcctccgtacggccggggaggagcgtggccgcggcagcgcagttgctgcttctcgctccgtacgattcagagacatgatgccgcggcactgcgcaaatcgcatcttcctatccggaggttccagcatcctccacagttcaaaatctagaggcagagcccctaggcgccacagcgccgtcagattcaggcggtgctgcgcgagagctagtttttggactcatcaccttcctgtcaaggttaccccgtcagagattattgaggtgctgcaagcgtcagatgttttcggcagcatcaggaaatggagcaggttgcagctggtcaccgtgataggggtgatggtgtgcgtagttctcgtagtcccttctgccgacgcagtcgatgctctcaagacgtgcacttgcctgctgaaggaatgcagaatagagcttgccaaatgcatagccaacccttcgtgtgcagcgaacatagcatgcctgaacacatgcaacaatcgacctgacgaaactgaatgccagatcaagtgcggagacctgttcgagaacaatgtagtcgacgaattcaatgaatgtgctgtttcacgcaagaaatgtgtcccaagaaagtctgatgtcggcgagttcccagtccctgatccagctgcccttgttaagaacttcaatatgtcagattttaacggaaaatggtacatttcaagtggcctgaacccaacatttgacacatttgattgccagcttcatgagttccatgttgagggagacaaactaatcgcaaacattacatggagaatccgcactcctgattctggtttcttcacccggtcgactgtgcagcagtttgcgcaggacccatcacaaccgggcatactttacaaccatgacaatgagttcctgcactatcaagatgactggtacattatctcatccaaggttgagaacaaggatgatgactacatacttgtatactaccgtgggagaaatgatgcatgggatggttatggtgggtctgttttgtacacaagaagtaaaactgtccctgaaacaataatacctgagctggaaagggctgcgaagagtgtaggtcgggacttctcaacgttcatcaggactgacaacacctgtggtcctgagcctcctcttgtggagagaatcgagaagactgtggaggaaggagagaagactatcatcagggaggtgagggagatcgagggagagattgaggaggaggtcgaggaactggaaaaggaggaagtgacactgttccagaagctggcagaaggtctcgtggaggtgaaacaggatctgatgaacttcttgcaagggctgagcaaggaagagatggagctgttggatgagatgaacatggaagcaactgaagttgagaaagtcttcagccgtgcactgccactgaggaaactaaggtagctctagcagcaaacgacttggagaaaacaggccttccagtagtgatcaaaataaattttatttgccacggcagtacctacagtaacagattgtcattttctttccccttttctgtggtcacaacatattgccagattagccctacttgtaaagcatcagagattatgcaacttttcttgcctaattaaaactgagtatatatttaattatttatgctacttttcctaatatatttgggactacagaaaaaaaaaaaaaaaaaaaa

SEQ ID NO: 7244 - protein, 448 aa, Panicum virgatum
  misc_feature: Ceres CLONE 1905282
  misc_feature (74)..(448): SWISSPROT Homolog: EC 1.10.99.3 Violaxanthin de-epoxidase, chloroplast precursor
  misc_feature (81)..(448): SWISSPROT Homolog: EC 1.10.99.3 Violaxanthin de-epoxidase, chloroplast precursor
MMPRHCANRIFLSGGSSILHSSKSRGRAPRRHSAVRFRRCCARASFWTHHLPVKVTPSEIIEVLQASDVFGSIRKWSRLQLVTVIGVMVCVVLVVPSADAVDALKTCTCLLKECRIELAKCIANPSCAANIACLNTCNNRPDETECQIKCGDLFENNVVDEFNECAVSRKKCVPRKSDVGEFPVPDPAALVKNFNMSDFNGKWYISSGLNPTFDTFDCQLHEFHVEGDKLIANITWRIRTPDSGFFTRSTVQQFAQDPSQPGILYNHDNEFLHYQDDWYIISSKVENKDDDYILVYYRGRNDAWDGYGGSVLYTRSKTVPETIIPELERAAKSVGRDFSTFIRTDNTCGPEPPLVERIEKTVEEGEKTIIREVREIEGEIEEEVEELEKEEVTLFQKLAEGLVEVKQDLMNFLQGLSKEEMELLDEMNMEATEVEKVFSRALPLRKLR

SEQ ID NO: 7245 - DNA, 2221 bp, Panicum virgatum
  misc_feature: Ceres CLONE 1905286
  misc_feature: Encodes the peptide sequence at SEQ ID NO. 7246
accatcgatcactactcacttttcccagcagcagcactgtccatcatatatatagcctcctctccatccaggcctcgctctcccttgtctcttcgatctctagctatatatatagcacgcatattacacacaatagctagctagctaggtaataagctagtctcacacaacacaacacaacacaaaaagagtagtctctcgatctctttctcgacgatctctgtcgcctcaagcagcagatagagcagcagcagcagcagcagcagctagcagagaaaggggtcggatcggagatgctggatgccatggacgccgcgagcatcataggctacttcaagggcaagagcgtcctcgtcaccggcgcaactgggtttcttggaaagatccttgtggagaagataatgcgcgtgcagcctgatgtccacaagatctaccttcttgtccgagcgatggatgagccatctgcaaagcaacgcgtccagcaagaggtgatagacacggagctgtttgacctcctgagagagaagcatggcaagggcttccagcagttcgtggaggagaaggtggttgcattggccggagacatcatctacgagaacctgggcctggagacacccatgctggaggcgcttgccaaggagatcgacgtcatcgtcaacattgcagcaaccaccaacttctacggaaggtatgatgtttccttggatgtgaacgtgatgggggtgaagcacctctgccagttcgccaagcagtgtgccaacctcaagatgctcatgcatgtctcgaccgctttcgtgtctggcttcagggaggggctgatcctggagaagcccatcaagcccggcgagtcgctgcgcgaaggcacctacctggacatcgacgccgagctgcgcctcgtcagagaagtcaagaaggagctcatgacggcgatgaactccagctcctcgagcagcagcagcagcagcagcgataaggacggcgacaacgcccacaataacaataataagaagaaggcagagaggacggccatgaaggagctgggcctccagcgggctcgccacttcggctggtccaacacctacgtcttcaccaaggccatgggcgaggtgctcctcgggcagctccggggcgacatcccggtggtgatcatgcgccccagcatcatcaccagcatccgggaggacccggcgcccgggtggatgcagggcacccgcaccatcgacaccatcatcatcggctacgccaagcagaacctctcctgcttcctcgccaacctcaacttcgtcatggacgtcatcccgggggacatggtggtgaacgccatgatggcggccatggtggcgcactcgggggacaagggcgcgcaggtggtctaccactccacctcgtcgctgcgcaacccgaccacctacaacgtgctctaccagtccggccgccgccatttctacgagaacccgcgggtgggcaaggacggcaaggtcatccctaccagggagatgtacttcttcccaaccatcgcgcgcttccacctatacatgatcttcacgtacaagataccactagagattctgcacttggtgaatctgctgctctgcgggttcttctcgcggctctacaatgacctcaaccgcaagtacaagtttgtgatgcatcttgttgatgtctatggccccttcgccttcttcaaaggatgcttcgatgacatgaacatggagcggctgaggttgacgatggcgatgaagacccccgaagatcgcatgttcaattttgaccccaagaccatcgactgggacgactacttcaccaaaatccacatacctggtgttctcaagtatttgtgcaagtgaaggctgctacgttaattactctcaacttgcttgttgcttcttcaccttcttgctatagaaaaaaggctcttattcttaatttatggaaagcgaataccatcccgtttgttgtacctgctctatggaccgggtgatcgattatcaagaaaagaaaataagacgagtagattgatatatatagttgtattggagaagctccatatacctctaataatggccaaacgtgtgcctgtgttaggtggcagcctgtcatgagcatgagtatgaagttgtaatctgtttgctgatatgtacgtgtcagtgagcatgaaaaagatctgtaatatctatctgcaatgccagtgaaattgaaggcaaaaaaaaaaaaaaaaaaa

SEQ ID NO: 7246 - protein, 517 aa, Panicum virgatum
  misc_feature: Ceres CLONE 1905286
  misc_feature (3)..(103): Pfam Name: Sterile Pfam Description: Male sterility protein
MLDAMDAASIIGYFKGKSVLVTGATGFLGKILVEKIMRVQPDVHKIYLLVRAMDEPSAKQRVQQEVIDTELFDLLREKHGKGFQQFVEEKVVALAGDIIYENLGLETPMLEALAKEIDVIVNIAATTNFYGRYDVSLDVNVMGVKHLCQFAKQCANLKMLMHVSTAFVSGFREGLILEKPIKPGESLREGTYLDIDAELRLVREVKKELMTAMNSSSSSSSSSSSDKDGDNAHNNNNKKKAERTAMKELGLQRARHFGWSNTYVFTKAMGEVLLGQLRGDIPVVIMRPSIITSIREDPAPGWMQGTRTIDTIIIGYAKQNLSCFLANLNFVMDVIPGDMVVNAMMAAMVAHSGDKGAQVVYHSTSSLRNPTTYNVLYQSGRRHFYENPRVGKDGKVIPTREMYFFPTIARFHLYMIFTYKIPLEILHLVNLLLCGFFSRLYNDLNRKYKFVMHLVDVYGPFAFFKGCFDDMNMERLRLTMAMKTPEDRMFNFDPKTIDWDDYFTKIHIPGVLKYLCK

SEQ ID NO: 7247 - DNA, 1806 bp, Panicum virgatum
  misc_feature: Ceres CLONE 1905306
  misc_feature: Encodes the peptide sequence at SEQ ID NO. 7248
aggatagcaatagaggagaggatagctctgcctctgctccgccggcgagtgacttcatggcgtcgccgcacctccccttcctctccttccccaaaacccagccacccctcgccctccaccgcgcccgcgcgctcccctcccgtccgcccgacgccgcgggggccgggcccgccgcgcccactcgcggggaccgcttcctcgaccgccacctcgccaccgacgccgccgcgcgcgtcctcgcgcccgacgacgcccagaggcgccagcgccgcaaagacaaacgccgggatctggcaagcaagccgtccggcctcccttcctgctacggctgcggcgcgccgctgcacacggcggaggaggccgcgccgggatacgtcgaccccgccacctaccacctgaaaaagaggcaccatcaactaagaaccgttctctgcacaagatgcaagctgctgtctcatggccatatggtcactgctgtcggtggccacggcggttatccagggggcaagcaatttgtctcagcggaagagcttagggacaagctttcctacctccgccacgagaaagccttgatagtcaaactggtcgacatcgttgacttcaatgggagtttcctgacacgagtacgtgatttcgctggtgctaatcctattattcttgtcataaccaaggttgatctcctccctagagacactgatttgaactgcgtaggtgattgggttgtagagtcagttgtcaagaagaagcttaacgtccttagtgtccatttgacaagctcaaagtcattggtcggcatcacaggggttatatcagagattcagcaggaaaagaagggccgagatgtatatatactgggttccgccaatgttgggaagtctgcatttatcagtgctttgctaagaacaatggcacataaggatccggtggcagctgcagctcaaaaatacaagccaatacagtctgctgttcctggaaccacccttggccctattgaaattgaagcattcttaggaggagggaaattatatgatacacctggtgttcatcttcaccataggcaagcagcagttattcatgctgatgatctgccttccctcgcaccccagagtcgtctaaaggggcaatgttttcccgctaatgatacagatgttgaattgagtgggaattctttattctgggctggacttgtccgcgttgatgttgtcaaggctcttccacgcacacgactgacattctatggacccaagaagctaaaggttaacgtagtcccaaccacagaagcagatcaattttacaagactgaagttggagtgacactgactcccccaactggcacggagagagctgaaggatgggcggggctgcagggtgttcgcgagttgaagataaaatatgaagaacttgatagacctgcttgtgacatatcgatctctgggctcgggtggatttctgtggagccattaggtgtgccatcaaacagcacggatagcaatggcaatgtcgatggtgagctgcacctgatagttcatgtacccaaaccagttgaggtcttcgtccgtcccccattgcctgtcggtaaagcagcatcgcaatggtaccggtatcaggagctgacagagcaagaagaggaattaagacctaaatggcattactgatactgctcccccttccctcttcttgtagttgtatcttgagtacgctactagtacaattttgtgtagtccaaattcagtaaaaagttatgctctcatgtgatgttaggataaactagtaaaaacaacaatggatatttagtattcaggatac

SEQ ID NO: 7248 - protein, 532 aa, Panicum virgatum
  misc_feature: Ceres CLONE 1905306
  misc_feature (28)..(532): SWISSPROT Homolog: EC 1.14.13.39 Nitric-oxide synthase 1
MASPHLPFLSFPKTQPPLALHRARALPSRPPDAAGAGPAAPTRGDRFLDRHLATDAAARVLAPDDAQRRQRRKDKRRDLASKPSGLPSCYGCGAPLHTAEEAAPGYVDPATYHLKKRHHQLRTVLCTRCKLLSHGHMVTAVGGHGGYPGGKQFVSAEELRDKLSYLRHEKALIVKLVDIVDFNGSFLTRVRDFAGANPIILVITKVDLLPRDTDLNCVGDWVVESVVKKKLNVLSVHLTSSKSLVGITGVISEIQQEKKGRDVYILGSANVGKSAFISALLRTMAHKDPVAAAAQKYKPIQSAVPGTTLGPIEIEAFLGGGKLYDTPGVHLHHRQAAVIHADDLPSLAPQSRLKGQCFPANDTDVELSGNSLFWAGLVRVDVVKALPRTRLTFYGPKKLKVNVVPTTEADQFYKTEVGVTLTPPTGTERAEGWAGLQGVRELKIKYEELDRPACDISISGLGWISVEPLGVPSNSTDSNGNVDGELHLIVHVPKPVEVFVRPPLPVGKAASQWYRYQELTEQEEELRPKWHY

SEQ ID NO: 7249 - DNA, 1562 bp, Panicum virgatum
  misc_feature: Ceres CLONE 1905338
  misc_feature: Encodes the peptide sequence at SEQ ID NO. 7250
gaagaacttcacaaatccaaatagccccgttcgcgaagcaagccttccctggaaactttctaattaggcctctaaaagaatctgacgttgaagttgaagtccctccccgcccccgcccacacctccccggccggagaagaccctgatgccgctgcggccggaggcctgaggttgcagatgggcggggtgacttcctcggtggcctccaagatggcgttcttccctcctaacccgccgtcttacggcgtggtcgacgaggaggaggagccgccgccgccggcgggtgccgctcaggggacgaattccgcggcggcggcggaggatgcgtgcaaggtggtaacgaggagggtggtgatgacgggcgtgcggtggagtgtgggcgtggaggcaaggcgggtgcggacgcggcggggctcggagatcatcgcgatgtacgtgcgtcgccccggggcccgcctcaccgtgctcttctcccatggcaacgctgccgacctcggcaatatgcacaaaatcttcgtcgagctcagcgcacgcctccacgtcaacctcatggggtatgattactctggttatgggcaatcatcgggcaagccaagtgaagctcacacctttgcggacatagaagctgcatacaaatgccttgtggacgtttacgggactagggaagaagacattgttctgtatggtcagtctgttggcagtggaccaaccctccatttagctgttcgtttggatcacataagagctgttgttctgcacagtccgatactttctggtttgcgtgtcttgtattctgtgaagaaaacatactggtttgacatttacaagaatattgacaaaattccccatgtgaaatgcccggttttggtaatccatggcacaaaggataatgttgttgactggtcccatggaaagcggctctgggagctgtgccatcagaagtatgaacctctgtggatcgagggaggcgaccatggtaacttggagacattccccgtgtacacaagacatttgaagaagttcctgtcagccataaaaaaactgccagctgaaaaagaagctgcagctgagagtggaaaatcaccagctgagaacaaaacaccatctgatgatctagctatttccgaggttccttccatgatctcgcgaaggttagaacactcgaggaagacggaacatgtggataaacgcagacgaagcactggctacagagagaaggcgagatccagtacagacaggaaagaaaaatctaggagaagtgtcgactgctttgacaggattgatgaacttgagcaaacagaaaagccaaggaaaagctttgataggattggagagaagattagatcgatgggtctgtgcaatgtggattgcttcaaagagccttcgcatagcactgagccttgccgtggtcattgaatgaatttctggttgctgtcagtattccccccagtttcttagatactggtttgtgtgctccatgtgatggaaaccataagatgttcacgaacagtaaagagaaatatagcacgaccttttgaagtcaaaaaaaaaaaaaaaaaaaa

SEQ ID NO: 7250 - protein, 412 aa, Panicum virgatum
  misc_feature: Ceres CLONE 1905338
  misc_feature (1)..(207): Pfam Name: Abhydrolase_2 Pfam Description: Phospholipase/Carboxylesterase
  misc_feature (1)..(97): Pfam Name: Abhydrolase_1 Pfam Description: alpha/beta hydrolase fold
MGGVTSSVASKMAFFPPNPPSYGVVDEEEEPPPPAGAAQGTNSAAAAEDACKVVTRRVVMTGVRWSVGVEARRVRTRRGSEIIAMYVRRPGARLTVLFSHGNAADLGNMHKIFVELSARLHVNLMGYDYSGYGQSSGKPSEAHTFADIEAAYKCLVDVYGTREEDIVLYGQSVGSGPTLHLAVRLDHIRAVVLHSPILSGLRVLYSVKKTYWFDIYKNIDKIPHVKCPVLVIHGTKDNVVDWSHGKRLWELCHQKYEPLWIEGGDHGNLETFPVYTRHLKKFLSAIKKLPAEKEAAAESGKSPAENKTPSDDLAISEVPSMISRRLEHSRKTEHVDKRRRSTGYREKARSSTDRKEKSRRSVDCFDRIDELEQTEKPRKSFDRIGEKIRSMGLCNVDCFKEPSHSTEPCRGH

SEQ ID NO: 7251 - DNA, 1735 bp, Panicum virgatum
  misc_feature: Ceres CLONE 1905386
  misc_feature: Encodes the peptide sequence at SEQ ID NO. 7252
aaaaaagaaatgcttgtcaaagcagcaagcgaaggcaaagagcgatgccggtggctgcaagcccttttcttcccccatcgtgcgagtccacggagtgatgtcacggagcggtggcggctttccccgattcactcccaaaactccatgttcttctccggctcgcaacctgttgacatcatcaccggctacctaaccgccggcgaccggtgatactaagctaggccccttgtccaccaaagtcttctctcgtcgagagcagctgccctcctgctcctcgcccgctctgctggtactggacttgcgcggagtggagatccacccgcccgggcctggttggatttcttcgtttcggttgctggtctgccaagtgggtggattgtgccaaccgcaggctggcttatcatcctgtcataagaaaaacgaaaaagggacgacagagcaatttgttgtctcattcttaggagctggcgagaacccagcatggcagatgctagttcgaggactgacacctcgaccgttgtagacactgacgatatgaatcaaaggagtggagctattgtcatggcttctaattcatctgatcgatctgacagatctgacaaacctatggaccaaaaggttttacggcggcttgcccaaaatcgtgaggcagcaaggaaaagtcgactgagaaaaaaggcatttgtccaacagcttgaaagtagtaaactaaaacttgcaagcctagagcaagagctccagaaagctcgacaacagggaatcttcatatccagctccggagaccaaacccatgctatgagtggaaatggagctatgacctttgatttagagtattctcgatggcaagaggaacaaaataagcagataaatgagctgaggactgcagtaaatgctcatgcaagtgatagtgacctccgtcttattgcggatgggataatggcacactatgatgagatattcaggctgaagggtgttgcagcgaaggctgatgtgttccatatactttcaggcatgtggaaaacacctgctgaaaggtgcttcttgtggcttgggggttttcgttcgtctgaacttctaaagctccttgtgaatcaacttgaaccactaactgagcagcaattgatggggctatccaatctccaacaatcctcccagcaggctgaggatgcattgtcacaaggaatggaagcattgcagcaatccttagcagaaacattggctgggtcccttggtccatcaggatcttccggaaatgtggcaaactatatgggtcaaatggctatggccatgggcaaacttggcaccctcgagaatttccttcgtcaggctgataatctacgacagcagaccttgcatcaaatgcaacgcattctaacgatccgacaagctgctcgcgcactccttgcgatccatgactacttctcacgtttgcgcgccctgagttctctttggcttgctaggccacgggagtaacatcgcttgcgttggtgtctgctccgtgaactgctggcggcaaactcacaacacatttgcagatgactggaggttccctcctttctgtacaagatgtattaacatcttctggtctaagattgtggtccagtgctgtacaagttagggtaaagcttggagtaacttgtaagttatcatgaatttatgattggcttattgtacacttgtattagcaataaagatggaagtacgtaataggccggaaaaaaaaaaaaaaaaaaaa

SEQ ID NO: 7252 - protein, 330 aa, Panicum virgatum
  misc_feature: Ceres CLONE 1905386
  misc_feature (1)..(45): Pfam Name: bZIP_1 Pfam Description: bZIP transcription factor
  misc_feature: The sequence is a functional homolog of  SEQ ID NO 1494 in the  10/374,780 US patent application
  misc_feature: The sequence is a functional homolog of  SEQ ID NO 1564 in the  10/412,699 US patent application
  misc_feature: The sequence is a functional homolog of  SEQ ID NO 1788 in the  10/412,699 US patent application
  misc_feature: The sequence is a functional homolog of  SEQ ID NO 1792 in the  10/412,699 US patent application
  misc_feature: The sequence is a functional homolog of  SEQ ID NO 1794 in the  10/412,699 US patent application
  misc_feature: The sequence is a functional homolog of  SEQ ID NO 2026 in the  10/374,780 US patent application
  misc_feature: The sequence is a functional homolog of  SEQ ID NO 2030 in the  10/374,780 US patent application
  misc_feature: The sequence is a functional homolog of  SEQ ID NO 2032 in the  10/374,780 US patent application
  misc_feature: The sequence is a functional homolog of  SEQ ID NO 206 in the  10/225,068 US patent application
  misc_feature: The sequence is a functional homolog of  SEQ ID NO 354 in the  10/412,699 US patent application
  misc_feature: The sequence is a functional homolog of  SEQ ID NO 356 in the  10/412,699 US patent application
  misc_feature: The sequence is a functional homolog of  SEQ ID NO 380 in the  10/412,699 US patent application
  misc_feature: The sequence is a functional homolog of  SEQ ID NO 534 in the  10/225,066 US patent application
  misc_feature: The sequence is a functional homolog of  SEQ ID NO 823 in the  11/479,226 US patent application
  misc_feature: The sequence is a functional homolog of  SEQ ID NO 831 in the  11/479,226 US patent application
  misc_feature: The sequence is a functional homolog of  SEQ ID NO 930 in the  11/435,388 US patent application
  misc_feature: The sequence is a functional homolog of  SEQ ID NO 934 in the  11/435,388 US patent application
  misc_feature: The sequence is a functional homolog of  SEQ ID NO 936 in the  11/435,388 US patent application
  misc_feature: Useful for making plants with modulated growth and phenotype characteristics
MADASSRTDTSTVVDTDDMNQRSGAIVMASNSSDRSDRSDKPMDQKVLRRLAQNREAARKSRLRKKAFVQQLESSKLKLASLEQELQKARQQGIFISSSGDQTHAMSGNGAMTFDLEYSRWQEEQNKQINELRTAVNAHASDSDLRLIADGIMAHYDEIFRLKGVAAKADVFHILSGMWKTPAERCFLWLGGFRSSELLKLLVNQLEPLTEQQLMGLSNLQQSSQQAEDALSQGMEALQQSLAETLAGSLGPSGSSGNVANYMGQMAMAMGKLGTLENFLRQADNLRQQTLHQMQRILTIRQAARALLAIHDYFSRLRALSSLWLARPRE

SEQ ID NO: 7253 - DNA, 2130 bp, Panicum virgatum
  misc_feature: Ceres CLONE 1905450
  misc_feature: Encodes the peptide sequence at SEQ ID NO. 7254
agaacctacctccagcgccttctgccaccgacacgtgggccaggcgcggcccgcggccccgccgcacgcgacaatgggacgggaggtgccagtcgcctcgccacatcctgtaacgccattggtggcttctttattgtgtctgtcgcccgcgcgcccatgcttcctccctcttcttcaacccctcctcctccttgacttcaccaccgtccttcctcgtcgtcttggaagcaagcaaggtagctgcacggaggcaaccacgcaataaggtgctcttggttctctgggatgatgaggcgcaggcagctcttgctggcgaccgcctgcttgtgggctctgtcgtgcgcctcgctgctccgtgcttccacccctgacgggcttctcagggtcagcctgaacaagaacaagctcgaccgcgaggcgctggccgcggccaaggttggcaggcagcacgacagccgccgcctgagggctgccggcggcgacgaggtccctctcatcgactacctcaacacccagtacttcggggtcatcggcatcggcacgccgccgcagaacttcaccgtcatcttcgacactgggagctccaacctctggatcccctcctccaaatgttatttctcgatagcatgctacttccaccacaaatacaagtccagcaagtctagcacttacaagtctgatggggagacttgcaaaattacttatggctctggatcaatttccggattcttcagcaaggataacgtgcttgttggagaccttgttgttaaaagccagaagttcattgagactactcgcgaacccagtttctcattcatccttgggaagtttgatggcattcttggtcttggataccctgaaatctctgtcggcaaagctcctcccatttggcagagcatggaagagcagaaacttcttaaggacaacgtcttctctttctggctcaaccgaaaccctgatgcatcttccggtggcgagcttgtctttggcggcgtggaccctaaacacttcaaggggaaccacacctatgttcctgtttcccgcaaaggttactggcagttcaacatgggggatctcctcattgatggtcactcaactggtttctgtgcaaaaggctgtgctgctattgccgactctgggacttctttgttggctggtcctacagctatagttgctcaagtgaaccatgcaattggggcagagggaattatcagcacggaatgcaaagaagtggtgagccagtatggagagatgatcctcaacttgctcatagcacagacagatccacagaaagtttgcagccagattggtctgtgcatgtttgatggtattcagtctgtcagtgaaggaattgaatctgttgtcgggaaagaaaacctgggctcagatgttatgtgcacagcctgtcagatggctgttgtgtggatagagaatcagctccgtgaaaacaaaacaaaggagataatattgcaatatgctaaccagctatgtgagcgtctaccaagtcccaatggcgaatcaacagtcagctgccatcagatatcaaagatgccaaatctttcattcactattgcaaacaagagcttcaccctaacaccagagcagtacattgtgaagctggagcaaggagggcaaactgtctgcatcagtgggttcatggcattcgacataccacccccgcgtggtcctctctggattcttggggatgtcttcatgggagcttaccacacagtgttcgactttggcaaggacaggatcggcttcgcggaatctgcatgagtgtgtcagcactctgctccgttagtgtagcttctctatcagctacatgcagacagtacactgcaaataaatggatcgcgaaaaatgctaaaaccgggaacatgatttagcacacgggcagacctttctttctgaagaagactaaatgaatgcttggagagctatgcttgaagatatgtatgcttgatgtttactgaagaaaggaacactgagaaataatatcatgctcatgtcatcccatcttgaaaattgtgtgatcatatttgtacaacctatcgtttgtaaaataacttctggattgacttggaactgatgtgcatgttacaatgcaatttgcttctctgttgtggt

SEQ ID NO: 7254 - protein, 497 aa, Panicum virgatum
  misc_feature: Ceres CLONE 1905450
  misc_feature (1)..(424): Pfam Name: Asp Pfam Description: Eukaryotic aspartyl protease
  misc_feature (1)..(425): Pfam Name: Asp Pfam Description: Eukaryotic aspartyl protease
  misc_feature (1)..(425): Pfam Name: Asp Pfam Description: Eukaryotic aspartyl protease
  misc_feature (1)..(424): Pfam Name: Asp Pfam Description: Eukaryotic aspartyl protease
  misc_feature (1)..(401): Pfam Name: Asp Pfam Description: Eukaryotic aspartyl protease
  misc_feature (1)..(424): Pfam Name: Asp Pfam Description: Eukaryotic aspartyl protease
  misc_feature (1)..(425): Pfam Name: Asp Pfam Description: Eukaryotic aspartyl protease
  misc_feature (1)..(425): Pfam Name: Asp Pfam Description: Eukaryotic aspartyl protease
  misc_feature (1)..(420): Pfam Name: Asp Pfam Description: Eukaryotic aspartyl protease
  misc_feature (1)..(425): Pfam Name: Asp Pfam Description: Eukaryotic aspartyl protease
  misc_feature (2)..(497): SWISSPROT Homolog: EC 3.4.23.40 Phytepsin precursor
MMRRRQLLLATACLWALSCASLLRASTPDGLLRVSLNKNKLDREALAAAKVGRQHDSRRLRAAGGDEVPLIDYLNTQYFGVIGIGTPPQNFTVIFDTGSSNLWIPSSKCYFSIACYFHHKYKSSKSSTYKSDGETCKITYGSGSISGFFSKDNVLVGDLVVKSQKFIETTREPSFSFILGKFDGILGLGYPEISVGKAPPIWQSMEEQKLLKDNVFSFWLNRNPDASSGGELVFGGVDPKHFKGNHTYVPVSRKGYWQFNMGDLLIDGHSTGFCAKGCAAIADSGTSLLAGPTAIVAQVNHAIGAEGIISTECKEVVSQYGEMILNLLIAQTDPQKVCSQIGLCMFDGIQSVSEGIESVVGKENLGSDVMCTACQMAVVWIENQLRENKTKEIILQYANQLCERLPSPNGESTVSCHQISKMPNLSFTIANKSFTLTPEQYIVKLEQGGQTVCISGFMAFDIPPPRGPLWILGDVFMGAYHTVFDFGKDRIGFAESA

SEQ ID NO: 7255 - DNA, 1074 bp, Panicum virgatum
  misc_feature: Ceres CLONE 1905641
  misc_feature: Encodes the peptide sequence at SEQ ID NO. 7256
aggcttcgcaaggcggccacacgccgagaccccccaccaccacccgctcccgtcgcctcccctgccgggcgacgccaccatgctgacgccggccggccgcctcgcggcccgccgcctcctcggcctcgcctcctcctccgcgtcggaagccgccgcccaacgcctggctccgtctccgatcgccgcctcgtcctacgccgccgccgctaggggcttcgttcccatctccagacccttctccacggctcttaactaccacattgattcgccggagaacaagccggacatgaaatgggagttcacggaggcgaacatgaagaaggtcaaggagatactgtctcgctacccaagcaactacaagcaatcaggtattattccgctgcttgatcttgcgcagcagcagcatggtggatgggtgccggtcgcagcaatggatgctattgctaaaatcgttgaagttgcgccaatcagggtatatgaagttgctacgttttacactatgtttaatcggactaaggtcggcaaataccaccttctagtgtgtggaactacaccttgcatgattcgtggctcacgtgaaattgaagagacattattggagcaccttggagttaaaagaaatgaggtgaccagtgatggtttattttctgttggagaaatggagtgcatgggttgctgtgtgaatgctcccatgattactgtggctgactactcgaaaggttcagagggttacacatacaactattatgaggacctcactccgaaacgagttgttgagattgttgagatgctcagaagaggagaaactccccctcgaggcacacagcacccagaacggaaaaactctggccctgctggtgggaacaccactttacacggagagccgaaacctcctccatgcagggatctagatgcctgctaggtttgccttggagcattacgagcacacaaataagtcggctcgcactgtatggtgtgcaaactgcaaacagcaggagggacgtgttattcttgtgtttcatcaatgaaagcttttctaacttttattctgcagaaaaaaaaaaaaaaaaaaaa

SEQ ID NO: 7256 - protein, 280 aa, Panicum virgatum
  misc_feature: Ceres CLONE 1905641
  misc_feature (49)..(280): SWISSPROT Homolog: EC 1.6.5.3 NADH-ubiquinone oxidoreductase 24 kDa subunit, mitochondrial precursor
MLTPAGRLAARRLLGLASSSASEAAAQRLAPSPIAASSYAAAARGFVPISRPFSTALNYHIDSPENKPDMKWEFTEANMKKVKEILSRYPSNYKQSGIIPLLDLAQQQHGGWVPVAAMDAIAKIVEVAPIRVYEVATFYTMFNRTKVGKYHLLVCGTTPCMIRGSREIEETLLEHLGVKRNEVTSDGLFSVGEMECMGCCVNAPMITVADYSKGSEGYTYNYYEDLTPKRVVEIVEMLRRGETPPRGTQHPERKNSGPAGGNTTLHGEPKPPPCRDLDAC

SEQ ID NO: 7257 - DNA, 1677 bp, Panicum virgatum
  misc_feature: Ceres CLONE 1905753
  misc_feature: Encodes the peptide sequence at SEQ ID NO. 7258
ctctttctcgcatcgccgcgccgcgccgcgccgctcggctccctccccctcctcctcctcgtcgccgctgccgtcgtcgtctcgcgccaccgccgttatcctcgtaagttgatcccggctcctccccccgaccgcgcggctcgtcccctccccgtccaaatcgctgccgcgcacgggccggggcggggcggtcccgtcccgcgcggcggcaatccgggcggttgggcttgcttcgcgttcgcggatcaaccgccgcggtggaatgcgtgtcgggcggtggcgactgacgacgcgcccctgtgtttcgctgcggttgcagggtgctgcgcagggcccggacgggggaggagcagatgggggtgtacctcagcacgcccaagaccgacaaggcctccgccgatggggagaacgaccgcgtgcggttcggcctctcctccatgcaggggtggcggaccaccatggaggacgcgcatgctgctttgccggaccttgatgactgcacttccttttttggtgtttatgatggccatggaggaaaagctgtatctaaattctgcgcaaaacatttgcataaacaagtcctcataaatgatgcaaattcatcgggtgatctacccgcttctgtccataaagctttcttaagaatggatgagatgatgaaaggtcagagggggtggagagaattgactgagctcggagaaaaggggaacaagatttcgggtatgctagagggcataatatggtcccccaagggtggagattcagatcatctaggggatggatgggaaactgaggagggtccgaattcaaactttcctgggccaacatctggaagcacagcttgtgtggctgtcataagaaatgatcaactcattgttgcaaatgctggggattcccggtgtgttatctcacggaagggtcaggcgttcaatttgtcaacggatcacaagccagatcttgagggagaaaaggagaggattttgagtgccggtggatttgttgttgctgggcgggtcaatggaagtctgaacttgtcaagggcaataggtgacatggaactgaagcaaaatgaggttttgccagctgagagacagattgtgactgctgaacctgagttgaaaacagtcaagctttctgaagatgatgaattcattgttttagcatgtgatggcatatgggactgtatgacaagtcaagaagtggttgattttgtacataaacacttaaacaccgaggataacctatcagatgtgtgcgagaagttgctcaaccgctgtgtggcacctacatctggtggcgaaggatgtgataacatgactgttatcattgttcagtttaagaaaccactttcttcagctgctactactagtaccgagcagcctgcagcaactgcagaagagatgcggccaaacgagctcggtggcccagacgacccccagaggtaggatcaagtagcacaccatgctggtggagctctaactggtggatgatagacaacaaaaaggatagtgagtggtgtacataagaaaagggattctattcgacaatctctatagggtttgttccttcttttctagtgttcagagtcgtcacaacctgtaatacatggcgtgttgtttcttaatccgggttttgtgaaatgcatggatgagttgtcaggagataagcattgctctc

SEQ ID NO: 7258 - protein, 363 aa, Panicum virgatum
  misc_feature: Ceres CLONE 1905753
  misc_feature (1)..(295): Pfam Name: PP2C Pfam Description: Protein phosphatase 2C
  misc_feature (155)..(335): SWISSPROT Homolog: EC 3.1.3.16 Protein phosphatase 2C isoform gamma
MGVYLSTPKTDKASADGENDRVRFGLSSMQGWRTTMEDAHAALPDLDDCTSFFGVYDGHGGKAVSKFCAKHLHKQVLINDANSSGDLPASVHKAFLRMDEMMKGQRGWRELTELGEKGNKISGMLEGIIWSPKGGDSDHLGDGWETEEGPNSNFPGPTSGSTACVAVIRNDQLIVANAGDSRCVISRKGQAFNLSTDHKPDLEGEKERILSAGGFVVAGRVNGSLNLSRAIGDMELKQNEVLPAERQIVTAEPELKTVKLSEDDEFIVLACDGIWDCMTSQEVVDFVHKHLNTEDNLSDVCEKLLNRCVAPTSGGEGCDNMTVIIVQFKKPLSSAATTSTEQPAATAEEMRPNELGGPDDPQR

SEQ ID NO: 7259 - DNA, 1140 bp, Panicum virgatum
  misc_feature: Ceres CLONE 1905755
  misc_feature: Encodes the peptide sequence at SEQ ID NO. 7260
ctgcctcgccgatcgccgtgcactcgggaatggcgctgcggccgctgctccacctcctcctcccgtcgcctccccaccggagccccatcctcccgccgtcaccgcctcccccctcctcctctgccaccactcgccgcaccgccgccgccgcgctcctcctcctcgccgcggccgcgggcgctccgcctccgcggcccgcccgcgccgccgccgagctcgaggacgtcgacgaggcccgcgtcgtccgcctgttccaggaggcgtcgccgtcggtggtgttcatcaaggacctcgtcgtcgcggggccgcaggggcggggaggtggcggggaggaggaggtcgacgagaaggagggcggcgccaaggtggaggggaccgggtccgggttcgtgtgggactccgcgggccacattgtaacaaattaccatgtggttgcaaaactagctggggatggatctgtgtttcatcgctgcaaggtattcttggaggattctagcggcaaaagttactcaaaggaagggacgctaatagggtgtgatccagcatatgatcttgctgtactgaaggtgcaggtagatgctgacagtgagaagttgaggcctgctctgattggcacatcacgggatttgcgagttgggcaaagttgttttgccattgggaacccttatggttatgaacacactctaactactggagtggttagcggattagggagggagataccatctcccagtaggagagcaattcgtggggctatacagacagatgctgctataaatgccggtaactcaggaggtccacttattgactcttatggccatgtaattggtgttaacacagctacattcacacgtaaaggatctgggatctcatccggggtgaactttgccatccccatcgacaccgtcgtacagtcagtccccaacctaattgtatacgggacctctgtgagcaacaggttttaaccgacattgtccacttcaattcatgctgccactgttacgctcactattcgccaacatacttggcgtctgtatcactggatggtgcaaggaagtttgcatgatcttggatgcgctgaacttagatggtacatacggcattgcacgctgccaaagttaaaaaaaaaaaaaaaaaaaa

SEQ ID NO: 7260 - protein, 311 aa, Panicum virgatum
  misc_feature: Ceres CLONE 1905755
  misc_feature (9)..(188): Pfam Name: Trypsin Pfam Description: Trypsin
MALRPLLHLLLPSPPHRSPILPPSPPPPSSSATTRRTAAAALLLLAAAAGAPPPRPARAAAELEDVDEARVVRLFQEASPSVVFIKDLVVAGPQGRGGGGEEEVDEKEGGAKVEGTGSGFVWDSAGHIVTNYHVVAKLAGDGSVFHRCKVFLEDSSGKSYSKEGTLIGCDPAYDLAVLKVQVDADSEKLRPALIGTSRDLRVGQSCFAIGNPYGYEHTLTTGVVSGLGREIPSPSRRAIRGAIQTDAAINAGNSGGPLIDSYGHVIGVNTATFTRKGSGISSGVNFAIPIDTVVQSVPNLIVYGTSVSNRF

SEQ ID NO: 7261 - DNA, 2125 bp, Panicum virgatum
  misc_feature: Ceres CLONE 1905797
  misc_feature: Encodes the peptide sequence at SEQ ID NO. 7262
gacccttcgcgaaaccgccgggcgaagcgcgaacgctatccgctgctgccggggagatccgtccggccctggtctctccttccttttgtcggtaaagggatcctagctctggttgtgtgggtgtggattgattgattcccttgttctcgatcagatccaagttaagtttgtatccgtccgcccgggttttgattgcgttcgtcttctccgtcagcggctgagcgctcaagatcggcgctgattggcgccccggccaattaaatttggcgccctgagaagaattgggaggtccaggcatgagcttccgggaccaggagagtggcggggaggatggggtccggacgtcctccgcgtcggacctgcggaagccgctcctcaacaccgggagctggtaccggatgccgccgccggggggcataatgggctcacggcaatccagcctcatggagcgcctaggctcctccgccttctccatccgcgacgtctctgtctcggccacgctctgcacgctcatcgtcgcgctaggtcccatccaatttggcttcacctgcggatactcctcgcccacccaggacgccgtggttgctgacctcagcctctccctctccgagttttccctgttcggatcactgtccaacgttggggcgatggtgggagccattgccagtgggcagattgcagagtatatcggacgcaaggggtctctcatgatcgctgcgatcccgaacatcatagggtggcttgcgatatcttttgcaaaagattcctcctttttgtttatgggacggctgctagaagggtttggagttggtgtaatatcttatacggtacctgtttatattgcagaaattgccccacaggaccagaggggagctctcggtgctgtctttcagctctcagttactattggtatattgctttcatacctgtttggcatgtttgttccctggagaattcttgctgttctaggcattttaccttgttcaatcctgattcctgggttgttctttgttcctgaatctccaaggtggctggcgaaaatgggaaagatggaagattttgagtactcactgcaagttctgcggggatttcagactgacatcacagcagaagtaaatgaaataaagcgatcagtggcatcgtcaaggaggaggacaaccattaggtttgccgatatcaagcagaagagatatagtgttcctcttatgataggaatcggtctcctcgtgctgcagcaactaagtggtgtcaatggcatcctattttatgctgcaagtatcttcaaagctgctggtattacaaatagtaatctagcaacatttggtttgggagttgttcaggtgattgctactggagtgacaacctggctgagtgacaaagctggtcgaaggcttcttctcattatttctactactggaatgaccattactctcgtcgttgtttctgtgtcattttttgttaaggacaacataactgctggctcacacttatactctgtaatgagtatgctttcgttggctggacttgtggcatttgtgatttcgtttaatcttggattgggagccattccctggatcattatgtctgagattcttcctgttagtattaagagtcttgctggaagtgttgccacccttgcaaactggctgggagcatgggccgttactatgaccgcaagtttgatgttgagctggagcaatggaggaacttttgctatctatgctgccgtgtgtaccatggctctcatttttgtgtgcttgtgggtgccggagaccaaaggaagaacgctcgaggaaattgcattttcattccgctgaagcagtccaatgttctgagaccaagcatcatcatgagagtctgagatctccccatgtgctatcaagacgtgccatttgggacgctgaacccatgaagtccgcagcaatcttgcagccatgttttgtttggatgtaccatcttgtgtctgtacattgtacaatatgattctttagcaggaggcagctgtgtttattatatgtgtaagatataatggaatattaggcactgaaaacccttgcacgggttacggaagagagcgatttgtttatttcattgagacacatttagaataattttttttttgagc

SEQ ID NO: 7262 - protein, 506 aa, Panicum virgatum
  misc_feature: Ceres CLONE 1905797
  misc_feature: Great-hit functional homolog of the protein sequence given in SEQ ID NO 9756
  misc_feature: Useful for biocontainment applications
  misc_feature: The plant produces a reduced number of seeds.
MSFRDQESGGEDGVRTSSASDLRKPLLNTGSWYRMPPPGGIMGSRQSSLMERLGSSAFSIRDVSVSATLCTLIVALGPIQFGFTCGYSSPTQDAVVADLSLSLSEFSLFGSLSNVGAMVGAIASGQIAEYIGRKGSLMIAAIPNIIGWLAISFAKDSSFLFMGRLLEGFGVGVISYTVPVYIAEIAPQDQRGALGAVFQLSVTIGILLSYLFGMFVPWRILAVLGILPCSILIPGLFFVPESPRWLAKMGKMEDFEYSLQVLRGFQTDITAEVNEIKRSVASSRRRTTIRFADIKQKRYSVPLMIGIGLLVLQQLSGVNGILFYAASIFKAAGITNSNLATFGLGVVQVIATGVTTWLSDKAGRRLLLIISTTGMTITLVVVSVSFFVKDNITAGSHLYSVMSMLSLAGLVAFVISFNLGLGAIPWIIMSEILPVSIKSLAGSVATLANWLGAWAVTMTASLMLSWSNGGTFAIYAAVCTMALIFVCLWVPETKGRTLEEIAFSFR

SEQ ID NO: 7263 - DNA, 1749 bp, Panicum virgatum
  misc_feature: Ceres CLONE 1905901
  misc_feature: Encodes the peptide sequence at SEQ ID NO. 7264
aatcctccccattctcacctccccaacattgtttcacgtacaggatccagcatgagtccatcaccaattcacaagtgcctcaaaatcgtctacacgaagactgtagacaacttcctcctagtagtctcaatgtcgctcacagttgcagctatcgttgcgatggcaagaagcaacactaacgatcttctcactgatcgagtccaagccctcaaccattcacatcagatcttgctgatgatcgggttgttcttagccaccgcggtgaccgtgtacatcatgcagcgcccgcgcatggtgtacctcatcgactacgcttgcttccggcccccacacaactaccgtgttccctctgcctcttttgccgagcatgtccgccatgtaagccagttcagcgagcgtagtatccgtttcttgacacggcttctcgagagatcgggccttggtgaggagacgagcctgcctccgctcagcttctacatcgaaggtcacaagtacagcacactggaggctggtctcaaggaggttgagctggtcatcttctccgccatcgatgatctccttgccaagacaggcatcgatcctaccaccatcgacatagttgtcgtaaactgcagcggattcagcccagcgccatctatgccagatatgattgtaagcaagtacaagatgcgtagcgacatccgcagcatccatctgtctggaatggggtgcagtgctgggttgatctcaatagagcttgcaaagaacctgttgcaggcgatgccccaaggtgcacgagcactagtcgtatccacagagatcctgacacccaactactatcttggaaacgagagagctatgctgcttccatattgcttgttccgcatgggtggagctgccgtgctgttatcgacatcaccagcaaaggcccgattcaggctcaagcacatcatacggacactcactgcaggagacgatagatcttaccgatgcatctaccaggaagaggatgacaaggggaacacaggggtcaacctctccactgacctcatagaagttgcttccaacacattcaaaaccaacatcaccacggttgcgccgctcatcctcccggtctctgagaaactgctgtttgcactgtccttcgtatcacaaaagcttttcaagatgagggagaagttgcgcatgcctaacttgctcacagggttcgaccacatttgcgtccatgcaggtgggcgtgcggtgatcgatgggatccaacgcagcctgtgcctgtcagatgagcatgttgagccatctaggatgacacttcatcggttcggcaacacatccagcagctccttgtggtatgaactggcatacgtagaggccaagggccggatgcgcaagggcgaccgggtatggatgattgggtttgggtctgggttcaagtgtaacagtgcagtatgggagtgcatcattccagccagcaatgaagatggaccttgggctgggtgcatccatcgttatccagtacatattccttaatagtcataaagcatgttgtagcaaacgcagaaacttttttttttaataattcaaatacagaaacttaaacgttaccaataaaatgtaattttaagtctttgtaatcttgcgcccaatcagctgtacttagctatggtatcatgttgggcgcccttatcatgcatatgtttctgtgaaataaaacgggcctttgagcctgtatataagaaaaatcaaaactcctaaaaaaaaaaaaaaaaaaaa

SEQ ID NO: 7264 - protein, 484 aa, Panicum virgatum
  misc_feature: Ceres CLONE 1905901
  misc_feature (1)..(289): Pfam Name: FAE1_CUT1_RppA Pfam Description: FAE1/Type III polyketide synthase-like protein
MSPSPIHKCLKIVYTKTVDNFLLVVSMSLTVAAIVAMARSNTNDLLTDRVQALNHSHQILLMIGLFLATAVTVYIMQRPRMVYLIDYACFRPPHNYRVPSASFAEHVRHVSQFSERSIRFLTRLLERSGLGEETSLPPLSFYIEGHKYSTLEAGLKEVELVIFSAIDDLLAKTGIDPTTIDIVVVNCSGFSPAPSMPDMIVSKYKMRSDIRSIHLSGMGCSAGLISIELAKNLLQAMPQGARALVVSTEILTPNYYLGNERAMLLPYCLFRMGGAAVLLSTSPAKARFRLKHIIRTLTAGDDRSYRCIYQEEDDKGNTGVNLSTDLIEVASNTFKTNITTVAPLILPVSEKLLFALSFVSQKLFKMREKLRMPNLLTGFDHICVHAGGRAVIDGIQRSLCLSDEHVEPSRMTLHRFGNTSSSSLWYELAYVEAKGRMRKGDRVWMIGFGSGFKCNSAVWECIIPASNEDGPWAGCIHRYPVHIP

SEQ ID NO: 7265 - DNA, 1060 bp, Panicum virgatum
  misc_feature: Ceres CLONE 1906022
  misc_feature: Encodes the peptide sequence at SEQ ID NO. 7266
ccccctccgttttctacttttgcttccaccggccgccgccccaattcggataacaaagctctcctcctcccggccgcaggagctagacgccggcagcctatccgggagagggccgacgagctggggttgcggctgcaattcgattggagcgaagccggttctctcgccgccggtccaggatggtgcgggggaagacgcagatgaagcggatagagaacccgaccagccgccaggtcaccttctccaagcgtcgcaacggcctgctcaagaaggctttcgagctctcagtcctctgcgacgccgaggtcgccctcgtcgtcatctccccccgcggcaagctctacgaattcgccagcgccagtgtgcagaaaacaattgaacgctacagaacatacacaaaggataatgtcagcagcaagacagcacagcaagatattgagcaagtaaaagctgatgctgagggcctggcaaagaagcttgaagcacttgaagcttacaaaagaaaacttttgggtgagaagttggaagaatgctcaattgaagaactgcacagtttggaagtcaaacttgaaaagagcctgcattgtatcaggggaagaaagactcagctgctggaagagcaggtcaataagctgaaggagaaggagatgacactgcgcaagaacaatgaagagttacgtgaaaagtgcaagaaccagccgcctctgccgttgactccagcgcgccctgtcatcaccgtggaagacgatcgcccggagcagaacgacgacgaccgcatggacgtggagacggagctgtacttagggctgcctggcagggatccccgccgaaacgaggttgcagaagtcaggtcaggatagctgtggacaagcaacgaaagcaagccgagaataatctagatctctgatgcggagatgcagcaagccaagcaacggtaaaaccgtcagtggtgttgtgtttacaaaactgtgttagttgtccaatgatgcagacccaaccaaacatccgtgtatgcactaccctgtctgtagatgtggttccgtggatccgaatctgaagc

SEQ ID NO: 7266 - protein, 226 aa, Panicum virgatum
  misc_feature: Ceres CLONE 1906022
  misc_feature: The sequence is a functional homolog of  SEQ ID NO 1368 in the  10/666,642 US patent application
  misc_feature: The sequence is a functional homolog of  SEQ ID NO 164 in the  10/666,642 US patent application
  misc_feature: The sequence is a functional homolog of  SEQ ID NO 422 in the  11/435,388 US patent application
  misc_feature: The sequence is a functional homolog of  SEQ ID NO 642 in the  11/435,388 US patent application
  misc_feature: Useful for making plants with modulated growth and phenotype characteristics
MVRGKTQMKRIENPTSRQVTFSKRRNGLLKKAFELSVLCDAEVALVVISPRGKLYEFASASVQKTIERYRTYTKDNVSSKTAQQDIEQVKADAEGLAKKLEALEAYKRKLLGEKLEECSIEELHSLEVKLEKSLHCIRGRKTQLLEEQVNKLKEKEMTLRKNNEELREKCKNQPPLPLTPARPVITVEDDRPEQNDDDRMDVETELYLGLPGRDPRRNEVAEVRSG

SEQ ID NO: 7267 - DNA, 1617 bp, Panicum virgatum
  misc_feature: Ceres CLONE 1906190
  misc_feature: Encodes the peptide sequence at SEQ ID NO. 7268
accaaacgctcaccccttcctccttgccccccccccctccgtctccgcctcctcctcctcgcctttcctccacgcctccgacgccgccacagcgccaccgggtggttcctcctcctcccccagcgccttcccgcgaggctccgccatgccttccctcgcgcaccaccatagccccatggatgatgggaggatgggcgcgctgaagagtaataatggcttcccgccggaggagacggcggaggacgccgcggcggcggccgccggtgcgtttgttaagaaggacgggttctcggtcgaggacctgctggaccttgaggagttctgcgagcctgacaaggaaagtgccgaggacgtagaggcgccgccgcctgcggcctccgccgcggccgaggtgaagtcgaacgaggactcccagccgttgtcggtcgtgacttacgagctcccgccgccgccaccggagattgttgaccttccggcgcatgacgtcgaggagttggagtgggtctcccgcatcatggacgactcgctctccgagctgccgccgcagccgcagccttccgccgcgttggtggcgtccatggcggcgcggcccccgctggcgcagcagcggcgggcgccgcttgtgcacgacggcgcgtaccgcgcgctgccggcggcgcccggcccgctgcggaccccgaccatctgcgcgctgtcaacggaggcgctggtgccggtcaaggcgaagcgcagcaagcggtcgcggggcccggggtggtcgctctctggcgcctcgttcttgtccgactcggcctcgtcctcgtcgaccaccaccacctcctcgtgctcctcgtcaggttcgttctcgccgttcgtcctcctggactcggtcccgtttggcgggctggagctgggcgagggctactacaaccacttcctgccggcgccgccgtccaagaagtccaagcacgctggcagcaagcacaagcccaagaagcgggggcgcaagccgaagcatcttcccccgaacccctccgccgccggtgcggcggcccagcagccggcgccgggcgaccgccgctgcagccattgcggcgtgcagaagaccccgcagtggcgcgcggggcccgagggcgccaagacgctgtgcaatgcgtgcggcgtccgctacaagtccgggcggctgctcccggagtaccgcccggcgtgcagccccacgttcgtgagcgacatccactccaactcccaccgcaaggtgctcgagatgcgccgcaagaaggagccggccaccgccgccgcgccggccgtcgcgtcgttctagctgcccctctctggcaacaaggaggaggctggccaccaagcaggcaagcagcagcggtggctgtacatttttttccggccgtagccctgtaccgtacctgaatttccctcccttttcctcctgctatgctagtatcgtcgtcgtagtgccttgggttaattagagtttaggagctttcgattcggtctggttaggtttagctttggttcctgttagggttctactgcgacagcagcgggcgcagcactagcgcagaacttaaatttctagcatttctaaaaaggcagcttttctttctaaaaaaaaaaaaaaaaaaa

SEQ ID NO: 7268 - protein, 384 aa, Panicum virgatum
  misc_feature: Ceres CLONE 1906190
  misc_feature (1)..(36): Pfam Name: GATA Pfam Description: GATA zinc finger
  misc_feature: The sequence is a functional homolog of  SEQ ID NO 1656 in the  10/374,780 US patent application
  misc_feature: The sequence is a functional homolog of  SEQ ID NO 478 in the  11/479,226 US patent application
  misc_feature: Useful for making plants with modulated growth and phenotype characteristics
MPSLAHHHSPMDDGRMGALKSNNGFPPEETAEDAAAAAAGAFVKKDGFSVEDLLDLEEFCEPDKESAEDVEAPPPAASAAAEVKSNEDSQPLSVVTYELPPPPPEIVDLPAHDVEELEWVSRIMDDSLSELPPQPQPSAALVASMAARPPLAQQRRAPLVHDGAYRALPAAPGPLRTPTICALSTEALVPVKAKRSKRSRGPGWSLSGASFLSDSASSSSTTTTSSCSSSGSFSPFVLLDSVPFGGLELGEGYYNHFLPAPPSKKSKHAGSKHKPKKRGRKPKHLPPNPSAAGAAAQQPAPGDRRCSHCGVQKTPQWRAGPEGAKTLCNACGVRYKSGRLLPEYRPACSPTFVSDIHSNSHRKVLEMRRKKEPATAAAPAVASF

SEQ ID NO: 7269 - DNA, 1782 bp, Panicum virgatum
  misc_feature: Ceres CLONE 1906194
  misc_feature: Encodes the peptide sequence at SEQ ID NO. 7270
acacacacacggcggctgcggctacggctcctccaatggcggcgatcaccgcgccgccgccccctcctcccgcctccacctcctgccgcctcccccgccgctggtctctaacccgcatcgccgccgcctcctcttccccatcctcccgcttccgcccatcctcttccacccgccgcccatcctcttccacctccttctccgcggccggcagcagcggcggcgggggcgagatcctccacgtctcgccaccttctccacccgccgatcccccgggggcgcccgtctacgtcacgctccccgccgacgccgtcggcccggggggccgcgtggcgcgccgccgcgccatgggggcctcgctcgccgcgctggccgccgccggggtcgccggcatcgccttcgagctctggtggggcgtcgtcgagcgccagggccccggggagtacgactgggccggctacctcgacctcgccgccatggcccgccgccacggcctccgcgtgcgcgccatcctcgccttccaccagtgcggcgctggcccgcacgacccgctctggattcctttgccaaagtgggtgcttgaggagatagataaggttccagacttgtcatataccaatagataccagcagagaaacaaagaatacatctcattggggtgtgatagtcttcctgttctgaaaggaagatcacctatgcaagcttactcagacttcatgagaagcttccgcaatactttcgaagattaccttggggccatagtaacagaagttcaagttggaatgggcccaggaggtgagcttaggtatccgtcatgcccaactgagaagctaaatcagctaggcagttcatccgaacttggggaatttcaatgttatgacaagtttatgcaagcatcattgagtgctcacgcacagattcatgggatccaagagagggggagtggtggttcaattggcacagatggctcacagcacaacctcgaagaaagtagtttttttcgtgctgatggaggatattgggatacaccttttggtcgctttttccttgagtggtattcaggaatgcttgtcctccatggagaaaggctatgcatgatagctgacactattttctccggtactggcgtgaccatctcaggaaaggttgctggcatgcattggcactattatacttgtgcacacccatctgaactgacagctggctactataataccctactgagagatggttaccttcctattgctcaaatgtttgccaagtacaaagctgcactctgttgcggttgttttgacctgagggatgcagaaaaaacaaatcccgagagcagtccagaagggacccttcggcagcttataggtgctgcaaaaatgtgcaatcttccccttaatggtgaaaattctgtgacaaggctggatgatgcatcactgaaccaagtgataagaagctcacggctctattcaggtcggagttcaagaacatcattttccttcaactatgttaggatgaacaaaagcttatttgaattccacaattggagtcgatttacaaagtttgttaggcagatgtcagatgccagaacctttctagcaagactagatgtcaggagagggcagcaacacttgtcttcaatgtcagttgtttgggtagttagtagggcatgtgcatatacatgaaagttttcaaaagcaattggaactcatgtacatgtaattttcaagcataaatgatttgacaacatggaaggagaagtttcgctctgtacaaaaaaaaaaaaaaaaaaaa

SEQ ID NO: 7270 - protein, 545 aa, Panicum virgatum
  misc_feature: Ceres CLONE 1906194
  misc_feature (1)..(423): Pfam Name: Glyco_hydro_14 Pfam Description: Glycosyl hydrolase family 14
MAAITAPPPPPPASTSCRLPRRWSLTRIAAASSSPSSRFRPSSSTRRPSSSTSFSAAGSSGGGGEILHVSPPSPPADPPGAPVYVTLPADAVGPGGRVARRRAMGASLAALAAAGVAGIAFELWWGVVERQGPGEYDWAGYLDLAAMARRHGLRVRAILAFHQCGAGPHDPLWIPLPKWVLEEIDKVPDLSYTNRYQQRNKEYISLGCDSLPVLKGRSPMQAYSDFMRSFRNTFEDYLGAIVTEVQVGMGPGGELRYPSCPTEKLNQLGSSSELGEFQCYDKFMQASLSAHAQIHGIQERGSGGSIGTDGSQHNLEESSFFRADGGYWDTPFGRFFLEWYSGMLVLHGERLCMIADTIFSGTGVTISGKVAGMHWHYYTCAHPSELTAGYYNTLLRDGYLPIAQMFAKYKAALCCGCFDLRDAEKTNPESSPEGTLRQLIGAAKMCNLPLNGENSVTRLDDASLNQVIRSSRLYSGRSSRTSFSFNYVRMNKSLFEFHNWSRFTKFVRQMSDARTFLARLDVRRGQQHLSSMSVVWVVSRACAYT

SEQ ID NO: 7271 - DNA, 1096 bp, Panicum virgatum
  misc_feature: Ceres CLONE 1906201
  misc_feature: Encodes the peptide sequence at SEQ ID NO. 7272
aacaagcaacacagttacacagcacatcacccaacagtagctagctaccgatggcgatggccaagctcgtcctcctcctcgtggccctcgccggctcctcctgcgccgcgtgggagctcaacatccggatgcccgcggcgcgcctggacggcgaggtcagggacgcggcggcgccgctgatccacgcgctgcgcccgctggtgggctccgccggggacctgggccggcgcggcggcgtcgcgtgcgacagctggcggctggccgtggaggcgtacaacaagcgggactggaagacggtgccggccagctgcgagggctacgtcggccactacatgctcggcgggcactaccgccgggactcccgcgtcgtcgtcgacgaggccgtcgcctacgccgaggggctcgagctcgccggcaacggcagggaggtgtgggtgttcgacatcgacgagacctcgctctccaacctcccctactacgccacccacggcttcggcaccgagccgttcaacgcgacgagcttcaacgcgtacgtgatggagggcagcgcggtggcgctgccggagacttggcggctcttcaggaagctcgtctcgctcggcgtcaagccggtgttcctgacgggccggagcgaggagcagagggccgtcacggccgcgaacctccgctgccagggctacgccggctgggagaagctcctgctcaagcccctcgggttcaagggcaccgccgtcgccttcaagtccggcgagcgccggaagctggaggacgctgggtacgtcatcgtcggcaacatcggcgaccagtggagcgacatcctcggcgcgccggagggggcgcgcaccttcaagctgcccgaccccctctactacatcggctgatcaagctaggatgcggtcgtcgcttcccaaccggtcgatgatcatccaacggctctccgtgaacccaccaatctgtccggccggccggttgttgcgtgctgtgcttgtttgtgacgaagtgctttgatgttttttattattatcacgccgcccttcatcagtgattaactattgcttagctccatgttatcgcttaaaaaaaaaaaaaaaaaaaa

SEQ ID NO: 7272 - protein, 276 aa, Panicum virgatum
  misc_feature: Ceres CLONE 1906201
  misc_feature (1)..(226): Pfam Name: Acid_phosphat_B Pfam Description: HAD superfamily, subfamily IIIB (Acid phosphatase)
MAMAKLVLLLVALAGSSCAAWELNIRMPAARLDGEVRDAAAPLIHALRPLVGSAGDLGRRGGVACDSWRLAVEAYNKRDWKTVPASCEGYVGHYMLGGHYRRDSRVVVDEAVAYAEGLELAGNGREVWVFDIDETSLSNLPYYATHGFGTEPFNATSFNAYVMEGSAVALPETWRLFRKLVSLGVKPVFLTGRSEEQRAVTAANLRCQGYAGWEKLLLKPLGFKGTAVAFKSGERRKLEDAGYVIVGNIGDQWSDILGAPEGARTFKLPDPLYYIG

SEQ ID NO: 7273 - DNA, 1756 bp, Panicum virgatum
  misc_feature: Ceres CLONE 1906224
  misc_feature: Encodes the peptide sequence at SEQ ID NO. 7274
accaccagcagtgcacttaacactccacagtgcactccaaggcggcagcagcagagagagctcatcagctcggtggtcatgcaggcatcgtcgaccacggccgccgtggcggcggccctggcgtcgctgcgcggcctcccgctcccggtgctggtgcccctcgtcgtctcggcgctggccttcgtggccaccgtcctccggctcgccctgcggcggcagcggccggtgtacctgctcaactatagctgccacctcccggacgcagaccggcaggtgaacctcgaggtgtgcgagtacttcggcctcaagtgccgccgctactccgacgacattgccgacttcatgcggctcatctacagcaagtccggcctggggcaggagaccttcgcgccgcccttcatcttctcgggccggttcgagaagacgctggcgttcgcggtgcaggaggccgaggagggcctcttcgccgtggtcgggcagctcctggccaaggccgacgtggcgcccgccgacatcaccgtcctcgtcgtggcgtgctccatgttctccccggcgccgtcgctggcgtccatgatcgcgcgccggttcgggatgcgccccgacgtgaaggcctacagcgtcgccggcatggggtgcagcgccggcaccgtgggcatcgacacggcgtcgcggtcgctgcggtgccagcgctgccccgggtacgcgctggtggtggtgacggagaacaccagcctcaactggtacttcggcgagaacaagcacatgctggtgaccaactgcatcttccgcgtgggcaccgcggcggcgctggtgacggacgtgccggcccggcgcgccgacgccaagtacgagctggtgcgcacgctgcggacgcaccacggcgccgacgacgcggcgttctacgcggcgacgcagatggaggacgagcgggggaacctgggcgtggcgctcaccaaggacctggtgcgcgtggccggggcggcgctccggcggcacatcacggcgctggggcgccgggtgctgcccgcggcggagatgctccggtacgcgtggcgcgtggcgcgcgcccgcgcggcggggaaccgcaaggcggcggcggcggaggtgccggacttccagcgcgcgttcgagcacatgtgcatccactcgggcgggaaggcggtgatcgactcggtggcgcggctgatggggttcgggccgtacgtggtggagccggcgagggcgacgctgcaccggttcgggaacacgtcgagcagcctggtgttctacgagctggcctacttcgaggccaagcgccgggtccgtgccggcgaccgcctctggatgctggccttcgggacgggcttcaaggcctgcagcaacgtgtggcgcgcgctccgcgactgcgggcccgacgccgacaacccctggaacgggtgcgtccaccgctacccgatgccgccgccgccgccgtccaagacgcacaagcacgcctgacgacgacggacctatcctgctgatgatgattagcgccgcccgccgccgcatcggccgtcgtccgttcttgcgttgcgtccggcggggaaataattaagaaagatgcgtaggacagtgagttgtgtttgattgctgcgtgatggtgatggtgatgagatgggctctcaggtccagtgcctttgcgaatatcatgagaaaaaatgtactagctactagctctgtttaatttggaaagtggaatatacccaggagcattccgtcaaaaaaaaaaaaaaaaaaa

SEQ ID NO: 7274 - protein, 465 aa, Panicum virgatum
  misc_feature: Ceres CLONE 1906224
  misc_feature (4)..(289): Pfam Name: FAE1_CUT1_RppA Pfam Description: FAE1/Type III polyketide synthase-like protein
MQASSTTAAVAAALASLRGLPLPVLVPLVVSALAFVATVLRLALRRQRPVYLLNYSCHLPDADRQVNLEVCEYFGLKCRRYSDDIADFMRLIYSKSGLGQETFAPPFIFSGRFEKTLAFAVQEAEEGLFAVVGQLLAKADVAPADITVLVVACSMFSPAPSLASMIARRFGMRPDVKAYSVAGMGCSAGTVGIDTASRSLRCQRCPGYALVVVTENTSLNWYFGENKHMLVTNCIFRVGTAAALVTDVPARRADAKYELVRTLRTHHGADDAAFYAATQMEDERGNLGVALTKDLVRVAGAALRRHITALGRRVLPAAEMLRYAWRVARARAAGNRKAAAAEVPDFQRAFEHMCIHSGGKAVIDSVARLMGFGPYVVEPARATLHRFGNTSSSLVFYELAYFEAKRRVRAGDRLWMLAFGTGFKACSNVWRALRDCGPDADNPWNGCVHRYPMPPPPPSKTHKHA

SEQ ID NO: 7275 - DNA, 1491 bp, Panicum virgatum
  misc_feature: Ceres CLONE 1906231
  misc_feature: Encodes the peptide sequence at SEQ ID NO. 7276
tgtgtctctccacacacttgggaaaaccatccctgtgcccttctctagctcatcatcatgacgatcgccttcgccgtgcgccggcgcgacccggagctcgtcggcccggcgaggaagacgccgcgcgagaccaagcgcctgtccgacatcgaggaccaggttaggctgcgctggcacgtgccgttcgtcctcttctaccgcggccgccgcggcggcggcaacccggccgccgccgtccgccgcgcgctcggcgaggcgctggtgccatactacccgctcgccgggaggctgcgcgaggtggacgggcggaagcttgtcgtcgactgcaccggcgagggcgtgctgttcgtggaggccgacgccgacgtgcggctcgccgagctcgaggccgccgggctcacgccgccgttcccgtgcatggaccagctgctcttcgacgtcgagggctccggcggcgtgctcggctgcccattgctgctcatccaggtgaccaggctgcgatgcggcggcttcgtcttcgcgctgcgtctgaaccacaccatttgcgacgccgtgggcatcgtccagttcatgtccgccgtcggcgagctcgcacgcggcctgccgactccgaccgtcgcgcccgtgtggtcccgcgaggtcctcgacgcccggagcccgccgaggccgtcgttccctcaccacgagtacgacccggtgccgccgacgccgttcccgccgccgggcgacatggtcacgcgcaccttcaccttcggccccggcgacgtcgcggcgatcaagaagggcctgccggtgccgcggggtgagaagaaggccacgaccttcgaggcactcgcggcgctcgtctggcgcgcccgcacagccgcgctggagatcccggccggcgaggacgcgcgcctggtcgtcgcggcgggcgtccggggcgtgcgcgacctggcgctgcccgccggctactacgggaacgcgtgcgtgtacccggcggcggtgtccgccgccggcgcgctgcggggctgcccgctgggcgacgcggtggcactggtgcgggcggcgaaggaggaggcggcgagcgccgagttcgtgcggtccacggccgacctgatggagctgcgcgggcggccgtcgctggcgctggcgaacatgttcatcgtgtcggacaaccgacacgccgggttccgccgcgtcgacctggggtggggcgagccggtgtacagcggccccgcgggggcgctgttcgtgctcagcttcatcgtcgccgtcaggaacggcaacggggaggacgccatcgccgtgcccgtcgtgctgccgcggcaagccatggcccggtttgtgtccgaagtcgacgtgctgttgaagagttagtgccggcgttcagccatgtgtttaatttggtactgtacgtgtttggactgtctgtggtgcaggccctagatggaagccttagcttgaatgtcttatcaagtgcaaatttatgaaaaaaaaaaaaaaaaaaaa

SEQ ID NO: 7276 - protein, 433 aa, Panicum virgatum
  misc_feature: Ceres CLONE 1906231
  misc_feature (1)..(430): Pfam Name: Transferase Pfam Description: Transferase family
  misc_feature (1)..(430): Pfam Name: Transferase Pfam Description: Transferase family
MTIAFAVRRRDPELVGPARKTPRETKRLSDIEDQVRLRWHVPFVLFYRGRRGGGNPAAAVRRALGEALVPYYPLAGRLREVDGRKLVVDCTGEGVLFVEADADVRLAELEAAGLTPPFPCMDQLLFDVEGSGGVLGCPLLLIQVTRLRCGGFVFALRLNHTICDAVGIVQFMSAVGELARGLPTPTVAPVWSREVLDARSPPRPSFPHHEYDPVPPTPFPPPGDMVTRTFTFGPGDVAAIKKGLPVPRGEKKATTFEALAALVWRARTAALEIPAGEDARLVVAAGVRGVRDLALPAGYYGNACVYPAAVSAAGALRGCPLGDAVALVRAAKEEAASAEFVRSTADLMELRGRPSLALANMFIVSDNRHAGFRRVDLGWGEPVYSGPAGALFVLSFIVAVRNGNGEDAIAVPVVLPRQAMARFVSEVDVLLKS

SEQ ID NO: 7277 - DNA, 1981 bp, Panicum virgatum
  misc_feature: Ceres CLONE 1906407
  misc_feature: Encodes the peptide sequence at SEQ ID NO. 7278
aaccctaaacccccgggctcggctcttcacctccggcagaccggcctccgggtaaccgccgcaactacaactacccacatgggccacatcgcccgccttgtccggcgtcctcaccttcgtcgttgtcctctccattcctctgggtcgccacggcgtggagatctactcgtccggagttcggattgacttcttccttttgttgtttgtcgcggatttgtttgtttgggttgcggagtatcaatccaggttccgatttggtgattgaagcttcgtttctccatggcgcttcggttcgagatattaggaagattcaaccgtgcccgtgcagctcgcttaactttgccccactttacttgccaaacaccactttttatgcctgttggaactcaaggtacaataaaaggcttgactactgaccaactggaggatataggttgccagattatacttggaaacacatatcatcttgaacgacgtccaggttctcaacttattgatgacttgggtggccttcacaaatttatgaattggaaaagggcattgctgactgactctggcggtttccaaatggtctcgttgctgcatttggctgatattaccgaggaaggagttacgtttcagtcacctgttgatgggaagcccatgctcctgacacctgaggaatctatccatattcagaacaatattggagctgatataatcatggctcttgatgatgttgtgaagaccacaattactggcccaaggatagaagaagctatgtaccgcacccttcgttggatcgacaggtgtatagctgctcacaagaaacctgatgtccagaacttatttgggattgtgcaaggaggattggatccagttcttagagatatctgtgtgaggggcttggttgagcggaatcttcctggatatgcaattggtggtctagctggtggtgaagacaaggactcattttggcgtgttgttgcccagtgcactgctggattgcctgaaaataaaccacgatatgttatgggtgttggctatccacttgatattgtagtctgcagtgctttgggtgcagacatgtatgactgtgtttatccaacacggactgctcgctttgggactgcccttgttcctaagggtgtccttaagttaaaacaaaatgcaatggcaactgatgaacgaccaattgatcctacctgttcatgcatggtctgcaaaaagtatacgcgtgcatatttacattgccttgtaacaaaagatgctatgggctctcaactgctgtcctatcacaatttatcatttatgatgcggttgagtagagacctccacatgtcaattcttgaaggacgatttccagaattcgtgcgaggattcttgagggcacagtttccaaagggaaacgttccgcagtgggtctgtaactcgatggaggttgctggcatcgacatatccgagtgctgcgcttcggccaagtgtcatgtcccaagcatccaggagcaacctttaaccgttccagatgacgcaaatggagtcgtgcagcagaattaaagccgttccctgcatctaaagattaaacgcggcaggctttttcacgaagaaggtttcctgtcgacatacagtcaagtagggtctcacagtctcaaccggttcagcatagaattttccaatagtatgctgaagctcacgcacaggtgtttggtagcattttttagggcatcgtgcgcacgtgtgtttagaaaaaacagcaggggcatgcaatttgctgtaccatgctcctggaggcggaggcctaggttatacgccgtccagattagtggatggaaagaattacctgtcattgggtccttggcacgcagtcgacgttaaggactcttggtgttgcgttggggtcagatgaaagaagcttgtaaaagcgtcggtcgccttacgctgaaacatttgttgttgtgaggaatgaaattggtagtccttgcaaaaaaaaaaaaaaaaaaaa

SEQ ID NO: 7278 - protein, 418 aa, Panicum virgatum
  misc_feature: Ceres CLONE 1906407
  misc_feature (1)..(237): Pfam Name: TGT Pfam Description: Queuine tRNA-ribosyltransferase
  misc_feature (12)..(386): SWISSPROT Homolog: EC 2.4.2.29 Queuine tRNA-ribosyltransferase
MALRFEILGRFNRARAARLTLPHFTCQTPLFMPVGTQGTIKGLTTDQLEDIGCQIILGNTYHLERRPGSQLIDDLGGLHKFMNWKRALLTDSGGFQMVSLLHLADITEEGVTFQSPVDGKPMLLTPEESIHIQNNIGADIIMALDDVVKTTITGPRIEEAMYRTLRWIDRCIAAHKKPDVQNLFGIVQGGLDPVLRDICVRGLVERNLPGYAIGGLAGGEDKDSFWRVVAQCTAGLPENKPRYVMGVGYPLDIVVCSALGADMYDCVYPTRTARFGTALVPKGVLKLKQNAMATDERPIDPTCSCMVCKKYTRAYLHCLVTKDAMGSQLLSYHNLSFMMRLSRDLHMSILEGRFPEFVRGFLRAQFPKGNVPQWVCNSMEVAGIDISECCASAKCHVPSIQEQPLTVPDDANGVVQQN

SEQ ID NO: 7279 - DNA, 1897 bp, Panicum virgatum
  misc_feature: Ceres CLONE 1906408
  misc_feature: Encodes the peptide sequence at SEQ ID NO. 7280
acgctgttcggcggttgcgctcgatccgcgtctccgtgcggccgtgtgagagagaagggaaggggagcggacagcggaagcaggagggggtcgtcatcgcgtggtgaccgcgccgctctgttcctccgtccccgccccccacctccggctctcgccgtcacatgtcgtgtggcgcgggaggagctctgatccggatggtgcagcgccgcgggatcgcgcacggccatgattgatcgcgaacaagcagatttcaagtcaacacaatttgatttgacaacgcatatgaagtcatgacgtactgatggttaattgaaggtctagtgaagaggaaatgcaagttaataatgaggcgccactagggtgcctcaagccaaatatttctcagtataactctccagagcagagaggtggaattgaaggagttcctgagaataatgaaaaaaggagtgatatggttgttgcggaaaaagtctgggaggcgtctcttgttccaactcaaggccttagcagacccttttaccgacaagaattttatgcttggccatatatttattcagattaccaaatggtgcgtcagccactaccttatggattcgagaaccaattttgtcaagtaaatagggaccacagttttcctattgagaacagagttcagtatcttccattcaagatgctcccccaaggtcacccccatgatgcacaacttcaggaatttcaatattttgtggttattgactttgaagcaacctgtgacaaggtgaacaatccatttccacaagagatcattgagtttccatctgtcttggttaacagtgcaactgggaaactggaagaatgctttcaaacgtacgttcggccaacatatcatcaatttttgactgacttctgcaaggagcttactggtatacaacagattcaggtggacagaggtgtgccactaggtgaagccttactcatgcatgataaatggctagaggacaagggcattaagaacacaaactttgctgttgtcacctggtctaattgggactgccggacaatgctggagtcagaatgcagatttaagagaattaggaagcccccttatttcaacaggtggatcaacctgaaggtacctttccaggaagtgtatggggatgtccgttgcaacttaaaggaggcagttcagttggctggccttacatgggagggtcgtgctcactgtggacttgatgatgctcgcaacactgctcgcctcctggcattaatgatgcaccggggcttcaaattctctatcaccaactcacttgtgtggcaacctgccccacaggcagcaacctgcctgctatcccctgaccgctctccagatcctgtccaaccgcagcttaagccgaatgagatgctgggatctcctgtgcaggttaatccatatgccgcctccgcagggaaggacagagcaatgtactgctactgtggtgtgctgagcaggtggagcgttgtgcgcaagccaggacccatgcaaggacgttacttctatggatgcggcaactggaccgccacgaggcgggcgatctgcccatactttgcatgggcatagtagagacgtaatgtgcttccgtccaagatctcaagggcaaaggacctggtgctttaactaagggaggcgctatgttgcggttgcctgctcctccgctgtgcctcccgatccgtatatattatgatataactttgctcataaggcaatggaagttcactaggtagtgtctaacctgtcatgctgacttctgttgatagaagagaatgggctcagatgctgcttaggtgtgatttatccatgaataatctaagtttgtggacgtttttaacttaatggaactattgtaggtgtggcttgtgcgaaaaaaaaaaaaaaaaaaaa

SEQ ID NO: 7280 - protein, 414 aa, Panicum virgatum
  misc_feature: Ceres CLONE 1906408
  misc_feature (1)..(173): Pfam Name: Exonuc_X-T Pfam Description: Exonuclease
  misc_feature (2)..(44): Pfam Name: zf-GRF Pfam Description: GRF zinc finger
MQVNNEAPLGCLKPNISQYNSPEQRGGIEGVPENNEKRSDMVVAEKVWEASLVPTQGLSRPFYRQEFYAWPYIYSDYQMVRQPLPYGFENQFCQVNRDHSFPIENRVQYLPFKMLPQGHPHDAQLQEFQYFVVIDFEATCDKVNNPFPQEIIEFPSVLVNSATGKLEECFQTYVRPTYHQFLTDFCKELTGIQQIQVDRGVPLGEALLMHDKWLEDKGIKNTNFAVVTWSNWDCRTMLESECRFKRIRKPPYFNRWINLKVPFQEVYGDVRCNLKEAVQLAGLTWEGRAHCGLDDARNTARLLALMMHRGFKFSITNSLVWQPAPQAATCLLSPDRSPDPVQPQLKPNEMLGSPVQVNPYAASAGKDRAMYCYCGVLSRWSVVRKPGPMQGRYFYGCGNWTATRRAICPYFAWA

SEQ ID NO: 7281 - DNA, 1765 bp, Panicum virgatum
  misc_feature: Ceres CLONE 1906441
  misc_feature: Encodes the peptide sequence at SEQ ID NO. 7282
gcgaaggacacactagctagtagtggtagagcaaaggtttcattcgtacatggctctcgccactctcctgctcccctcctcctcctcggcctccacggccagcaaggccgccgccggcgaccactccgacagccggcgtcatgaccacgaccacggcagcaagcgcaagaagaagccgccgccgtcaccgcaaccgtcgctctcgtcggcgccaagaaccccgccaggcgcacgaagccagcgcggcatggccgtggccgcgtcgtccaagaagagtcccaaggtcgccgccgcggccaagaaccgcccgccgcagtaccagcagcaccgagcccagtcgacgaagaagcaggccgcagcggcggcggcgtcctcctcctcgtcctcgtcgtcatgggagcaggtgaagagcctgctcagctgccggagcgcgacggcggcggcgcgcgtgcacgacccggccgcgccctcggcgctggcgcggctccgcggcagcggcgcgggggcctgcggcgcctcgctctgcgccatgcgcgacgtggtcgacgccgcctcctccgccgcgtcgtccgccgccgcctccgcgtccgccgaccgcgacaccgccccgctgaaccgccgccgcgcgcaccgcgctgactggtcgtcgtcgtcctccgctgccggcggcggcggcggcggcagcagccaccactcctccctgcgcggcctctccggctgctacgagtgccgcgccatcaacgtcgagcccatgtcgaggcggtacccgaggccgagggagctgtgcgcctgcccgcagtgcggcgaggtgttcaccaaggccgacagcttggagcaccaccaggccattcgccatgcagtgtcggagcttggacccgaggactccggccgcaacatcgtggagatcatcttcaagtccagctggcagaagcgggaccgccccatctgccacatcgaccgcatcctcaaggtgcacaacgcgccgcgcaccgtggcaaggttcgaggcctaccgcgacgccgtgcgtacccggtgccgcgccgccgccgcgcgggccgccgccgacgggaacgagctgctcaggttccactccgcgccgctcgcgtgcgcgctcgggctcagcggcgccacctccctctgcgccgccgccgactcgtcgagccggagtagcacgaccgacacggcgtcgtcgtcctcggcggcaggtgcaggtccttccgccgccgccgcgtgctgcggcgtgtgcacggccatccggcacgggttcgcgccgtgggtcggcgcgcacccgctcggcgtgcgcaccacggccagcagcggccgcgcgcacgactgcggcgcggcgtcgtcgtcgtcggtgcaggctgacagcggtggctgccgcgccatgctggtgtgccgcgtcatcgccggccgcgtccgccgcgacggcgacgccgcctgcacgtccgccgccggggaggagggccccttcgactcggtggccggcgaggacgcggccagcagcagcgtgtacggcaatctcgaggagctcttcgtggccaaccccagggccatcctgccgtgcttcgtcgtcatctaccgtgtgcttgaatcttaattatattgaatgcttcttaatcacttcatatacattttgtactactaaagaagaatgtcgccaagatcatgtctgttagtttttcttcccttttcttgtaaaaaactacaacttttatatgccacataaatattgtgcctgtaacaaaaaaaaaaaaaaaaaaaa

SEQ ID NO: 7282 - protein, 516 aa, Panicum virgatum
  misc_feature: Ceres CLONE 1906441
  misc_feature (1)..(24): Pfam Name: zf-C2H2 Pfam Description: Zinc finger, C2H2 type
MALATLLLPSSSSASTASKAAAGDHSDSRRHDHDHGSKRKKKPPPSPQPSLSSAPRTPPGARSQRGMAVAASSKKSPKVAAAAKNRPPQYQQHRAQSTKKQAAAAAASSSSSSSSWEQVKSLLSCRSATAAARVHDPAAPSALARLRGSGAGACGASLCAMRDVVDAASSAASSAAASASADRDTAPLNRRRAHRADWSSSSSAAGGGGGGSSHHSSLRGLSGCYECRAINVEPMSRRYPRPRELCACPQCGEVFTKADSLEHHQAIRHAVSELGPEDSGRNIVEIIFKSSWQKRDRPICHIDRILKVHNAPRTVARFEAYRDAVRTRCRAAAARAAADGNELLRFHSAPLACALGLSGATSLCAAADSSSRSSTTDTASSSSAAGAGPSAAAACCGVCTAIRHGFAPWVGAHPLGVRTTASSGRAHDCGAASSSSVQADSGGCRAMLVCRVIAGRVRRDGDAACTSAAGEEGPFDSVAGEDAASSSVYGNLEELFVANPRAILPCFVVIYRVLES

SEQ ID NO: 7283 - DNA, 1905 bp, Panicum virgatum
  misc_feature: Ceres CLONE 1906444
  misc_feature: Encodes the peptide sequence at SEQ ID NO. 7284
ttatcatcagaggagcagcatcattgagtgcctttgatcatcagcacatatgacgctgaagttagtttccagctaagaatggcattgaataattatttgtattattaattgcaaatttaaatatttttattgatgtacacaactttctaaggcttataaatacggctaattctcttcttctgctcatcacacaatatgcatcctttcattaacatatgtatcgttcttctttgcatcatatctagcttcttcaattcccaggcaacagataccagaccccagaccccgaacagccttgtccttggccttagccatgtcaggtctctgtatactccatccatgacactactgaactccacaaactatgacttcttggacatcatagaaccaataactgcatacacagatggctacttgctgtccctgaaccttggcacacccctacaggtcttccaagtgtacctggacacagggagtgacctcacctgggtcccctgtggcacaaccagctaccagtgtatggagtgtggcaatgaccacagctcctccaagccatctccgatgttcttgccgtctcaatcctcttcgaacacgatggacctctgcgggagccacttctgcgtcgacgtccacagctccgacaacaggtttgatccgtgcgcagcagctgggtgcgacatcgctgccttcaccggtggtctgtgcccaagaccttgccctcccttctcctacacctacggtggcggagcactggttctgggctaccttgcaagggactctatcacactccatggaagcatacacggcattgatcctctgtctcccgtggagttcccgggcttcagcttcggctgtgtgggcagctccatcagggagccgatcggcatcgccgggttcggcaagggcacgctgtccctgccctcccagctaggcttcctgggcaagggcttctcccattgcttcctcggcttccggttcgcgaggaaccccaacgtcaccagccccctggtgatgggcgacctcgcgctgccggcggcgacggacggcttcctcttcaccccgatgctgaggagcgtcacctacccaaacttctactacatcggcctggagggtgtcagcctgctaggagatggcggctctgccgcggccgccatggccgccgctcccccgagcttgagcggcgtcgaccccgaaggcaacggcggggtgctcgtcgacaccgggacgacgtacacgcacctcccggacccgttctacgcgtcgctcctgtcgtccctcggcacggccgcgccgtacgagcggtcgcgcgacctggaggcgcgcacggggttcgacctctgcttcagggtcccctgcgcgcgagcgccgtgcacggcggaggaccggctgccggcgatcaccctccacctcggcggcggcgccaggctcacgctgcccaagctgagcagctactacccggtgaccgcggtgagggactccgtggtggtcaagtgcctgctgttccagaggatggacggcggcggcggcggcgggccgggagcggtgctcgggagcttccagatgcagaacgtggaggtcgtgtacgatctggtgaccgggcgggtcgggttcctgccgagggactgcgccctccgcgcctagtggtgttgcccaccagtctgcatggttcgtgctggtgctcgtcaattttttgacatcttttgagtgcacgatagaaaggtgtgtgttgcaggtgtggtacgtgttttgttctgaaaaaaaaatagagccgtacgatacgcgtgcaaaggctgaagggggccgtactgagtcgctagcagaaaagtgcgtcaagttgggatttgggagctggcgtggaatggaaatattgggtgcctttctattcaaaaaaaaaaaaaaaaaaaa

SEQ ID NO: 7284 - protein, 481 aa, Panicum virgatum
  misc_feature: Ceres CLONE 1906444
  misc_feature (1)..(392): Pfam Name: Asp Pfam Description: Eukaryotic aspartyl protease
MHPFINICIVLLCIISSFFNSQATDTRPQTPNSLVLGLSHVRSLYTPSMTLLNSTNYDFLDIIEPITAYTDGYLLSLNLGTPLQVFQVYLDTGSDLTWVPCGTTSYQCMECGNDHSSSKPSPMFLPSQSSSNTMDLCGSHFCVDVHSSDNRFDPCAAAGCDIAAFTGGLCPRPCPPFSYTYGGGALVLGYLARDSITLHGSIHGIDPLSPVEFPGFSFGCVGSSIREPIGIAGFGKGTLSLPSQLGFLGKGFSHCFLGFRFARNPNVTSPLVMGDLALPAATDGFLFTPMLRSVTYPNFYYIGLEGVSLLGDGGSAAAAMAAAPPSLSGVDPEGNGGVLVDTGTTYTHLPDPFYASLLSSLGTAAPYERSRDLEARTGFDLCFRVPCARAPCTAEDRLPAITLHLGGGARLTLPKLSSYYPVTAVRDSVVVKCLLFQRMDGGGGGGPGAVLGSFQMQNVEVVYDLVTGRVGFLPRDCALRA

SEQ ID NO: 7285 - DNA, 1460 bp, Panicum virgatum
  misc_feature: Ceres CLONE 1906632
  misc_feature: Encodes the peptide sequence at SEQ ID NO. 7286
gtgaacaagcacgcggcttgcagcggcaggcccagcggcagagaggggcggaacacgcgtcgacgtcgacgaggctcacccaccggctgcaaggcctcctcttcttccccccatcctatccaccccggcaagtgtccagcgagaggcagagcagctgagcaggtcacctcagcgcgacgcctgtgtgatgcttgagcgggtgattgacaactggtagctggcgagggagtcggcgtcgacggtgatgggcctctggagctggccgtgggggcggcagggcccctcgggcttcggctcggcctccaccgccgaggaggtcaccgccggcgtcgacgccaccaatctcaccgccatcgtcacaggagcaacaaacgggattggaaaggaaacagctagagttctagctctgaggggagcgaatgtgatcataccagcaaggacactagagagtggccagaaggtgaaagagagcctcgcagatcaggtcccgagctccaagctgcatgtcatggagatggacctgagctctctcagctctgtccgcaactttgcgcagtccttcaactcgtcgcataagcacctgaacatcctcataaacaatgcagggattatggcctgcccgtaccagttatccgaggatgggattgagctgcagtttgcaacgaatcatgttggccatttcttgctgacaagtctcctacttgacaagatgaaatcaactgccagagaggctggtgtgcaaggcaggatcataaacgtgtcttctgtcgcgcataaaagaagtgatggtacatgctttgatctgaacaagctaaacgataaggctaggtacaacccattcattgcttattcacattccaaattggccaatattctccatgcaaatgagttgtccaggcgttttcaggaagaaggatgcaatctaacagcaaattccctgcaccctggagtaatcttcaccaatatcgtccgctacattgcaggaaacagtgcgctacttccagttctctccccactggcaaaactagttctgaagggcttaccccagggagctgcgactacttgctacctggcattgcacccagatctgaaaaatgtatctggcaaatactttgcggattgcaatgaaacgacaccaaccacggttgcaagggatacagagctggccaagaagctatggttgttcagtgaagaacttgtagggatcaatgcggcgagcagatccaaatgatatgtccctatccgtatgtgctgtggctgcgagcctgtgagagtaccaatgcttgaaatgtaacttctctaaaaagatgccaaaaatatgaaacaatcgatagtgttagcaatgaatggttgctgatatgacctgaattgctgttactgttagtattttgttcagaagaatgtattcagaagaaaattaatgatagattaattaggcacaaaaaaaaaaaaaaaaaaaa

SEQ ID NO: 7286 - protein, 328 aa, Panicum virgatum
  misc_feature: Ceres CLONE 1906632
  misc_feature (1)..(143): Pfam Name: adh_short Pfam Description: short chain dehydrogenase
MGLWSWPWGRQGPSGFGSASTAEEVTAGVDATNLTAIVTGATNGIGKETARVLALRGANVIIPARTLESGQKVKESLADQVPSSKLHVMEMDLSSLSSVRNFAQSFNSSHKHLNILINNAGIMACPYQLSEDGIELQFATNHVGHFLLTSLLLDKMKSTAREAGVQGRIINVSSVAHKRSDGTCFDLNKLNDKARYNPFIAYSHSKLANILHANELSRRFQEEGCNLTANSLHPGVIFTNIVRYIAGNSALLPVLSPLAKLVLKGLPQGAATTCYLALHPDLKNVSGKYFADCNETTPTTVARDTELAKKLWLFSEELVGINAASRSK

SEQ ID NO: 7287 - DNA, 1877 bp, Panicum virgatum
  misc_feature: Ceres CLONE 1906646
  misc_feature: Encodes the peptide sequence at SEQ ID NO. 7288
atctgcaatccccaaaacccacgcacgccggcgtcggccggagaacctccccgccggccgccgccatgccgccgcctctccaggcccaccgcctccttatctcccaccgccgcctacccactcccgctcgccgccggttcactgccgtctcttccctccaatccgctcccgccacgaccttggccccgggccccgccacatcctccatcctctccatccgcgagtcgctgctctcaggtgagaggaccgcggcggacatcacatccgagtacctctcccgcctccgccgcaccgagccgagcgtgcgtagcttcatccacgtcgcggacgccgccgcagagcgggaggcggaggagctcgaccggaggattgcctccggggagaaggatgcggtggggccgctcgctggagtgctggtgggaatcaaggacaacctctgcaccgccaacatgccctccactggcgggtcgcggatactggacggataccggccggcatacgacgccacggcggtgcggcggctgcgggatgctggcgccattgtggttgggaagacgaacctcgacgagttcggcatggggagcaccaccgagggctccgcgtttcaggtgacaacaaacccgtgggatgattcacgtgttcccgggggatcctctggtggttctgcttctgcggtttctgctaggcaatgtgtagtgtcactaggaagtgatacaggtggaagtgtgagacagccggcatcattctgtggcgtagtggggttgaaaccaacttatggtcgtgtatctcgttttggcctcatggcctatgcttcatcgttggatgttgtgggatgcttaggttcatctgtttttgacactgcaaccatcttatctgttgttgctggccatgacaagatggattcaactagcagttcgcaggatgttccagactatgtatcagagttggtctctctagatttacttgaatcaaaaccactcaatggtttgagaattgggattatacaagaaactcttggagaaggcgtggatactggagtcatatcgtcaatcaaggatgctgcttcacacctggaacacttgggatctgtggtggaagaggtttcactgccttcattttctcttggcttaccagcatattacatactagcatcatctgaagcatcttctaatctatcacgctatgatggtatcaggtatggaaggcaggtttcagctgatgacctgaatgagatttatggagagtcccgtgctgatggtctgggtcatgaggtcaaaatgagaattttgatgggaacctatgccctttctgctgggtactatgatgcatattacaaacgagcacaacaggtgaggacactggttaaggaaagcttcaaaggtgctttggaaagatatgacattcttatttcaccagctgctccatcagcagcctacaaaataggtgaaaagataaatgatccattagcaatgtacgctggagatatcatgacggtgaatgttaatttggccgggcttcctgcattggttgtgccttgtggatttgttgaaggtggagctgcagggctccccgttggactacagataatcggatctccattcagtgagggaaatttgctgagagtagggcacatctttgagcaaacactgcagaatttcagttttgtccctccgttgttggccgaacgctagctgcaatataggattctctgccctactctgagttatcaaacaagcaattaccagagtcacgggttttgaaggcccatttgtccattcttacaagttcgagacatgtcatgtattatactgaggaaattggctgcacgcatgtagaatttagatattttcctcgtggaaaaaaaaaaaaaaaaaaaa

SEQ ID NO: 7288 - protein, 541 aa, Panicum virgatum
  misc_feature: Ceres CLONE 1906646
  misc_feature (1)..(447): Pfam Name: Amidase Pfam Description: Amidase
  misc_feature (1)..(431): Pfam Name: Amidase Pfam Description: Amidase
  misc_feature (1)..(442): Pfam Name: Amidase Pfam Description: Amidase
  misc_feature (1)..(452): Pfam Name: Amidase Pfam Description: Amidase
  misc_feature (1)..(455): Pfam Name: Amidase Pfam Description: Amidase
  misc_feature (1)..(452): Pfam Name: Amidase Pfam Description: Amidase
  misc_feature (1)..(447): Pfam Name: Amidase Pfam Description: Amidase
MPPPLQAHRLLISHRRLPTPARRRFTAVSSLQSAPATTLAPGPATSSILSIRESLLSGERTAADITSEYLSRLRRTEPSVRSFIHVADAAAEREAEELDRRIASGEKDAVGPLAGVLVGIKDNLCTANMPSTGGSRILDGYRPAYDATAVRRLRDAGAIVVGKTNLDEFGMGSTTEGSAFQVTTNPWDDSRVPGGSSGGSASAVSARQCVVSLGSDTGGSVRQPASFCGVVGLKPTYGRVSRFGLMAYASSLDVVGCLGSSVFDTATILSVVAGHDKMDSTSSSQDVPDYVSELVSLDLLESKPLNGLRIGIIQETLGEGVDTGVISSIKDAASHLEHLGSVVEEVSLPSFSLGLPAYYILASSEASSNLSRYDGIRYGRQVSADDLNEIYGESRADGLGHEVKMRILMGTYALSAGYYDAYYKRAQQVRTLVKESFKGALERYDILISPAAPSAAYKIGEKINDPLAMYAGDIMTVNVNLAGLPALVVPCGFVEGGAAGLPVGLQIIGSPFSEGNLLRVGHIFEQTLQNFSFVPPLLAER

SEQ ID NO: 7289 - DNA, 1497 bp, Panicum virgatum
  misc_feature: Ceres CLONE 1906696
  misc_feature: Encodes the peptide sequence at SEQ ID NO. 7290
gccgatcagcttatccccttccgccgcacacgacgaactgcgactgcgagacgaggagggggaaggcagaggcagtggcgaagcgagacaattggggaggacatggagccgatgccctcctcccgctccgtgctctcctcctgcgatcgtgagccttcctcctcctcgctggcgagattgcttgtctagatgcgcacggtcttgctcgttcctccgttttcatgcaccactccgattctgaaaatggaaatctggcttgcggttattgcaaggatagttgttcttgctccgtccgggagagtatccgcgagtgcgaagcggaaggagaagggagtagtatggtaaactgcaaaccctcgttcagccattggaaatgctttgctaatgccatgtacccatgtgtgtcgctgttgcgcagtttgtcttggttgataacatgctttgcttggtaaacggaaagtgtttgttcttggcacacatgacacatcttcgtaataattaactgttctgtccttgacacatcgagacttcgagagacctccactgcacaccctctttttttatgaagaattgcagtgctgttacagtgcacaatggtgtgctgaatggacattattgctggggaaaaactctcagtatttgggttggtgagaaggacgtggaagaggggaggatccggaggagagcagcattttccttgctgctggcttcgccggtgttgtcagtggcgttctcggcctatgcgaagagtaaaagcatgaacccttacgacgaaaggcggctgcttcagcagaataagaagattcaggaagccaaccgtgcccccgaagacttcccaaacttcatcagagaaggttttgaagtcaaagtagtgacatcggacaactgcataacacgggactctggactaatgtatgaggacataaaagttggtacaggcaactctccaaaggatggtcagcagattatatttcattatgtgggctacaacgaagcgggtcgaaggatagatagcacctatattcaaggttcccctgcaaaaattcggttagggaatggaacactggttccaggttttgaagaaggcatacgggacatgaaaccaggcggtaagagaaggattataatacctccagagcttggtcctcctgtcgggccatcgacattcttcagcgcaaagcagtttgaggtgttcgacgtggagctcctggcggtgcaggactgccaacggaggaccatagccttttattcagatgttgtgtgcagctgagcatctgatatctcatcaagcctccacttagcagcacattttacgtcatcttcctgcatctttggctgctaacaggatttttgctggtggtcggggttgttgtgtaattgtatagccatctgttgtttctgctacagtaaaggttactgatccataacagtggtagactggtagagtattagctcttcatttttgtcctaaatgtttggcttatctgctctcatctt

SEQ ID NO: 7290 - protein, 235 aa, Panicum virgatum
  misc_feature: Ceres CLONE 1906696
  misc_feature (1)..(71): Pfam Name: FKBP_C Pfam Description: FKBP-type peptidyl-prolyl cis-trans isomerase
MKNCSAVTVHNGVLNGHYCWGKTLSIWVGEKDVEEGRIRRRAAFSLLLASPVLSVAFSAYAKSKSMNPYDERRLLQQNKKIQEANRAPEDFPNFIREGFEVKVVTSDNCITRDSGLMYEDIKVGTGNSPKDGQQIIFHYVGYNEAGRRIDSTYIQGSPAKIRLGNGTLVPGFEEGIRDMKPGGKRRIIIPPELGPPVGPSTFFSAKQFEVFDVELLAVQDCQRRTIAFYSDVVCS

SEQ ID NO: 7291 - DNA, 1966 bp, Panicum virgatum
  misc_feature: Ceres CLONE 1906904
  misc_feature: Encodes the peptide sequence at SEQ ID NO. 7292
ctcacccgtccttcccttccctgctcacccgcgatgcgggggagatgctttacttcctcacacctgtaacgccgcaccaggccgcggcacgccgcgctgcacgtttcggctcgcgctacgctacgctacagaatctccattggccattgccagccagctgcgccgcgcttggccctgctctgctctgcgtataagttccttcctcccttggacgcttctgcgctcgccgctcttctcctcccttcgccgtctcctccccctccctcccagatccattcttccccgtgctcacgcctcccctgcggcgaggcgagacagagccgggagaggctgagccggggagggcaaagaaccatggcttctcgtgttgttgccgtgattcttgttgccgtccttgtgggagcaagcgccgcccatggctcggagccgtggtggaacgagacgcaggtgtacggcaccaacgccaactccggccgcagcaccggcgtcttcgttggcctgacactcatccagtcggcggccgccaagggagccgtgtgcttggatggaagcttaccgggttaccacctgcaccgaggatttggatcaggagcaaacagttggcttgtcaacctggagggtggaggctggtgcaatgatgttagcagctgtgtgttccgcaaaagcagtcgtcgtgggtcatcaaatcatatggagaggcaactccagtttactgggataatgagtaacagacctgaagagaatcctgatttctacaactggaacagagtgaaggtccggtactgtgatggcggatccttcactggtgacagttctaatgcggctgcaggcctttatttccgaggtcagcgcatttggcaggctgctatggatgacctgatggcccaaggaatgcgttatgctaatcaggctcttcttgctggatgctctgctggtggtgtttctaccatacttcactgtgatgaatttcgtggattgtttccatcaaataccaaagtcaaatgccttgctgatgctggaatgtttcttgacactgttgatgtttccggtcgtcgggaaatgagatccttcttcaatggcattgtgagattgcagggttctggaagaagtttgcctaggtcttgcacctcccgcatggacaaaacctcgtgctttttcccgcagaacgtggtgccaaacattcagaccccaactttcattttgaacactgcctatgatgtgtggcagcttcaacaaagtgtggcccccaaaaccgctgatccccaaggtctatggtcaaaatgtaggacgaaccatgcctattgtaatagcaaccaacttcagtttttacaaggtttcaggaaccaaatgcttgattccgtgaggggtttctctgcgtcaaggcaaaatggtgtgttcatcaactcatgttttgctcactgtcagagcgagaggcaggatacatggtacacaaacaactcaccacgtctcggtaacaagagaattgctgaagctgtcggggactggttcttcgggaggggagacgcaaagtacaccgactgcgcgtacccttgcgataacacttgtcatcatcttgtgttcaggggagaccattaacactaattattctttgccggcctcgattcggatggcgagaggagcatacccccaacgggtatagaatcaaaagatgaaaaaaaagggtacagatatagagagggtgcaggcgtcctggcttgccctttgttcgtcacttggtcacaaagatatgattgatagggcaggggcctcgcccgcaaatgcgaggaggtccctgcgttagcttcacataccatgatatcgattcttttttcattgaacacaccattcatcatgtgcctgaacatttagaccctaccattgtactgagtgacgctatatattcatgtacgaaacgtgattacagtatgaaggaaaggaagattgtgcgaggagtttaattacctcc

SEQ ID NO: 7292 - protein, 413 aa, Panicum virgatum
  misc_feature: Ceres CLONE 1906904
  misc_feature: Great-hit functional homolog of the protein sequence encoded by LOCUS At3g05910
  misc_feature: Great-hit functional homolog of the protein sequence encoded by LOCUS At5g26670
  misc_feature (2)..(368): Pfam Name: PAE Pfam Description: Pectinacetylesterase
  misc_feature (12)..(364): Pfam Name: PAE Pfam Description: Pectinacetylesterase
  misc_feature (3)..(361): Pfam Name: PAE Pfam Description: Pectinacetylesterase
  misc_feature (18)..(359): Pfam Name: PAE Pfam Description: Pectinacetylesterase
  misc_feature (14)..(357): Pfam Name: PAE Pfam Description: Pectinacetylesterase
  misc_feature (1)..(364): Pfam Name: PAE Pfam Description: Pectinacetylesterase
  misc_feature (3)..(362): Pfam Name: PAE Pfam Description: Pectinacetylesterase
  misc_feature (2)..(368): Pfam Name: PAE Pfam Description: Pectinacetylesterase
  misc_feature: Useful for making plants with altered cell wall content and/or composition
MASRVVAVILVAVLVGASAAHGSEPWWNETQVYGTNANSGRSTGVFVGLTLIQSAAAKGAVCLDGSLPGYHLHRGFGSGANSWLVNLEGGGWCNDVSSCVFRKSSRRGSSNHMERQLQFTGIMSNRPEENPDFYNWNRVKVRYCDGGSFTGDSSNAAAGLYFRGQRIWQAAMDDLMAQGMRYANQALLAGCSAGGVSTILHCDEFRGLFPSNTKVKCLADAGMFLDTVDVSGRREMRSFFNGIVRLQGSGRSLPRSCTSRMDKTSCFFPQNVVPNIQTPTFILNTAYDVWQLQQSVAPKTADPQGLWSKCRTNHAYCNSNQLQFLQGFRNQMLDSVRGFSASRQNGVFINSCFAHCQSERQDTWYTNNSPRLGNKRIAEAVGDWFFGRGDAKYTDCAYPCDNTCHHLVFRGDH

SEQ ID NO: 7293 - DNA, 1926 bp, Panicum virgatum
  misc_feature: Ceres CLONE 1906921
  misc_feature: Encodes the peptide sequence at SEQ ID NO. 7294
agccttatccatgcaggcccagcgagagcaccaccgctcgctcgccgctcccggacgccggcgcccgcgacgcgctcgatggaatgccgcgcctgagctctccctctccctgacccgcactcccagccgccccgcgcgccgcggctgatgccgctcgccggcactgccctcgcgcctctcctcgtctcccccctcgcgccgtcgcctagccgtggctgcgtcgccgctgttgcagccgcgagaaggccgaccgctctccggcgagctcggtgctcggccgcggccgcttccggtgaagccggggaggccggtgagctgccacgggcgacgctgctatggagggcggcgaagctgcccatatactctgttgcgctcgtgccactcacggtagggagcgcctgtgcttatcatcacgcaggcttattctttgccaaacgttactttattatcttggcagcggcagtccttgtgatcacttggctcaatctgagcaatgatgtctttgattcggatactggggctgacaagaacaagaaagaatctgttgttaacattattggcagtcgagcagtgacacagaatgctgcaaatgtttctcttttcctcggctttgctgggctattttgggcctttgcagaagccggtgatactagattcatcttcctggtgatgtgtgcgatcttctgtggttatgtttatcagtgtcctccatttcgattaagctaccaaggactaggtgagcctttgtgttttgctgcttttggtccattggcaaccacagctttctacttctcaagcagcaacgtaaatatttcaagtggaacggcactgctccctctcaccaaaacagttatagcttcatcagtacttgttgggttgacaactactttgatactcttctgcagccattttcatcagattgatggagatcttgccgttgggaagatgtctcccctggtcagagttggcactgaagcaggatcacgaatagtgatggttgctattgccatgctttacattctcttggctgcatttggcgtatgcaaagctcttccatcagcttgcaccgtcctttgtgcccttactctgccagtgggcaaattggttgtggattatgtgctgaaaaatcacgaggacaatgctaagattttcatggcgaagtactactgcgtgcggctgcacgctctgtttgggatggcgctggcttctggtttggtcttggcccggaatggtatactagcctgacagatgagcaaccctgaaatccaggagaagatccagagcagagagcaccacaccctgcagtttcagatactgaatgcacagccttccattgcgttctgaacttctgattcaacaacagaacagactggagaatgggtgcagtactgaactggcgcagatttgcgaagaaatggaaaggaaatgccagggaggtactctatgtccactgggccgtattgaacggcaagtagctgttgctggttgagtgaacgatgagcttcggacgttcggttgcttgcttcagcatccggtttttgcccaagttgctcgtcttctacgctttgaccggctcggcttgctcatgcacggtcaggttgccgttgcacatatagccgtataggaggatcccaatatgaattgaattcctagccagaacgggtcatgttcaagcattacttctctgtacaaacgcaccaactggccatgcagatttgtggggaatttacacgcccttgtgtttcacatttggccttctctggttggtggttaggcagctaccgtgcagggtttgtaattgcaatgtctagtttcatctctttgtccagacaagtaaacagtgctaaatacaatcaacatgtaaaacaaatgcaaatgtgcaatcgtcttaagagaagacaatgctactactactattactactac

SEQ ID NO: 7294 - protein, 365 aa, Panicum virgatum
  misc_feature: Ceres CLONE 1906921
  misc_feature (1)..(258): Pfam Name: UbiA Pfam Description: UbiA prenyltransferase family
MPLAGTALAPLLVSPLAPSPSRGCVAAVAAARRPTALRRARCSAAAASGEAGEAGELPRATLLWRAAKLPIYSVALVPLTVGSACAYHHAGLFFAKRYFIILAAAVLVITWLNLSNDVFDSDTGADKNKKESVVNIIGSRAVTQNAANVSLFLGFAGLFWAFAEAGDTRFIFLVMCAIFCGYVYQCPPFRLSYQGLGEPLCFAAFGPLATTAFYFSSSNVNISSGTALLPLTKTVIASSVLVGLTTTLILFCSHFHQIDGDLAVGKMSPLVRVGTEAGSRIVMVAIAMLYILLAAFGVCKALPSACTVLCALTLPVGKLVVDYVLKNHEDNAKIFMAKYYCVRLHALFGMALASGLVLARNGILA

SEQ ID NO: 7295 - DNA, 1797 bp, Panicum virgatum
  misc_feature: Ceres CLONE 1906930
  misc_feature: Encodes the peptide sequence at SEQ ID NO. 7296
aggctgttcgacgcttcgccccgcccgcgcgcagccacgccatggccgcctccgtctccgctgccgccaaggcctccgccgccttcgcccacaagaaggagctcgccgctgcggcgccggcgcagcaccgcgcgggctcgggccgccggagcaagccatgccgcgtgtgcgccgtcgcctcgcccgcgcgcgcgccccgcgccccggcgtccaccggctcggtgaagaccgcgatgacgatgacggagaagatcctggcgcgggcgtcggagcgcgcgggcctggagcccggggagaacgtctgggtggacgtcgacgtgctcaggacgcacgacgtctgcggccctggcaccatcggcatcttcaagaaggagttcggggaggatgccaaggtctgggaccgcgagaaggtcatcatcatcccggaccactacatcttcaccagcgacgagcgggccaaccgcaatgttgatatcctcagggacttttgtatggagcagaacatcaagtacttctatgacatcaaggacctcagcaatttcaaggctaatccagactacaaaggcgtctgccatgttgcacttgctcaagaaggccactgccgaccgggcgaggttctccttggtactgattctcatacatgcaatgctggagccttcggtcaatttgcaacgggaattggaaacactgatgcaggttttgtattgggcactggaaaggctcttctcaaggtgccaccaactataaggtttgtactagatggagaaatgccaccttatttactcgcaaaggatctgattttgcaaattattggtgagatttctgtatctggtgcaacctacaagtccatggagtttgttggatcaactgtggaaagtctaaatatggaagagcgaatgacattgtgcaacatggttattgaagctggtggaaagaatggtgttgtgcctgctgatgaaactacatttaagtaccttgagggcaagacatccgttgattatgaacctgtctacagtgatgctcaggccagattttttagtgactatcggtttgatgtatccaaactggagccagtagttgccaagccacattcacctgacaaccgtgctctagcaagagaatgcaaagatgtcaagattgaccgagtttatattggttcttgcactggtggtatgacggaggacttccttgctgctgcaaaggtgttcttagcttcgggcaagaaggttaaagtccccacattccttgtccctgcgacacaaaaggtgtggatggacttatatagcctccctgtaccaggatctggtgggaaaacttgctcccagatacttgaggaggctggatgcgacacaccagctagccctagttgtggtgcttgtttaggtggccctcgcgatacatatgcacgcatgaatgaaccgatggtctgtgtgtccacgacgaacaggaacttcccgggcaggatgggacacaaggaggggcagatctatctggcatccccgtacacggcggctgcctcggccctgacgggctacgtcacagaccccagggacttcctcatgtaacgaccttgaaaccacagagttcatgatgtaatagaatgcctgtgttactgtttttttttcgtgttgaaccttagtttagacgtgtttctggatgagaaataagcagtttttccttgataacgactgcaaatcgtgaggttgggatacatggttttgcattattacagagtgtactatcaagaacaaacatgattgttcacaaggaaaatgcattcatctacatacctgcagc

SEQ ID NO: 7296 - protein, 507 aa, Panicum virgatum
  misc_feature: Ceres CLONE 1906930
  misc_feature (1)..(432): Pfam Name: Aconitase Pfam Description: Aconitase family (aconitate hydratase)
  misc_feature (1)..(432): Pfam Name: Aconitase Pfam Description: Aconitase family (aconitate hydratase)
  misc_feature (1)..(432): Pfam Name: Aconitase Pfam Description: Aconitase family (aconitate hydratase)
  misc_feature (1)..(427): Pfam Name: Aconitase Pfam Description: Aconitase family (aconitate hydratase)
  misc_feature (1)..(395): Pfam Name: Aconitase Pfam Description: Aconitase family (aconitate hydratase)
MAASVSAAAKASAAFAHKKELAAAAPAQHRAGSGRRSKPCRVCAVASPARAPRAPASTGSVKTAMTMTEKILARASERAGLEPGENVWVDVDVLRTHDVCGPGTIGIFKKEFGEDAKVWDREKVIIIPDHYIFTSDERANRNVDILRDFCMEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLNMEERMTLCNMVIEAGGKNGVVPADETTFKYLEGKTSVDYEPVYSDAQARFFSDYRFDVSKLEPVVAKPHSPDNRALARECKDVKIDRVYIGSCTGGMTEDFLAAAKVFLASGKKVKVPTFLVPATQKVWMDLYSLPVPGSGGKTCSQILEEAGCDTPASPSCGACLGGPRDTYARMNEPMVCVSTTNRNFPGRMGHKEGQIYLASPYTAAASALTGYVTDPRDFLM

SEQ ID NO: 7297 - DNA, 2165 bp, Panicum virgatum
  misc_feature: Ceres CLONE 1907079
  misc_feature: Encodes the peptide sequence at SEQ ID NO. 7298
aattccgcttcccacacaccctgcctcttcgggtcgtggcggagttcctggctgcggcctccccgctcctcctcctcctctaccgcctggtggccgcgcgccgctcctcctcctcctcctcctcgtctaccgcctggtggccgcgcgccgctcctccctcggtttgggtggcgcgggctcgacggctttcttcgtccctggtgagtaatccgagacggatacccttgtcgcgagagccggtctagtgcccggcctgatccacgcatttcttcctccccctctttgtccgtcgcggggttcgtgtgccaggcggtaccccaaaggcctagagatccaacccgtgcctctatctgcggttgggttgggttctcttggtggcgttcatcagcgtcgatcctccgatctcagtggtgcagcgccgtagaacaccttggtgcccaattgagctgacaggcgtagtttctttctcaaaaagaaatgatgtttatgttccagttcggtgtttccagtttgttaatgtatttgggacacatcgagcgcatgtattctagaaccaaaatagaggatgcccattcacgtttcgataaatttgccttgcctctcccccgttttcccttgcctcctattgaagaaaaattagttcgaggcgacgctggagatttgtttggaaagtgggttggagaaaagctattgtctccggcgaaggtatataatttgatccattggaattcacatcctaatcttacaggtttagagttgagacaagttaagagtttacttgattgacgcattagaaacagttgcaagaacaatctagtcttgagcttatgtgtatatgtttcttggaacaatctgttggttctaaagcgaattattatatatgcttatctgtaaagcattatttttttgaaatcttgggtattcaattaaatcttttcagtcttttatctttttatagttgtgatcatagttacttattgactttgttatattggatctttgtggaagcttgtgtacttggtctagtaggatcacgtaacttgcgtttgaattttaatatgcttatatgccctgttgaactttgtgctcagatcttgaacatcttgtcattttttgcagtgccaacgaggttcagattcaactttgaattttcacgaggcagtgcattaactggggaaaatgtcaggtggcaggcaatcatactggtgttaccaatgccgacagcgggtaaggcctcgtggccgggagatggtttgtccttactgcgattctggttttgtggctgaaatggatgatgtagatgcactcatgagccacttcgttgggatggatcctaatttccatcgtgacccaaggtttgggatcatggaggccatctctgccgtgatgcggcatggtatggctgggatgaacagggaggttgatgtcagaggaagaccaaacatcttttcggacttagagatggagtttggctcagggccatggttgctcttccgtggtcagctccctggtcatctcactgaggataatggttttgatgtgttcatcaatggacggcgcggtgttggcatgaggagggcaaacattgcagactacttcgttgggcctggattagatgatctcattgagcaattgactcagaatgatcgtcgtggaccgccccctgccgctcagtcctcgattgatgctatgcccactgttaagatcactcagaggcatctaagtggagactcacactgccctgtctgtaaagagaagttcgagttgggatcagaagcaagagagatgccatgcgagcatttgtatcactcggattgcatagttccttggctagagcagcataattcctgccctgtttgccgttatgagcttccaacacagggttctactactggtgctagctgctcacgcacaagatcaacaaaccaaagccagagctcaagtagttcaagcagcagcggaagaaccaatgggcgtcaaaggagaaggaacccgttctcgttcctatggcctttccgctcatcaagttctcgctagattagcgtggtaatctcgccccaagttcactatactgctttagtcaatacactggcctaatgtgctttaatatgtgggatcttagtactcaatcagtactgtatggctaatggcttgttatgattgcc

SEQ ID NO: 7298 - protein, 285 aa, Panicum virgatum
  misc_feature: Ceres CLONE 1907079
  misc_feature (1)..(41): Pfam Name: zf-C3HC4 Pfam Description: Zinc finger, C3HC4 type (RING finger)
MSGGRQSYWCYQCRQRVRPRGREMVCPYCDSGFVAEMDDVDALMSHFVGMDPNFHRDPRFGIMEAISAVMRHGMAGMNREVDVRGRPNIFSDLEMEFGSGPWLLFRGQLPGHLTEDNGFDVFINGRRGVGMRRANIADYFVGPGLDDLIEQLTQNDRRGPPPAAQSSIDAMPTVKITQRHLSGDSHCPVCKEKFELGSEAREMPCEHLYHSDCIVPWLEQHNSCPVCRYELPTQGSTTGASCSRTRSTNQSQSSSSSSSSGRTNGRQRRRNPFSFLWPFRSSSSR

SEQ ID NO: 7299 - DNA, 1594 bp, Panicum virgatum
  misc_feature: Ceres CLONE 1907081
  misc_feature: Encodes the peptide sequence at SEQ ID NO. 7300
gcccgtaaccgcttcgatccaatcgatacatactcctactagcaacgagaagagaggaggagagcagagcagcctgtagaggaggaggagaggcagaggcaatggcggccgcggggccttccgccgcgctggtcctgctcttgtgctccgtcgccgcggtggccttggccgacgccgccggcacgccggatggctccgaggagtggggctacgtccaagtccgacccaaggcgcacatgttctggtggctctaccacagcccgcagcgcgtggacacgacgccatggccgaccgtgctctggctgcagggaggccctggcgcgtccggcgtcgggtacggcaacttcatggagatcgggccgctggacgacgagctcaagccccgcgccaccacctggctcgcaaaggccgacctcctcttcgtcgacaaccccgtcggcaccggcttcagctacgtcgacggcggcgacaggagcctcatggcgcgcacggacgccgaggcggcgcgcgacctcaccgcgctgctctgcgcgctctaccgcgacaagccccgcctccgggccagcccgctctacatcgtcgccgagtcctacggcggcaagttcgccgtcaccacggcgctggccgcgctcagggccatcgaccagggccgcctccgcgccaacctcgccggggtcgccctcggagacagctggatatcgcccctcgacttcgtgttgtcgtgggggcccttgctgtaccaagtgtccagggtcgacgagatgggcctgcagcaatgcaacagtgtgtcagccaagatcaaggaccaggtggagaagaagcagttcacggacgccgaggcgtcgtggtcggagctggagaacgtcgtcctcgccaactccaacgccgtcgacttttacaacttgctcaaggacgacgcggtcccgacggcggcgcagcggcagaggtcgaccctgtcgtccttcaggaggaagaatggctactcggggtacctcgagtccatggccgcggcggcggcctcagcgcgggagggcggcttcgacgggttcataaacacggtcatcaagaagaagctcggcatcatccccaaggatctctcgtggggagagcagtctggcgatgtcttcgacgctatggctggggacttcatgaagcccaggatccaggaggtggaccagctgctcgagctcggcgtcaatattaccatctacaacggccagctcgatctcatctgcgccaccaaaggcaccatggactgggttcagaagctcaagtggggcggcctcaacaacttcatcaactcacccaggacgcccatctactgcagcaaggaaggccagtccggcacccaagccttcgtcaagtcgtacaagcatcccaaattctactggatactcggagctggacacatggttcccatcgacaacccatgccctgcactcaagatgctggctgacattacgcgatctcctgccaaggagtaggagtacagagctggcctgacaccaattcttcaagattcttttcctgtttaattagttttgtagtagtactccatttagttttcttaatttacacaaatacagtcatgcag

SEQ ID NO: 7300 - protein, 460 aa, Panicum virgatum
  misc_feature: Ceres CLONE 1907081
  misc_feature (2)..(428): Pfam Name: Peptidase_S10 Pfam Description: Serine carboxypeptidase
MAAAGPSAALVLLLCSVAAVALADAAGTPDGSEEWGYVQVRPKAHMFWWLYHSPQRVDTTPWPTVLWLQGGPGASGVGYGNFMEIGPLDDELKPRATTWLAKADLLFVDNPVGTGFSYVDGGDRSLMARTDAEAARDLTALLCALYRDKPRLRASPLYIVAESYGGKFAVTTALAALRAIDQGRLRANLAGVALGDSWISPLDFVLSWGPLLYQVSRVDEMGLQQCNSVSAKIKDQVEKKQFTDAEASWSELENVVLANSNAVDFYNLLKDDAVPTAAQRQRSTLSSFRRKNGYSGYLESMAAAAASAREGGFDGFINTVIKKKLGIIPKDLSWGEQSGDVFDAMAGDFMKPRIQEVDQLLELGVNITIYNGQLDLICATKGTMDWVQKLKWGGLNNFINSPRTPIYCSKEGQSGTQAFVKSYKHPKFYWILGAGHMVPIDNPCPALKMLADITRSPAKE

SEQ ID NO: 7301 - DNA, 1809 bp, Panicum virgatum
  misc_feature: Ceres CLONE 1907196
  misc_feature: Encodes the peptide sequence at SEQ ID NO. 7302
agggtttttccccacttcgctttgcttccccacctgctctctctctctctcgtccccatcaccgtcgccatcacctctctctctctctctctcccctcggctccaatggcggacgccgacgctaacacccagccccccgacgccgcggcgtccccgatcgcctcgatctccccctcctccgtcggcgccgcggacgccgacgccgacgcgatcgagaagcagctcgccgggctgggcatcgccgtcgctggcgggggcgggttcccggggccctcgggatgggacgacgtccccgtccctgtccccgtcgccgtcggcggcggcgatgaagtcgccgccgagaaggtgcgggggccaccgccggcgccggcgggggcggcggatggcaaggtgcgcttcccacgccggcccggggagccggactgcagcttctacgtcaagttcggcagctgccgcttcgggatcaagtgcaaattcaaccacccgtcgcggaagaagaaaagcaacagggcgcgagggagtgggagcagcgtgagcgggagcaacagcagcagcaataaaacatcttcgcctgatgatgatcaggctcctagagaagaatacgaaggccttgttccagatatttcagattctgtgagctttcatgataaggggagttcatctaactcaggaaatcataggaagacgtcatatgaggttattgatatgaagaaggggagaatggagtcaaaggaaaagattgcagaagagcttgaaaagggggtgtatttcaagaagttagatgagacaaatatcacaaaccagaagattttgaagggtgtcaaggataaaagaaaggaaaccttttcggaagggagtcctcaggaggaatgcaagtactattcaacaccaggtggatgcaaatttggtacagcttgcaagtacctccaccgtgagggaaaagaagggaaagcagaggttgaaaaggtcgaactgaattttcttggtcttccactgcgaccaggtgaaaaggagtgcccgttctatatgcgcactgggagctgcaaatttgccactaactgcaaatttcaccacccagatcctagtaatgtcgcttcaaaagaaccagttttggaacatgagaatggggataatccacagcaaaatgtccaaggaccctctcagccaagtgttccgatatggcctgaacagagagcattgaatgagcaacatgttccttttctagctccagcgccatcgtacagtgcaggaatgattccacctcaaggaatgtatccctctcctgactggactgggtatcaccaggttcctgtgaatccatattatcctcctggggtcccttttccgcattttccagctcctcatatgaatcacccgatgtataaggctgctgatataccaggacatcagcaactaccttctgatgaatatccagagagacctggccaaccagaatgccagcattttgttaagagtggtttctgcaaatacaggatgaaatgcagatttcaccatccaagatcgtgccagcctgcaccgctaacaggtcttagccctatcggcctgcctatcaaacctgtaagttcctatcctatccaatcttcttattttccccattaggactagagcattaattattgcaccaggaattcactagtacatgaatcataggcctaccttatgtgtatctcgacttatatggagaggaaagaagaaatgactccaatattttgtttgggaacatctcagaacagttgcattgcgtggaaaaaatatttaagcatgttgcaaaaaaaaaaaaaaaaaaaa

SEQ ID NO: 7302 - protein, 504 aa, Panicum virgatum
  misc_feature: Ceres CLONE 1907196
  misc_feature (1)..(27): Pfam Name: zf-CCCH Pfam Description: Zinc finger C-x8-C-x5-C-x3-H type (and similar)
MADADANTQPPDAAASPIASISPSSVGAADADADAIEKQLAGLGIAVAGGGGFPGPSGWDDVPVPVPVAVGGGDEVAAEKVRGPPPAPAGAADGKVRFPRRPGEPDCSFYVKFGSCRFGIKCKFNHPSRKKKSNRARGSGSSVSGSNSSSNKTSSPDDDQAPREEYEGLVPDISDSVSFHDKGSSSNSGNHRKTSYEVIDMKKGRMESKEKIAEELEKGVYFKKLDETNITNQKILKGVKDKRKETFSEGSPQEECKYYSTPGGCKFGTACKYLHREGKEGKAEVEKVELNFLGLPLRPGEKECPFYMRTGSCKFATNCKFHHPDPSNVASKEPVLEHENGDNPQQNVQGPSQPSVPIWPEQRALNEQHVPFLAPAPSYSAGMIPPQGMYPSPDWTGYHQVPVNPYYPPGVPFPHFPAPHMNHPMYKAADIPGHQQLPSDEYPERPGQPECQHFVKSGFCKYRMKCRFHHPRSCQPAPLTGLSPIGLPIKPVSSYPIQSSYFPH

SEQ ID NO: 7303 - DNA, 1820 bp, Panicum virgatum
  misc_feature: Ceres CLONE 1907289
  misc_feature: Encodes the peptide sequence at SEQ ID NO. 7304
aagcgaaaaatcgagtaggaaaaaaaagggagaaaagattcttcatccgattcctaccgctttccaagcgacctctccagtctccggtccaactccctgcccgcaacgaaacaaaacccaccgccgctccatcgtacgggcgctcgcctgcgccgcgcggaggagagccacgaagatggcggacaccatcctccacggcgcggtcgtcgtcaccatggacggcgagctccgcgtcctccgcgacggcgccgtcgccgtcgccgacgaccgcatcgccgccgtgggccccgccgccgacgtcctcgccgccttccccagcgccgcgcggaccctcgacctcggcggccgcatcgtcctcccagggttcgtgaacacgcacgtgcacacgtcgcagcagctggcgcgggggatcgccgacgacgtcgacctgatgacgtggctgcacgggaggatctggccctacgagtcacacatgacggaggaggactcctacgcctccaccctcctctgcggcattgagctcatccgctccggggtaacatgctttgctgaagcaggtgggcagtttgtttccgaaatggctcgggcagtggaattgttaggtttgcgggcatgtttgacaaagtcaacgatggattgtggtgagggtttgcctacaaattggagttcttgctccactgacgattgcattcagtcacagaaggaactatatgaaaagcatcataatacagctgatgggcgtatcaggatatggtttgggttgaggcagatcatgaatgcaacagatcgtttactgcttgaaacaagagatgttgcccagaagctaaatactggaatccatatgcatattgcagaaataccatatgaaaatcaacttatagtgcggaccaaaggaattgatcatggcacggtgacatatttagagaaaattgattttttgaggtgtaatttgttggcggcccactctgtctggttgaatgaacctgagatagggcatttttcaaaggctggcgtcaaggtttctcactgccctgcatctgcgatgcggatgttgggttttgctcctattagagaaatgctagattctggtgtttgtgtctcccttggtactgatggagcaccaagcaataacagaatgagcattgtggatgagatgtacctagcgtctctaattaacaaaggacgtgaggcatacatcagtggaacaactaacccaactgctcttccttctgagactgtactgaagatggctactattaatggcgcgaaagcagttctatgggataatgaaataggttcgctggaggtcgggaaaaaggcggacttggttgtagtgaatccatttacatggtccatggttcccttacatgacagcattgccaacattgtctattgtatgaggacggagaatatagagtctgttatgtgcaatggtcagtggattatgaaggatcataaaatcatgaatctcaatgaggaggaggtaatttcttcagctgtgcaaagagcgaacgacctccttgcgcgagctggcatcaatctccccaaacggatgaactacgtgtagttattgccttgccagttcgtcatgcactgccacgacaccctttgcggtgttgcagatgatgcacgctcgcccaaaggatagaagacatgtttacaggactgttggcgtcacagtactgagttgaaaataatgtgccgtagcataggtttctggaaggaataagagcatcatgaaagtctcgacttataacaactgtaaagaatcaaactatgataaaaatagttcatttgactaaaaaaaaaaaaaaaaaaaa

SEQ ID NO: 7304 - protein, 463 aa, Panicum virgatum
  misc_feature: Ceres CLONE 1907289
  misc_feature (1)..(330): Pfam Name: Amidohydro_1 Pfam Description: Amidohydrolase family
MADTILHGAVVVTMDGELRVLRDGAVAVADDRIAAVGPAADVLAAFPSAARTLDLGGRIVLPGFVNTHVHTSQQLARGIADDVDLMTWLHGRIWPYESHMTEEDSYASTLLCGIELIRSGVTCFAEAGGQFVSEMARAVELLGLRACLTKSTMDCGEGLPTNWSSCSTDDCIQSQKELYEKHHNTADGRIRIWFGLRQIMNATDRLLLETRDVAQKLNTGIHMHIAEIPYENQLIVRTKGIDHGTVTYLEKIDFLRCNLLAAHSVWLNEPEIGHFSKAGVKVSHCPASAMRMLGFAPIREMLDSGVCVSLGTDGAPSNNRMSIVDEMYLASLINKGREAYISGTTNPTALPSETVLKMATINGAKAVLWDNEIGSLEVGKKADLVVVNPFTWSMVPLHDSIANIVYCMRTENIESVMCNGQWIMKDHKIMNLNEEEVISSAVQRANDLLARAGINLPKRMNYV

SEQ ID NO: 7305 - DNA, 1739 bp, Panicum virgatum
  misc_feature: Ceres CLONE 1907336
  misc_feature: Encodes the peptide sequence at SEQ ID NO. 7306
acactctgcccaccaatggcgacgggtggctgagaaaaacggagtccaagctccccgaaccttcccccatggctcctctcgcctcccctcctctcccataccgcgcccctgccttcctcgccgcccccgccatccgcagcgggcggcctccacgcctgctcagcccgtcgcggtccgcgtccccactcctctcctccggctgcgcaggctgcttcccccgcgcccctcgcgcgccctgtaccgccgcccgcgaacgccgccgcgacgccgtgcggacattctcccaaactgatgctgctggacaagcacctttatcaaagactctgtcagacctcaaggattcctgctggagatttctgaggccacacacaattcgaggaactgctttgggatccatagctttggttgctagagccttgatagagaattcccacctgataaattggtggttgttattcaaagcattctatggacttgtagcgttaatctgtggcaatggttacatagttgggatcaatcagatctacgatgttgctattgacaaggtaaataagccatatctacccattgctgctggtgatctctcagttgagtcagcatggttgctggtgacattattcgcaattgcaggcttttcaattgtagtgttaaactttggatctttcattacctctctatactgccttggcctatttcttggcactatatattccgttcctccattcagactgaagaaatatccggttgctgcttttcttatcatcgcaacggttcggggttttcttctcaactttggtgtgtactatgctactagggctgcactaggtcttacattccaatggagctctcctgttgctttcattacatgcttcgtgacactatttgctttggtcattgctataaccaaagatctccctgatgttgaaggggatcgcaagtatcagatatcaactttggcaacaaaacttggtgtcagaaatattgccttccttggctctggtctattggtagcaaattacattgctgctattgctgtagcttttctcatgcctcaggcgttcaggcgctctgtcatggtccctgtgcatgttgtccttgcagctggtttaattttccagacatgggttctggagcaagctaagtacactaaggatgctatttcgcagtactatcggttcgtttggaatctcttctatgctgaatatatcttcttcccattaatatagagcctagagatctggtagttcagagtgggctacagcctaatgatgggagcaaatcaaaaagggtggagtcgataaagtgcaggggctatcaaggatcctggagttgtaggagcttcggaagcttttgtcatgctgagagtgagggctttgttggaactgcggtagctgtctttggcacaaattcagcagtgccccgttctgtagggtcttgtctgggagggcttgagctcaggtctgacgtcgatggaaactcaagttctggccccaaacaggtggtggtgctggtgcaacggccaagccaagctcgtagcttgtcactcgaggttaagctaatacgcgagacatattgacggcgtgccctcgcagtgagtcacgaatacagaccacggactactaactctaagcatccctttggcttatactgcatatatattccttgagcttcagctgtacctgttgtatagtcggaaccactgtcttttccaccgttctggaaggactgaaactttctcc

SEQ ID NO: 7306 - protein, 385 aa, Panicum virgatum
  misc_feature: Ceres CLONE 1907336
  misc_feature (1)..(281): Pfam Name: UbiA Pfam Description: UbiA prenyltransferase family
MAPLASPPLPYRAPAFLAAPAIRSGRPPRLLSPSRSASPLLSSGCAGCFPRAPRAPCTAARERRRDAVRTFSQTDAAGQAPLSKTLSDLKDSCWRFLRPHTIRGTALGSIALVARALIENSHLINWWLLFKAFYGLVALICGNGYIVGINQIYDVAIDKVNKPYLPIAAGDLSVESAWLLVTLFAIAGFSIVVLNFGSFITSLYCLGLFLGTIYSVPPFRLKKYPVAAFLIIATVRGFLLNFGVYYATRAALGLTFQWSSPVAFITCFVTLFALVIAITKDLPDVEGDRKYQISTLATKLGVRNIAFLGSGLLVANYIAAIAVAFLMPQAFRRSVMVPVHVVLAAGLIFQTWVLEQAKYTKDAISQYYRFVWNLFYAEYIFFPLI

SEQ ID NO: 7307 - DNA, 1723 bp, Panicum virgatum
  misc_feature: Ceres CLONE 1907420
  misc_feature: Encodes the peptide sequence at SEQ ID NO. 7308
attttctttctcctctaagaacttctccagtgttctatcaacatatcaagtgatgcttctacttgcgcctattaaaagttcagattctttttctttcagatgattgccctcccacgtacttttccatccattttttacgctctgcccatctgttttgtttcagaggtgttgtgctatggatgatgccttgtttgccgatttgttttttgttcaagtggtgttttgaattttgattagtactggagttttcggctgatacctcgtctctgaatgatcacctgccgcagtgcccgttcttacgcgaatttcccatgtataaatggctcaggacagcggcggcgtttggcgcagcagcagggatggacgccagctcggcgatggagcaggagttgcaccggcccatggagctgcccccgggcttccgcttccaccccaccgacgaggagctcatcacgcactacctcgcccgcaaggtcgccgacacccgcttcgccgcgctcgccgtcggcgaggccgacctcaacaagtccgaaccttgggacctgccgtcgctggcgaagatgggggagaaggagtggtacttcttctgcctcaaggaccgcaagtacccgacggggctgaggacgaaccgggccacggaggccgggtactggaaggccacgggcaaggacaaggacatcttcaggggcaaggccctcgtcggttccaagaagacgctcgtcttctacacggggagggcgcccaagggcgagaagtccggctgggtcatgcacgagtaccgcctccacggcaagctccccggcgccgccatgcccaatgctgcatcgtccaagaacgagtgggttctgtgcagggtgttcaagaagagccttgtcgtaggtgtggcgccagcacccaaacggggcgccatggagatggacgacgtggcagccatctcccacctccttccgctgatggacatgtccaccgccgccgccgtaggcaacccagccgcggcacacgtgacctgcttctccaacgcgctggagggccagttcttcaaccagacggcggcgccgcaagccgccgcctctgccacggaccacctcggcctcgcctcctcctccccgttcctgtccagcttcgcgcagtacgggccgctgcaccacggcggcgtgagcctggtgcagctcctggagagcagcgggtacggcgccggcggtggcagcctcccggacatgcccaagcagcagcagcacaaggggggcgacgagcgggagcggctgagcgcgtcgcaggacaccgggctgacctccgacgcgcaccccgagatctcctcctcctccggccaacgattcgagcacgagcagctctggggctactgagcagcagcacgagcttcttcacgcaccgcgttaatggcggtcacagtatagagcactactgtaaataaacatctgttgcaacctcgatcgcggcgtgcgtcgagctacgcgttccaattatttgttcgtgtgattgtagttagccgatttgggggtgtaattagcgcttgtgtaagcacgatttggtgcaagatttccctggttgatgatggtgccaatcaaccgatggcactagcagctgcgatagttcgttaggcttatctagtttgtttgtgaaaaggggtcgcccggccagtgtgctagtgtcatcctgaacgtacctaaaagtttgacctgttcaaaaaaaaaaaaaaaaaaaa

SEQ ID NO: 7308 - protein, 350 aa, Panicum virgatum
  misc_feature: Ceres CLONE 1907420
  misc_feature: Great-hit functional homolog of the protein sequence given in SEQ ID NO 9531
  misc_feature: The sequence is a functional homolog of  SEQ ID NO 326 in the  10/412,699 US patent application
  misc_feature: The sequence is a functional homolog of  SEQ ID NO 760 in the  11/479,226 US patent application
  misc_feature: Useful for making plants with altered terpenoid content
  misc_feature: Useful for making plants with modulated growth and phenotype characteristics
MYKWLRTAAAFGAAAGMDASSAMEQELHRPMELPPGFRFHPTDEELITHYLARKVADTRFAALAVGEADLNKSEPWDLPSLAKMGEKEWYFFCLKDRKYPTGLRTNRATEAGYWKATGKDKDIFRGKALVGSKKTLVFYTGRAPKGEKSGWVMHEYRLHGKLPGAAMPNAASSKNEWVLCRVFKKSLVVGVAPAPKRGAMEMDDVAAISHLLPLMDMSTAAAVGNPAAAHVTCFSNALEGQFFNQTAAPQAAASATDHLGLASSSPFLSSFAQYGPLHHGGVSLVQLLESSGYGAGGGSLPDMPKQQQHKGGDERERLSASQDTGLTSDAHPEISSSSGQRFEHEQLWGY

SEQ ID NO: 7309 - DNA, 2408 bp, Panicum virgatum
  misc_feature: Ceres CLONE 1907457
  misc_feature: Encodes the peptide sequence at SEQ ID NO. 7310
gtatgcaattattcgcacccggacgccaccgcctccaccaccaccgcatccgccatgggcgactcctcggtggccggcgcgctcgtgccgtccgtgcccaagtcggaggccgcgccgtccggtgacgcctccgcggcggccgcggcggcgctggcgctggcggaggaggcgggcacgcgcgcggcgtcggcgtccccgcagggcccggcggaggagggggagggacccgccgacagggacctcctctgcccgatctgcatggcggtcatcaaggacgccttccttaccgcctgcggccacagcttctgctacatgtgcatcgtcacgcacctcagccacaagagcgactgcccctgctgcgggcactacctcaccaaggcccagctctaccccaatttcctcctcgacaaggttctgaagaaaatttcggcccggcaaattgctaaaacagcatcaccaatcgatcaatttcgatatgcattgcaacagggaaacgaaatgggggttaaagagttagatagtcttatgactttgatttctgagaagaagcggcaaatggaacaacaagaatcagagacaaatatgcaaatattgttagtcttcttgcactgccttagaaagcaaaagctggaagagttgaatgagattcaaactgatctacagtacatcaaagaagatataggcgctgtggagagacataggttagaattgtatcgcacaaaagaaaggtactccatgaagctgcgcatgcttttggatgatcctgctgcacaaaaaatgtggccctctcctatagacaaagctagcagtctctttcttcccaattctcggacaccacttagcgcatcatgcccaggaagtttacagaataagaagcttgatttgaaagctcaagtaagccaccaaggatttcaaaggagagacgctctaacttgttcagaccctccaaactcccctatacaatcgggtaacatcattgctaggaagaggagagttcaagcacagtttaatgagcttcaagaatactacctgcaaagacggcgcactggagcacaggcacgcaggcaagaagaaagagacattgttgcaatgaacagagaaggttatcatgcaggtcttcaggatttccagtctgtgctaacaacattcactcgatacagtcgtctacgtgtcatcgcggaactaaggcatggagacttgtttcactctgccaatattgtatcaagcattgaatttgatcgtgatgatgaactattcgctactgctggcgtctcgaagcgtattaaagtttttgaattttctagtgttgttaatgagccatcagatgtgcattgcccggttgttgaaatggctacgagatctaaacttagttgcctcagctggaacaagtactcaaaaaatgttatcgcaagcagtgactatgagggtattgtaactgtttgggatgtccagacccgtcagagtgtgatggagtatgaagagcatgagaagagagcgtggagcgttgatttttctcgtacagaaccttcaatgctagtatcagggagtgatgattgcaaggtgaaagtgtggtgcacaaaacaagaagcaagcgtgatcaatattgatatgaaagcaaatatttgctcagttaaatataatcctgggtcaagcttctatgttgcagtcggatctgctgatcaccatattcattactttgatttacgtaatccaagtgcacctgtccatatttttggtgggcacaagaaggcagtatcgtatgttaaattcttatctaacaatgagcttgcgtctgcatcaacagatagcacattacggttatgggatgtcaaggatcattgcccggtacggacgtttagagggcacaaaaatgaaaagaactttgtggggttgtctgtgaacagtgagtatattgcttgtggaagtgaaacaaatgaggtttttgtttatcacaaggcaatctcaaaacctgcagcgagccatagatttgtatcctctgacctgggcgatgctgaggatgatcctggttcttatttcattagtgctgtctgctggaagagtgatagccctaccatgttaactgctaacagccagggaacgattaaagttcttgtacttgctccttgatgttaccaaggggttacagccagcttgtatatcttattaggattttgagggatttcgtgccattatattccctaagtgggatttggagcttcattgatctccggtttagggcacgaagttttggagctggtcacctgacgtaggattttgaggtttcagaatgtgcataatcattgttatgttgtataggtgtaaaagcagcgaagttattgattacaagtgtaacatgagaaatacaccttaataaaatccattatttccaaaaaaaaaaaaaaaaaaaa

SEQ ID NO: 7310 - protein, 690 aa, Panicum virgatum
  misc_feature: Ceres CLONE 1907457
  misc_feature (1)..(38): Pfam Name: zf-C3HC4 Pfam Description: Zinc finger, C3HC4 type (RING finger)
  misc_feature: The sequence is a functional homolog of  SEQ ID NO 1841 in the  11/479,226 US patent application
  misc_feature: Useful for making plants with modulated growth and phenotype characteristics
MGDSSVAGALVPSVPKSEAAPSGDASAAAAAALALAEEAGTRAASASPQGPAEEGEGPADRDLLCPICMAVIKDAFLTACGHSFCYMCIVTHLSHKSDCPCCGHYLTKAQLYPNFLLDKVLKKISARQIAKTASPIDQFRYALQQGNEMGVKELDSLMTLISEKKRQMEQQESETNMQILLVFLHCLRKQKLEELNEIQTDLQYIKEDIGAVERHRLELYRTKERYSMKLRMLLDDPAAQKMWPSPIDKASSLFLPNSRTPLSASCPGSLQNKKLDLKAQVSHQGFQRRDALTCSDPPNSPIQSGNIIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSSVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASVINIDMKANICSVKYNPGSSFYVAVGSADHHIHYFDLRNPSAPVHIFGGHKKAVSYVKFLSNNELASASTDSTLRLWDVKDHCPVRTFRGHKNEKNFVGLSVNSEYIACGSETNEVFVYHKAISKPAASHRFVSSDLGDAEDDPGSYFISAVCWKSDSPTMLTANSQGTIKVLVLAP

SEQ ID NO: 7311 - DNA, 1695 bp, Panicum virgatum
  misc_feature: Ceres CLONE 1907506
  misc_feature: Encodes the peptide sequence at SEQ ID NO. 7312
ttccgccgcaccttctcccctaccgcctccgatggccacgacgacgacgacggcgacggtgacggcgcgggcggccaacgccaacttcgtagcgacaccagcggctccgcatcctcggcccgtcgtgccacccgctccccgggccccctccaccttgggtcccgtcaagtcggaggcccctccgatcccctcgcccactacctccgccgccgcccccgctgccgccgcatccggaccggaggatccatcctacatcatcaccatcccgagttattcagcgtggttctcgttcgactccatccacgacactgagcgccgcctcctgccggagttcttcgagggggaggccgcggcggcgtccggatgccggggcccgggcgcgtacaagtactaccgcgacagtctgatacggaggttccgggcgcggccgggtcgacggctcacgctcacggagtccaggcggggactggtcggcgacgtcggctccatccgccgcgtattcgacttccttgaggaatgggggctcatcaactacggtgctttgccgtcaggctcaaagcaggcgaaagagaagagggaagaggttgcaccacattcgatttcttctggggcaacagcacccaggaagctttgtaccgggtgccgcactgtgtgcgggcttgcttactttgcctgcgacaaggcagatataagtctctgtgctagatgctttttcggtaataacttccggccaggtctgactgcggcaaacttcaacaaagttgaaattactgaagattcaaagtctgattggacagacaaagaaactcttcacttgcttgaggctgtcttgcattatggtgaagactggaagaaggtgtctgaacatgttggtagtcgatcagaaaaagactgcattgcaagattcatccgtctaccttttggagaacaattcatgggacccaaggaggatagaatggggtttgaaaatgatgatgatactactgatgaacctggaacagatgtctcaaaacggctacgcctcagtccactggcagatgcaagcaatccgattttggctcaggttgcattcttatcggccattgtgggttctgatgctgcctcagctactgctcaagcagctatttctgcacaatcccgtattgatctaaatgatgaagagattgattcttcaataaatagcaccagggaagaaggcaatgatttgctgaaagaggctgccgctaatgcaagggcacaacttgaaaaagaaaggaacggcatagagcaatctttatccgatatagtggacgtccagatgaaggaaatccaagataaaatatgccgtttcgagcataaggagatgctgatggagaaagagcgacagcagcttcgatgccttagggatttgcttttcacagatcaactggcgatcatgcaacatcaacgcaagccccaagctgtagccgcagagagcaaatatgacgaggagccaaaacccatgattaacataagttgattcaaatagagggtttttttatcgaaactggaaatggttcctcagcctgactggaacgacagttgtgagaattggacataggtctgcaccatttagctaacttatttcccccttcggttgcctgactctagttgtatgttcaatccatgtgcgttcgcctcagatgttataggaagcaagggcgatgacaattcttt

SEQ ID NO: 7312 - protein, 488 aa, Panicum virgatum
  misc_feature: Ceres CLONE 1907506
  misc_feature (1)..(46): Pfam Name: Myb_DNA-binding Pfam Description: Myb-like DNA-binding domain
MATTTTTATVTARAANANFVATPAAPHPRPVVPPAPRAPSTLGPVKSEAPPIPSPTTSAAAPAAAASGPEDPSYIITIPSYSAWFSFDSIHDTERRLLPEFFEGEAAAASGCRGPGAYKYYRDSLIRRFRARPGRRLTLTESRRGLVGDVGSIRRVFDFLEEWGLINYGALPSGSKQAKEKREEVAPHSISSGATAPRKLCTGCRTVCGLAYFACDKADISLCARCFFGNNFRPGLTAANFNKVEITEDSKSDWTDKETLHLLEAVLHYGEDWKKVSEHVGSRSEKDCIARFIRLPFGEQFMGPKEDRMGFENDDDTTDEPGTDVSKRLRLSPLADASNPILAQVAFLSAIVGSDAASATAQAAISAQSRIDLNDEEIDSSINSTREEGNDLLKEAAANARAQLEKERNGIEQSLSDIVDVQMKEIQDKICRFEHKEMLMEKERQQLRCLRDLLFTDQLAIMQHQRKPQAVAAESKYDEEPKPMINIS

SEQ ID NO: 7313 - DNA, 1523 bp, Panicum virgatum
  misc_feature: Ceres CLONE 1907556
  misc_feature: Encodes the peptide sequence at SEQ ID NO. 7314
acccacttcggctggggggggcatcatgaatctggccgccttccccgccttccccttgccacgcccgcggcctcccccgctgcaatgagatgccattaaattcctccgctttctcctcctcgctgctccgccgctcgctccgcgcgtccctccggaggatctccccgatggcctccgcctcagcccccacctccgcgcccgccgccgccgccgagaacggcgccgcgaaggcggcggagcagcggcccgtgcaggtagcaaagcgattggaaaagttcaagaccacaattttcactcagatgagcatgcttgccatgaagcatggggcaataaacctcggccagggctttccgaattttgatggcccagactttgtgaaagaggctgctattgaagctataaatgctgggaagaatcagtatgcaagagggtttggtgtgccagaactgaactcagctattgctgaacggttcctgaaggacagtggtttgcaagttgaccctgataaagaagtcactgttacatctggatgcactgaagctatagctgcaacaatactgggtctcatcaaccctggtgatgaggtgatattgtttgctccattctacgattcatatgaggctacactgtcaatggacggtgccaatgtaaaggccattaccctccgtgctccagatttcgcagttccacttgaagagctaaaggctgcagtctccaagaacaccaaagcaataatgataaacacaccgcacaatccaactgggaagatgttcacaagggaggaacttgaatttattgccaccctctgcaaggaaaatgatgttttgctgttttctgatgaggtctatgacaaattggcatttgaggctgatcatatatcaatggcttctatccctggaatgtatgagaggactgtgaccatgaactctctaggcaagacattttctcttacaggatggaagattgggtgggcaatcgcaccacctcacttgacatggggtctaaggcaagcacactcattcctcacattcgccacctgcacaccaatgcaagcagcagcagcggcagctctgagagcaccagatagctactatgaggaactgaagagggactacagtgcaaagaaagctatattgttagaaggactaaaagccgcagggtttattgtttacccatcaagtggaacgtacttcattatggtcgatcacacccctttcggttttgacaatgacatagagttctgtgagtatttgattcgtgaagtcggcgttgttgctataccaccaagcgtgttttacctgaaccctgaggaggggaagaacctggtgaggttcaccttctgcaaggacgaagatacgctgcggggcgcggtcgagcggatgaagacgaagctgaggaagaaatgaagcgcggggaaatttccacgtggctggtgattgctgaataatctgttaggtttgcacactgcggcaggatgcatgtactaccctttttctagcaatagttatcctgtcggtgacttc

SEQ ID NO: 7314 - protein, 438 aa, Panicum virgatum
  misc_feature: Ceres CLONE 1907556
  misc_feature: Great-hit functional homolog of the protein sequence encoded by LOCUS At1g77670
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature (1)..(354): Pfam Name: Aminotran_1_2 Pfam Description: Aminotransferase class I and II
  misc_feature: Useful for making plants with modulated nitrogen use efficiency
MPLNSSAFSSSLLRRSLRASLRRISPMASASAPTSAPAAAAENGAAKAAEQRPVQVAKRLEKFKTTIFTQMSMLAMKHGAINLGQGFPNFDGPDFVKEAAIEAINAGKNQYARGFGVPELNSAIAERFLKDSGLQVDPDKEVTVTSGCTEAIAATILGLINPGDEVILFAPFYDSYEATLSMDGANVKAITLRAPDFAVPLEELKAAVSKNTKAIMINTPHNPTGKMFTREELEFIATLCKENDVLLFSDEVYDKLAFEADHISMASIPGMYERTVTMNSLGKTFSLTGWKIGWAIAPPHLTWGLRQAHSFLTFATCTPMQAAAAAALRAPDSYYEELKRDYSAKKAILLEGLKAAGFIVYPSSGTYFIMVDHTPFGFDNDIEFCEYLIREVGVVAIPPSVFYLNPEEGKNLVRFTFCKDEDTLRGAVERMKTKLRKK

SEQ ID NO: 7315 - DNA, 1765 bp, Panicum virgatum
  misc_feature: Ceres CLONE 1907569
  misc_feature: Encodes the peptide sequence at SEQ ID NO. 7316
gaacaccactcgcctgtttctttgcgaaacttctggttctgggcgcgggtggatggcgaattgggcggagcagctgcagcgcgagctcgccggccgcggcctcgccgtcgcctccattcccggaaagggacggggcctcgttgcctcccgcaccttcttcccaggggaagtcattatcagccaagaaccttacgcttctacatccaacaagattttagtcggatcaagctgcgaccattgtttcgcgtctgacaacctgaggaagtgctcggtttgccgagttacttggtactgcagcagcgattgccagaaagtagaatggaaactacatcagctcgagtgtagagcgatggcagcgcttacggaggacagaaaaaagatgcttactcccacaattcgtttgatggtgaggctggtactgaaaagaaaattgcaaaatgagaaggtcattccatcttcatgcattgataactactatctagtggatgccttggagtcccatatatcggaggttgatgaaaatcaacttgtactctatgctcagatggccaatcttgtggacctcattcttccttcggttgaacttgatcttaaggaaattgcacatactttttctaagtttgcctgcaatgctcatacaatatgtgattctgagcttagacctcttgggactggattgtaccctgttatatctataattaaccacagttgtgtaccaaatgcagttctgacatttgatggtcggacagcttatgttcgcgctttgcaacctatagggaaagatgaagaggtgtcgataagctacatcgagactgcagcagtaactaagaagagacagaatgatctgaagcagtacttcttcacctgcacatgcccacgctgtgtcaagggttctgaagacgatgctctacttgagagttatagatgcaagaaccaagcatgtgatgggtttctgctgcctgagtcaggagaaaaggcttacacatgccagaaatgtagcatttctagagatgaggaagaggtcaaaaagatgacaagagaaattgtactgctatcagataaagcatcttcacttcttaagtcaggaaataccactgaagcaggttctatctacaagacaattgagcagttagagcagaagctctaccatgctttctcaatcactttgctgcacacacgtgaaacactgctgaagatatacatggagttacaagattggcagactgcattgacgtattgcaaatcaacaattcctgtttatgaaagagtttatccaccatttcatccaatgatcggattacaattctatacttgcggaaagcttgaatggctgctcgagtgcacagaggacgctctgaaatctctaaccaaggccgcagatatacttagaataacacatgacacaaaatcacagttcatgaaggagctctttggcaagatagaggaagcaagggctgaagtttcttttaggctatcctccggtcctgggcatgatgagcaattttcatgagggactgcaggccaactatgacggaaaatagatataatatcaaaaaatatgctgctgtcgttgagacaatgttcaaaaaatacaaggactgagaatgtctaggcatgcaaatagcattgttgggatagcgaccagctcgttccaagcttcattcagttggaaatggggaaatagcatctgttgtaaaattgatcagattttcgattttattgtcagcatgtggcgagttgaactcaaaaaaaaaaaaaaaaaaaa

SEQ ID NO: 7316 - protein, 485 aa, Panicum virgatum
  misc_feature: Ceres CLONE 1907569
  misc_feature (1)..(63): Pfam Name: Fe_hyd_SSU Pfam Description: Iron hydrogenase small subunit
  misc_feature (1)..(38): Pfam Name: zf-MYND Pfam Description: MYND finger
  misc_feature (8)..(473): SWISSPROT Homolog: EC 2.1.1.43 Histone-lysine N-methyltransferase ASHR1
MANWAEQLQRELAGRGLAVASIPGKGRGLVASRTFFPGEVIISQEPYASTSNKILVGSSCDHCFASDNLRKCSVCRVTWYCSSDCQKVEWKLHQLECRAMAALTEDRKKMLTPTIRLMVRLVLKRKLQNEKVIPSSCIDNYYLVDALESHISEVDENQLVLYAQMANLVDLILPSVELDLKEIAHTFSKFACNAHTICDSELRPLGTGLYPVISIINHSCVPNAVLTFDGRTAYVRALQPIGKDEEVSISYIETAAVTKKRQNDLKQYFFTCTCPRCVKGSEDDALLESYRCKNQACDGFLLPESGEKAYTCQKCSISRDEEEVKKMTREIVLLSDKASSLLKSGNTTEAGSIYKTIEQLEQKLYHAFSITLLHTRETLLKIYMELQDWQTALTYCKSTIPVYERVYPPFHPMIGLQFYTCGKLEWLLECTEDALKSLTKAADILRITHDTKSQFMKELFGKIEEARAEVSFRLSSGPGHDEQFS

SEQ ID NO: 7317 - DNA, 1492 bp, Panicum virgatum
  misc_feature: Ceres CLONE 1907576
  misc_feature: Encodes the peptide sequence at SEQ ID NO. 7318
aggcagctgctgcaggtaccgtcttcctgccatggccatggcgtccgcccttgcgctcctcctcacgccccggcccatctccgcgaggcccacatcgcctcatctccactcccgccggctcgctcttcctcctccccgaccggccaccatctccgcctcagccgccacccacccgcgcaaggccgggagcctccagcagctccatgccgcctcctccaccgcatcgagcatcgtcgccagcagcctcgccgcccccgcccccgcccccgcgccgtcgccccagccccgcagccccgcctccgccgcccgccccaggctcatcatgagcaagcccgtcttcgccgcctccagcgccgtcgtgtaaaccgccgaacgagaagctgaaaagtcagacgagagagaagccaactactcctagtagcatccgcccggcgataaaaagaagatgagcgggtgcctttgcctcccctgctatcaaaagaaggaggccgtccccgcggcggcagcgaagccgtccatacattccccagcctcgtcactcgtacagaacaagaagcccacccaacctccacctcctccctccaagggcatggacgccgtcgagcgcttgaagagcgggttcgagcagttcaagacccaggtctatgacaagaagccggagctgttcgagccgctcaaggccggccaatcccccaggtacatggtgttcgcctgcgccgactcccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgcgctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggagaaggaggccgtgaacgtgtccctctacaacctcttgacctacccctgggtcaagaaaggtgtggagaacgggaccctcaagctggtcggcgcacgctacgacttcgtgaacggtgtgttcgacacatgggtgaaataagccaccaactcctacatcatcaaatacatacatagtacttgcataccgatatgcacctcatcgatgtgaatccgtggagtacttactgcctatttcgaccgcttcgaaccggatcgtcctatgctgtaataagcaatagcattttctactgctttactttctaaggtggagcttatatatatgtaatatatggtgcgtaatttgaccgcttttgtggtcaagagacatcagctgtataagcctttttcataatattatcatgcagtatctttttactaaaaaaaaaaaaaaaaaaaa

SEQ ID NO: 7318 - protein, 249 aa, Panicum virgatum
  misc_feature: Ceres CLONE 1907576
  misc_feature (1)..(170): Pfam Name: Pro_CA Pfam Description: Carbonic anhydrase
  misc_feature (12)..(247): SWISSPROT Homolog: EC 4.2.1.1 Carbonic anhydrase, chloroplast precursor
MSGCLCLPCYQKKEAVPAAAAKPSIHSPASSLVQNKKPTQPPPPPSKGMDAVERLKSGFEQFKTQVYDKKPELFEPLKAGQSPRYMVFACADSRCCPSVTLGLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILEKEAVNVSLYNLLTYPWVKKGVENGTLKLVGARYDFVNGVFDTWVK

SEQ ID NO: 7319 - DNA, 1977 bp, Panicum virgatum
  misc_feature: Ceres CLONE 1907590
  misc_feature: Encodes the peptide sequence at SEQ ID NO. 7320
gtcttcctcctccgccccccaccccacgccaccaaccccgaccaaacttgcttgccttgtttctctctctagtctctcccctccaccacctccgtcggattcgggcccccaactcctgctgctgacttcaacatcccccgccattcgcgccatgattattcctcccctcctcccctgccctcagagctgctgctgctgctactactagatgcccgcccgttgctgatccccaccccatcccatcccttccctccctcccaagccaagctcttccgctcttcccttcccctcaatccagctcaatcctccccaaggggcattcatggcgtccatccgccggccgcactcgccggccaagcagcacctgctgcgctaccaccaccccttcgcctcctcctcgccgccctcctccccgctccgccactccagctcctcctccagctccctgaggacccaccaccacaacctctacccgcaccccttcctcttcctctcccgccgcccactcccgcgcttcgccgccttcttcctcctcggctccttcctcggcctcctccacttcctctcccacctgccccacaccccgcacatccgccccgcggaccccgtcgcggccgcggctggcctccgccaacacctacaactccccatccgggtaccagacgacgacgacgccgatgacacaaggaaaaagctgctcatcgtcgtcacgcccacgcgcgcccgcgccgcgcaggcctactacctcagccggatgggccagacgctgctcctcgtcgacccgcccctgctctgggtcgtcgtacaggccggcaagcccacgcccgaggccgccgccgcgctgcgccgcaccaccgtcatgcaccgctacgtcggctgctgcgacaacctcaacgcctcctcctcctcctcctcctccgccgacgacctccgcccgcgccagatgaatgccgcgctcgacctcgtcgagaaccaccgcctcgacggcatcgtctacttcgcccacgaggagggcgtctactccctagacctcttccaacgcctgcgccaaatcaggaggtttggcacatggcctgttccagtggtctctgaaaacagaaaggatggtgtggttctggagggccctgtgtgcaagcagaatcaagttgttggatggcatacaagtgaaggtcacagcaagctccggagatttcatgttgctatgtcaggattcgcgttcaatagcaccatgctctgggatcccaagctgaggtcccatgtggcctggaattcaattcgccatccagaaatggtgaaagaaggcttccaaggaaccacgtttgtagagcaactagtggaggatgaaagccagatggaaggcatacctgctgactgctcgcgtataatgaactggcatgtgccatttggatctgagaatcttgcctatcctaaaggatggcgagttgggacgaatctggatgtgattattcctcttaaatagtaccaccagctatgttcaacaaagcactaactcctttgacaggcatatactgtagaattaaaagccatgaagctttggcttgaatagttcagaggaatcccagggtttgactactttcaagaagcagctcctggaaagaggaggcttcaggttttgcacaacctcatgcagaatttctgctgttatagtcagaatttttgggaaatattttgtaggatgaaattagtgcagcatcaccaaagaagccagccatttcgctgcaaagcctgttcattgtatttgtacatgtttgtattcatttttttagttcacaagccaaaaggcgttctgcatagttactgattatttcaggagtttcagttaaagcatgagtcattttattttgaagtgctgaatttcttgttcttgtgagtgatctgtaaaatgtgctgaatttcttgttcttttgtgatgatcagtaaaagctattgttgtaccaaaaaaaaaaaaaaaaaaaa

SEQ ID NO: 7320 - protein, 385 aa, Panicum virgatum
  misc_feature: Ceres CLONE 1907590
  misc_feature (1)..(217): Pfam Name: Glyco_transf_43 Pfam Description: Glycosyltransferase family 43
MASIRRPHSPAKQHLLRYHHPFASSSPPSSPLRHSSSSSSSLRTHHHNLYPHPFLFLSRRPLPRFAAFFLLGSFLGLLHFLSHLPHTPHIRPADPVAAAAGLRQHLQLPIRVPDDDDADDTRKKLLIVVTPTRARAAQAYYLSRMGQTLLLVDPPLLWVVVQAGKPTPEAAAALRRTTVMHRYVGCCDNLNASSSSSSSADDLRPRQMNAALDLVENHRLDGIVYFAHEEGVYSLDLFQRLRQIRRFGTWPVPVVSENRKDGVVLEGPVCKQNQVVGWHTSEGHSKLRRFHVAMSGFAFNSTMLWDPKLRSHVAWNSIRHPEMVKEGFQGTTFVEQLVEDESQMEGIPADCSRIMNWHVPFGSENLAYPKGWRVGTNLDVIIPLK

SEQ ID NO: 7321 - DNA, 1882 bp, Panicum virgatum
  misc_feature: Ceres CLONE 1907663
  misc_feature: Encodes the peptide sequence at SEQ ID NO. 7322
attcaaactctccctccccggattatctatccatctcctccaaaccgcaagagatttgggtcgggcgaggggtttcaaaccaaacaaacacctcaggtcaagtctaatccaatccaatccaacccaaatccggtgagctgcctgcccggccggagggggactagtatattgttattactactactatatataagcggccgtcgtcgctcctaccgccaccggacggacggaccctgctagctcctcggccctctcgtcgctgagctccgcagcctccgttgccgggaggaagagaggcagagcaagggggtgcggggatggcggaggaggcagtgcgggagctgcgcgcgagcttcgcggcggggcggacgcgcgcggcggagtggcgggcggcgcagctccgggcgctcgtccggatgatcgacgagcgggaggccgacatcaccgccgcgctccacgacgacctcgccaagccgcacgtggagtcgtacctgcacgagatatctctggcgaagtcctcgtgcaagttcgcgctcaacgggctcaagaactggatgaagcccgagaaggtacctgcggccataactacgttcccgtcctctgcgcaaatcgtgcctgagcccctcggtgtggtgctcgtcatctccgcctggaactaccctttcctgctctctattgacccggtaattggagcaatagctgctggaaatgctgttgttctgaagccatcagaaatagcgccagcaacctcgtcaatgttcgctaagctgctacctgagtatgttgacagcacatgtattaaagttgtggagggaggtgtttcagaaacgaccacgctcttggaacaaagatgggataagatcttctacacaggtagcgggactgtaggacgcatagttttggcagcagccgcaaagcatctgaccccggttgctctggagcttggtggaaaatgccctgctattgttgattctgacgttgatcttcatgttgctgttaagaggcttgctgttggcaagtggggatgtaacaatggccaagcatgcatcgctccagattacatcataacgacgaaatcatttgcaccagagctggtggactctttgaaaagagttctggagaggttctatgggaaggatcctctggaatcggtggatctatctcgcatcgttaattctaaacattttcagagattgacagaattgatagcagaaaagaaagtagctgacaagatcgtgtacggaggccagactgacgagaagaaactaaaaattgctcctacactattgttggatgtaccccaggatacagcactcatgacagcggaaatttttggccccttccttcctattgtgacggtcgagaagatcgaagatagcattgacgtggtgaactccaagaccaagccactggcggcctacctcttcaccaagaacaagaagctgcagcaggactttgtggcgaacgtccccgcgggaggaatgcttgtgaacgatgtcgcgctgcatctcacgaacccgtacctccccttcggcggcgtgggcgacagcgggacgggcagctaccacggcaagttcagcttcgactgcttcagccacaagaaggcggtcctgatccgcggcttcggcggcgaggcggcggcgaggtacccgccctacacgccggcgaagcagaagatcctgaggggcctcatcaacggcagcttcatcgccctcgtcctggcgctcctgggcttcccgagggagaggcgctaggctagacgatcgatcccccttccagttcagttcagtacaggcttttgctcgtgttcgtccggtgcagatatgcttcatgatggattcaatgaaacaaatttgatattataagtattattatttctttc

SEQ ID NO: 7322 - protein, 478 aa, Panicum virgatum
  misc_feature: Ceres CLONE 1907663
  misc_feature (1)..(419): Pfam Name: Aldedh Pfam Description: Aldehyde dehydrogenase family
  misc_feature (1)..(305): Pfam Name: Aldedh Pfam Description: Aldehyde dehydrogenase family
  misc_feature (10)..(438): Pfam Name: Aldedh Pfam Description: Aldehyde dehydrogenase family
  misc_feature (27)..(452): Pfam Name: Aldedh Pfam Description: Aldehyde dehydrogenase family
  misc_feature (1)..(431): Pfam Name: Aldedh Pfam Description: Aldehyde dehydrogenase family
  misc_feature (1)..(419): Pfam Name: Aldedh Pfam Description: Aldehyde dehydrogenase family
  misc_feature (1)..(419): Pfam Name: Aldedh Pfam Description: Aldehyde dehydrogenase family
  misc_feature (1)..(419): Pfam Name: Aldedh Pfam Description: Aldehyde dehydrogenase family
  misc_feature (27)..(452): Pfam Name: Aldedh Pfam Description: Aldehyde dehydrogenase family
  misc_feature (30)..(454): Pfam Name: Aldedh Pfam Description: Aldehyde dehydrogenase family
  misc_feature (2)..(472): SWISSPROT Homolog: EC 1.2.1.3 Aldehyde dehydrogenase 3H1
  misc_feature (6)..(476): SWISSPROT Homolog: EC 1.2.1.3 Aldehyde dehydrogenase 3I1, chloroplast precursor
MAEEAVRELRASFAAGRTRAAEWRAAQLRALVRMIDEREADITAALHDDLAKPHVESYLHEISLAKSSCKFALNGLKNWMKPEKVPAAITTFPSSAQIVPEPLGVVLVISAWNYPFLLSIDPVIGAIAAGNAVVLKPSEIAPATSSMFAKLLPEYVDSTCIKVVEGGVSETTTLLEQRWDKIFYTGSGTVGRIVLAAAAKHLTPVALELGGKCPAIVDSDVDLHVAVKRLAVGKWGCNNGQACIAPDYIITTKSFAPELVDSLKRVLERFYGKDPLESVDLSRIVNSKHFQRLTELIAEKKVADKIVYGGQTDEKKLKIAPTLLLDVPQDTALMTAEIFGPFLPIVTVEKIEDSIDVVNSKTKPLAAYLFTKNKKLQQDFVANVPAGGMLVNDVALHLTNPYLPFGGVGDSGTGSYHGKFSFDCFSHKKAVLIRGFGGEAAARYPPYTPAKQKILRGLINGSFIALVLALLGFPRERR

SEQ ID NO: 7323 - DNA, 1517 bp, Panicum virgatum
  misc_feature: Ceres CLONE 1907666
  misc_feature: Encodes the peptide sequence at SEQ ID NO. 7324
aaatcggtcgagagaggaggaagacgataaagtcaatcgtgcctgcgaggagtgagccagccttcttcttcttcttcttcttcttcttcttcttcttcgaggggaggggttaggctagcaagggggggacaggaagcgaggatgagcggagcaggcatggacggggcccccgccgccgagttccagccgacggtgacgcacggcggccggttcctccagtacaacatcttcggcaacctgttcgagatcaccagcaagtaccagccgcccatcatgcccatcggccgcggcgcctacgggatcgtctgctcggtgatgaactttgagacgagggagatggtggccatcaagaagatcgccaacgccttcgacaaccacatggacgccaagcgcacgctccgggagatcaagctgctcaagcacctcgaccacgagaacatcattggcatcagggacgtgatcccgccgccgatccctcaggcgttcaacgacgtgtacatcggcacggagctcatggacacggacctccaccacatcatccgctccaaccaggagctctcggaggagcactgccagtacttcctgtaccagatcctgcgcgggctcaagtacatccactcggcgaacgtgatccaccgggacctcaagcccagcaacctgctgctcaacgccaattgcgacctcaagatctgcgacttcgggctggcgcgcccctcgtcggagagcgacatgatgacggagtacgtggtgacgcggtggtaccgcgcgcccgagctgctgctcaactccaccgactactccgccgccatcgacgtctggtccgtcggctgcatcttcatggagctcatcaaccgccagcccctcttccccggccgcgaccacatgcaccagatgcgcctcatcaccgaggtgatcgggacgccgacggacgaggagctcgggttcatccggaacgaggacgcgcgcaagtacatgcggcacctgccgcagttcccgcggcggccgttcgcgaccatgttcccgagggtgcaacccgtggcgctggacctcatcgagcggatgctcaccttcaacccgctgcagaggatcacagttgaagaggcgctggaccacccgtacctggagcgactacacgacatcgctgacgagcccatctgcacggagcccttctcgttcgacttcgagcagcaggctctgaccgaggaccaaatgaagcagctgatcttcaacgaggccatcgagatgaacccgaatttccgatattagattgaatctccagatgtagggttcccatctgcttatgcatgtcgtttgtaaataggcgtaagattgaagaggcggctagactgaacattgcatttgtttgtttgttgagatgttcgagcccaccatcctatcagtgtaaggctgtgtaagctgttgctgctgattccaggcgttcttgtaatcgactataccaagaataaaaggtttggagcgtgattttcgagcatttcgaaaaaaaaaaaaaaaaaaaa

SEQ ID NO: 7324 - protein, 374 aa, Panicum virgatum
  misc_feature: Ceres CLONE 1907666
  misc_feature (6)..(374): SWISSPROT Homolog: EC 2.7.11.24 Mitogen-activated protein kinase 5
  misc_feature (8)..(372): SWISSPROT Homolog: EC 2.7.11.24 Mitogen-activated protein kinase 3
MSGAGMDGAPAAEFQPTVTHGGRFLQYNIFGNLFEITSKYQPPIMPIGRGAYGIVCSVMNFETREMVAIKKIANAFDNHMDAKRTLREIKLLKHLDHENIIGIRDVIPPPIPQAFNDVYIGTELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDEELGFIRNEDARKYMRHLPQFPRRPFATMFPRVQPVALDLIERMLTFNPLQRITVEEALDHPYLERLHDIADEPICTEPFSFDFEQQALTEDQMKQLIFNEAIEMNPNFRY

SEQ ID NO: 7325 - DNA, 1655 bp, Panicum virgatum
  misc_feature: Ceres CLONE 1907709
  misc_feature: Encodes the peptide sequence at SEQ ID NO. 7326
tttttctcctaacccagcaccagcagagcccagcttactcttccgatccctgtcagggcagttagccttcagctggtggaggatcatggtggccaagagcaggcgacaggtcgccaagctcgcgctgcttgcactcgccctgctcctcctcctcctcgccgccaccttgctgtgcgtcctcctgatcccgcgccaccgccggaagccgctgccgccgggcccgccgccggggaacgcctcgaaccccgacgacagcatcgtggcgttcgacttctccccgtacctcatcatgtacaagagcggccgcgtgcaccggctggacggcaccgcccggtgcgcggccggcgtcgacggggacacgggggtggcctccaaggacgtcgtcatcgacgccgggacggggctcgcggcgcggttgtacctgcccccggcgcccggcgggaagaccaaggacctcgccaggctccccgtgctcgtgttctaccacggcggcgcgttcgtcatcgagtccgccttcacgccgctgtaccacgcgtacctgaacgcggtgtcggccaaggcgcgcgtcgtggcggtgtccgtggagtaccgcctcgcgccggagcaccggctgccggcggcgtacgacgactcgtggcgggcgctcaactgggtggccaggaacgccgccgggtccgggccggagccgtggctgcgggaccggggcaacctgtcccgcctcttcgtggcgggggacagcgccggcgccaacatcgcgcacaacatggccatgcgcgcgggcacggaggaagggggcctggacggcggcgccgccatcgcggggctcctcctcctggacccctacttctggggcaagaagcccgtggccggggagacgacggaccgggcgacgcggcggcagtacgaggcgacgtggtccttcatctgcggcgggcggtacggcatcgacgacccgctggtgaacccgctgtcggcggagctgaggaggctggcgtgctcacgcgtggcggtgacgacgtcgggcctggacgacttccggccgcgcggcctggcgtacgcggcggcgctccggaacagcgggtggggcggggaggtcgagcagtacgagacgcccggcgagcggcacgtctacttcctggacaggcccaaggaccccaactccgtcaaggagctggccttcgtcaccggcttcctgagccgggagtagccatgactggcctagcagctagcgaggcagatcaggtcgtcggcgtaggtgcgcgatcgccaggatagcgctgcgctgcgctgcgctgcgctgcggtatagtatgattcatagtttgattgatactagtagattatcggcagagtagcatgttcttattgttttcttgcgtttggatcttcaatttttgacggggttctcgagaggtcacgaactgatgaggatctcgttaaatttggggatctcggaggttggaacacctcctctgtcaccgtgactccgtgcggaaaggtgcctgcaccgcgatactttccgtgcctgtagaggtcaggagaatcagggaaagtcgttgctgtgcttgtctgctactctgcttgggcaggaaatgctctcctccgctagaatcatgttctgggatcctgattggtcaaaaaaaaaaaaaaaaaaaa

SEQ ID NO: 7326 - protein, 373 aa, Panicum virgatum
  misc_feature: Ceres CLONE 1907709
  misc_feature (1)..(224): Pfam Name: Abhydrolase_3 Pfam Description: alpha/beta hydrolase fold
MVAKSRRQVAKLALLALALLLLLLAATLLCVLLIPRHRRKPLPPGPPPGNASNPDDSIVAFDFSPYLIMYKSGRVHRLDGTARCAAGVDGDTGVASKDVVIDAGTGLAARLYLPPAPGGKTKDLARLPVLVFYHGGAFVIESAFTPLYHAYLNAVSAKARVVAVSVEYRLAPEHRLPAAYDDSWRALNWVARNAAGSGPEPWLRDRGNLSRLFVAGDSAGANIAHNMAMRAGTEEGGLDGGAAIAGLLLLDPYFWGKKPVAGETTDRATRRQYEATWSFICGGRYGIDDPLVNPLSAELRRLACSRVAVTTSGLDDFRPRGLAYAAALRNSGWGGEVEQYETPGERHVYFLDRPKDPNSVKELAFVTGFLSRE

SEQ ID NO: 7327 - DNA, 1972 bp, Panicum virgatum
  misc_feature: Ceres CLONE 1907728
  misc_feature: Encodes the peptide sequence at SEQ ID NO. 7328
gcacccgcttcccttccttacttggactcgtcgtccgtccaccagtgttccatccatcagccctccacggctcggcctgatcgcaacacgtaaagtctagctcgatcaagatcgccgccgcaccgatggtgatgatgccggcggcggcgtcgccgggcgcgcggcggtccgtggtggcggagctggagggcgggctgctccggggcgcggacacgttcccctacttcatgctcgtggcgttcgaggcgtcgggcctgccgcgcttcgcggcgctgctggcgctgtggcccctgctgcggctgctggagctggccggccggggcggcctggcgctgcgcgccgcggcgctcgcggccaccgcgggggtgccccgggccgaggtggaggccgtgtcccgcgccgtgctgcccaagttcatggccgacgacgtcgacccgcgcgcctgggccgccttcggggcctgcgaggggaggcgcgtcgtcgtcgccacgcggctgccgcgcgtcatggtggagcgcttcgccagggagcacctcggcgcgcacgaggtggtcggctgcgagctcgagtacagccggctcaggcggtgcacggggctcctcaggggcggcgccgccgaggccgtcgcgggccgcgtccgcgcgctcttcgccggcggcgacagcccggacctcggcatcggccggtcagagatggcgcgctccttcttgccgttctgcaaggagcagctcgagccgccgttcaccgcgggcgccgcgacgacgagcgccgccgcgccgccgttccggccggtcatcttccacgacgggcgcctcgtgtgccgtcccacggcgctcatgtccctcgtcatcctcctctggctgcccctcggtgcgctggtcgccttcgtccgcatcgccgtcggcctcatggtgcccatctggaccatcccctacatcgcccccatcttcggcggcgccgtgatcacgcacggccgcgcgcctccccccgtccgccgtgccagcgacgccgccgccgcggaggacggcggctcgccctcggacgtgctcttcgtctgcacgcaccgcacgctcatggaccccgtggtcctggccaccgtgctcggccgccgcgtggccgccgtgacctactccatctcccggctgtcggaggctctgtccccgatcccgacggtgcggctgacgcgcgaccggggcgtggacgcggcgcggatgcgcgcggagctggcccggggcgacgtggccgtgtgccccgagggcaccacctgccgggagcccttcctgctccgcttctcggcgctgttcgcggagctcagcgaccggatcgtgccggtggcgatgaactaccgggtggggctcttccacccgacgacggcgcgcgggtggaaggccatggaccccatcttcttcttcatgaacccgcggcccgtgtacgaggtgacgttcctgaaccagctccccgcggaggcgacgtgcgcggcggggaggagccccgtggacgtggccaactacgtgcagcggatgctcgccgccacgctcgagttcgagtgcaccagcctcacgcgcaaggacaagtacagggtgctcgccgggaacgacggcatcgtcagcgccgccaagccggcggcgcccgggaaggcggcgtggcagagccgcgtcaaggaggtcctcggcttcctgctccactaaccagtagatcgatgcagagagacgacacgtcgtagctctggccaaatactcgatcggctcaccaatttcattgagttattatacacttatacatgtacgtatagtcacgtaaagaatgccctcctagcaaaaatacagtttttgtggccttttcttacacgaaatttaccctgtatattgatctgttcattttactttaatctgtaaatgcttttggcaaattctactggtttgtaattaaagattagatcgagttgttcctcgaaaaaaaaaaaaaaaaaaaa

SEQ ID NO: 7328 - protein, 520 aa, Panicum virgatum
  misc_feature: Ceres CLONE 1907728
  misc_feature (1)..(119): Pfam Name: Acyltransferase Pfam Description: Acyltransferase
  misc_feature (15)..(495): SWISSPROT Homolog: EC 2.3.1.15 Glycerol-3-phosphate acyltransferase 5
MVMMPAAASPGARRSVVAELEGGLLRGADTFPYFMLVAFEASGLPRFAALLALWPLLRLLELAGRGGLALRAAALAATAGVPRAEVEAVSRAVLPKFMADDVDPRAWAAFGACEGRRVVVATRLPRVMVERFAREHLGAHEVVGCELEYSRLRRCTGLLRGGAAEAVAGRVRALFAGGDSPDLGIGRSEMARSFLPFCKEQLEPPFTAGAATTSAAAPPFRPVIFHDGRLVCRPTALMSLVILLWLPLGALVAFVRIAVGLMVPIWTIPYIAPIFGGAVITHGRAPPPVRRASDAAAAEDGGSPSDVLFVCTHRTLMDPVVLATVLGRRVAAVTYSISRLSEALSPIPTVRLTRDRGVDAARMRAELARGDVAVCPEGTTCREPFLLRFSALFAELSDRIVPVAMNYRVGLFHPTTARGWKAMDPIFFFMNPRPVYEVTFLNQLPAEATCAAGRSPVDVANYVQRMLAATLEFECTSLTRKDKYRVLAGNDGIVSAAKPAAPGKAAWQSRVKEVLGFLLH

SEQ ID NO: 7329 - DNA, 1485 bp, Panicum virgatum
  misc_feature: Ceres CLONE 1907760
  misc_feature: Encodes the peptide sequence at SEQ ID NO. 7330
acagcccatccatcccttccctctctctctctctcctccctcttgcttgccatccgcaccaaagccaagaaccaactcatcggaggcagagaccacaggcagggaaaaggcaacgagggggggaggagaaatcatggagccgatttgctgtggagattcggccgcgtgatccggtcggatcttgctttcctggggggcgacggtgccatggtggccgcctcctatatccttctccgcgctgcttctgcttcccccgagatgccgcattagccaccactaagcagcgagcgccccgttcccagcggccgcaaggaagagacccacccgggaagcaggaacagccgttccgcggccatgacggtggtcgatgccgagtcgcggttccacgtcctcgcggtggatgacagcctcatcgacaggaagctcatcgagatgcttctcaagaactcgtcctaccaagtgaccaccgtcgattccgggagcaaggccttggagctgctgggattgagggacgaggctgccgagtcatcatcgccttcctcctcctcctcctcccctgaccaccaggagattgatgtgaacctgatcatcactgactactgcatgccgggcatgacagggtatgatctgctgaggagggtgaaggggtcctcctcattgaaggacattcctgtggtgatcatgtcctctgagaacgtgcctgcccggatcaacaggtgcttggaagatggcgcagaggagttcttcctgaaacccgtcaagctcgccgacatgaagaagctcaagtctcatctcctgaagaagaaacagcccaagaagtgtcagccgcagatccagccagagcccgagcagcggctggaggcaccgccacagccacagccacggccggcgcacaagccggaggaagccgtggcagaagtgatcgctgatggaacgacgacgacagccatcagcgactgcaacgccagcaacaagaggaaggcggcggccatggagcagcaggaggggctgacgtcgccggagagcaccaagccaaggctgtccaataacagcctggcagtggagacctgaaatagcaaccgaattgatcagccagaaccccctactaagaaattcttcttttgctgtttttttttttgtggaggctaatcatgggatggatgggtcactagctccttgggagggggttttagctcgaagtgaaaaacaattacggcatatacttatatagtaacttcttcggcctacaaattttgttgtgatcaggaacacccttgtgtgttcgttagaaagatgaagggaaaaaaaagggaagttgtagataaaggcagctcctttgggttgctcttgtttaggctaattttagcttggtgacggcttattatgccactgactggctcaaaggctgtgtgatgtgttttgcagaggtcgatggatcaatcggttaatgtggctcatttctgataaaaaaaaaaaaaaaaaaaa

SEQ ID NO: 7330 - protein, 238 aa, Panicum virgatum
  misc_feature: Ceres CLONE 1907760
  misc_feature: The sequence is a functional homolog of  SEQ ID NO 932 in the  10/666,642 US patent application
  misc_feature: Useful for making plants with modulated growth and phenotype characteristics
MTVVDAESRFHVLAVDDSLIDRKLIEMLLKNSSYQVTTVDSGSKALELLGLRDEAAESSSPSSSSSSPDHQEIDVNLIITDYCMPGMTGYDLLRRVKGSSSLKDIPVVIMSSENVPARINRCLEDGAEEFFLKPVKLADMKKLKSHLLKKKQPKKCQPQIQPEPEQRLEAPPQPQPRPAHKPEEAVAEVIADGTTTTAISDCNASNKRKAAAMEQQEGLTSPESTKPRLSNNSLAVET

SEQ ID NO: 7331 - DNA, 1629 bp, Panicum virgatum
  misc_feature: Ceres CLONE 1907789
  misc_feature: Encodes the peptide sequence at SEQ ID NO. 7332
aaatactgaagagttccgtcaagaacacccactctcaaaaaaaaaaaagaacacccactctctctctctctctctctctctctctctctctctctctcgtccccaccatggattcatttgcatgggcggcggtctctcagaccccggggctagccggcggcggcgccgccggctccgacgggcaaggcgggggtttcttgccgtcgatggccgggttccatctcccacctccggcctgtctcgaacacttctcggtggactccggcctcgtcgagcgggccgggcgctcgccctgtttcggcgctgcaaatggaacagcaaccaccgcaagcgcctccaacatcaccttggagggggcgtcggctcaccggagcaaggtcgccggcgggagcagcagtgtcagtggcgtccacgacgaggccggcaccggagactgctcctccggaggaccggagccggactacaagaatatgaatggatcaaacgaggacgttcttgggacggatcgagcgaaggcgtccaacgcgtccaccgattccgcaaacgagagctcgcgcagcaagggcgtcaaaggcgaagagaatggcctggccgcagcgacaggggtggccggcaagaggaaacggaatggatccaaggcgcctgacgaggaaggggaagggtacatccatgtcagggcccggaaggggcaggcaaccaacaggcacagccttgcagagaggttgagaagggagaagatcagcgagaggatgaagcttctgcaagaccttgttcctggttgcagcaaagtgaccgggaaggcggtaatgctggatgagatcatcaactacgtccagtccctgcaaaggcaggtcgagttcctatccatgaagcttgcggcggtcaatccacagctcggcctcaacatagaagggatcctgtcaaaagatcttattcgcttccctggtactcctccatctgctcccctcggattctcattgtcgcagtcaggcatggtccaggaaggcgttcatggattggccagttcgaatgggttcagaacagtcatgcaggagcaactaaatgagagagactcgttcagacagcatgtttctcagtctctggagcagatgcctcgcgccatggatggatggttccacaatgcagggcaaatagggtacagggcagtcatcaatccagaacatctaagcatcagccctgatcaggacgggtttcatctttgatgttcagctccagctccatatggatgttcaaagtttcttctcaccagcggacatgtagagagacaggcacataactagcatgtgcactggagtaactgcatagtgcaggagcaggacaagcttgaatgctccaggaaagttcagacggttgcaaccattgctccagggttgtacatggggttatgtaggctgtagctacgaatttatgatgttggaaaccctgtctggctgtctaggtggagtcttgagtgaatatccctgaagattaaatacctacgaaaataggcagaattgctgcacagcgcattttttagttccaaagtactgtttgtattattaacaacgtttgcaaaacagcaatggcaacatatattttcagattgaacaaaaaaaaaaaaaaaaaaaa

SEQ ID NO: 7332 - protein, 371 aa, Panicum virgatum
  misc_feature: Ceres CLONE 1907789
  misc_feature (1)..(51): Pfam Name: HLH Pfam Description: Helix-loop-helix DNA-binding domain
MDSFAWAAVSQTPGLAGGGAAGSDGQGGGFLPSMAGFHLPPPACLEHFSVDSGLVERAGRSPCFGAANGTATTASASNITLEGASAHRSKVAGGSSSVSGVHDEAGTGDCSSGGPEPDYKNMNGSNEDVLGTDRAKASNASTDSANESSRSKGVKGEENGLAAATGVAGKRKRNGSKAPDEEGEGYIHVRARKGQATNRHSLAERLRREKISERMKLLQDLVPGCSKVTGKAVMLDEIINYVQSLQRQVEFLSMKLAAVNPQLGLNIEGILSKDLIRFPGTPPSAPLGFSLSQSGMVQEGVHGLASSNGFRTVMQEQLNERDSFRQHVSQSLEQMPRAMDGWFHNAGQIGYRAVINPEHLSISPDQDGFHL

SEQ ID NO: 7333 - DNA, 1541 bp, Panicum virgatum
  misc_feature: Ceres CLONE 1907853
  misc_feature: Encodes the peptide sequence at SEQ ID NO. 7334
gttttcttttcttttctcttctcttttggaggaaggaagagagaagccacgcgaagccaagttcaagcgacgtccctccgagcgaggagataatggcgccgccgtcccggttgctgccgccgacgttgcagattctccggcaccgctgccacttgtccactgttgtctcgccgccgtccaaggccgtgctctacgacgagcacggtgcccccgagcaggtgctgagggtggcggatgcgccgcccgtccatctcggggaccgcgacgtctgcgtccggatgctggccgcccccatcaacccctccgacatcaaccgcatcgagggcgtctaccccgtgaggcccccgctccccggcgccgtcggggggtacgagggggtgggccaggtccacgccctcggccccgccgtcaccgccccgctctcccccggcgattgggtcataccgtccccgccctctttcgggacatggcagacctacatcgtcaagcaccagagtgtctggcacaaggtccgcagcgatgtgcccatggaatacgccgccaccgccaccgtcaaccccttgaccgcgctcaggatgctccaagaatttgtaaaactcaatcctggtgatgccattgtccagaatggtgctaccagcattgtcggccagtgcgtgattcagctcgccaagctacatggaattcacacaatcaacattataagggacaggccgggctcagaggaagcaaaagataaactcaaacaacttggtgcggatgaggtgttcatggaatctcagctagacatgaagaatgtcaagagcttgctgggtgctttaccagaacctgcattgggatttaactgcgttggaggaaatgccgcttctctgctactcaagtttctgaggcaaggaggcaccatggtgacttatggtggaatgtccaagcgacctgtcactgttcctacttcatatttcatttttaaggatatttccctgcgagggttctggctacagaggtggatgaactcagataaggcagaggattgcagaacaatgatagactacctcttgggcctggtgcacgaaggcaaactcaaatatgagatggagctgattccgttcggtgagttcagcttggctctggagaaggccctgggaaaacatggaagccagccaaagcaagttatgaggttctgagatgaaagataagaggggctatagggattatcaaagtatccctcccattgatgtgtacattcttacagttggttatgtcaaatgtttggcagagcgacttgggagttttgtgaaggaaaaaaggccgcgcagtcttgatgctagattcctgtccgagcgagttcatcgatctttcattgcaatgaactaatgaaggggctaagtgagtgaattaccacgagatagcagttgtacacatgggttgtgcgttaagtatttttgtttctggaatacgctatctgcgtcattagtttgtttaggcggatggttaatacgaatttaatagagatttgtttctaatagcaaaaaaaaaaaaaaaaaaaa

SEQ ID NO: 7334 - protein, 361 aa, Panicum virgatum
  misc_feature: Ceres CLONE 1907853
  misc_feature (1)..(86): Pfam Name: ADH_N Pfam Description: Alcohol dehydrogenase GroES-like domain
MAPPSRLLPPTLQILRHRCHLSTVVSPPSKAVLYDEHGAPEQVLRVADAPPVHLGDRDVCVRMLAAPINPSDINRIEGVYPVRPPLPGAVGGYEGVGQVHALGPAVTAPLSPGDWVIPSPPSFGTWQTYIVKHQSVWHKVRSDVPMEYAATATVNPLTALRMLQEFVKLNPGDAIVQNGATSIVGQCVIQLAKLHGIHTINIIRDRPGSEEAKDKLKQLGADEVFMESQLDMKNVKSLLGALPEPALGFNCVGGNAASLLLKFLRQGGTMVTYGGMSKRPVTVPTSYFIFKDISLRGFWLQRWMNSDKAEDCRTMIDYLLGLVHEGKLKYEMELIPFGEFSLALEKALGKHGSQPKQVMRF

SEQ ID NO: 7335 - DNA, 1595 bp, Panicum virgatum
  misc_feature: Ceres CLONE 1907938
  misc_feature: Encodes the peptide sequence at SEQ ID NO. 7336
agcctcaacctcaatcagaagaggttgcttcgcgttgtttcccccgtccggcggcggttcctctgactctgacgggatcgatcagaatcaccggcggcggttagccggcgagggcgaggggaggagccggcgacgggatggaggtgccgtggctgctggtggcgcacgggtcggtgacggcgctggtggtggtgtcgttcctgtgcgggcagtggcccatcttcgagggcaccttcgtccagagcatcaaccacttcctcaccttcggcgcttaccactacctcctgcggttcgtgcagtcggtgtgcggcaaaggggccagggatctcgtcctcggcgtcgagcagtactgctgcgaccggccaaacccgatcctgcaggtgttttatgttgccctaattggggtcacatattttataatagtgcagacatctttcgagtatattcctgggtattatattagtggatggcacagatattttagcatagttgctgttgctgttggtgctatactcttcgtgctcactagcttttctgatcctgggactgttactgctgagaatgtctctcaatatgtatctgcctacccatatgacaacgttatctttgtggagaaagaatgctctacttgcaagattcctagaccagccagggcaaagcactgcagaatatgtgataaatgctttgctcgatttgatcaccattgtggatggatgaataattgcattggggaaaaaaatactcgctattttgtggcctttttggtttggcattttcttatatgtgtgtatggcgcagtagtccttgccttaattcttgctggtgaactaaaagagaagaaagtcatctacattctcacagcttattatggtattgagaactcattctcgggattatttccacatgttgcacagtggttgcttgctgtgcataacacacagatacttctgagtgtatttttggctatactagcattgctccttggtggtttctgcacgtatcatgcacacctttgtttaaaaaatacaacaaccaatgagtcattcaaatggcaagactacgtcgtgtggatgaaaagggagaatgaagcaaaggcaaatgctgctgcactcaaggccagcatgggctcagctaacagcgatgcccacaaagctcctccaagcaaatggagggcattcttcgttaggtccagaagaccgactgtggaaccagttgtgaaaaacaacatatatgaccgaggcatgattagaaatatgtgcgaggtgattgtccctttgtcagagcggaagtcattttcccgcaggaaaacagactgagaccgactgttgttatagctgttgtatcaccaaactgttgtatatccatgtagaatttgcaaaaacatttttttcatatcagagggattgctgcaaaatatagatttccgactttgttcaggactgatgagatagcatcaaaatatagataaaaagttttgaaattccatttgtctgtaattttgtgcccttcctgaaacatctgtaatctgtcagaacaatgagcacttgctgcaacaaaagaggattaccgcattcgaaaaaaaaaaaaaaaaaaaa

SEQ ID NO: 7336 - protein, 392 aa, Panicum virgatum
  misc_feature: Ceres CLONE 1907938
  misc_feature (1)..(66): Pfam Name: zf-DHHC Pfam Description: DHHC zinc finger domain
MEVPWLLVAHGSVTALVVVSFLCGQWPIFEGTFVQSINHFLTFGAYHYLLRFVQSVCGKGARDLVLGVEQYCCDRPNPILQVFYVALIGVTYFIIVQTSFEYIPGYYISGWHRYFSIVAVAVGAILFVLTSFSDPGTVTAENVSQYVSAYPYDNVIFVEKECSTCKIPRPARAKHCRICDKCFARFDHHCGWMNNCIGEKNTRYFVAFLVWHFLICVYGAVVLALILAGELKEKKVIYILTAYYGIENSFSGLFPHVAQWLLAVHNTQILLSVFLAILALLLGGFCTYHAHLCLKNTTTNESFKWQDYVVWMKRENEAKANAAALKASMGSANSDAHKAPPSKWRAFFVRSRRPTVEPVVKNNIYDRGMIRNMCEVIVPLSERKSFSRRKTD

SEQ ID NO: 7337 - DNA, 1941 bp, Panicum virgatum
  misc_feature: Ceres CLONE 1907981
  misc_feature: Encodes the peptide sequence at SEQ ID NO. 7338
aaatccccaatgcgaaccttccaaagtccaaaccccacctcgccggagcggtaggccgccggccagcgagaggactcacttccgttccccgtcacccggaggtctgcctcgggtagtcgggtgagagggagcagaggatggagttcacggagccttacaagcagacgggcccatgctgcttctcccccgacgcgcgcttcctcgccgtcgccgtagactaccgcctcgtcgtccgggacgtcgtctccctgaaggtggtacaattgttttcatgtgtggataagataagctctctagagtgggctccagattcagaatatattctatgtggactttacaagcggcccatggttcaggcctggtcactgagccagcctgactggacctgcaagatcgatgaaggccctgcagggattgcatatgctcgctggagccctgacagtcgtcatatactcactacatccgagtttcagcttcgtctcaccgtgtggtctcttgtaaatacagcatgcgtgcatgtccagtggccaaagcatgcttctagaggtgtttcttttaccaaggatgggaagtttgctgcaatatgcaccaggcgcgactgcaaggactacataaatttgctctcatgtcattcctgggagataatgagtgtctttgctgttgatacagtagacttagctggtgttgagtggtcaccagatgatagtgctattgtcgtctgggattcacttcttgaatacaaggttctgatttattcgcctgatggaaggtgcctgttcaagtatctagcttatgaaagtgggttaggcgtgaaatctgttgcttggtcaccatgtggacagtttttagcagtgggcagctatgatcaagcagtgcgtactttgaaccatctgacatggaaaacttttgcggagttcacacatacagcctctattagaagtccctgtaatgcggctatatttaaggaagtggatgacccgtggcagcttgatatgtcagagttatgtcttagtgaaggcttctctcgtaacatgcaagacaatggtgctgaaaatggcactgagggaggaggttctagagtaaaatatgctgtgatggatgttcccatcaccttaccttccacgaaaccagctactgacaagcccaaccccaaacaaggaattggtatgctatcatggagcagtgacagccactatttcttcacccggaacgacaacatgccaactgctctttggatatgggatatttgtcgccttgagcttgcagcagtgcttgtgcagaaagacccaatccgtgctgccgcttgggaccctacctgcacacgcctcgttctgtgcacggagagctctcacctgtacatgtggacaccgtctggtgcctgctgtgtaaatatccccttgccgaatttccggatcgtcgacttgaagtggaattcagatgggagatgcctactcctgaaggaccgtgagtttttctgctgtgctgcaattgtatctgccctgcctgaggaaggacctgatcaatctgatgaaagttctgaagatgatgaatgatctcttcgtatgcgttgcttctgcatagtggaactggagccagcagtggagagagctacgttgtatgacatactagcagtaggtgaattcggggcgccaacttactgtaatcggtgtaggcggaaagatgaatgcttctttcgtctctaaactcctcgtacagatgatgctaccgttctactccctccgttccaaattgtatgtcgtttttaacaaatctagatacacaattgttactatgcatttagatacatttaaattatgtatgtagatttttcaaaaagacctacaatttggtagagggaatagatcatatttccgtgtattatgttctagattcgttatacctggtcaattttttttgctgtaaaaaaaaaaaaaaaaaaaa

SEQ ID NO: 7338 - protein, 471 aa, Panicum virgatum
  misc_feature: Ceres CLONE 1907981
  misc_feature (1)..(47): Pfam Name: DPPIV_N Pfam Description: Dipeptidyl peptidase IV (DPP IV) N- terminal region
MEFTEPYKQTGPCCFSPDARFLAVAVDYRLVVRDVVSLKVVQLFSCVDKISSLEWAPDSEYILCGLYKRPMVQAWSLSQPDWTCKIDEGPAGIAYARWSPDSRHILTTSEFQLRLTVWSLVNTACVHVQWPKHASRGVSFTKDGKFAAICTRRDCKDYINLLSCHSWEIMSVFAVDTVDLAGVEWSPDDSAIVVWDSLLEYKVLIYSPDGRCLFKYLAYESGLGVKSVAWSPCGQFLAVGSYDQAVRTLNHLTWKTFAEFTHTASIRSPCNAAIFKEVDDPWQLDMSELCLSEGFSRNMQDNGAENGTEGGGSRVKYAVMDVPITLPSTKPATDKPNPKQGIGMLSWSSDSHYFFTRNDNMPTALWIWDICRLELAAVLVQKDPIRAAAWDPTCTRLVLCTESSHLYMWTPSGACCVNIPLPNFRIVDLKWNSDGRCLLLKDREFFCCAAIVSALPEEGPDQSDESSEDDE

SEQ ID NO: 7339 - DNA, 1596 bp, Panicum virgatum
  misc_feature: Ceres CLONE 1907986
  misc_feature: Encodes the peptide sequence at SEQ ID NO. 7340
aaaaaaaaaaagggctctcgcttcttcgctcccttaatttatcactcctataaatataatttattttatttccgccttcttctcaactttagtatccccaactgtccccgcacctcagaaagtcagaacccggattgcttgtcagaataaaatttcgcacaagttcggattggccaatcggggatcctccggtctcctccccaatttcttgcgctccacgatcgcgcgcgacaggattttggcctgggttccgccgatttcgcctccgggcatggagcgccgcgggttgctaaaggcggctctttttctgtgcttgcttgctgtttgctccgggagagaacttacgatcaaacataacccctccactgccatatacaactccactcttgccaagatacttgtggagtatgctgctgcaatctatacggctgatttgacacaattatttaattggacatgtgctcgatgcggtgacttgattaaggggtttaagatgatacagatcgttgtagatgttgagaactgcttggaggcatatgttggttttgctagtgatattaatgctatagttgttgtgtttagagaaactcaagagaacagcatccagaattggatagaggatttgttatggaaacagcttgatcttgactaccctggtatgcctgaagcaatggtgcaccgagggttttattctgcctaccacaacacgacactacgtgacggaatagtcagtggtattaaaaagactaggaaattttatggagatattccaatcatgatcacggggcattcaatgggaggagctatggcttcattttgtgcatttgatcttgttgtgaactacggactggatggcgtaaaactgatgacatttgggcagcctcgtattggcaatgctgcttttgcttcttatttcaagacatacttgcctcatgcaattcgagttactcatgcccacgatatcgtgccccacctgccaccatacttctcattcttcccagagaagacctatcatcacttcccaagagaggtatggatccataacattggactaggaagcttagtctactctgtggagaagatctgtgatgattctggtgaagacccaacttgcagcaggtcggtaagtggaactagtgtgcgcgaccatatatactatctcggtgtcagcatgcatgcagaagactggagcagctgcagaatcgtcatggactacagcaaattgcagtatcagatggacctcaatggtaatgtcatattgtcgaagcagcctggtttgtcgaatgatagaggattcagtgcccagtgaacaagtgtatgatatgtatagtacgatagcatcacgaatcagtaatgtgagatagcactgcacagatattcccactcatctctgttgtgatgcttgctgttaaaatattcctgcatcaaaccggagggtgaaaggagcacgcagatttggatattcttggtgtaaatgtggttgcgcaatatattgttcagtttgcaaacatctgtgctgatattgacaaatgcgttgtgtattcaataattcatccaatctagtttgaacaacaacaaaaaaaaaaaaaaaaaaaa

SEQ ID NO: 7340 - protein, 345 aa, Panicum virgatum
  misc_feature: Ceres CLONE 1907986
  misc_feature (1)..(141): Pfam Name: Lipase_3 Pfam Description: Lipase (class 3)
MERRGLLKAALFLCLLAVCSGRELTIKHNPSTAIYNSTLAKILVEYAAAIYTADLTQLFNWTCARCGDLIKGFKMIQIVVDVENCLEAYVGFASDINAIVVVFRETQENSIQNWIEDLLWKQLDLDYPGMPEAMVHRGFYSAYHNTTLRDGIVSGIKKTRKFYGDIPIMITGHSMGGAMASFCAFDLVVNYGLDGVKLMTFGQPRIGNAAFASYFKTYLPHAIRVTHAHDIVPHLPPYFSFFPEKTYHHFPREVWIHNIGLGSLVYSVEKICDDSGEDPTCSRSVSGTSVRDHIYYLGVSMHAEDWSSCRIVMDYSKLQYQMDLNGNVILSKQPGLSNDRGFSAQ

SEQ ID NO: 7341 - DNA, 1420 bp, Panicum virgatum
  misc_feature: Ceres CLONE 1908008
  misc_feature: Encodes the peptide sequence at SEQ ID NO. 7342
acgtctcgcgcaccagctccaccgagagcgcaccaaacccgttgtaggggccacgccgaggccgaggccgagatgcggtggcggcgcagcctcgccgccgcgggcgtcctgctcgccgcgctggcgctcacaaccgcggggctgcgcccgacggccacggagcgcgggcagccgccgtcgggcgccgacgccagccggccgccgctgcggtttgggtcgggagggtcgttcaaggtggcgctcttcgcggacctgcattacggcgaggacgcgtggacggactggggccccgcgcaggacgccggctccgaccgcgtcatggccgccgtcctcgacgccgagaagcccgacttggtggtgtacctcggcgatctcgtgacggcgaacaacctcccgatccccaacgcgagcctctactgggacagggcggtttctgcggccagaggcagggggatcccgtgggcgaccgtgttcgggaaccacgacgacatgccattcgagtggccgcccgagtggttctcccctgacggcgttccgccgctgcgctgcccaccacccacgagcatgtccgcttcaggagcggatcaaggatgcagctttcgagggactccgcggattgatctcatcacagcagagatcagcaagaacaggctgtcctactcatccagcggccccaaggacctgtggcccagcgtctccaactacgtcctgcaagtgctctcacgctcccacgacgacccggctctgctcctgtatttccttgattccggtggaggatcgtacacggaggtcttatctagtgctcaggtcaagtggtttcagagccagtcgcaggtcctgaatccaaatggaaggatccctgagctgatcttttggcacataccaagcacagcatatgtcaaggtagctccaaaggccaaatctgaaattaggaagccctgtgttggctctatcaacaaggaggatgtggcgccacaagcagctgaatggggtatgatggatgctcttgcaaagaggccgtcagttaaggcaatctttgttgggcacaaccacgggctggactggtgctgcccgtacgagaagatgtggctatgttttgctcggcacaccggttatggaggttacggcaactggcccagaggagcaaggatcattcagataactgagaacccatcctcgactgtgtcatggatacggatggagaacgggacgaagcacagtgatgttacactaagctcctgaatctgcctgaatttcatgtacagaggagatttttttttttaagaaaaaaagagagaaagagaaccataggactgagtggttattttctgtaaattacaaagtgtgagccctgatttttttttggataaaatggtggggttgtattcccatttagttggaaaaaaaaaaaaaaaaaaaa

SEQ ID NO: 7342 - protein, 389 aa, Panicum virgatum
  misc_feature: Ceres CLONE 1908008
  misc_feature (1)..(272): Pfam Name: Metallophos Pfam Description: Calcineurin-like phosphoesterase
MRWRRSLAAAGVLLAALALTTAGLRPTATERGQPPSGADASRPPLRFGSGGSFKVALFADLHYGEDAWTDWGPAQDAGSDRVMAAVLDAEKPDLVVYLGDLVTANNLPIPNASLYWDRAVSAARGRGIPWATVFGNHDDMPFEWPPEWFSPDGVPPLRCPPPTSMSASGADQGCSFRGTPRIDLITAEISKNRLSYSSSGPKDLWPSVSNYVLQVLSRSHDDPALLLYFLDSGGGSYTEVLSSAQVKWFQSQSQVLNPNGRIPELIFWHIPSTAYVKVAPKAKSEIRKPCVGSINKEDVAPQAAEWGMMDALAKRPSVKAIFVGHNHGLDWCCPYEKMWLCFARHTGYGGYGNWPRGARIIQITENPSSTVSWIRMENGTKHSDVTLSS

SEQ ID NO: 7343 - DNA, 1646 bp, Panicum virgatum
  misc_feature: Ceres CLONE 1908069
  misc_feature: Encodes the peptide sequence at SEQ ID NO. 7344
gtctctccgctagctcttcctcctctcccagcctcacctcacatgctcgaatggcgacaatggcagcagcgcgtcttcttccccggtcgtcctcgtccaagctccagcagtgcagctttgctgtcctcctcctcttcttcttccagagctcgtgctgccacgcagcggctgtgggttacagccagcaggagggcgaccgggtgcggttcctccccgggcagccgccgcacccgccggtgtcgcagttcgcggggtacgtcacggtgaacgagcgcaacgggagggcgctcttctactggttcttcgaggcccaggcgtcgccggcgaaaaagcctctcctgctctggctcaatggaggacctggttgctcatcagttgggtatggagctgcttctgagttggggcctctcagggtcaccagccacggggcagggcttgagttcaacaagtttgcatggaacagagaggccaacttgctcttcctggagtctcctgttgggttcggcttctcctacaccaatacatcctctgacctgaccaaacttgatgacgccttcgtagctgaggatgcataccacttcctggtaaattggttcaagaggtttccacagtataagggacgcgatttttatatctctggagagagctatgcaggtcactatgttccacaacttgctgaacttgtctatgataggaacaaagataaggccagcacatatatcaaccttaaaggtttcatggttggtaatccactaactgatgattactacgactcaaaggggctagctgaatatgcttggagccactcagtagtgtcagatgaaatttacgagcgcatcaagaaggtgtgtgacttcagaatttcaaactggtccgatgattgtgataaagccatgagcactgtgttcagccagtaccacgagatcgatatttacaacatctatgcacccaggtgcaatcttcctaagtcatcagcagcacttgctgttgatcaagcacttacagctaacgatcaggaacatttcaggcgtaggattaggatgttctcgggatatgacccatgcttttcttcatatgcggagaggtacttcaataaggaagatgtgcagagagcattccatgcaaatgtcagtggaactcgaaaatggcaagtttgcagtgactcaattttaaggtcatacaatttttcggtactttccatcttacccatctactctaagctcatcaaagccggattgagagtctggctttacagtggagatgctgatggtagggtcccagtgataggatcgcggtattgtgtggaagccctgggcctgcctatcaagacacagtggcaaccttggtacctgaacaaacaggttgcgggaagatttgtggagtaccacggtatgacaatggttacaatcagaggagctggccatttggtgcccctcaacaaaccagaagaagggctcgcgcttattgacacattcctcctggggaaacagcttcccacacacagatgacaagaacgtttagggtcgcggtgagttttttttttcgaaaagcaattgtcaaggattggacaacataagcgccgaagcggagaacaacggaagagctttgaaagaaagcttaattttgattggggactgattattcct

SEQ ID NO: 7344 - protein, 485 aa, Panicum virgatum
  misc_feature: Ceres CLONE 1908069
  misc_feature (1)..(427): Pfam Name: Peptidase_S10 Pfam Description: Serine carboxypeptidase
  misc_feature (1)..(427): Pfam Name: Peptidase_S10 Pfam Description: Serine carboxypeptidase
  misc_feature (1)..(429): Pfam Name: Peptidase_S10 Pfam Description: Serine carboxypeptidase
  misc_feature (1)..(428): Pfam Name: Peptidase_S10 Pfam Description: Serine carboxypeptidase
  misc_feature (23)..(482): SWISSPROT Homolog: EC 3.4.16.6 Serine carboxypeptidase 24 precursor
MATMAAARLLPRSSSSKLQQCSFAVLLLFFFQSSCCHAAAVGYSQQEGDRVRFLPGQPPHPPVSQFAGYVTVNERNGRALFYWFFEAQASPAKKPLLLWLNGGPGCSSVGYGAASELGPLRVTSHGAGLEFNKFAWNREANLLFLESPVGFGFSYTNTSSDLTKLDDAFVAEDAYHFLVNWFKRFPQYKGRDFYISGESYAGHYVPQLAELVYDRNKDKASTYINLKGFMVGNPLTDDYYDSKGLAEYAWSHSVVSDEIYERIKKVCDFRISNWSDDCDKAMSTVFSQYHEIDIYNIYAPRCNLPKSSAALAVDQALTANDQEHFRRRIRMFSGYDPCFSSYAERYFNKEDVQRAFHANVSGTRKWQVCSDSILRSYNFSVLSILPIYSKLIKAGLRVWLYSGDADGRVPVIGSRYCVEALGLPIKTQWQPWYLNKQVAGRFVEYHGMTMVTIRGAGHLVPLNKPEEGLALIDTFLLGKQLPTHR

SEQ ID NO: 7345 - DNA, 1714 bp, Panicum virgatum
  misc_feature: Ceres CLONE 1908148
  misc_feature: Encodes the peptide sequence at SEQ ID NO. 7346
aacgaaaccaacggtcgtggtcgtccaaatccatctatccccttcgccgcagcctgccccgcgctccccggccgtgcgccaccacgaccatggccgcgctccaatcccagcaccaccacctcctcctgccgcgtcaccgtctgctctccctccgaccacctcctcctcgcctccgcgtgctgtcgaggtcccaccgcctgcttccccgcgcgcgcgcggtcagcgcggcggcagcgtcgaccgccgcgctggaggacttccggcggtggctttcctcccacggcgcggtcgaggggaaggcctccccggccgccgtgccggagggcctcggcctcgtggcggcgcgggacctgccgcgcggggaggtcgtcgcggaggtgcccaagaagctctggatggacgcggacgccgtcgcggcctccgacataggccgcgcgtgcggcggcggcggggagctccggccgtgggtcgccgtcgcgctgctgctgctccgggaggtcgcgcgcggggcggactcgccgtgggcgccctacctcgccatcctcccgcgccagaccgactccaccatcttctggtcagaagaagagctcctagagatacaaggaacacaattactgagcacaacaatgggtgtcaaagactatgtgcagagtgaatttgaaagcgttgaagctgagatcataaatgcaaacaaggacctcttccccggtaccataacatttgatgatttcctatgggcatttggaatactcaggtccagggtatttccagagctccgtggagataagcttgctctcataccgtttgctgatctggttaatcacagtgctgatattacctcagaagggtccagttgggagatcaaaggaaagggcctttttggtagggaagtcatgttctctttgcgaacaccagtggacgttaaatctggaaaacagatatatattcagtacgacctgaacaagagtaatgctgaactggcacttgactatggattcatcgaatcaaatccatcaaggaactcatatactgtgaccctggagatatctgaatctgatccattttacggagacaagcttgacattgcagagttaaacgggctgggggagagtgcctatttcgatatcgtcctcaatgaaccccttccacctcaaatgattacttacctgcgattactttgcattggcggaacagatgcatttctcttggaagcactcttcaggaattcagtttggggccaccttgaacagccagtcagtcctgacaatgaggaatcaatatgcaaggtcatgcgagatgcttgcaaatctgcccttggtgcctatcacaccacaatacaagaggatgaagaactattggaaacggaaaatttgcagccaagacttaaaatcgcgattggagtaagggccggcgaaaagaaagtactgcagcagattgatgatattttcaaacagagggaggaggaattggatggcctagagtactaccaggaaagaagactcaaggatcttggtttagtcggtgacaatggtgaaattattttttgggagacctagagatttttttttgttactcttatctgtccaatagcgctactgcaagaaatgcattctgatactgtcaagaattgcatggtaaaatggtctgtgtacttctgtgacataatcagcaaacagattgagaaaaattgaatcaaaaaaaaaaaaaaaaaaaa

SEQ ID NO: 7346 - protein, 488 aa, Panicum virgatum
  misc_feature: Ceres CLONE 1908148
  misc_feature (20)..(484): SWISSPROT Homolog: EC 2.1.1.127 Ribulose-1, 5 bisphosphate carboxylase/ oxygenase large subunit N-methyltransferase, chloroplast precursor
  misc_feature (54)..(487): SWISSPROT Homolog: EC 2.1.1.127 Ribulose-1, 5 bisphosphate carboxylase/ oxygenase large subunit N-methyltransferase, chloroplast precursor
MAALQSQHHHLLLPRHRLLSLRPPPPRLRVLSRSHRLLPRARAVSAAAASTAALEDFRRWLSSHGAVEGKASPAAVPEGLGLVAARDLPRGEVVAEVPKKLWMDADAVAASDIGRACGGGGELRPWVAVALLLLREVARGADSPWAPYLAILPRQTDSTIFWSEEELLEIQGTQLLSTTMGVKDYVQSEFESVEAEIINANKDLFPGTITFDDFLWAFGILRSRVFPELRGDKLALIPFADLVNHSADITSEGSSWEIKGKGLFGREVMFSLRTPVDVKSGKQIYIQYDLNKSNAELALDYGFIESNPSRNSYTVTLEISESDPFYGDKLDIAELNGLGESAYFDIVLNEPLPPQMITYLRLLCIGGTDAFLLEALFRNSVWGHLEQPVSPDNEESICKVMRDACKSALGAYHTTIQEDEELLETENLQPRLKIAIGVRAGEKKVLQQIDDIFKQREEELDGLEYYQERRLKDLGLVGDNGEIIFWET

SEQ ID NO: 7347 - DNA, 1395 bp, Panicum virgatum
  misc_feature: Ceres CLONE 1908182
  misc_feature: Encodes the peptide sequence at SEQ ID NO. 7348
accacaccacttctctcgtctctcccccgcctcgcccccacgaacccggagccctcgcccgctcaacagaagcctcagatctccgtcgccagcgccgccgctccgttcgtgtggaggcgagaggagaggaaatggcgagcgagggcgtgctcctggggatgggcaaccccctcctcgacatctccgccgtcgtcgacgacgccttcctcacgaagtatgacatcaagctcaacaatgccattctggccgaggagaagcacttgcctatgtatgatgagttggccagcaagagcaatgttgactatattgccggaggagccacccaaaactctatcagggttgcccaatggatgcttcaaactcctggtggaacgagttacatgggatgcatcggaaaggacaaatttggtgaggagatgaagaagaatgctcaagctgcaggagttactgctcactactacgaggatgagactgctcctacaggcacatgtactgtatgcgtcgttggcggtgaaaggtcattggttgcaaatctgtcggcagcaaactgttacaaatctgagcatctaaagagaccagagaactgggcactagttgagaaggcaaaatacatctacattgctggatttttccttacggtgtcgcccgattcaattcagctagttgctgagcatgctgcagcaaacaacaaggtgttcctgatgaacctttctgctcccttcatctgtgagtttttccgtgatgcccaagagaaggttctcccgtatgttgactacatcttcggaaatgaaactgaggcaaagatcttcgccaaagtccgtggttgggagactgagaatattaaggagattgctttgaagatctcccagcttcctctggcttcaggcaaacaaaagaggattgctgtcattactcagggtgctgatccagttgttgttgctgaggatggaaaggtgaaaacattccctgttatcctattgcccaaggagaagcttgtcgacaccaacggtgcaggtgacgccttcgttggaggcttcctctctcagttggtccagggcaagagcatcgaagactgcgtgagggccggttgctacgctgccaatgtcatcatccagcgctctggctgcacgtaccctgagaagccagacttcaactagagcaaactcaggcccgccatgagagggatcgttataggcaaacttattcttaaccgctgagtggttcggtgtgttcaacctgtattcttccgaggcttcttctgatccggccaatatttttgccgtgatatttgttgcacaactataaacgtcgatgttgtctctgtataaggcaggatttgccagcgtgctgtgttgcttcgctgatgcttgcaatgcaatcagaatgggtgaggtc

SEQ ID NO: 7348 - protein, 341 aa, Panicum virgatum
  misc_feature: Ceres CLONE 1908182
  misc_feature (3)..(316): Pfam Name: PfkB Pfam Description: pfkB family carbohydrate kinase
  misc_feature (1)..(293): Pfam Name: PfkB Pfam Description: pfkB family carbohydrate kinase
  misc_feature (1)..(317): Pfam Name: PfkB Pfam Description: pfkB family carbohydrate kinase
  misc_feature (1)..(317): Pfam Name: PfkB Pfam Description: pfkB family carbohydrate kinase
  misc_feature (1)..(317): Pfam Name: PfkB Pfam Description: pfkB family carbohydrate kinase
  misc_feature (3)..(317): Pfam Name: PfkB Pfam Description: pfkB family carbohydrate kinase
  misc_feature (3)..(316): Pfam Name: PfkB Pfam Description: pfkB family carbohydrate kinase
  misc_feature (3)..(316): Pfam Name: PfkB Pfam Description: pfkB family carbohydrate kinase
  misc_feature (3)..(317): Pfam Name: PfkB Pfam Description: pfkB family carbohydrate kinase
  misc_feature (3)..(317): Pfam Name: PfkB Pfam Description: pfkB family carbohydrate kinase
  misc_feature (4)..(341): SWISSPROT Homolog: EC 2.7.1.20 Adenosine kinase 1
  misc_feature (4)..(341): SWISSPROT Homolog: EC 2.7.1.20 Adenosine kinase 2
MASEGVLLGMGNPLLDISAVVDDAFLTKYDIKLNNAILAEEKHLPMYDELASKSNVDYIAGGATQNSIRVAQWMLQTPGGTSYMGCIGKDKFGEEMKKNAQAAGVTAHYYEDETAPTGTCTVCVVGGERSLVANLSAANCYKSEHLKRPENWALVEKAKYIYIAGFFLTVSPDSIQLVAEHAAANNKVFLMNLSAPFICEFFRDAQEKVLPYVDYIFGNETEAKIFAKVRGWETENIKEIALKISQLPLASGKQKRIAVITQGADPVVVAEDGKVKTFPVILLPKEKLVDTNGAGDAFVGGFLSQLVQGKSIEDCVRAGCYAANVIIQRSGCTYPEKPDFN

SEQ ID NO: 7349 - DNA, 1471 bp, Panicum virgatum
  misc_feature: Ceres CLONE 1908257
  misc_feature: Encodes the peptide sequence at SEQ ID NO. 7350
actcgaagcagagggaacgaacccgatggccgccgccgcgcccacgccatccccattcgtcgcctccacccgccgcttcgcccctcgcctccgctccctcatccccggggccgccatgtcacccgccgcctcttccgccccaaaccccagctccggcgccggcgaggaggcgcaggcgcaggcgcccccgctcccgcactcgaccctcgagatcgccggggcgcggcggggcgtcctctccggcttcgccagcctccgcaccccgtaccgcgcgttccccgtgctcgcgttgaatcgacacgtcgagaccatcttcgccgcgttcacgcggtcgctccccgccgtcaagctgcggcgcgagtgcctccgcggccccgacgacggagccgtcgcgctcgactgggtcgcgggcgacgaccgcgcgcttcccagggatgcgccggtgctcgtactcttgcctggtctaacaggggggagtgatgatacatatgtaaggcacatgcttatgacagctagaagaaagggatggcgtgttgtggtatttaatagccgaggatgcgcagacagtcctgtgaccacacccaagttctattctgcttcatttactggggatctccgccaagtaattgatcatgttttatgccgttatccccaatctaatgtctatgctgttggttggtctcttggagcaaatattcttgtgcgctaccttggcgaggaaactgataaatgccctttatctggtgcagtctccttgtgcaatccatttaacttggtaattgcagatgaagatttccacaaagggtttaataacgtctatgatagagcattggctagggccctgagaactatatttaagaagcatgcactccttttcgaagatattgagggtgaatatgatatacccaaggcagcaaatgcaaggactgttagagactttgatgaggggctaacccgagtttcttttggtttcaagtcagtagatgattattactccaattcaagcagctccgattccattaaaaatgtttgcatacccttattatgcatacaggcggataatgacccaattgcaccatctaggggaattcccagagaagatatcaaggcaaatccgaattgcctacttatagtaacaccgaaaggtggccatcttggatgggtagcgggtgatgaagctccattcggatgtccgtggactgatccgattgtgatggaatatctagagtatcttcagagcgaaaagaactcaagtaccaaaaacaacataccctatgatcagcaaggtgtttcagaggcatcagcaccccatctgaccgtacatgtacaaacatagcagcatttcccttccccgaatgctcccactggctatgtatctcatatgcaaatagttagatcatttagcttgcctactctgccggcgggattggcacattgctacagaggtatatacgtcccgtaattctgctcc

SEQ ID NO: 7350 - protein, 436 aa, Panicum virgatum
  misc_feature: Ceres CLONE 1908257
  misc_feature (1)..(210): Pfam Name: Abhydrolase_1 Pfam Description: alpha/beta hydrolase fold
MAAAAPTPSPFVASTRRFAPRLRSLIPGAAMSPAASSAPNPSSGAGEEAQAQAPPLPHSTLEIAGARRGVLSGFASLRTPYRAFPVLALNRHVETIFAAFTRSLPAVKLRRECLRGPDDGAVALDWVAGDDRALPRDAPVLVLLPGLTGGSDDTYVRHMLMTARRKGWRVVVFNSRGCADSPVTTPKFYSASFTGDLRQVIDHVLCRYPQSNVYAVGWSLGANILVRYLGEETDKCPLSGAVSLCNPFNLVIADEDFHKGFNNVYDRALARALRTIFKKHALLFEDIEGEYDIPKAANARTVRDFDEGLTRVSFGFKSVDDYYSNSSSSDSIKNVCIPLLCIQADNDPIAPSRGIPREDIKANPNCLLIVTPKGGHLGWVAGDEAPFGCPWTDPIVMEYLEYLQSEKNSSTKNNIPYDQQGVSEASAPHLTVHVQT

SEQ ID NO: 7351 - DNA, 1551 bp, Panicum virgatum
  misc_feature: Ceres CLONE 1908328
  misc_feature: Encodes the peptide sequence at SEQ ID NO. 7352
agggggcgtgcaaagcctggtggcgcacccggatcgggatcccgtccctttcccctcgcccaaaagccggaaccgctcttgaaatagccccccgtctccgcggccgccgcccaccgccccgccaacccaaccattcgccccgccacccccgatcgatctcgtccctcgtagcatctcctcctcacgcgcgcatcgaccatgtcggcctactgcggaaagtacaaggacgagctcatcaagaacgccgcctacattggcacccctggcaagggtatccttgctgctgatgagtccactggcactattggcaagcgcctttccagcatcaatgtcgagaacattgaggagaaccgccgtgccctccgtgagctcctcttctgcgcccctggtgccctccagtacctcagtggtgtgatcctctttgaggagaccctctaccagaagaccaaggatggcaagcccttcgtcgatgtccttaaggagggaggtgtcctccccggcatcaaggtcgacaagggtaccattgaggttgctggcaccaacaaggagaccaccacccagggccatgatgaccttggcaagcgctgtgccaagtactacgaggctggtgcccggtttgccaagtggcgtgctgtcctcaatatcggccctaatcagccatcacagcttgccattgacctgaatgctcagggtctcgctcgttacgccatcatctgccaggagaacggtctggtgccgattgttgagcctgagatccttgttgatggtccgcatgacattgagcgctgcgcttatgtcaccgagatggtccttgctgcctgctacaaggctctgaatgagcaccatgtcctcctcgagggtaccctcctgaagcccaacatggtcacccctggatctgatgccaagaaggtggcccctgaggtgattgccgagtacactgtacgtgcccttcagaggactgtccctgctgctgtgcctgccattgtcttcctctctggtggacagagcgaggaggaggccaccctgaacctgaatgccatgaacaagctcaacaccaagaagccatggtccctgtccttctcctttggccgtgcccttcaggcgagcaccctcaaggcctgggctggcaaggaggagaatgtggagaaggccagggctgccttcctcaccaggtgcaaggccaactcagaggccaccctcggcacgtacaagggtgatgctgctgccggcgagggcgtctcagagagcctccacgtcaaggactacaagtactgatctgctccccttttggacctgctggctacgagcatttaggtgagtttagtttgcccgtcagagcgtggttggacagcgaaactcctttgtaataatcctgaacttatgcttcccttttgtggatgatggttggctacttattattcgtatattagtctttttggtggtaatctcgtgtatgcctcagctactttttgttctgtcgttgctgtaatgctggttatataatggaaaaaaccacttggtttgtagtcagaaaaaaaaaaaaaaaaaaaa

SEQ ID NO: 7352 - protein, 358 aa, Panicum virgatum
  misc_feature: Ceres CLONE 1908328
  misc_feature: Great-hit functional homolog of the protein sequence given in SEQ ID NO 9254
  misc_feature (1)..(347): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(347): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(349): Pfam Name: Glycolytic Pfam Description: Fructose-bisphosphate aldolase class-I
  misc_feature (1)..(352): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(348): Pfam Name: Glycolytic Pfam Description: Fructose-bisphosphate aldolase class-I
  misc_feature (1)..(358): SWISSPROT Homolog: EC 4.1.2.13 Fructose-bisphosphate aldolase cytoplasmic isozyme
  misc_feature: Useful for making plants with modulated phosphate use efficiency
MSAYCGKYKDELIKNAAYIGTPGKGILAADESTGTIGKRLSSINVENIEENRRALRELLFCAPGALQYLSGVILFEETLYQKTKDGKPFVDVLKEGGVLPGIKVDKGTIEVAGTNKETTTQGHDDLGKRCAKYYEAGARFAKWRAVLNIGPNQPSQLAIDLNAQGLARYAIICQENGLVPIVEPEILVDGPHDIERCAYVTEMVLAACYKALNEHHVLLEGTLLKPNMVTPGSDAKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 7353 - DNA, 1147 bp, Panicum virgatum
  misc_feature: Ceres CLONE 1908333
  misc_feature: Encodes the peptide sequence at SEQ ID NO. 7354
acactcgagtatccatccagtctccactgttcagtggcccacttgtcatgtcctcgtcggccactccacgctcggcggcaccggcgccgccgcacgtcgtcgaggactgcttcggcgtcgtgcagctgctcagcgacggcacggtgcggcggtccacggattactcggcgctcccgctcgtcggcggcgtgccgccggacctgcccgtggagtggaaggacgtcgtctacgacgacacgcacgacctccggctccggatgtaccggcccaccaccaccggcggcggcgggggcggggagaagcagaggaagctgccggtgctcgtgtacttccacggcggcggcttctgcctcgccagcttcgagctgatcaacttccacgccggcgcgctccggctcgccgccgagctcccggcgctcgtgctctccgccgactaccgcctcgcgcccgagcaccgcctccccgcggcgctcgacgacgccgagtccgccttctcctggctccgcgcccaggccaccgcgtcccccgccgccgccgacccgtggctcgccgagtcggccgacttcggccgggtgttcgtgatcggcgactccgccggcggcaacatctcgcaccacatctcggtgcgccacggctccggccggctccccctcggccccctccggctcgccgggtgcgtgatgctctggccctacttcggcggcgaggagccgacgccgtccgaggcggcgtccccgcccggcgagcccctaggcacggcgctgttcgaccagatgtggcgcctggcgctgccgccgggcgcgaccaaggacaacccggccgcgaacccgttcgcgccggggagcgtcccgctcggcgacctcggcgacgacttcccgccggcgctcgtgctggaccctgaccaggacgcgctgcacgaccgcgtggcggactacgtcgccaggctgagggccgccggcaaggccgtcgagctcgtcgtcttccccgggcaggggcacgcgttcttcgtcacggagccgtgcggggaggcctcggacgagctgatccgggtcgttaggcgtttcgtgcacggtggttaactgatgaattgtaatcttgtctgcgtgtctaataatatgccaaattttaaaaaaaaaaaaaaaaaaaa

SEQ ID NO: 7354 - protein, 343 aa, Panicum virgatum
  misc_feature: Ceres CLONE 1908333
  misc_feature (1)..(231): Pfam Name: Abhydrolase_3 Pfam Description: alpha/beta hydrolase fold
MSSSATPRSAAPAPPHVVEDCFGVVQLLSDGTVRRSTDYSALPLVGGVPPDLPVEWKDVVYDDTHDLRLRMYRPTTTGGGGGGEKQRKLPVLVYFHGGGFCLASFELINFHAGALRLAAELPALVLSADYRLAPEHRLPAALDDAESAFSWLRAQATASPAAADPWLAESADFGRVFVIGDSAGGNISHHISVRHGSGRLPLGPLRLAGCVMLWPYFGGEEPTPSEAASPPGEPLGTALFDQMWRLALPPGATKDNPAANPFAPGSVPLGDLGDDFPPALVLDPDQDALHDRVADYVARLRAAGKAVELVVFPGQGHAFFVTEPCGEASDELIRVVRRFVHGG

SEQ ID NO: 7355 - DNA, 1227 bp, Panicum virgatum
  misc_feature: Ceres CLONE 1908343
  misc_feature: Encodes the peptide sequence at SEQ ID NO. 7356
aggctggccactggaaaacgggagggaccgagggagcgcaaaggcaaaaggctattatccaatcggcgcggcgagtgcgcatcgcatcggcacaggcgcacagcccaccaccaccccaccccaccggggaagggaagggaagggatagactactactagtagaagaagcgaggcgcttccctgcccgcccctggggaggcggggcgctggggcggaggccgccgcgatgggctccgccgtgtcgtcgagcatggcgcttgcgctcgcgggcttctgcttcagcgtcatcttcatcgtcttcgtctgcacccgcctcgcctgcgcgctcctccgccgccgccgcgcccgctcccgccgcgccgcggcgctcccccagttcgccgccgtctcccactactcgttcgccgcccacgccgcacgccactccgccggcggcgccagcggcgggggcctcgatcccgacgcggtcgccgccttacccacccgcgccttcgccgccggcccgcgcggctcgggcgcctccgatgccgattcccagtgcatcatctgccttgcggaatacgaagagaaagatgtgctacgcattcttccttactgcagccataatttccacatggcctgtatagatttgtggctggagcagaacacaacctgcccagtctgcagagtctcattgcttgatatccctgatagtgaacagacggcacctcctccacttcccagcgtagtgataagctgtccaagctctcctgaatcgtcaagatctgatccgtgtcgctgcctgtttgtcagcacaggacattcatccagggcatcagaggctcctagacatgagcccgaccaggagaatcaggtggcatccgcaccatcaatggatgggcctaacaacatgcccttgtctgaagttaacccccctcctgaaaataacaaccaagcagtaagaaagcaggtggacagatctacccagctagggccctgcaaatagcagctgccttggcgtctccgttgtctccgctctgcacagaactgcagagcgaagttccagtaaaatgtgaaacatctgcactggtggatggctgttgtaggtctagctttgaggggtttgttgtaaatatgagaaatcattcaggtttcttgttggagaaagaaaagagagggagcacattttattagttttgagtcatacaggaaacagcaaattgcatccaaaaaaaaaaaaaaaaaaaa

SEQ ID NO: 7356 - protein, 252 aa, Panicum virgatum
  misc_feature: Ceres CLONE 1908343
  misc_feature (1)..(42): Pfam Name: zf-C3HC4 Pfam Description: Zinc finger, C3HC4 type (RING finger)
MGSAVSSSMALALAGFCFSVIFIVFVCTRLACALLRRRRARSRRAAALPQFAAVSHYSFAAHAARHSAGGASGGGLDPDAVAALPTRAFAAGPRGSGASDADSQCIICLAEYEEKDVLRILPYCSHNFHMACIDLWLEQNTTCPVCRVSLLDIPDSEQTAPPPLPSVVISCPSSPESSRSDPCRCLFVSTGHSSRASEAPRHEPDQENQVASAPSMDGPNNMPLSEVNPPPENNNQAVRKQVDRSTQLGPCK

SEQ ID NO: 7357 - DNA, 1176 bp, Panicum virgatum
  misc_feature: Ceres CLONE 1908420
  misc_feature: Encodes the peptide sequence at SEQ ID NO. 7358
ttcctccaagtcttccattccttccagtaccttctcccctccctccccagtccccactaagcaacccccaaagctagctctcccctcccctcccctcccctcccttgcgatcggagatcccgcgatgcaggccccagcgcccccttcctccgtcgacctgccgctggcggcgccgccgccgccggtgaaggcgccgaccccgcgtccgcccccgccggcctcgctccagcccgagtccccgggggtcttcttctccgcggcggcggccgcgctgccctcgggctccgcccaccgccgcatcgccatcgccgtcgacctctccgacgaatccgcctacgccgtgcgctgggccgtcgccaactaccttcgccccggggacgccgtcgtcttgctccacgtgcgccccacctccgtgctctacggcgccgactggggcgccgtcgacgtctccctccccaaccctagagacggcgacgagggcgacgacgacgacgaggccgccgcgcgcaggatggaggatgactacgacgccttcacggcctccaaggccgacgacctcgccaggccgctcaaggacgcgggcatcccctataagatccacatcgtcaaggaccacgacatgaaggagcgcctctgcctcgaggtcgagaggctcgggctcagcgcggtcatcatggggagcaagggcttcggcgcctcgcggaggaccagcaaggggaggctcggtagcgtcagcgactactgtgtccaccactgtgtctgccccgtcgtggtggtgcgcttccctgacgaaggctcctcggaggatggggaggctggtggcctgtcgtcagcggtgggtgcggaggatgtgctgcaccctgtgcccgaggaggatgccgagtaccatgatgctactgaggagcacaaggatacttgattgtgttgatgaattgtgaagtgaagtgcacttggatccagcatgtaaaggttctactgttggctgggtgctagctgggaagtgcatgtggtgttgaactttcattgcccatgtctatgtctatctttgctttcacgttgtttgtatcttcagttgcctttgttcacgtagcttgtttgactatttgactgcctggtgatatttgtggttgaaaaactttgtactttcttcacacagaaaaaaaaaaaaaaaaaaaa

SEQ ID NO: 7358 - protein, 264 aa, Panicum virgatum
  misc_feature: Ceres CLONE 1908420
  misc_feature (1)..(170): Pfam Name: Usp Pfam Description: Universal stress protein family
MQAPAPPSSVDLPLAAPPPPVKAPTPRPPPPASLQPESPGVFFSAAAAALPSGSAHRRIAIAVDLSDESAYAVRWAVANYLRPGDAVVLLHVRPTSVLYGADWGAVDVSLPNPRDGDEGDDDDEAAARRMEDDYDAFTASKADDLARPLKDAGIPYKIHIVKDHDMKERLCLEVERLGLSAVIMGSKGFGASRRTSKGRLGSVSDYCVHHCVCPVVVVRFPDEGSSEDGEAGGLSSAVGAEDVLHPVPEEDAEYHDATEEHKDT

SEQ ID NO: 7359 - DNA, 1475 bp, Panicum virgatum
  misc_feature: Ceres CLONE 1908472
  misc_feature: Encodes the peptide sequence at SEQ ID NO. 7360
gctcgctctactgcctcccctgctgcagatatcacaagcttttcctgctgcacctgcagcttctccatctgcagtgcgagcagctgctaaattccccataagcgcctgccctcctgcccccagcacagcacgaggatcgatcattcactcactacagtggcgtactagatttccacttgtgcgcacacagcggcagcaggaggcgtgcatagtggtgatgcacaggtgagctgctgcgggcggccgccgctaggctagctccatggaggatctgtacagcatccacccggggatctcgcgggccggcggcgcggcgagcgaggcgtccgtcgccggcgccggcggtgcggcggcgccgtcggatctgacggagctcatgaaggcgcagatcgccagccacccgcgctacccctccctcctctccgcctacatcgagtgccgcaaggtgggagcgcctccgcaggtggcgtcgctgctggaggaggtcagccgggagaggcgcggcggcgccggcgagatcggcgtcgatcccgagctcgacgagttcatggactcgtactgccgggtgctggtgcggtacaaggaggagctgtcgcggccgttcgacgaggccgcgtcgttcctgagcagcatccaggcgcagctcagcaacctctgcagcggcggcagctcgccggcggcgacgaccgccacgcactccgataacatgatggggtcctcggaggatgagcaatgctcaggggacacggatgtgccagacatagggcaagaacacagctcccgcttagctgaccatgagctcaaggacatgctgctcaagaagtacagtggatgcctcagtcgtcttcggtcagagttcctgaagaagcggaagaaagggaagctaccaaaagatgcaaggacggtgttgctggagtggtggaacacgcactaccgctggccttatcctacggaagaagataaggtgaggctcgcagcgatgactggcctcgaccctaagcagatcaacaattggttcatcaaccagaggaagaggcattggaagccgtcggaggacatgcgattcgcgctcatggagggcgttgctgggggatcttctgggacagcactctacttcgacactggcacaatcggaccctgaaccggcctccacttcttgggcagaaaactggccagctcaatcagtagcctgacctggattgtgaagatcatcaatctgccgggtcaaaattgacaataaatatctgccatcctgaaattgtcaaattagcccactgcctcattattttgcaagatcatgtgtatatggtgtcgtcgtaatgaaacaaaatgtatgtacgagcaaatttggaagaactgcaaacgcattttattagtagtttcgtgtatcggctgtaatactggctatccaatttaattgttagataggctgaagggctaggtaattaaagttacttgtgctgttccgttgttcg

SEQ ID NO: 7360 - protein, 292 aa, Panicum virgatum
  misc_feature: Ceres CLONE 1908472
  misc_feature (1)..(59): Pfam Name: Homeobox Pfam Description: Homeobox domain
  misc_feature: The sequence is a functional homolog of  SEQ ID NO 2674 in the  10/374,780 US patent application
  misc_feature: The sequence is a functional homolog of  SEQ ID NO 76 in the  10/225,066 US patent application
  misc_feature: Useful for making plants with modulated growth and phenotype characteristics
MEDLYSIHPGISRAGGAASEASVAGAGGAAAPSDLTELMKAQIASHPRYPSLLSAYIECRKVGAPPQVASLLEEVSRERRGGAGEIGVDPELDEFMDSYCRVLVRYKEELSRPFDEAASFLSSIQAQLSNLCSGGSSPAATTATHSDNMMGSSEDEQCSGDTDVPDIGQEHSSRLADHELKDMLLKKYSGCLSRLRSEFLKKRKKGKLPKDARTVLLEWWNTHYRWPYPTEEDKVRLAAMTGLDPKQINNWFINQRKRHWKPSEDMRFALMEGVAGGSSGTALYFDTGTIGP

SEQ ID NO: 7361 - DNA, 1153 bp, Panicum virgatum
  misc_feature: Ceres CLONE 1908506
  misc_feature: Encodes the peptide sequence at SEQ ID NO. 7362
ggacttctatgtaaaggcaccccacctccttggccttgtcctctgcctcctccctctccccagtccccactcgcgaactcacgagctcagcagcagcgcccaaagacaaacctcgagcccatccctcctcttgacacctcactcccccaagaacccagtattccaggagttggtgatgctcgtggagtttggctagacatggcgcctccacaggagcgggattacatcgggctgtcgccggcgacggcggccaccgagctgcgtctggggctgccgggcacggaagaggcggagggccgcaacgcggtggcggggacgccgctcaccctcgagctgcttcccaagggcggggccaagcgcggattcgcggacgccatcgtgcggcgggacgcggctgcaacaggcaaggcgccggcggacgacgaggaggtggacaagaagaaggcgcaggctccgacggcaaaggcacaggtggtaggatggccaccaatccgcggctacagaaagaacaccatggcgatgaaccaggattgcctctatgtcaagattagcatggatggtgctccatacctcaggaaggtggaccttaagatgtacagcaactacaaagagctctcactggcgctggagaaaatgttcagctcctttactgttggtgatattgaatctaacgggaaatcaggaagagaaggattatctgattgccgactaatggatcataaaaatggcactgaacttgtgctcacatataaggacaaggatggagattggatgcttgttggtgatgtcccgtggagaatgttcacgggcagctgtagaaggctcaggatcatgaagggctcagatgcagtgggccttgcacccagagccactgagaagagcaagaacggtaactaggaaaaggatgaatgcgctctactccctacagcctcatcctactcttacctgtaaggtcccattctcaaacccacaaggttaaaggacttaacatgtgagaaggggattacttatatcaatatgtacacctatggattttgttttgccccccttattttgctttttttttgtttggactcagatatgttagattgcaaacataagatgtgtgattatgtctatgtctgtcaccgtgcaaaaaaaaaaaaaaaaaaaa

SEQ ID NO: 7362 - protein, 232 aa, Panicum virgatum
  misc_feature: Ceres CLONE 1908506
  misc_feature (140)..(294): Pfam Name: AUX_IAA Pfam Description: AUX/IAA family
  misc_feature: The sequence is a functional homolog of  SEQ ID NO 652 in the  11/479,226 US patent application
  misc_feature: Useful for making plants with modulated growth and phenotype characteristics
MAPPQERDYIGLSPATAATELRLGLPGTEEAEGRNAVAGTPLTLELLPKGGAKRGFADAIVRRDAAATGKAPADDEEVDKKKAQAPTAKAQVVGWPPIRGYRKNTMAMNQDCLYVKISMDGAPYLRKVDLKMYSNYKELSLALEKMFSSFTVGDIESNGKSGREGLSDCRLMDHKNGTELVLTYKDKDGDWMLVGDVPWRMFTGSCRRLRIMKGSDAVGLAPRATEKSKNGN

SEQ ID NO: 7363 - DNA, 1439 bp, Panicum virgatum
  misc_feature: Ceres CLONE 1908508
  misc_feature: Encodes the peptide sequence at SEQ ID NO. 7364
attcatctcatcagggccatatatgttcaactactgcaactactatatatcatcacatgccatgcgtgtgtaagcaagctacttaagttgcaggcagggggccgggtctttctagtagtcgtcgtcttacaccagcagctggctagctagctccgacgatgactagctgcttcaacggcggcgccggctggccggagcccgtggtgcgcgtgcaggccgtgtcggacacttgcggcgccacgatcccggagcgttacgtgaagcccctgtcggagcggccgtcgctctcgccagccgccgccggtggcgccgggggcggcccgaacatcccggtggtagacctgtcaatgccggacgcggacgcgacgtccgaagccgtggcggcggcgtgccgggagtggggatttttccaggcggtgaaccacggcgtgcgcccggagctgctgcgcagcgcgcgcgcggcgtggcgcggcttcttccggcagcccgcggaggtgcgcgagcgctacgcgaactcgccggcgacgtacgagggctacggcagccgcctcggcaccgccaagggcggccccctcgactggggcgactactacttcctccacctcctgccgccgtccctcaagagccacgacaagtggccgtccctccctgcctcgctacgggaggcgacggaggagtacggcgaggaggtggtgcagctgtgccggagggtgatgcggctgctgtcgacggggctggggctggaggccgggaggctgcaggcggcgttcggcggggagggcggcgagggggcgtgcatgcgcgttaacttctacccgcggtgcccgcagccggagctcacgctcggcgtggcggcgcactccgaccccggcggcatgaccatgctgctggtcgacgaccacgtcaggggcctgcaggtgaggagccccgacgccggcaagtggatcaccgtcgaccccgtccccgatgccttcatcttcaacataggcgaccagatccaggtgctgagcaacgcggcgtacaagagcgtggagcaccgggtggcggtgagcgcggcggaggagcggctgtcgatggccttcttctacaacccgcggagcgacctgccgatcgcgccgatgccggagctggtggcgcccggccgcccggcgctgtacccggagatgacgttcgacgagtaccgcgtcttcatccggcagcggggcctggccggcaaggcgcagctccagtcgctgcaggcaaaggccaccgccgctcctgccgacgacccagctgccggcggctcgccgtcctctagctagcacacacagctgtaacctagcagctaccgagctaccttactatatatcatctgcccgcaggtcaggtttcagctacctgtgctgtgcatatatattggatcgatctcggtgaacaataaaaaaaaaaaaaaaaaaaaa

SEQ ID NO: 7364 - protein, 380 aa, Panicum virgatum
  misc_feature: Ceres CLONE 1908508
  misc_feature (2)..(101): Pfam Name: 2OG-FeII_Oxy Pfam Description: 2OG-Fe(II) oxygenase superfamily
MTSCFNGGAGWPEPVVRVQAVSDTCGATIPERYVKPLSERPSLSPAAAGGAGGGPNIPVVDLSMPDADATSEAVAAACREWGFFQAVNHGVRPELLRSARAAWRGFFRQPAEVRERYANSPATYEGYGSRLGTAKGGPLDWGDYYFLHLLPPSLKSHDKWPSLPASLREATEEYGEEVVQLCRRVMRLLSTGLGLEAGRLQAAFGGEGGEGACMRVNFYPRCPQPELTLGVAAHSDPGGMTMLLVDDHVRGLQVRSPDAGKWITVDPVPDAFIFNIGDQIQVLSNAAYKSVEHRVAVSAAEERLSMAFFYNPRSDLPIAPMPELVAPGRPALYPEMTFDEYRVFIRQRGLAGKAQLQSLQAKATAAPADDPAAGGSPSSS

SEQ ID NO: 7365 - DNA, 1678 bp, Panicum virgatum
  misc_feature: Ceres CLONE 1908525
  misc_feature: Encodes the peptide sequence at SEQ ID NO. 7366
gtcactctctcccaactcacttcagtcacacgctcccgcccgtccgcctcttccccgaagtccccccggccccaccgacgcctgcctgcggggtccagccgccggcggcggccgcgctcctccgtcctccctccgcgacgcttgcgacccgtccgtcctgcgcccagcggtccctcgtggcagcagcggggagcgagccggcggcgcccggggtcctctttgctctcgccggctgctggcagcccgccccctcgtcgtctagactggccgtgatgctcctggcgcgcaccctgcgctcccgcctccgcccgccgctctccgtggcggcggcgttctcctcggcgccggcatcggcggccgcggcggaggcggagcgagcgatacgggacgggccccggaacgattggagcaggcctgcgatccaggccgtctacgactccccgctcctcgacctcctcttccacggggctcaggtccacagaaatgtgcacaaatttagagaagtgcagcaatgcacacttctttcaataaagactggtgggtgcagtgaagattgttcttactgccctcagtcatcaagatatgatactggattgaaggcccagaaattgatgaacaaagatgctgtcctagaagcagcaaaaaaggcaaaagaggctgggagcacccgtttttgcatgggagctgcatggagagaaaccatcggaaggaaaacaaatttcaatcagattcttgaatatgtcaaggaaataaggggtatgggcatggaggtctgttgcacgctgggcatgatagagaaacaacaggctgaagaactgaagaaggctggacttacagcatacaatcataaccttgatacatcaagagagtattaccccaatattattaccacaagatcatatgatgatagactgcagactctccagcatgttcgtgaagctggaataagcatctgttcaggtggaataattggtctcggagaagcagaggacgaccgtgtggggttgttgcatacactagccaccttgcctacacacccagaaagtgttcctattaatgcattggttgctgtaaaaggcacacctcttgaggatcagaagcctgtagagatctgggaaatgatccgcatgattgccactgctcggatcgtgatgccaaaggcaatggtgaggctttcggcaggccgcgtacggttctccatgccagaacaagcgctctgcttccttgctggggccaactctatatttgccggtgagaaacttctgactaccgcgaacaatgacttcaatgcagaccaggcaatgttcaagatactaggtcttatccccaaggccccaagctttggtgacgaagaggcggtagctcctgctgaggccgagaggcctgaacaagctgcttcaatgtagagcattgtattggagaaaccactattttttagtcgcttgagattgattaaaataaagtaggcccacggcatgcttctactgttgtcttttttatccatgtaagtagatgttggaatgtggtagctcatgtacttagcaagttgagccaatcagctctctgaatcggtctagtttcatgtagcaccagagtttctcggatcttctctttttaagggtcggttaaatgaatgaaaggaaggctacctgttactcaaaaaaaaaaaaaaaaaaaa

SEQ ID NO: 7366 - protein, 377 aa, Panicum virgatum
  misc_feature: Ceres CLONE 1908525
  misc_feature (1)..(376): SWISSPROT Homolog: EC 2.8.1.6 Biotin synthase
MLLARTLRSRLRPPLSVAAAFSSAPASAAAAEAERAIRDGPRNDWSRPAIQAVYDSPLLDLLFHGAQVHRNVHKFREVQQCTLLSIKTGGCSEDCSYCPQSSRYDTGLKAQKLMNKDAVLEAAKKAKEAGSTRFCMGAAWRETIGRKTNFNQILEYVKEIRGMGMEVCCTLGMIEKQQAEELKKAGLTAYNHNLDTSREYYPNIITTRSYDDRLQTLQHVREAGISICSGGIIGLGEAEDDRVGLLHTLATLPTHPESVPINALVAVKGTPLEDQKPVEIWEMIRMIATARIVMPKAMVRLSAGRVRFSMPEQALCFLAGANSIFAGEKLLTTANNDFNADQAMFKILGLIPKAPSFGDEEAVAPAEAERPEQAASM

SEQ ID NO: 7367 - DNA, 1391 bp, Panicum virgatum
  misc_feature: Ceres CLONE 1908540
  misc_feature: Encodes the peptide sequence at SEQ ID NO. 7368
atcgtccaaacaaattccgagcatctccgcccaccgatcccgtcgtcctattcgctcccccaccatcccccgcctcgccacggcctctcgcggtctcgaggagaggactcgctccggcaaacccaatggccgccgacgccgtccccaacggccacgccgccgccgacgcgcccccttcctcctcgtcgtcgctggtgttcctgggcacggggtgctcgagcgccgtcccgaacgcgcggtgcctgatccagccccccgacccgccctgccccgtctgctcccagtccctctccgtcccgcccgagctaaaccccaactacaggtgcaatacttctcttttgattgactattgccgagatgaaggtgcacataagtatattataattgatgttgggaagacattcagagaacaagttcttcgatggtttgtttgccacaaaatcccttgtgttgattctattcttctgactcatgagcatgcagatgcaatcttaggccttgatgatattcgggttgtacaggcatttagtcccacaaacgatattgatccaacccctatttatctctctcagtttgctatggacagcatctccctaaagttcccttatttggtcaaaaagaaactaaaggaaggggaggaggtcaggcgagttgctcaactggactggagaataatcgagagtgatcttcagaaaccatttaccacttcagggctagagtttgtcccccttccggtgatccatggtgaagactacatttgtttgggtttccttttcggcagaaagtcaaaagttgcatacatatcagatgtttcacggtttccgccaagcacagaatatgcaatttcaaagtctggtgggggccaactggatttactcatcttggattgcctatacaggacgggttctcacaacgtgcatctttgttgggaccagactctggatgctgttaagaggatttgccccaaaagagcattgctcattgggatgactcatgagatggaccatgacaaggacaaccaaacattggaagaatggtccaggagggaggggatatatgtgcagttagctcgtgatggcctgcgtgtctacattgatctgtaaccgtgaaaggaccatgacatgctcagtgaactgtactaggtttcctgccgctcttaacattcccctcttgtgaagaaagaaagcacgaactgacttggcgcaccaatcttcgtgtgaaaccaggagatattctatttttacatttcatagtctacacgtgattcgaaataaaagtaagtaatatagtagttgaatggttcctgtcaattggaagctacactgcagcagaggcataatgccaaccggcagcaacaggtattgtctttggaaaaaaaaaaaaaaaaaaaa

SEQ ID NO: 7368 - protein, 325 aa, Panicum virgatum
  misc_feature: Ceres CLONE 1908540
  misc_feature (1)..(46): Pfam Name: Lactamase_B Pfam Description: Metallo-beta-lactamase superfamily
MAADAVPNGHAAADAPPSSSSSLVFLGTGCSSAVPNARCLIQPPDPPCPVCSQSLSVPPELNPNYRCNTSLLIDYCRDEGAHKYIIIDVGKTFREQVLRWFVCHKIPCVDSILLTHEHADAILGLDDIRVVQAFSPTNDIDPTPIYLSQFAMDSISLKFPYLVKKKLKEGEEVRRVAQLDWRIIESDLQKPFTTSGLEFVPLPVIHGEDYICLGFLFGRKSKVAYISDVSRFPPSTEYAISKSGGGQLDLLILDCLYRTGSHNVHLCWDQTLDAVKRICPKRALLIGMTHEMDHDKDNQTLEEWSRREGIYVQLARDGLRVYIDL

SEQ ID NO: 7369 - DNA, 1142 bp, Panicum virgatum
  misc_feature: Ceres CLONE 1908582
  misc_feature: Encodes the peptide sequence at SEQ ID NO. 7370
tgttgcttggcagtgctcgacgaatagctctgctcgatcagaaccgcacgagcttcctatcggactgccaagtcgctccatgtgcctcgcgagatccacacgatgacactcgaccccgcttggatcgtcgcagaccaggacagcgagttccgtcaaatccacagctaagccaagccagcgagcagcagggtctgcaaggaaggggaaggaggcggcggcacgcaactttgagccaaatccatcgctcctgacctgacctctcgccgatccaagaagcggggggagtccgagagaagcgagaaggcccgcgagcgagagctcgatctccatggcgaccggcaacctggccagcgtggtggtgtcggtggacggcagcgaggagagcatgaacgcgctgcggtgggcgctcgacaacctccgcctccgcccccgccccgacggcgagttcgtcgtgctccacgtccagccgccgcccaacatcgccgccgggctcaacccggcgcccatccccttcggtggacccagtgggttggaggtgccggcgttcacgcaggccatcgaggcgcaccaacggcggatcacacaggccatcctggagcacgccctcaagatttgctccgagaaacatgtggaggtgaagacggaggtgatcgtgggtgatcccaaggagaagatctgcgaggtgacggccaaccgcaatgccgatctgctcgtcatggggtgccgtgccattgggccgctcaagaggatgttcttgggcagtgtgagcaattactgcatcaaccatgtgggttgccctgttgttgtgatcaaggggacttgaggccttgagctaccctcgatcgacattctttggtgcatttcaattcaagtgttttctggttgctattgtgcccttttaatcctgtacagaccatgcatcatatttgtcagtttggtgctgagggatgagggttgctatgtggtctccgtttgtaaagaaaaatgtgttttgcttctgtaatcgtggaaataagcctgccatgtgacacattgttctgtatattcttgtatttgtcggggatatacattgtgctgcctgaactctgaacatctcaaaattgccagaatcccggtttttgtaaaaaaaaaaaaaaaaaaaa

SEQ ID NO: 7370 - protein, 164 aa, Panicum virgatum
  misc_feature: Ceres CLONE 1908582
  misc_feature (1)..(154): Pfam Name: Usp Pfam Description: Universal stress protein family
MATGNLASVVVSVDGSEESMNALRWALDNLRLRPRPDGEFVVLHVQPPPNIAAGLNPAPIPFGGPSGLEVPAFTQAIEAHQRRITQAILEHALKICSEKHVEVKTEVIVGDPKEKICEVTANRNADLLVMGCRAIGPLKRMFLGSVSNYCINHVGCPVVVIKGT

SEQ ID NO: 7371 - DNA, 1480 bp, Panicum virgatum
  misc_feature: Ceres CLONE 1908747
  misc_feature: Encodes the peptide sequence at SEQ ID NO. 7372
atttcctccacgccaagcaactcccgcccgcccgtctccttcctcggttcctcctcccgagacgagacgacgaatcgcccgcccagatccccagctcccggtcgatccacaccccctccccggcctcaatccaagcagaattcgtggggggaagcagttggtctccctctccgggactacgactctgcaattctggatttgtgaaggaaccttatgagctgcttggctggggctctactccaattctggtgctactaagatgggtcaggacccgatcagcaacaagtttgggacaagactaaccatagatgaagtagcaggcgcctaccacttatcgcttctgctctcccctgttgtttccttctgggattgcatcttccgcaagataagatactcattcagacctgagtgggtgtagaatcttgcgttgaccctcctttttagcagtagctggtttgcaaataaatagaccacctagcaaggagtccaaaagtatgaactttgaagattttgtctttccctaattttacatagatagtagaggagtttagctgagatagtaaatagccggcacagttgttatggacaagactatcatgagcaaccaggcaggcaaagtcttgaagaaaggaaaaaagaaacaggccaaggatgaactggatcgccagaagcaggctgagaagaagagacgccggctagagaaagcgctggcaaactcggctgccattatttcagagctggaaaagaagaagcagaagaggaaagaagaacgtcaaaggctggatgaggaaggtgctgcgatagctgaagcagtcgctcttcatgttctcataggtgaagactccgatgaaccctgccacttgatgctaaacaagcacagaaggtgcagccattgggatccctcggctggctttgaattcaccgtggatccacagaccactgatatttattcttcagatggactgatttgcaccagccatgcatatgcccccaaagggaggtgggctgattgggggattggtcagccattgccatcttggggagaagtgagggacctccaagtccaaggcccctactatcaaggaacattccatcagtcagtcaactgccctggtttcatagcagcccaagcagtgtcgtcattgcagatcagagaagactcgtcagaaatcgcatctccaagccaaggagcggcagctgcaactgtggttaacaggatgcttggtggcgccaacaggctcaacctttacagagaaatataaaaatacattttgtcatagcattgtatatagtcaccaaaaaatgtgttgactatgttgcctgcgatatatggttttcttgtttcaaaacaaatggatcaaacatcttgtttgctgttttgtgagtgtactaaacttgtaaagggtatgttgtatcagttaacattggtattgtaatgaacatatatggttttgatttcgaaaaaaaaaaaaaaaaaaaa

SEQ ID NO: 7372 - protein, 226 aa, Panicum virgatum
  misc_feature: Ceres CLONE 1908747
  misc_feature: The sequence is a functional homolog of  SEQ ID NO 919 in the  10/666,642 US patent application
  misc_feature: Useful for making plants with modulated growth and phenotype characteristics
MDKTIMSNQAGKVLKKGKKKQAKDELDRQKQAEKKRRRLEKALANSAAIISELEKKKQKRKEERQRLDEEGAAIAEAVALHVLIGEDSDEPCHLMLNKHRRCSHWDPSAGFEFTVDPQTTDIYSSDGLICTSHAYAPKGRWADWGIGQPLPSWGEVRDLQVQGPYYQGTFHQSVNCPGFIAAQAVSSLQIREDSSEIASPSQGAAAATVVNRMLGGANRLNLYREI

SEQ ID NO: 7373 - DNA, 1738 bp, Panicum virgatum
  misc_feature: Ceres CLONE 1908806
  misc_feature: Encodes the peptide sequence at SEQ ID NO. 7374
  misc_feature (1437)..(1437): n is a, c, t, g, unknown, or other
  misc_feature (1455)..(1455): n is a, c, t, g, unknown, or other
  misc_feature (1463)..(1463): n is a, c, t, g, unknown, or other
actacctcccgcccctcaactcatcacttccgctcgctctcccttcctctcagcagcttctctcccccatctcctgccatctgaacatcccaccgttcggttgccgtgaagcagccatgccagcgcttctcgtgaacaccatatcggtctcccccgctagcccatggctaccctcctcgcggcccaccacgacacggcgagctagcagtcgccacaggtgccgagccgaagcatccggcagcggcggcggcagcaccaaaggcgacggctacaagccggggggcgtccgcgggtcgtgggtctccgactacgacctctacgagctgctaggcgtggagcgctcctcgccgcagtcggagatcaaggcggcgtaccggtcgctgcagaagcggtgccacccggacgtggccggcgccgccgagggccacgacatggccatcgtcctcaacgaggtgtacgcgctgctctccgacccggccgcgcgcctcgcctacgaccaggagcaggcgcgccgctccgagttcgccggctacacgggccgcccgctctactcgtcctggctcggcgccgaggccgagcgccgggcggtcttcgtcgacgaggtgcgctgcgtcggctgcctcaagtgcgcgctccacgcctccaggacgttcgccgtcgaatccgtctatggccgcgcccgcgtcgtcgcgcagtgggccgacgacgaggacaagatcatcgacgccatcagcacgtgccccgtcgactgcatctcgatggttgagaggtcggacctggcggctctcgagttcctcatgtccaagcagccgcgcggcagagtccgtgtctccgaaggcaacgccgtgggagctcgcgcgccaaacatcttcaacgaggtcgccaagttccagaaaagattcgaggagatgaagcagaaatctgcaacaagagaatcccaggagtcagagacagtcaagaaatccaggacttcagccgtgcacaccatcagatccatgtcaaactggtggtactggcgcccattcgggtcgtcggcgcccggccaccatcgtcctcgcttcgcgcctcctgccgccgccgtcggcggcatcaccttctaaagccgctgaccccgtggcggacagactccgagaagctgtcgccgcccggcgcaaaacggaaggcgcggcgaccgymagccgcggcgcacgccccaccgcgacgactactggaccccgcrrctgaacctgccatcktctgcttctccaccgagcrmttcaccagtaggggaagaggacgctcccgcaaggcacacagtccgcaggcagacgatgttgctgcgcgttgaaagcgaccgccggggccagcgagagaaggggtgcaagcatcagacctgacgcgcaccgcgtgttgactggggattcttctcggcggggcttgtgtgggttacaacggggnaggagatggccggaagcngggagcgngcggcattcagggagcactttggtaggcgccattgcgtcttggaatcgtgaacagctctcgaaatgaagggtcatgttggccgcgggtgacctggttcatcatcgcgcgctgccattgccggtgtgatccgggtgcttggaagaagagaaagaggaaatttgaaagtaaaatgaacgtgcttgaaactaattcatcataaatgcgttctcactgtctcgcaaatgatcaaccatatgtagtcataacatagctctcacacggttaccctgcttgt

SEQ ID NO: 7374 - protein, 327 aa, Panicum virgatum
  misc_feature: Ceres CLONE 1908806
  misc_feature (1)..(61): Pfam Name: DnaJ Pfam Description: DnaJ domain
MPALLVNTISVSPASPWLPSSRPTTTRRASSRHRCRAEASGSGGGSTKGDGYKPGGVRGSWVSDYDLYELLGVERSSPQSEIKAAYRSLQKRCHPDVAGAAEGHDMAIVLNEVYALLSDPAARLAYDQEQARRSEFAGYTGRPLYSSWLGAEAERRAVFVDEVRCVGCLKCALHASRTFAVESVYGRARVVAQWADDEDKIIDAISTCPVDCISMVERSDLAALEFLMSKQPRGRVRVSEGNAVGARAPNIFNEVAKFQKRFEEMKQKSATRESQESETVKKSRTSAVHTIRSMSNWWYWRPFGSSAPGHHRPRFAPPAAAVGGITF

SEQ ID NO: 7375 - DNA, 1584 bp, Panicum virgatum
  misc_feature: Ceres CLONE 1908897
  misc_feature: Encodes the peptide sequence at SEQ ID NO. 7376
ccatcagaccatcacacaccacacacacacacaaccgccgccgcagctgcaggcgcgcctgccactctccgacaagaccccgagaagtatacttgccagcccaggccaccctccccgccgcaacaatgctgaccgccgccgccgcctccgtcaagcccaccgcggccctggccgccaccgcaaagccggcattcaagcccctccacctccctcccctgccccccgccggcaccaggcccctcaccctctccgtctccgcgcggccgctgtaccgccaggagcatgtcctcgcgaccgtggcggtggcggtggccggccgcggcgaccgcgcctcgtcccccgcgccgccggccgccaccgcggacggcgcccggccggtggagatctccgcgccggcggagcccgccgagaccgcgcgccgcgccaggatcggtgtctacttcgccacgtggtgggcgctcaacgttatcttcaacatctacaacaagaaggtgctcaacgcgttcccgtacccgtggctcacgtcgacgctctccctcgccgccggctccgccatcatgctcgcgtcctgggccaccaggatcgccgaggcgccgcagacggacctcgatttctggaaggcgctctccccggtggccatcgcgcacactatcggttacgtcgcggcgacggtgagcatggccaaggtggccgtgtcgttcacgcacatcatcaagagcggtgagccggcgttcagtgtgctcgtctccaggttcttcctcggcgagaacttcccagcgccggtctacttctccctcctcccgatcatcggtggatgcgccctcgccgccgtcaccgagctcaatttcaacatggttggattcatgggggcgatgatctccaacctcgcattcgtcttccggaacatcttttcgaagaaggggatgaagggcaagtcggtcagcgggatgaactactacgcctgcctctccatgatgtccctggtgatcctcctccccttcgccattgccatggaggggcccaaggtgtgggcagcaggctggcagaaagcagtcgccgagatcggtcccaacttcgtctggtgggtggcggcgcagagcgtgttctaccacctgtacaaccaagtatcctacatgtcgttggatgagatctcgccgctaacattcagcgtcggcaacaccatgaagaggatttctgtcattgtcgcgtccatcataatcttccaaacgcccgttcaacccatcaacgcgctcggagccgccattgccattcttggaaccttcatctactctcaggcaaagcagtaatgccttggaatcaagatggtcccaattcaccgcgtatcgactcggtgctcgaacataacagcctatgactcatgagcgtatctaagaacgccttgtataatataattagatcctctcttttttttgtattttcttttatatataggactagctaccagtgttcctgagctgctcatttcttcgccttttcaccatgactatgatgatatagagggacatggaaccatctgaataagactatcagattttttttttctaaaaaaaaaaaaaaaaaaaa

SEQ ID NO: 7376 - protein, 393 aa, Panicum virgatum
  misc_feature: Ceres CLONE 1908897
  misc_feature (1)..(146): Pfam Name: TPT Pfam Description: Triose-phosphate Transporter family
MLTAAAASVKPTAALAATAKPAFKPLHLPPLPPAGTRPLTLSVSARPLYRQEHVLATVAVAVAGRGDRASSPAPPAATADGARPVEISAPAEPAETARRARIGVYFATWWALNVIFNIYNKKVLNAFPYPWLTSTLSLAAGSAIMLASWATRIAEAPQTDLDFWKALSPVAIAHTIGYVAATVSMAKVAVSFTHIIKSGEPAFSVLVSRFFLGENFPAPVYFSLLPIIGGCALAAVTELNFNMVGFMGAMISNLAFVFRNIFSKKGMKGKSVSGMNYYACLSMMSLVILLPFAIAMEGPKVWAAGWQKAVAEIGPNFVWWVAAQSVFYHLYNQVSYMSLDEISPLTFSVGNTMKRISVIVASIIIFQTPVQPINALGAAIAILGTFIYSQAKQ

SEQ ID NO: 7377 - DNA, 1930 bp, Panicum virgatum
  misc_feature: Ceres CLONE 1908932
  misc_feature: Encodes the peptide sequence at SEQ ID NO. 7378
gcgtttcccaatcaactactccatcacatcgccacagcaccgcgcctgccaaaccctgctgcggccattgtcgcgcgctcgagcgagctcactgcatcagccatgtccaaggccttcgccaagtcctgctcccagatcaacaaggccctcatcaggaggctcaacgccctcgtcatccgcgcgcagcccccgccggcgaggccggacgggcgcgttgtgccgacgacgctggacgcgctcccggcggggcgcggcggcggcgtcgccgtgtgcaaggtcgagggcggcctgctcaggtcctcctccaccttcccctacttcatgctcgtggcgctggaggctggcggcctcctcaggggcctcctcctgctgctgctctacccggccctgcgcctgctcggccacggccgcgcgatcaaggccatggccgtcgtgagcttcctcgggctgaaaagggacgcgttcctggcgggcagggcggcgctgcccaggctgctcctggaggacgtgagcgccgaggtgttcgacgcggcggtggcgtcccgccggcgcgccgtgtgcgtgagcgccatgccgcgggcgatggtggagccgttcctgagagagtacctcggcgtcgacgccgtcgtggcgccggagatgagggagttgagggggcgctacctgggcgtcacgcaggatgaaagcgaggtgctgcgagggctggacgtggagaaggtgatcgccagggcggagaagggcggtgacgacgtcgttggcgttggtggactcgggtcctcctttgtccacctcttccaaaaccattgcaaggaggtatacgtgccggccgagtcggcgcggcggcgatggcacgcgctcccgcggcggcgctacccgaagccgctcatcttccacgacggccgcatcgcgttccgaccgacggccgccgcgacgctcgccatgttcatgtggctgccgcttggcgcggccctcgccgtcgcccgcatcgcctccttcctcatcctcccgttctccctctccgtgcctctcctcgcggccctcggcatgcacacccgcgtcatcgccaactcctcctcggcggccaccaacctcttcgcctgcaaccaccgctccctgctcaaccccctctacgtggccgcggtcgccgggcgcgccgacctcgccgcggccacgtacagcatcagccgcctctcggagatcctgtcgccgatccccaccttccgcctcacccgcgaccgcgcggcggaccgcgccgccatgcaggcgaagctttccggcggcggcgggctggtggtctgccccgagggcaccacctgccgcgagcccttcctgctgcggttcagcccgctgttcgccgagctcggctgcggcgtggcgcccgtggcgctgcactcgtcggtgggcatgttccacggcacgacggcggggggctggaaggcgctggacccgctgttcctgctcatgaaccccgtgccggcctacatcatgcagttcttggacaccatcgagatcgagtgcgacggcggcggcgggggtccggaggcgccgtgcgccgcggcgaacgaggtgcagcggcggatcgcggaggcgctggggtacacgtgcacggggctgacgaggagggacaagtacctcatgctcgccggcaacgaaggcctcgtcgacgtcgaccacggcgccaagaagaaaactaccgcttctactacccagaactagtagtgtgcttaaattaaaggcttcaacgaaggataagaaataaataacaacaaaagaggtcatctaaaccttcgttttgtgttgttctgtgttactctccttttcttttgaggagattgatgtgttgtgtatatactcaaggtagcgtgcaaaaatcgtgtgcgtgtaaaatttaacagataaactttagattaacaaagatgtcagttggatc
